United States Patent 11,242,544 (MICROBIOMES AND METHODS FOR PRODUCING MEDIUM-CHAIN FATTY ACIDS FROM ORGANIC SUBSTRATES) - sequence listing, part 12

SEQ ID NO: 707 - DNA, 479048 bp, Unknown
  Metagenome-assembled genome
agtcactgtggattcaaatcaccaaagcaacttgaagatgagtatcaaactcaaattcaaaatttagtcgtggcataggacaaaaaagtctctatttaaattgtctattttattgacaggggaccactgcgcttcgatttcccaagcattaatatatgaaaaagttcatatttgtgtcgatttttctgaaggccctctctataccgattatatctttgatttattgcaaacttacaataccgggaatttagtacttacacggcatttatctgctcaaacggacatttatttatcagatttttacacttcgtctgtaaaacagcaacagttggtttggcggaatccccctcagacacaggattgggtactacttgagaatttggttaataacgttaggaaaaagaaaatagacggcgcaatcattgatcatgcacaaactggtattcattaaaattaatcagcaacgtttgccaaactcgactttttccggtaaaaatgaactcaaacaccccataatctggagaaatttcagattatggggtgcttttggcaataaagagtcttacaactatctgttctcggtgttatatagaaaaattataacttcgtttttaaataaagttcttcagcttgacgccttgcggcaattgcatgttccttgtgaacatacatccgattaagcacatacctgccatgaaaatatagtctggctacccaacgttgctgacattgatcaaaactcacccccgtgacgccgcttttattactcgaacgcaaatcatgagaagttgggtgccacgtcttttttaagacgctcgcattgccgatatacacttttgtttgcggattgttttgaattgattgctttgacttttccttccgcaaacatccacaactttcagattgtccagatcgcaagttatatccatcaacaaccttactgttcccacaatcgcaccgacacaaccatctcatattaccattttttgctctgcctgcctgcttaataacggtcaaacgaccatatcgctttcctgtaagatctatcgctttactcatcgatcccacctccaaaaataagacatgtcattagcatccaacacctttccccaaagattttaagttgaactcctgtctacactgttaattatttattattccggagaatagtactaggtagttaaagtcgaaattttccccgtttttttgcgtttttctaagaaattcggattgatcctgtaataaaaaaaagcgttgcactcaacatctgtcgtgcaacgcttccccttatattatatgattttcacatgatcaaaggtcatcaactaccgcattatttctgtactacaggatccacgaaattatcgttggttttagatacgtttggtcgccacttgtcgccaacttgttcccattcaaaattagattgaagctttacttgctgatcctttttttgaacttctaccacaataatcagttgatggtcaaattgtgtacgactaacgtatttttcacccgtgttttcgataacctgttgatccttctcagtaaacccacctaagtcaattaaattaagatccattgttagttctcctcctgtttcagtaataatttaatagcatttagcatgtcgcgttcactcgataacaatttggcaattatttcacgattctcagccttgttttcatttaagaaaagtaacgccttagaattattaacgatcgcctgttgcaagaagtaagttgatctcgactgcgtgttccccgattcagccactcgctcgatgtattcaatcgcagcatttcctaaatcatttttgtccagtgcaattttggtaccatttcgaatcacaatgtcagaaacattaatatcgcccctcagttcatgcacctcatcatctgtcaaacacaacagcaaggtttgctttgtcggcgtttctggaacaaaattctctgtatgaaccaccgcgtcaccgataccgatctcatccattggataatactttttatttgaaacgtcaggtaaggttatcggcctcactcgattgggctgttcactatttaataattcaatttcttcgccaatgacatcgtctgtcccttgataaattcgcaccgaaccgatgcgatcatacgtcagttcaagcgaaacggatgattctcccatgatacgattcacgggttcaggattactgactaaaagatacccttctatgacaggtgtttcgaccctatatgattctcccgtagcgcgaaatatcttttgtggatccatcagttcaacacctgcaacagtctggaaatgaaattcaatagatttttgatttcttcgaaaacttgaccggatatcaggcattttatatctcctaaaatttaacctaagaataatcaacattcattaatttaagtaaatcctatcacgtttattttacccaaataatgtagcaatatctatttatacatacaaataaacgtccttatttttttgattattttaaaaaggttagaacggtttttgaaattcaaaaattattttgattacgtttccctacttagccacttatcttgagattgtttattaatggttttatcatcagtgtggcttcattcaggggatatttaatctatttctatatatcaaatctgcgttcatgagcaagaataatattgctatctagattgataatcttatttttaactcgttgcagttagctctaaatgagtttcaatcatcaggttatttttaatccacctttgtactttttgcactaagtactgaagattttggctgacgcttaaccatgggagccaataatactgatcatccgatggctgatcagcttcgtcaacaattctaaaggtcggcgtcatcacttccgttgcgactggtaaactgtctagtcgccagtcaaacgacataaactgagtcattagtcgctgctgcaggataccaacgacataatcgctgaacgacgctggataaccaacatcgatttgtcgtcgtggtaaaaagcggtttaactcatcgcttaacactgaaactaacaagtctttttcgggtgccaattcgggaacatcttttgcaaagtcagtaataatttttcttaattttggcaacacctcgccagacgtttcctggtctaaaaacatcaccggctgatggactagcagtgcaaattgaacgctttccattagaaactcgtcaagctgctcaaagtaaagcggtgaccgatacaccttcaagcgtgtgataacggttttgacaattaactgaattaaatatggcaatcccgctcgttctcggggttttactagcttggtctgattcgtatccacgaagtacggactatacttcaccatatactgtaaccaataaacttcaacaagattaaatttaattttattagctttctcaggaagattcatgccatttagcagcccactcttttcaaccatggggaaattactgttctttcgactcacataattgtcttgcgcaagtcgaatcgccgtcacttttaaatactcacacaatgactcggttttattctgattttctggcaaaagcttttttaaagagtcgaaatacggaatttcttccttttccagttcaattcgactaccacctaatttaaataaccgccattcaaatattcgaatgaggcgttcatcccccgtaatttcatttgtttgccgattataatcgagctgataccgattaagccatttaacgattggctcaaggcgactagcaaccgtttgccgccgtacattaagcacagtttttggctgcttccgaatggcagaagtcagacattgatatccaactgaatgtctgattaagtactgagtaagctgcgagtaaacccaatcacactgtttcaggagttctcccttgctcagctttttacccgaaattgtctggtaattagcaaccactcgacgataaacctgctgtgttgaaacatatggccaatctaatagctttgaaagctctgtaaactcaattcgttgctgtgttcgaatggcagacaacagctttaattgccgctgttctgctgctgttaataataaatcgacaaacatgagcgcttcacctcttttgtactgtagatttcacttcatatgtattggccgggaatgggggttctcggccattcgatcgagggggataggttccaagatcgagagtgcgctaactactcgaaagcgcacggaatattgtttttaaaatgcgactggaaatcaggcaatttccagccgcccgactgaaagtttatccgaggaggattgtttgctcccagacgacgtgcgctaattacccgaaagtgcacggtgacgggtgttgcttgcgattgaactaggcaatttccaatcgcccaatcttagataaatctgagggggatgacttacctaggattggcgtgcgctaactactcgaaagcgcacggtacttttgattcaaataccggttgtgatatgacgcttattcgtgccgtctcttccggtttttgccagccaatccgaacaagcccagtagcgcaataccgatttcagtgattaatgaagcatccgactgttcaccggtttgcggcaagctggtcttagcactgccctcaagcgctggctgcttagcttgattagtagtcgatgacttcactggcaccgtcttagtggtagcagtcgtcttagcgacaacttgctgagtgcctgatacggtttcactggtcaaagcagaagggttattcgttgcttcagaagtaccgccagcatctgtgtgcttaacggtttcaccagatactgcgtggccaccattagtcgctatactttctggcttaacgttttggttatcaatgttctggttactgctattctgattggtatcaccagtttgactgacatttgaggatgtcggcaccttctcaggattggtttcactaccaggtgtttgcgttgaactcgttcctgttgaagaaccaatcgttgtacctgtctgaccagtggtggtattaccgccactaataggtgtattggcaacgtaagtgatcaacgtatcttgtgacgggtttcctggcaaatcagggaattgatacccttccgtcacatccttagcattgaccggtgttaatggcgtcttggcggtaccactaaccgcgttgtagccattcacgtatggcaccacttcacccgttggtacactgaccttagtcatatcggtgctgtcaacttggtatttgaccgttgtacgtttaccatctggcgtcgtcatgacgatgctgcccaccggtgcatagacgtagttaaccgcttgattatctgtgaatgtaccgctagcattggctggcttagccgtcaggtagtaaccagcgatagacttagccgaagtggtgtaagcatcaccatagttatggttctccgtggtcgtggcatccgctaaagcgttattcttggcatccacgtaattggtggtcagtttaaagttattggctttgatggtcaatcgacccgcgacagctgtgactttgtaatcctcgttggtccctagaataacgttgattggataagcacccactttactgtcagcactcacatccgtcagtttgtagttcaaggccacaccggctgcaggctgtccagtgacgacggcttgcaaattacccgtgtaacccttttgatcataatccttagatacaatcggtgcggtaatcgtcacgggtgctggatcaaccgttacgatcccagttttgacgtccttcgccgctaacgtgtagtttggttgctgttgcaaaatagcttgcaagccttgtgcgttcaacgaaaccgggtaatcacctgcgtctttaccgaccgcggtccagtcaaagtcactggccggcagattgttgatcactgtgccgttggccaaagtaacagataacacttgggttggttgagaggttgtcccgtcgtaggtcttgtgaaccgtgctgatagtggctgaagttgcggctggcgtaatcgtcagctggccacccttggtcacagtgaattgataattactgttggccgttggcgttaccgttaagtcgtataacccaacattttcaccgggtgctcgagtcaccttgtaggcaatcttggcgccattttcaggctgtccggtcaccgtagcttcgaagactggatcattggcaccgaaggccttggtggcatccttagcttgcagcgtcactgttgctggtgtgatggtagccgtaccagctgtcaccttgttaagactgatattcgggttctgctgttgaagcttagcctttccatcagcattcaaggtcacttggtaactgcccacattggcttgaacgttgctccaatcaaagtcagctgcagttaacgttggcaccttcgcatccttggctcccgtaatggtaaccgctggtgtgctggtaaagctcgtcatgccatcatacgtcttcgttacaccggcaacggtaacatccgccatttcaggtgtgatggtgaattgacccggtttgacgttcaccgtgtaattagcgttagtggttggcgttaccgtaatggtatagcttcccacgttctcaccagtttcccggcttactgtatagttcacagcagcaccttttgcaggtttatcactcaccgtcgccgtcaatgctggatcagtatcgccagcgaccttaccagtatccttagccgtcaccgtaacagtggccttattgatagtggcttgacccgccgtaacagccgttgcatctaaagccatatcaggattttcgctgagtaatttttgaattcccgcagcattcagtgtcacgctgtagctacccgcgttagcttgaaccttgctccagtcaaaatcatcgctggttaatccagtagcggtaaagccttgtgtcaaactaacggttggcaccttgttaaaggttaccgtgccgtcgtaagtcttagtaacattgtcaaccgtggccttggcttgaaccgcggtaatcgtgaactgacccgtctgcgtggtaatgatatagttcgggttatccgtatctttagcagtgacgtgaatcgtgtacgtcccgaccgcttcaccagcatcccgactcaccgtatacttagccgcaacaccctgagttggttgattgctaacggtggcagtcaacattggatcagccgtcttagctggtttcgaaccatccttcgcgctaatcgtaattgaagccttattgatcaccgcatgacctgctttaacgtccgtagttgccaacttagtattggcattagcatccgtgactttcttgattccagccgcattcagcgtcactgcgtagctgccagcatctggttgcaccttggaccaatcaaaatcactggtagtcaacgtcggtactgtagcgtttgtcagaccagtcaattgaaccgttggcatagtggtaaaggctgccgtgccatcataggtcttggtggcttccccaactgtggcagttagcgctactggattgatagtggcttgacccgctgtgacatccgtcgccgctaacttagtattggcattggcatccgtgactttcttgatcccggctgcattcaaggtaaccgcataagtcccagctgctggttggactttagaccaatcaaagtcagtagccgtaaagcttggcaaaactgcattagtgaggccgctcaaggtgaccgttggcatagtggtaaaggttgaattaccatcataagtcttcgaaacattgccaaccgtggctttcaacgccgtaatcgtcggtgctgctggcttaatcgttgctttaccggctgtcacatcggcagtggctaaggtcgtattcgggttagcatccgtgactttcttgatcccggctgcgtttaaagtaatcgcgtaagtcccagcagttgcttgtactttggaccaatcgaaatcactggcggtaaagactggcaccgctgcgttagtgagaccacctaaagtaactgtcggtaacgtcgtaaaggtggcgctcccatcaaagtctttggaaacattaccaactgttgctgtcagcgcagtggttgtagtagtcaccggactgatgactgctttaccggctgtcacatctgcagctaccagcgtggtgttcgcgttggcgtccgtaatcttcttgataccggtggcattcagggtaacgtcgtaagtgcccgctgctggttgaacattcgaccaatcaaaatcagtcgccgtaaatgttggtacgactgcattggcaaggccgctcaacgtaactgtcggtgtggaactaaatgtggtagtcccatcagcagtcttcgagacattgccaaccgtggcttttagtgccgtaattgttggcgctgctggtttaatcgttgccgtacccgctgtcacatcgctagtagctaaggttgtattcgcgtttgcatcggtcactttcttgatcccggctgcattcaacgtaatcgcgtaactgcctgctgctggctgaactttggaccaatcaaagtctgtagccgtaaaggttggcattactgcattagtgaaaccactcagcgtaactgttggcacggaactaaacgtggtggtgccatcggcagtcttcgagacattgccaactgtggctttaagcgccgtaattgttggtgctgctggtttaatcgtggcagtacccgctgtcacatcgctagtagccaaggttgtattcgcgtttgcgtccgtgactttcttgatcccggctgcgttcaaggtaacggcgtaagtgcccgccactggttgaaccttcgaccaatcaaagtcgttggtcgtgaacgttggcacgactgcattggtgaggccgctcagcgtaactgatggcacggaactaaacgtaacggtgccatcagcagtctttgagacattgccaaccgctgcctttagtgcagttgcggcggcagtgatggttaaggtaccgttgttgatcttaatctcataatttggattatccgttgctgaagcggttaccttaatggcataggtacccggttcttcacctggatctcgagtatacgtatatttgacttggtcaccatcagccggtcggttactgatgaggatactcaaatctggatctgaatcatgctgctttttagtcgcacttgcaacgtcaatggtaatcggtgctttatcgattttcgcttgaccagccgtgatcgcagtggttgctaaagttgtgttgggattagcatccgtaatcttcttaattccagctgctgtcaaggttactgcgtaagtcccgacatttttgcctacctggctccaatcaaagtcgccagttgttaatgttggtactgttgcgttatcacttaacgtaatcgatgggacatcggtaaacgccgttgtgccatcgtaagttttagtcaccaaaccaatcgttgcggttaacgccttagtgttcggcgttgctgggttgatggtcgccttacctgccgtaacgtcggcagttgctaaagtcgtattagcgttggcatccgtcactttcttgatcccggctgcgtttaaggtaatagcatacgtgccaactgcaggttgtaccttcgaccaatcaaaatcgctgattgcaaaggttggcgtcttgacccctgttaggccactcaattgaaccgatggcactgtggtgaaggttgcgctaccatcggcagtcttggagacatcaccaacggttgcctttagagccgtaatctttggtgcggctgggttgatggttgcttttccggctgtaatgtcggtagctgctaaggtcgtattagcgttggcgtccgtcactttcttgatcccggcggtatttaaggtaatggcatacgtaccggctgccgcttgcaccttcgaccaatcaaaatcactgattgcgaacgttggcgtcttgactcctgttaggccgctcagttgaactgacggcactgtggtgaaggttgcgttaccatcggcagtcttggagacatcaccaacaactgcttttaatgccgtaatctttggtgtggctggagtgatggtagctttacctgctgtaatatcggtagttgctaacgttgtattagcgttggcatccgtgactttcttgataccagctgtattcaaagtaattgagtacgtacctgcagtggcttgtactttcgaccaatcaaaatcagtagtcacaaacgttggcgtcttgactcctgttagcccactcagttgaaccgttggtactgtggtgaaggtcgtgttaccatctgcagtcttagatacattgcccaccgtagcttttaatgccataatctttggtgccgctggagtgatggtagctttaccagctgtaatatcggtcgttgctaaagttgtattagcgttggcatctgtcactttcttgattccaacggcattcaaagtaattgagtacgtaccggcagtggcttgcactttcgaccaatcaaaatcagtaatcacaaattttggcgtcttgacccctgttaggccactcagttgaaccgttggtactgtagtgaaagttgcattaccatctgcagttttagatacattgccaactgttgccttcaatgccgtagttgttggtgtggttggtgcagaaccacttgtccagtgattaatgactagctgaattgtttttttgtcagtcatgctaactaatttgctcgaacctgtagtatatgttgtattaacatatttaaaattgggtacagtcagacttttatctgggttaggaatctcatctccaaccgttccagtgtaataagaatcatctgtcaatccaattggggaactgtaaagatgcttcatttgcccagtagttggatccacaatatgaccaatactgtttaaaacgtaaccagctttgatagtaccgctaagatccgaaacaacaataacattattgttttcatccacgttgactgtaatggcgattgccaaattatgtgaattttgctgctgatcatcatcagtcatagctccgccgccattataattcatgtatgcttggtaagcaccatctaattcggctgtagctagaataatgtccgatgccgtcccagttttatatgccgtctgtaattgagatattaacggggcaaataaattataattcgtcacgacgggaccgtcgtaaattcccgaaaccgttgtagttaacggattacttgtcattgtcaatccggcaaatgtattatttaacatactgacagcagtttgtttggcagtcagtaactgtgcttgagttgaatagcctgacaaaccataatccaaagctgtcggatcaaccacataccgaaaatcaccaatcaagccactctgctgcaactggttaacaaccgattgataatcattaacatttggtgctgaaacaatcaaatcaccataagcatctaacttggcactggtaccagatggtaataccacctgtttcattgcgctttgagctgtttcaatgagttcagaatcgtaaccagctttatccgcagccatcatctgtttagccacatctaattcctgacgcatatttatcagaatcttattggcttgtgtcaggcctaatgcttcagtggtcagatcttttggtagcgtttccgattgtgccgtcagtgcaacgttgatctggttgacttcttgagccatgtgttcttgcaatgcactgtaagcggtgttgttcacgtcatgatcttgattattagctgctgcttgtgtagtcgcttcatcagccaccttttgcaagtcacttaatacgctctgagcagattgttgaatattagttttctcagcatcatatggcgcttcggctactttttccgcttcttgtgtcgcattttgactaacatcagcttgatttactttttcgtttttagcattaagcttttgatttgctgcaaacgcttgattatcagtgacttgtttagtcggtgtcgcgttctgatttccgctaacatcgctcaccggttgtccagtctgcgctgcgctttcttggttatcagctactggagtcgtattgtttgttgttgtgcttacagcaggctgattatgagttgtagtattactcgattggttagcggtagtttcagtcaatggatttacagtttgcgacatcgtattagccgccgtatcttgaccaccaagtaacggattaattggtgttgccacagtagtcgctactggtgaggtcgctgtctttgcagtaacactacctactgttgttgcatttgtatccgttaaagaacttaattcactggtggaatcgtcagtcactgtatcagcgtgtgctgttgttgtgagtgaattgacgatttgtgggaccccattaactcccatttcgtgaacgccgaacagaatagccacactagaaattccccgaacaacccattttgttttcactttgtacagcttataccgggtcacattcggttcagctttttcaatttgatcgtatcggtaacgtttcattttatacttcaccctctatttccctaaattgtcacgccgcaccggagttcccggtattctgacgcccctacaatgctgcatgttactcatatgtgtgctttacgtctaaagcggagaaaccctgtaaatgcttatgtatgaaacaagcagaccgaagtctgcttgttcccgaactcggttaaatcggaattcgatttgctcattcgcctaaaacctaatcacttagtctttgtctgaagaagcatccttatcttgacgacgtttctttagcgctccagctaagcccaaagtaccaatcattccaagaagacctagaaggccatcggcactttgattttcattagtttgaggcagggtggttgctgacttgttgccagtagcattgtttccttgagcttttgatgcaccctttgttacttcacctgtggttccggctgcttgatcataactgatcgaactaccgttaccaccgttgttgtctgaaccaggaacacgttgcgacgtctttggcgtatttggcgtcttcggcgttgcagaaccaccttctggagtagcaggtgtcgttggttcagttggcggattaccacccggcgtagcagtaccagtttctggtgtgcttggcgtcgttggtgtggtaggcgtcgttggttcagttggtgggttaccacccggcgtattggttgtaccaccacctggtgtgtttggtacgtaagtgatcggcgtgttagtgccaggatcattaggtacttctggtggcaagtaacccttagttacattgtttggatcaaatggcttcagtggatcgccgtttggaccaactggtgtgtaacctgggatgtttggtacgatacccgtctttggcgtcacaactttatgtggatcttgtggatcgtttggataggtaatatccgtattattgccaccatctggaggcgtaatctgatattgaccgatcttgttgtaaacgtaggtaacggtaatatcatcgtgaccaaccttaccagttgcattagccggttcggcagtcaggtagtaaccggtgataacctttgcattggtctggtaagaatcgccaaacttcaagtcaccgaccgtttgagggtcagccactgcagtaccagccttatcaacgtagttagcaactactttatgagctgcgtcgttaatgcttaattgcccaggaactacggtaactttgtagtttggattatcatcagcattagcagttacagtgattggatagttacctaattcaacgtctttactgatatccgtcaacgtgtacttcaagtcgtcgcctaacttaggttgacccgaaatcgttgcgacatcgtcagtgccagcatatggcaaaccatcgtaagtcttagccaaagttggcgcggtaatcgtcactggtgctggggtgatgacaaacaaaccattttgaacatcactagcatcaaagacatagttcgtattagccgcttgaaccttagccaaacccgaagcactaagcgtcactttgtaactgccaacattttgactgttaataccactcaaatcgtagtcgtcagcagtcaacgttgggataacaaagtctggatacttggctggacccaagaccttgtagctggttgctgcaggatccgttgaggcatcaccatcataaactttggtattcccttgaactgtgatcgaagtatcctgcttaggattgttcttcggatcattcgggttaaccggcttattaggatcgttaggcggcgtcatagccaagtgaatcggcgtgatcgttaactgaccatctaccggagtgatcgtgtagttcttgttagctgatgcatctgcaacgactccaatagcgtacgttccaacgttaacgtccccgctgatatctgccaaactataaactggatcaatacccttgattggttgaccagtaactttgccactcagctgacttgctgggtatggttgaccatcgtagtacttctcaaccgttggaccagtaatcgttaatggtgctggtgtgataacgaacaaaccgttttgaacatcacttgcatcaagcttgtaatttggatttgcagcttgaatcttagctaatccagcagcactcaacttaaccacgtagttatcaacattctgactggtaatgcctgaagtatcgaaatcatcagcagttaacgtcggcactgtgaagtcggtgtattgagtaggacccgcaaccttaaaggtcgttggatcagtcgatgcatccccgtcataaaccttagttgcaccttccacaaccacactagttgctaatggttgattgtcatttggtgtcttagggttcgatgggttgcttggcgtgttatctggtggcgtcgtcaagcctgcttgggtaatgttcaattgtccatcgattggcgttaccaagtagttttcattagaaacaccaaccaaacttggcgttgtcaggtaagtaccaacattcttgatattgtcaatcttagcgtctttatagttaacatcgacacccaaggctggcttgccaataacttcaccagtatcgcttaactgactgtcagtaaaggctgaaccatcataaaccttagtaccactctggcctttgaccataactggtgccttgtcaatgatatacaaaccattttggatatcttctggtttgattgtgaagtccttgttggcagcaaccaacttgtcgatcccggcttgagtcaaggtaactttgtaggtaccagcattttgattgatatcagtggtgaaatcactggcatcaaaggtcggcattacgaagtttgcataagcagtgcctgtagggccaagaactttaaacgttgatggcgtggtgcttggatcgttatcgtaaactttccgaccaccctgaaccacaacggaagcttctagggctgggttgttgttaggattatcaggattagttggcttaccaggttcgttcggcggcgtttgttccagacctaatggtgtgattgtcagcttaccattggtagcagtaatgtcatagttaccatttgcctttgggtcagtgcttaggattacattgatgtcgtagctgccaacatcaatgtcgccactcacgtcggtcacactgtaatcagctggaacaccctttgcaggaactccgtcaactttagtggttaaatcaccagcaaatggcttaccgtcataaacctttgaaccacttggtgcggtaatggtgacaggtaccttagtaataaccagcaaaccattttgaacatcctctggcttgatcgtgtaattcttgttagcatcctgaattttagccaggccactagcgttcaacgttactttatagctgccaacgttttgactggtaatgccactcaaatcaaagtcatcagcagtcaatgttggaacgacgaagtcggtgtacttgcttggtcctaagaccttgtaagttgctgggtcagttgttgaatcgccatcgtaaggcttgatggcaccttgaacaatcacggaagtttccagttgaggattattgttaggttcatctggattggttggcttgcccggctcgttaggtggtgtctgatccaagccttgtggcgtaatgttcaattgaccatcaattggcgttaccaagtagttttcattagaaacaccatccagagtaggtgtcgtcgtgtacataccaacattcttgatgttactgatgttagctacgttatagttaaccgcaaccccaagagctggtttgtcaaggacttcaccagtatcgcttaactgactgtcagtaaaggctgaaccatcataaaccttagtaccactctggcctttgaccataactggtgccttgtcaatgatatacaaaccattttggatatcttctggtttgattgtgaagtccttgttggcagcaaccaacttgtcgatcccggcttgagtcaaggtaactttgtaggtaccagcattttgattgatatcagtggtgaaatcactggcatcaaaggtcggcattacgaagtttgcataagcagtgcctgtagggccaagaactttaaacgttgatggcgtggtgcttggatcgttatcgtaaactttccgaccaccctgaaccacaacggaagcttctagggctgggttgttgttaggattatcaggattagttggcttaccaggttcgttcggcggcgtttgttccagacctaatggtgtgattgtcagcttaccattggtagcagtaatgtcatagttaccatttgcctttgggtcagtgcttaggattacattgatgtcgtagctgccaacatcaatgtcgccactcacgtcggtcacactgtaatcagctggaacaccctttgcaggaactccgtcaactttagtggttaaatcaccagcaaatggcttaccgtcataaacctttgaaccacttggcgcggtaatggtaacaggtgccttcgtgatagtgaacaaaccattttgaatgtcttcttggttgatcgtaaagttcttgttggccgcaaccaatttgtcaatcccagattgagtcaacgttaccttgtactgaccaacgttttgagtcagatcagtaatggtaaagtcactggcatcaaaggttggcattacgaaggttgcgtacttgtcaccagttggcttcaaaacattaaaggttgttgaatcagtggttgcatcaccgtcataaaccttagttgcaccttgaacaactactgaagcttctaaggctgggttctttggcggatcagtcggattaattggcttgcctgggtcgtttggtggtgtctgctccagacctaatggattaatggttaacttcccagagttaacagtaagcgtgtaatctgggttatcacttgacttagcagtaattgccgtgtcgtaatttccaacgttcttaattgtactcaaatcagtgattgctgccgctgttggattagcttcatcagtcgcaatcaaactgtaaactggagccttcatgtcacctgtgacatcagcaccagtaacctttaattgatcagctgtaaatggattgccatcaaaggtcttagtagcggttggcgcagtgattgtcagcttagctggcgtaatattgaaggcaccatcagtgacatccttggttggatcaaaggtaaagcccttagccgttacagctgcagtgatcttatcctgaccagctttagtcaatacaaccttgtaactgccaacatctggttgaacatcctgaactgtaaagtcagttgttacccaagtaattggtgctaaacctgtagctccggtcaaggtaacattgtagataccttgtttggtagtatcggttgttggattaccgtcggccccgtcttcatcagtcgttgtgccatcgtaaacgtgggtatgcgtgctgatggctgcggctacttccccagctgttataatggttaacttcccagggttaagagtaagcgtgtaatctgggttgtcacttgctttggcagtgattgccgtatcgtaagtcccaatattcttaattgtactcaaatcagtgactgctgtcgctgttggattagcttcatcagtcgcaatcaaactgtaaactggagccttcatgtcacctgtgacatcagcaccagtaacctttaattgatcagctgtaaatggattgccatcaaaggtcttagtagcggttggcgcagtgattgtcagcttagctggcgtaatattgaaggcaccatcagtgacatccttggttggatcaaaggtaaagcccttagccgttacagctgcagtgatcttatcctgaccagctttagtcaatacaaccttgtaactgccaacatctggttgaacatcctgaactgtaaagtcagttgttacccaagtaattggtgctaaacctgtagctccggtcaaggtaacattgtagataccttgtttggtagtatcggttgttggattaccgtcggccccgtcttcatcagtcgttgtgccatcgtaaacgtgggtatgcgtgctgatggctgcggctacttccccagctgttataatggttaacttcccagggttaagagtaagcgtgtaatctgggttgtcacttgctttggcagtgattgccgtatcgtaagtcccaatattcttaattgtactcaaatcagtgactgctgtcgctgttggattagcttcatcagttgcgctgacggtgtaaactaacgccttcattggagcagtgacatcaccagcaatctttaactgatcggctgtaaatggactgccatcataggtcttattagcggttggtgctgtgatcgtcactggtgctggtgtaatgttgaaggcaccatcggtgacatccttagttggatcaaaggcaaagcccttagcagttgcggctgcagtaattttgtcttgtccagctttactcaatacaaccttgtaactgccaacatctggttgaacaccttgaactgcaaagtcagttgctgcccaagtaattggtgctaagcctgtggctccggtcaaggtaacattgtagataccctgtttcgtagcatcggttgttggattgccgtcggaaccgtctttatcagtcgtcgtaccatcataaaccttagtatgcgtactaattgctgcggatacttccccagctgtcgtaatagttaacttcccaggtttaagagtaagcgtgtaatctgggttgtcactgtctttggcagtgattgccgtatcgtaagtcccaatattcttaattgtactcaaatcagtgactgctgtcgctgttggattagcttcatcagttgcgctgacggtgtaaactaacgccttcattggagcagtgacatcaccagcaatctttaactgatcggctgtaaatggactgccatcataggtcttattagcggttggtgctgtgatcgtcactggtgctggtgtaatgttgaaggcaccatcggtgacatccttagttggatcaaaggcaaagcccttagcagttgcggctgcagtaattttgtcttgtccagctttactcaatacaaccttgtaactgccaacatctggttgaacaccttgaactgcaaagtcagttgctgcccaagtaattggtgctaagcctgtggctccggtcaaggtaacattgtagataccctgtttcgtagcatcggttgttggattgccgtcggaaccgtctttatcagtcgtccgtaccatcataaacctagtatgcgtactaattgcggcggatacttccccagctgtcgtaatagttaacttcccaggtttaagagtaggttaatcgggttgtcactgtctttggcagtgattgccgtatcatacgtgttaacagctgtaatcgtatcagatcactgaatatctggtccagctggtgaagttggatcatttggatatagtatgttctgccttagcactgacagtgtaaactaacgccttcattggagcagtgacctcgccagtaatctttaactgtcggctgtaaataaatggaccatcataggtcttattagcggttggtgctgtgatcgtcactggtgctggtgtaatgttgaaggcaccatcggtgacacccttagttggatcaaaggcaaagcccttagcagtgcggctgcaagtattttgtcttggtccagcttttactcaataccaaccttgtaactgccaacatctggttgaacacctgaacgcaaagtcagttgctgcccaagtaattggtgctaagcctgtggctccggtcaaggtaacattgtagataccctgtttcgtagcatcggttgttggattgccgtcggaaccgtctttatcagtcgccgtaccatcgtaaactttagtatgcgtactgattgctgcggctacgtgcttttgttcaatataggtaaccgtaaacttctgagtaccgacaccagttgtagcattcccagtatcaatcttgttatcgaaagttggattatctttcaaagcatccttaagaggcgtaacactatgaacttgcccagttggtggagttgcgagagttgtataagtcttaccattaccacctgtaactgcaaccgagtaatcgtaacctggaactacaagatctgtatcagttgtcccaaaggcgatatttggtgtgccaccctttgtagtagaagctgttggagtaccagttgctatatctttaatttgaggatttgtacctggcttattggttgaagtcaagtttgcgacatcaacttggtaagtgttggtaataactgcattgccatcagctgtaaacgtaaactgctgaactgaattcccagatgcatccttaataggctggccattagtaccattaatgtaaacaggcttgccatcgtcagcttgaccaggatcatcaattttagcaggtgtagaatctgtagcagtgacactcttcaaaatataacctggaattgaatccggcaaatcatctggaagtggtgtaccagaagcaccaactaatcctgtagaagttccatcaggattgatcgtacccgtttcaacaggataacctttaatctcattaccatcttgatcgacatatttaactgtagcagtcgtttcgaaattatcttttatttgtccaacaacgttttgccgaccatcagcacgataattaacatcaatattatctactttacctttatctttactactatttggatccatagctggaagagtaacatcaactgactgttgagcaccgagtgacttgattgaggtcacaactgacttaactgtactccaatcggtgacttcacttgctttctttaacgtagcagtacttgtaccatctgttggattaaagtaatactttgtcccatcagcaaattcaatcgatttaccaccgctatcaagcaagtcaacttggccattagtttcagtcgtcgtcttaatagggcttgtataaaatagagtttgagtagtggcacctgttgcaccagaactagctgctttagcaacaccttccgttggcgctccagttaagttaagaacgaagtttccaggagttgctccactattcgccgtatttgtttgaggcaaattaaacacagcactaacattattaactacgtcagaggtgttgttgttcaaacgaactcgaatactctgagaatccgttccatcagtaactggaaggtttgtaccaccagttttgtatgtggcatcgttatttccttttatggtaccagtcataaccagagtcgatggtgccgcaatctctaatgttgacgcatagcttggcgtattattaaatgctaaaacatcccgcgacataccagatgcattcgttgaaaaagtacttaatccatcaactttatttccatctaaagttgtgaacaaccccgtttgtttagttttatcaacaatatttccaactgaattaaccccagtagtatcactaccctttacaaggaagacagcagtggcttcaccacccgtaccaccattggtagcggacggaacattaactgtttgactcccaatcggataagaagtagcagctgtattagcgactggaataccagccgtcaatgcgtcatcatcagctgtaaattcaaagttaaaccacatattagttggatcccaattaaaaccagtaccggtataatcaagctcataaactgtttgtccatcagcattcttatgactcgttacttttggcgtagctgtctgagaggcccaacctgcgcctaccttagaaaagatactaccgttttgttgtttaatttgtgtttgtttaggcacagttacataaataattggctcaactttatcctttgtaattccggcaaaaccaggttgatcgtccccatccagcttacttggtctattagcatcagcgacagagttatcagcgtctttcccaccaaaactattttgaacgttgtttacataataaccgtcagcgttcaaattatttcctgctgggatattattagagcctgtagcccctaactgcaaagtaaatgtatcaccaggattaattggggtcgaaatatctgatagtgtgttagcactaatcggtgccgttttaaccgctgttatatcaattgttttgggtgttgtagcaatcttatcacccggcgtatccgaaacaaaactaactttagacgaaagcttagtcccatcggcaactgaagaatctacatagcctaacaaagcaaagttttgaacgtatatatcattggagtatccgaatggttgatagccgtctccttctccacccataccatacattccagacaatgctctttcttctggaacgaaggtagaatggatttgataactttttacttgggcaccagctggaacagccatcatctgagtagtattagctgtgccagtttgcggtatagttgataacgttgttccttccttcacgcctttaaacgattgtgaagtcccatcagtataatttactgtaatatcatatgtctttgcacctgtaggtgaaaagtcataccacgcttgacttgggataggaacatatagtccagtagaatcaattcccttggccacatccaattcgatattaccggtttcattaacggtaccatcatttgaataagtaagacctcctacaacgttagtagacttatcaccaataaccatcttaccttcttgattagcagtattagcgctgatgtagaatgatttataagaatcagcatcattaacagcttctttatatacaggtatagtaccggtaaaatcagtccaaccgtttatagacgaagtcttagctgtaactttactctcaccaccgccatcttttgcaacgggtgccgttgtattaccatctttagtcctagagtacgtgaatttagtaatcttgaaatcttgttcaccagtagcacctgtctcatactggcccgcaaagtaaacgtttgaatcaattgtagaccatgagtctgtcccatcagttttaacaataatcggtgtaccagtaccaccaggttgtgaaacggttaatccaagaatgccttggcccagttgaaattccgctttattagacagtgtaggatctaatgtaaactttgaaggtacctgaatatccatttccttcaaataataattttgttgttgtgccgtatttacgggagcctggccaatagcgctcacagcatagacatacttagtcccagtatgctttttagtaactcctgcagcgaataaactggcatcgctaatgctaacggatttaataggagcactattatcaagagtaatagaggtagtcttagaagttaagttggtgcctccataggtgattggtagaattgtttggtcagccaagccacccgtagtaccaccaataccaccggttgctgtggtatattttgcgctttgagctaatgtattccagttagcatttcccattccagataatgtaaccaattctgtttgcgtacttccagcttgggctacagtccaagtgacagtcgttgacccatctgagttactatgggtagtagggttaccatttgcattcacattattagtaaaaccaccatttggtaagttagctggaactgttacccagaatttatcacccacattaccagcaaatgaaacattaaatgtaactgactttgtaagtgcgtcctgaccagcttcaaaatacgtagccgaaccatctgaatttacagttaacattggtgatccagcagcataattagcggcattaaatgttaggcccatactttcagccggatccacaacttgccggaagctactaatcaatccctgatcacttaaactatctacaacagccttaaaggcttgatcattacttgccgtaacaaccaaatcgccataggcatccagcttagtgttcacgccactaggcagactaaccttttcataagcgttctgagcgttagtaacaacgttggcttgaacacccttcttatcagctgcaagcaagacaccagcttgttcaacttcattagtcatgctatccacgactgtgagcgctttgttcaagttgtccaatgctgtttgcttatcggttgctgcaacggcgtcagcagatgtcactgcatcgttaactgacgctgtttcggctgcttggtgggaagctaatgcagctaatgcgtcgtcctgtggaatattatcgttggcgtttgcgtcagctaaagcgttggattgtgttaaataatcttgtacctgagcttgtgctttggctgcctgctgaatcaagctttgaccggcttctttactgtattcagtaatagtgccagttgcatcggaagcggctttagttgcagtcgcatctgtagtctttggcgtagtcgctgtttgatcagcaggagtttgtactgctgacttagtggctgcattggcagctgctgtgacatcactcgcattagctgaagcatcacttgctgcttttgtggcagaagctggatcagttgcgggtgtttgtgcatccgcagtctttgacgtgtccgttgatgcagctggtgtagcagccttcgtactagtgtctgctgcggcactggtagaagctgaatcagcatccgtttgtgttgcgacgggtgttgcagccttatcaactgactgatctgtggcatcctgccccgcacttgtatctgcagaagcagctggtgtgtcagcagttgccgtggtattcacggtatccgctttaacagaaacaccgtttaatgagctgtatgcaaggcttgagctaaacagtgaaatccctgcaacgagccacattttccctttcttatacatcttgtaatggcgcttttcatctaggctatccctgaataaccttgaatcatatccgaaccttctcaaataaatgcacctcctaaatttccgtttgatccccaatcggtgttactttcactaagcgtggataagttcccacgtccacggtacccgaaacttccaggactgtagacaattcgtgaagtcgcactttgctactcttctttgccaattctactgagttggcaaatttaccctgttgctgtttcatttggcgacgactaggcacttgttgaccgtatcgctccaaataatcacccccttaaaagtttgatactatgaaaaccaatgcttctgtgtgtaaaatggatcaacttccgtttggacagcctgtccaatttgatcatcgagtgtcccaatcaggatgtccgcaccgtgtggcaggtaccggtgagcggccttagcaacacgccgagcaacgttggcctgaaaatcagtggatttaccctcgtaatcaagcaccacggtgtagtcaaactgatcctcagctttaaccttggtctcaatcaaccaagcgtggctgactttacggatatgcttcaactctcgcgaaattgctgcttggagtttcttgggtgttgggttgataatccgaaactggaagggttcctcactatcaccttccggaagactaaccggcactacttgatgaatataatgccagtattcgtgggtcagtgggaaattctgataacctggattgatcaggatgccagcaatttctagactgtcagcctcatccatcagttcttgactagtaaactcaaacgaacgcagaggttcaagttgcggtgttccgctcagaaaatggttcatcttggtctgatcggtaaacaccggaatgtacttttgaccgtctgctaggtatgtggtgaccgccaccgacagcgttaaacctggtttaggctgcttggccgacgcatttcgcttaccggcttgaactggtaccacgaaacgcatggtcaagagtgttgccgcaaactgactctccagattggcatccatcgggtgattcatgtaccgctgcaggtagtggttaaagccggtcgctcgaaacggcatgattgaaccactgctagtcgctggtgtttccacttccggctcagcccggtctgctgacttggattcttccatctcacttgctcctttctataatggtattaatctctaaatatccttaacgattcagttgcgaaatggcgtcaagcagtgatttcgcactatcgactaactgaaggacttgttctttctcaccatcattggcggcactttcgatcccttgagccacctttttcatgttctggctcagcacctttacaggtgttaagccaaccaaagcttcaatatctgaatctgagttgtgtttttcttccatgatttactcctccttaaccccatctaacaacgttaaagttcgaatcgtatctagtatcttcttcgatgaatctgatagtgctgccaccgtcttggagtcatccgcttccgccatactgtcacagatctgcgacaaagcggccgctaacagtgaggctggtgatgtcggctttgaagctaccagatgactatgctgcgatgttgcggacgattcagactccgttcgtaccggtgcctcttcgttagcatcaccaaaattagctttatcgaagattgatgaaacactcttttttgttgactctgcagtggtactagaaactggtttagcatcctcgcttggctgccgcaaatcgtccagatcgggtaacttcccatctgggtcaatggtcaacgcggtttccatctcatcaactttgttcttttcctcgggtgttaaacaaaccaagttcgtcttttgattcggttcagcaggctgaaaatgcattggatcttcaacttgtttccctaaaccatcatcggtcattacataataatgatgtccggaaataactggtaattcaacgcgtgccacttgatcaggctgatcactgtttctaagtgtgattaattctccagccacatcggttaatccgtggtacacctgcaacgtaccgatccgatcgtaaaccagtcggatcactgctggtgtggtggtcatcgttctggtcagctcgtcaggtttcttgatcaatacatagccctttagaattggcgtggcaacttggtaactttcgtcaatcgccttaaaaattttaagcggttccattatggtgtcgccagcttttgtttcaaaccgaacttctgcgtaattttgcccctgatgcttctcctcggcctcagacatttactctcccccttttcaaacgttcctgatgtatctatcattacctataattttattcaataaacctgcttatatccatgcatatatattgagttttgttctcactttttaataataattaaaaaatgatgaactcaatatctaaatgtgtttattaattgattggtaactatttgactgaagaatccattcaagccttgttacctgagcgtttcacgagtttcagaaaacttaacttgatgtcaaacaataatgtgtagcacacgatttttatcatgttctacacattatttggctacatcattctcactatcccaacttttcccggatgggctattacgaatgatgacttaacttttgatattgaaacgcttattgacgttttcttcgtggctgaattttgattccaaaccagcctaagatcgtggccaacagcatacctaggaaaccgaataacccactgtgactgacttgttcgtcggtctgtggtaactgtttaaccgcaccgtgaccataacgggctgtccgagtggcgcctaacttttcagacccaattcgcgatggtgccattactgaccgcgccgtttgataaacaacgccttcgccatcctcagtcttattattggtatcttcatcattaccatcgactgatgccgcttgagtgtcagtggatagtggcgaatcgccaatcattgacgcgtcagaattggtattggtattgctttcagttgtactgctcgttccggccgtggtatcgctatcagttgtggtactggtgtcggtggaagtcgttttgctggttgaagcccctgtgctggttgtggtgcttgtgccagttgttgtgccagtaccagttgtagtacctgttccggttgtgataccagtgccagttgtggtgctcgtaccagtcgttgcacctgtgccagttagtgtgctggttcctgttgtggcgccagtaccagtcgtggtacctgtgtcggttgtggtgcctgttccggttgtggtgccagtaccagttgtggtacctgtgtcggtcgtggtgcttgttccagttgtagtgccggtaccagtcgtggtacttgttccagtcgtagcaccagttcctgttgttgtaccagtatcagttgcagtacccgtccctgttgaagtccctttatcagttaatttggtataaaccagcttaaaggtctgattgttgcttgaattcgtatcatagtttaccggggtggcggtttcgtccgtaatcaatcgatagccgtctaccgtcttgttcacactgctaaaatcaatcggtgatcctgacttaccagaaactgagtagccgattgcacccgaagtgttcgataccggatggtcgttttcgtcaactaaagaaataactgcagtttgatcagtggtatcttctttaatggtgaacgtccccgccttcgttgtaatattgtaatttggattttttccgagagtaatcgtgattggataatcgccagccgtttcaccctgatcacgggtaacggtgtaattaagtttatcgccgctcggatagacgtggtctggcgttgctgtcagcgttggatcagattgcccaactgtcttggtttgattatcagcagttaaagtgacatcggcttgcttaatggtggcagtaccagcagtcacgttcttagctgagaaagttgcgtcgggattaacggctaaaacggccgcgatccccttatcattcaaggtcactggatacgttccaacgtcaggtttaacttgactccagtcgaaatcatccgcagtgaagttggcctgattcatagtagaggcaccgtcgatcttgaaactgaggcctggatagccgccattaaaattacttgtgccatcataggtctttgaagtcgttccaaccacagcgctaatggtggctttagtgtcgctgggattggtgccatcagcttgaatggtgaacgtgccatttttagtagtaatgttgtaatttggattgtctccaagcgaaagcgtaatggcgtactggccagccgtttcgccaggttcgcgctttagcgtgtaatttaatttatccccattcggaaaaagcttgtctgagctggcagttaaggttggatctggtgcgcccaccgtcttggttttattatctgcggttaagaccacgtcagccttgttaatggttgcggtaccagccgtaacatcatcttttgtaaacatggcccctggattggctgccagcacggccgaaataccatcttgattcagcgttactgaatacggtgttgtactggcatccggtttaacgttcgaccagtcaaagtcatccgcagtcagtgtgggtcggccaaacttatcggtacccgatactgaaaatttcacccctggataaccaccattaaagttggttgtaccatcataagtcttctcagtgctctgcacagctgccttaatcacaaccgactcagttggagtggctgcggtgttggtgctatcactatttgttggatcagtggctggtgttgtggcagcggctcgctgagttgctggcgtacccgtacttggatcagacgatacagatgcagcaccagactggttgttgtcctcagtctttaaactgctatccgttggtgaggtcgtggtagcgctgggtgttttggttgacgtggcagtggttgatgaactatccggtgcttgtgattgatcaccagtagttgttgcgctactgctagtcgtcacattaacgttagtagccgttgccccgttatctaccgtggcagccctggctaccgttggcgtgccgtcaaagaaatcaacaccattcgccatttcagcttcgtggataccaaataacacggcaaccgtcgaaagcccccgaatcgtccaccgaattttggcactgaacaaacgtgttttggtgatcggatcggatttgagttgttcataacgatatctttgcaaaatgtactcccccctgtaatttttctctgtttcaatatttaatcactatatctacttctacttataatcttaagaaagtcataaatgtatatctatattcagacatcgaaataattctgttattttatcgatttcacaaaaaaatgaaactaaggatacatatcgtgacgaacgtcgacacacaaaaatcccgtagatccactggaatacagtcgaatctacgggattttgtatctataaacgattaaaaacttagtttagtcattaattgttcgtttgctaattgacgaatgatgtttgaatacttcacttcggagcgtacttatcatatatgaatatgatgttagcacttcttgatcctattcctccgcacggttgtttaattcgtcaacttcgtgggtggtgacgataacgtaatcttgctgcaacttggctgacaacttgctcagcttggcctgcgctttttcgataacttcctgcgtgtcttcacccgtgacgatattattattgatgcgaaccagtccctgcgccaaagcaacataatccggcaagtcattgtacataaaatctgaaatattcagtaactgccgcggtgcactgagtaattcctgaaaagtctgttcgatgacccgtaagtcgttgtcataactgggaatatatttgacaacttcacgcctaatctggcgaagatattccaactggtggtaggcgttacggacttcccgtttgaaaaaggtccgctcagaactatccaaaccgcttttggttagttcctgatcgctaatgaacaaggactcggtcatgccgctctcgttgacttgtttagcatattgacgaagcttgacgcgatgccagacgttcatccccacgttcaccagaacagtgatgagtatcaataaaggcattagcccataggccacggtgtataagtcggtaaaacccgtttccgtttgaaacatcatcaccaagctcatcagggctaaaatcattgctggtatgacaacgccccataaccagcgggtgctgaaacaaaattgcagcggtacggctaataacagatacaacccaatcacactattggcactctgatgaaagaccaagagcatggcaaaggtcgccagcgtaatcaaggcgccgagccatcgtgttcgatactgtagtaataactccattttgcgccctcctattcggctgtcacaccgttgcttgacttgattgaattgagttgaacatacttgtcgtggccgctatacccaatatcagcatctaagatatacacgttatccgggtaaacggtaaagccaagatccacttttctggaatggccgtttttaacgttaacgttattactgtccatggtgagcaaatggtgatcagccttcaataatttgccgatatggtcacttttgctcaagatatcctcactgttaggtccgctgaacagctcatattcgtcggtgctaatgtcatggtcgccgtcgatggaagacgtcagcgaaacggtggcatggattatgagatattgttccagttcgttcgtgtcggccgaatcataagccggctgtgggcttttcaacagttcatagccggtaatggttaagtgcgtccccgaagattttaatgtcagtggctgccccgtgaactggtatgaacgctgagcttgagccgtaaccgaagtgaacatgaaagtcacgattagactgaggataatcattaattgtttcatttcaatacctccaagtccttcgttttaacgtggaaaacaatcgacgtatcgtcgtctttagctggtacattatattgataatagaaaccttgatagagaaaatcaaagctggcagacttgggtcgcttcaccacaatattgaacggtttgcgaaccccttccgaatactcatcgccgtaccagccattggtatcaaggatattcatcaccggtttattcaccccgccgactttgatcttggtaccgataaaatcgcgtgcttctgagtaatcatcactatccgcttcggttttatcgctccacttgcggtacacctcaaaggcatcggcacttaaactagtatccgaatgtctgggttgtacactcagattgacgatgagtaccggatcaccctcgtcagtctccgcagcataagcatgatgaaccttaaactcaaggttccggctgcgataagtcgtattatcctttaacgtcaccttttgatgtgaatcatttcccgagatgtggcggggtttcacattcgtagacccaaacgccaccgcattaccaaccagcagtacggcacccatcatgaacagttgcattcgcaattgccgtttccggaccttttttcttggctgtttagcgattgccatttgcggttgagcacccacagcaccatttttcaggtaattaaccgttgctaaaaaattattcagttgagtggcatcaaaccactctctgtttaaagtaatcccactgcgcgattgtaaatgaggacgctttttccggtcaaatcgcagggcccgttgccaatctaagtgaacgttgctgccattcttaacgattttaagccagtcgaatggcacgtagacttgttctgtccgaaaatagtagcgggttaaccagatgccggtttgattttgattaatctcgatcagttgataatcctggcttcgcaaactatgataactgaacgcgatggcggccagaagaatacaagtggcaaaccaaaaaacgcccaccatgatcaacggctgagcagaactgtaactatgcttagcagcaagtttgataatcacagtgccgacgatcatgattccgacaatcacccagcaagcctgaattaacgcactgagaatcgattgtgccctgaatttcaatgtgttctgcatagttattccgcctttggctgctgcttaacggtttcaactaacttagtctttaaatccgactccatggtttggagctgattttcaacttctttccgcttgacactgccctcttgttgaatcttcagggtttcagtgattgtgttgatcaaatcatcctgggtctgttttagcgtatcaatatccacaaccccacgttggctggccttggccacctcaactgcggattgcgataacagtttgctattctttttcaataaatcattagtggtttcagccaccgcgttttgagcagccaaagcgtctttttgattgagtaacgctaacgcaatcaccacctgatttttccacagtggaatggcggtggtaatcgacgactgtatcttttcagccagcaccgtattgctgttttgaatcagccggatttgtggcgcttgttggatcgtgattgcccgggtcaacatgagatccatcatccgtttttccagtcgatcctgggtggcagctaagtcttgaacttgctgagctgccatttgatcagtagcggtgctttgaagctgctgaatttgtttagtaatttcatcatgtttcatcgacgcgcccacgataagtaggtttagtgattgataaaatttaagattctgctgatacatgtcgtccagtaaatcattatcttgtagcaacttagcctcttgcttactcaactgctgggctgatcgatcaatctgaacgctgacttcttgatacttagcggtcatttcaaaaatggatgctttcacctttgaaaatagtttcgcaaatagcgaagcatccgactgactgagtttgtcaggattggtttcgttcaaactcgccactaatttccgcagactatccccaatttcacctaactcattattttgaaccttcaccagtaccgtgttcgaaaaactcgacagaccctcttgctgagttttaccgtaatccaagatggacgattgtttatcttcgctaatcgtagccgccatattagcggcttccgtcagttcctcaggactcagtttttccttaatcgaagttgctagtgcaactggtgtcgtctcatcggtttgactaactggcacaacgcttttatcaatacttgtgacatctttcattttgattcctccaaagtgtgttagcaaaagttaataccccaaaaatgacttaacttgtgtttttgatagtataacgtaatttgtaattgggcgcaaaattccttggagaaatagaaatatgtaggtgtactgtgaagtaaattgcaagcaaatcaataattgcaacgttgccttaacatatttatccgtaagcttgctataatatccttgaaagaggtattggcaacaccagcattcacatattctagttaagattgccaatgctattaaattccccgaaaggaactgataccatggcattaaaccggcaaaataaaatccgaaattattccgtgacttctgccaccgacaccattaaagaaacgctagcttatcggcatctgagtgctgactggttggcggacatgctgcacatggatcacgaggaaatgaataaggtgttgaaacgtgaaaactatttgaccatggatcagttaaaacaagttcagtccttaatcggtgtgtcagcacagttgttaagaaaactagattctaattttcttgaacaccatttgacgccagcggaactggctaaaattgaaaagcttgagcaaaattccactgatgctgattttgaaaatattgatgatcttgattgggataaattgtgatgtgaggtgtataagatgccaaataaacgacagcggaaaaagaattataacaagtgggctaataaaatggttcgtcagatctgggatcgacgccctaaagatcttaagacacaggaagaagctgaccgatggcttgatgaacaggttgaaaatgaaggtattctcaattggcgtacacaacaagccgtaaacgaagcgatttatgatgcgaaatcgccacattcaacattaaaaacatatgattcggttgatgaattgatggctgacttagaaagcgatgactgaaatggcaaataaacgacagcgtaaaaagcagtataaaaagaatatgaaggaaattgctcgcttgtcagaggcaatgtcccctaaaacgttggacactcaagaagaaatcaatgcatggttgtttggggatgacgaggaaaatttcgctaattcatcaaaaactgacgatcatttttgggatgaatccaattggtccggtttccgtgacagtatcaccgacgaggaccgcgaatgggataccacgaagcctgttggtaaagaaaaactcaatgccagtgatgatttggtcgcactgtggcgagtgttagattcacgaaagaatgacaaagcagttgatttagacgaaatgattgctgaagtcgatgttgaaaatcaacatgatgattcatcagatttttggaataccattgatgatcaagctaaaaagtacgggtcagttgacactcccgaagttgactgggggcaagatgtcgaaatggactctgaggataatgaggattaacaagcttaaattttatgtgctcttttgcaaagagcgcttttttgattcaaattagagtgtgaaatgatataaagccattctttctggtaaactaggattgatagttttgcttacataaacataaaatacctttgctaatgagtttatctttcataagggagcatcaggagtcatggcgaaaacaaataattttcccgtaacaacacaattttccagcttattcaatttaactcgtactttgattaaaccttactcaaagtatcagcatttaagaatcgtagaatacttgctgtatctttacaccaccattgccgtagccgtaactcaaggatggataattcatctaagccaaggcatccgtaatgattttgcactcacaggtccacttatacttaccggtataatcttgatctttgttcttaaatggataaatcaccgacgtataataaaaattattcatacttttctaccgattaatcaagatgatcagtatcaacggcaatatcaaactattcgaaaagctgcattgcatccggttacaacaaaatttcagcaagccctagaaggcttcgttacaatcgttaccttcatattcgtaatgcctatcattttcatgtagacgaaagtgatatattaattcagaacgtatcagattcaatgattattgtttattttcccatacaaaatttagtgctgcactatttggaaatttctaacgatactaaaaaaccgcccagaatagccttggacagttaacgacggttctttagttgtttaaggtagtctataggtatcattctactgttaacacgactcagttataacatgagccgtagtatttttgtaacttgctgattaaaatccgttaagtacttggaattcgactttttaaaaagatttattatgtgaacagcacataactctaatttactaatttactaatttataaaattttttcgtagtatttactcatcaaccttgtttatcttggtcgatgctgcccgtaatgttgtccgtaccgttttaaatccattctaattcgctcaaataacccaactgataaaaaaagagccaaccccttcggatcagctctgcaccgcgttgttctcttaagcgggtgacgggaatcggacccgcgactcaagcttgggaagcttggattttaccactaaactacacccgcataacagtaactatgttatcatattcagcttaatctgtcagcatgaaattgcataaaaatcagcttttctgaaatagtttaccgttattttcattattcggcttttgcttttgccggttcagcgtcttctttacgcacaatagcgcggttgttaagttcaccaaccaaaatacgatcactcttgttataacttaaaatgtgaattaataccgagttttcataaattttctcgatttccccttcaaagtcatgttcaaaagagccaaatttcttaccctttacatagtcgccaacttgatgttctgccattgggttatcccctccacttcgcatgatgaaaaagatgataacaaatttagccagtgaatacaaggcttattttcataatactgaaactttccgtaaacttaatcttccttaagattttcaaattgaaaatgagtttcataacgccttcgtggtagacttaagataacagtaactaacgataactactaccaatatgcaatatattttattctaggatgtgacttgtatgtggctgaccatctacttcatcagtttaatattacttatcccagtaaccatcatcggtttaaaccgaacatctgagaaaaagattgcccagtggctcattattgaccgcttagtttatctcatcatggcgtgtgcaaccgttgtactcatgattcgaacttttcaccacgcacctttcttggtttcgctaaagggcgcactggcaatcatcgtcgttttaattattgaaattgcttttggtcgcaaacaagaacacagtctctccattgcttggagtattgtcattactctgctaattttactcacggccgcagtgggcattatgacaacactacattccatttaaaatcaaaaagattagccagtttcccaaatggacactgactaatcttttttgcttatttcttttgtgctttcaacgccaattccaacgaccgatcaaccaagattgactggctatcaatcatcggcttatccgtcactggttcacggtcctgtgccaaagataactcggtacagcccagaaccaacgcgtcacagtgggtttcgtcaaacatttgctgaactaaaccatgatacagctgacggtctacaacgttgttatctttaatacagtcatagatcagcttgttggtctggtcttgcacagattggctgggagctagaaactcgtagcccgcatccataatttcatgatcataaatatggtcgtatatggtaccttcagtagcgattaaaccgattcgccgcgcttcaggatacttcttaccgatttccttcactgcttcgcgaggcatatgcagaattggaatatcggtagcggcctgcatctcatcatagaaatagtgcgccgtattacatggtaaggcaaaaaaatcaggctttaactggctttgaaccttaatatcattcaccagtggtatcgctggattcggctggctatgatctttaatatagcttgtacggtctggcactgtcgcatgattgaccagaatatagttgagataatcctgatccttattagctggcgtccgttcgtttaactgatgaatgtaagtttcagtggcttctgttcccatgccaccaatgattgtaaagaagtgttccataaaatcaccctttgttttcagcaaaataacggtcaaaattcttcgagtaattatgattcatccattgaatcaatgcccagcgcttcaggttcatatcgtgtgaatactgataggtggtcccataacggcctgctcggatcaattccagtgcccggtctttatcggcattctcacgggcgtattttttaaagactttagctggtactcccaaccaaagcgcgtgcttactttcgtcctgattaccataaacagttggttgatcaaccagatcctgcttaacgtagtctttaacaacccaatcagctaaattatagccgttgagtgtcacaaagaagctactgcgcccctgtcggaggttaatttcgaataatttgaacgtatcatcacgtacatcatacttcatatcaaagttagcataaccggtaaagtcgattttttccaagaaatctttgattgtcttgtaaatggcttcgttatactccggcaaaattgccacgtaattaccaattgcggaaggtgctggatcttccaacaacgggtgacccagacacatcatcttaacgtggtgatactgatccacgtatgcattcagtacccgcatgttactgtcatcgccaggaatgaagtcttggagaataaaatctgacttatacccgttagcatatgcagcgtccaataccttgtcaaactcttcgcgagactggatccggaaggctttcttccgaccttcaaaatgcacgtccagccattccacactattagttggcttcaaggcaaccgggtagtcaaagggctgttcaacaaccgtctgactgtcatgttctttcttagaaatcgtccgcgtcttaggatatggcaaattgtatttgtcacaaattttgtagaaacgttccttattgtttaattgcttcaataaatcatagtcgatgtatgggcaaacaaacacctcggataactcatccttatgtttagcaattagctcagcataaccgtcaccacagccaatcaggatcactggttctttatggtcacgatagcgttccttgatcttacgcattgagtcgatccagactggatcctcagagaagcctgggatcagttccaagtcaacaattttggtgaatcgagttggggctaattggatggacgcgatagccttcactggttgatggtagagttcataaaacgaacgtgccatgccgtatacattaaagtcgcttcccaataaaactggggtaaattctggtgtttcttgcatcatctaaagttcctccacagcgtttttagcaatcgtgacatcggttgggtatggcgtgttgacaccattcactttctggaaggcatcttcacccttaccagcaagcaccacgatatcatctttcgtactcattttgatagccgtttcaatcgcagttttgcgatccatgacgtactgcactttgacttgctgatgatcgatatgagcatcgatttcctcagcaattttcttcggatcttcataggcgggatcatccgtcgtcaaaatcgccacgtcagcctcttcactcagtgctttaccaaagccttcgcgacgggaaacacccttatttccagtgctcccaatgacaacgatgactcgaccggcaccagtttgaaccttcaagaagctcaacaacgcctttaaactaccgtagttatgtgcgtagtcaatataaatggtgccgtgatctttgctggtcaccatttccatccgtccaggaacgtgaacatccgtcaatgctgtctttgcatcatcataacttgcgccagacagcgcactggcaatgattgaactggcggcgttactctcgttaaagtcacccggcacgtgtaattcatagctaccgtcaatagcgagctgcttcgctttttcggataccgcagtcacttgaaatttgctttgatgcaacgtctcactagtgttcttgaaagtcacatcaaggtccagtggcatctccagcttggcaccttctcgtgcatacaagtaaatatcttctggttgcgtcgtagttttagcagcgtagtacacatccgctaaatgcgtcgtttccgcattaataatgcaagtttcggcattcaccagtagttgttccttgcagtgcaaatagtctgcgaaggttgggtgttcattttcaccgatgtggtccggcgaaatattgagaaaaattccaacgttatactttaatccgtacacccggttcttcttgtacgcttgtgaggacacttccatgactaagtgtgtcatgccattatccacggcatgccgcatatcgtggaacaagtccaatgactcaggcgtcgttaagtccgacttgaaccggtcttcaggtgcgttgcccacgatacgatcaatggttgaaaacagtgctactcggtcatgggtatgcgtccgttcgataccgtaagtaaagtaagctgaagttgtcttcccctttgttcctgtgaaagcaatgataaagaggtcattttgaggatagccgtaaaacgcagcacctagtaatgacatggctttttgaatatcagtcacgataatgctagtcaatccttgcccctcatcgtagctagtctcagaaacgtaagccgtggcccctgcttctttagcacctagtaaataagcgggtttaaaattccccttacagaagaacaacgtatcgggcttaaccgtttgtgaattatagttcacgtgttgaaactgctgctgtgaatcagtcattgtgaccgtttttaataaatcatgttcatctaataaagtcaccacttgggttatatcaagtgacacgcgtttcatctccaattaattgcgtcctaaattctattagttcacggttttatccaaaaagaaaccgacatttcagccggtttcatatggaaaaatgcagtttagttagccactggaatcttatcgatatccgtacgacgaaccttgctaatagtatctgctgaagtattctctgggaagtagacttcataccaaagaataaaggtgtagatcgtaaagatcttttgcattgatgacttaccgttgatatgttcttgaagaatctcaagtaatgcatccgtgttgaagaacttcttagcaacgtctgaagtaaaggcttcttcaatccgcttacggtacttatcttgcttgatccaggtagcgattggagatgggaaacccatcttttccttcttagcaacccgttctggtaattcagctaacgcagccgtccgcagagaaaccttggtttcagtaccgcgaatccgcgtcttgattggcatggtagcagcaaacttagcaacttccttgtcaactagtggtgtccgaacttccaacgagttgcacatgctcatccgatcagctttatgcaaaatatcgtatggtaaccaagtgttgatgtcaaaatactgcatttgagtcatctcatctttgtctttaacatcatcaaagatatgcttagtgtattcaccagcatcacgattcaaatcagggttcttcaaaatcttttcacgatcatgataatcaaagacgtagttcacccggtaataacgttcactcaatggctgtgcaccacgaactaagaaccgacgcccatggaatcttggcaaattaacaacggctttagccaaacccttacgaacaaaacgtggcacggacttttgataacgctcaaacggctttgcttccaagtaggtgttgtaaccgccgaagaattcatcggcaccttcaccagacaaggcaaccttcacgtgttcacgagtcccctttgacaggtaatacagctgcatagctgaagggttagataacggttcatccatgtagtacataatggttggtaaaatgtcgaaataatcatcacccgtcatggttaacggtgtgttggcttgatgaatttccttagcaaattcagttgaccagctcaattcactgtacttagagttattaaaccctaaggagaaggattgaattggcttgagttttgcggcttcgttaagtacgtagctggaatcgatcccgcttgataagaaactaccgacttcaacgtcagcgatcatgtgggcatcaacggaatcatcaacgatcttacggatcttcttagcgtcttcttcgatggtttgattctcatcgatattgtcataactgaacttatagtattcgtgagtttcagtgtgaccatctgctttatgaatgaagtaatggccaggcattaatttgaagacgttcttaaacatcgtatcctttgaaggaataaattcaaagctcaaatgaatggctaatagatcttcattaagttcttttttgaagtttgggtgttccaagaatgctttgatttctgaagcccagaggaaagtcttgccatcatcgtaatagtacaatggcttgataccaaagtgatcacgggcaccaaagacttcaccggttttagaatcgtaaataacgaaagcaaacattccgcgcaaatgctgaagcaaatccggaccccaggcatcgtagccgtgaatcaaaacttctgagtcaacgtctgttcggaattcgtaacctaacttctgtaaatctttacgaatatcttggtagttataaatttcaccgttaaaagtcaaaactttagtttgatcccggttatacatgggttgtttaccatgcgcaagatcaataattgataaacgacggaagcccatcgagaccttatcatcattaaagtaagcttcatcatcaggtccacgatgacgaatacgattggccatcttcacgatcgtatcgctaggcacatctgtttggttaacataaccaacaaatccacacatgttgtaatcccctttttagcatttatttaccgtttcatgcgacgcatcacgtacgccggcctcacgacttgaacgatcactaaaagatgtcacaagacgtaattcaaaacaatgttcattttatcaaaaaaaccgctgtaatactaggaaacatcgtggcttataacgttttctttaaactcgtctcctgaaagcgtttgcggtataatataagtgaatcaagaatggagtgattttaatggataatcttatattttttaaccctggtgattcaattgccaacttccacgactacgatgaagcagtaaggagtgcccagatctatcgccagaatcacgttcaggctggtcacgtcctggttgttaagggtatggaaagcgaaaagcagtttgacattttcctgtcagataacgaaatttcccatgataatgagttggggaattcaaaaccgtataaggtgtcgaaaaagttctaggtgcaatctaggtgtggaagtgagcgcttagagagcggagtgtaactgtgaaacggtggaagccctggtttttgggggttctaccgttttatagttacatgcagctctctgctcactggagcccgataatgtctaggtgtggaagtgagcgcttagagagcgaagtgtaactgtgaaacggtggaagcccctggtttttggggggttctaccgttttatagttacatgcagctctctgctcactggaacccgataatgtctaggtgcggaagtgagcgcttagagagcggagtgtaacgagaaaatggcggaaaccccgggttttggggggtctgccattttgttgttacatgcagctctctgctcactggagcccgataaaacataggtgcctagaaaaactgtgaaacggtaggtgcccccggtcttggggattctaccgttttttatagttacatgcagctccctactcatgggaccccaatccagctctacaccaattacttcccaagcttcttcgcatacggcaacgacatatctcttccatctgaccgaacacttagaaaatgatcttgatcataacgcacaaacgtcaccggtggcttaacgctaagttgcgcatactcacttgatagtgagagcagttcctcgccactagccgaaagctgataaccaatactgtcaaaaaacagtttaatttccgccttacgtgctcggatacgtaattctgcaacatcgccaatcagcaactgcatcttcaatcattctcctttttcggtaatgtatcgtcaatatagtcaatcgcctgcaatagatggtctttgaacccaattaaatcatcatatgccatggattttgacggaattgaaacaatttgactcgataaatctaaaagcacttgtaaataccgccggtgcaaccgttgagcagccatcggttcacgcctggaaagtctttgattggcctgatagctatcccgaatagcaagccgtaactgatggttaacttcaatcactgcgtcaaagtcactccgctttcgaactgcttcttcaacgttgctaattcgccaacgccactgctgaagctggattaagatagctcgcttagcatctgcgtaattgctaaaatcaatcttacttttgtcgatcgtcgagtgcctgttttcccttctccgttaaaccactgatatagggatctgcgtcaatgtaacctgcatcaataagtggctgcggattaccaccaatcacgttatcgcaatagtccacaaagtgtctcggactagtaccaggttcaactttacctgaggcaattgcatctaaaatattataatcagtaggcgttaattccattttcttttcctccaaattcgatttaaattgagaatagtcttgttcttgttgaatcgcaagtgattatactaaaacgcatgctgcagcatagttgctgtaacatgcgttttatttatggtgttaaatccgccaacgattcacccttttcataccgggtattcaaggcagctgctttaacctcaatgacttgattgtcgttgattcgggcaaaagctaacacctcgttaatcaaacggtcaacgaccgcttgatcttctttttcttcgatcgcattcttagccgctaaaaacttcaatctaggcagaaaataagtgacatgatgttctgaacacatctccacacccttatcaaccaacttttgactcgcctttaactgaccaacagaattgtagtagctagccgtgaagaaaatcatggtcagcaatcgtaagtaattatcgccaactcgattgaagtaaagctgttcatcctttaagacgttgcgaataaacgaatggacctttttaaagtagaaattagcacggtccgcttgttgcagccggttatacatcacgccagatcccacataaactaactgtgtaaagatggtttcatgtgactcatccaaatcgtttaaaatttgcgaaaaatcatacaaaacttcttcaggcgcctgattgatcaacgcacccatcagcccccgtaaataatagaactgcatttttaacagcatggaatccaactgtttttcatcaattgctgaaagaccctttaaaaccttctggtaattttccatcaccaactcccgctcaagcgaatccaaatcctccttgagctggttagcactaactttattcgattcgttcaagtcatcaatggtgaggccgatcctggcgcaaagtttcgataagattttcagtgaaggtacatggccgccacattcaaacttactcagcgttgattgcgtacagatgccctcgcacatcctgacctgagaaatatgcagcgatttgcgtcgctgaacaaattttgcgatatccattgaaatcaaccctattcttattgactaaccgtgaattcctaaggcaacctttgcaaatcggctcatccgatcaatactccatgctggttcccaaacaagatttatatcacagttttcaacaccatcaactgaggtaaccgcttcagtaatcgaatctgctaataaattacccagtgggcaacccatggtcgtcaaggtcatcgtaatcacacagttacccttatcatccactttaatgtcataaatcagacccaagttaaccatatcgatccctaattctgggtcaataacatcttccaacgctgccataactttgttttcaactggcgaaaattgtttttcaacttcttcagacatacgtgcactacctcctcgtgatcatgcaaagtgccctgtcttgcttgtgattcctagaatatcgacaccttgatcattcactcttctgccttaaatcataccataattatgaccaaataagacgcatttcgcgtgaaaaatcgtgatatccgtagtgctcacctgcttaacaagctgactaaaaacagcactgaacgtcatcatcattcaaccggttaccagcaaactattcatcccgttttaacaacatggcagtaagcgtttttaaatcagatttgacttgatactcaggcaactgatcaattaaggctagtgcttgctgcgtcagttcagtagcttccttctgcgctttttcaacaccctgattctcggctaccagctgctgaacggtctgcaaatcagctgaggtcatccgctcttttttagccaaataaggcttaaaagcactcttagcatccgccatggctaaaattaacggcagggaataaacgccagcttttagatcctctagcaccggctttttcgtcttctgcgattgaccatcataatctaaaatatcatctaaaatttggtaggctttaccaatcgtcatgccgatttcacccgctaagttaaccacttgatcatcgctatgactcaggaccgccccctgccgacagcttaaccaaaacaattgagccgttttaccggtaatttcgcgaaaataatccgcttccgtgacgttacgcttataattgagcttcatctgttcaagttcaccgataagaatattgcgcatacttgtgatgtttaactgcagttcggccatatcatgggtcgttttcaaaacttctttaaagtaaaccgtaaacaggtagtccccagcgtaaatggcgtttcgagaaccgtaaagcgtatgtattgttgtgacaccacgacgcaatggtgattggtcgatgacatcatcatgaatcaatgtcgccacgtgcagtaactctaatgcagcggcaccagcacgcaacacgtcgtcatcgttttgctggccaaactcactaaagaggtaaaagaaacccggccttaatagtttgccacccgactgcagtaacgctaatatttggtgatgaatcggttgattgggcagttgtactgcttccaataagtatggttgaagcttctctaaccgtttttctatcctcggaaactgatgccaaagtttgtgaaccatgtgctgccactccccctacttaaaattacccatccacctgatggtcccctcgatgtgccatcatggtgttttaaccatgttaccacatgattgtgaactcatgcatcattagaacattaaaaagcccgttcagccaaaaactaaacgggcttttagtaggcacttaatctgaaagcgacttgatctggtctaaaatattgagcaattgttttgcggcttgttcgtaatccgcaatttgattaccaaactgctgattaaacccgtcaagaccacccgcaacaaaggcatactcgtattgatacacttgctgataagctgccgttaattgcgataataatttcgagtgatctggctctgacagctgcagagcaatctgaatcacccgtaaatccgtataccctaactcaaactgaattgcccaagcgcgcataaactcatgctgagcctggatgtgcagaaaatgatgttccgtattccaagccagacgatcaattgaatcctcgattttaagcattttaaacctccaaagtttgtgacttcgacacgactacgccaacaaaatactcaatttgaaggtttgaagcaagtcattgcacttgctacttttctgatcctaggtggcgcagtgcatgagcgcgattcagcagcgtaaacacactgtgaactaataccgttccaaagaaaatcaccgaaatcaatcgaacggtaaacagtgcaataatcatccagattgagtagtgaatataccccaatttaaagacttcatacgtaaaggcaacgatagtggtggtcacggaagaggtcaataagcttgcccaactccagtttttgtagcgccaagcggcaaagccaatctcagaacccacaccttgaacgattccggaaagcaacgctgcaatgccaaaagtaccaccaaaaataacctcagccgcagcgcccaacacttcaccgacaaccgctgccccaggtatccgagttaaataaatggcaagtggtcccgccatgatccaaaggccaaataaaatttcgttagcaaacggccccacagccatggaaagcacgttgtacaagtaatctgtccccacaaaaatagcaccgaaaatcagagcaatcatggtgattaaaataatatcttgaaggtgaaattgttttttcattgtcgtcatcctttcatgctttaggctgtgaacaccacgtgacgataaaatcagccatcactttagtgtaatcaagcaattgtgatagttgcaccatttcattgtcactgtgagcttgtgccatttgtcctggaccatacgtcaccgcgggaatatgataaaaatcaaaccagccaccatccgaaactgacgttgacatattaatatcaggcgctgctcccagctgttgctcatgactttgcttcagtaactgtaccgctggctgcgtggcgtcaatcgctaatggcggaaaaacttcccctttatctaccagcattgaatcgccaccccagctaaaggttggtaatgtttcttttaaccaaggatcggctttagcagcagcaatcacagcagcctcgatttcttgagtgacctggccaatcgtttcgttggggtaaaaatgaaccgtgatccataatttacactcgttggcgacaaacgcaggatgaacgccgccttcaatataagctggattaatggtgttggttcctgcagggaaacctttgtaggtcttagtgaccgcccaataatgctccagcttctgaagggcttcaatgactaccggcattttctcaaccatactggcagccttcaaaccgccaccggctcgtagcatgttcacccggttgccgtcatgatacgtatgcgggcttttaagtgtgatccagccagttaccacaccaccttgtccttgaaatgccatattgctggtgtcgccaaccactgcgaagtcagctttctcgccctgttccagcaaggttttcgtacccgcttcaccggcttcttcaccaaccactgactggaatcgtaaatcacccggtaaatgaacgtccaactgttttaacaactgaaagaggtacagaaaacaagcgaccgcgcccttcatatcactaacaccacgaccatataattcatcaccatgctgtacaagttggaacggatctgtctgccagtggtcaagatccgtcagtgcagccacatccacatggccgtttaataggagactgtgatggtcactggctgcgtcaccgcttagctgtcccgaaaccagtgaatcttgatcatagaatgattgttgcttaacagtaaaaccggcttctatgagttgctgtttcacgtaattttgaatttccaacgtatttctagccggtggtgataccgtttgaaaggcaactaactgacttaaaatagcgagtaaacttgactgttgctcatcaattgcctgtcgtaattgttgctgtaataccgtcattgcttcatatcccttcatggttcgactcagccatgaacctgggtgaaaccaactaaaaaactcccgaagctagacttcaggagttttacacacgttcaatcagctttcctacgtgagtgctaactctcaggttcaaagggtctggcgtttgccatctcagctctattagagcacccctagcttgtaaacttatcatgtcataattagttgattaatgcaagtacttatcttggttcaaattaaaaaaggaaccgctcaaaagcagtttcttaatttcaacggtgttatcgctccagccaacgcgcaatacttggccagctattcttagtgataatcatccgtggcgctaatttaagatcgttttcgttggtcacaatcccattatttaacgtgtaaatcacctgtaatctcggttgatgaaccaggaagttttgaaccaacggcgttccgctaccatacggataagtaaagatgggcgtcgtttggccagttttctgcttcatcaccttctgactggtagcataatcacggacaaatttcgggtaattacgctttaagttaaacgctggcgtccctttaacaagataatgcatgttattagtatgaacgcccaacgtcattttggtgccctcagaccggtacaatttcataatctgagaccaagtagcaagttgttcgccaccgatatactgaccggttgatcccgtaatgattgaagcggtgaacggatagccataatgtttcatgataggcgctgcattttcggccatcgtccggtcaatgtcgtcgaaggtcaagacaacgtatttaccatgaactggctgattatttttcagcatactgatcatttgtgcggtagaaatcactttaatatggtgctgatgcaaaaactgcatttgttttttaaattcggatacgttcacgttataaacgtggagttgattatttggcgttaaagattccacacttttaaccatcgtgtcattatcgttcagaattcgatgatagcaaaaaaccataatgccatttttgattttggtatcactgcttgccagcgcatagttttcccgggttcccagttcaaacttggtactcttacgaacgttgacggcaaccaggctaatgaaaacaacaataatcaatcctaatatccatttacgcgttgtctttgtcatttgctgccgcctttcgtttaagattccgaatgtggatcacaccgtacacaacgctcagaccgccaataatcaaaatgagattgcctaatagtttatagaggtgaaacgacaaattgaacagcgaataattcacaactaagccatctgaatacaccccaaaaataaagcagagattaatagctaagacataaatggcgaagacccacaaaacaatgagcaaaatcatccgccgaaaccgtgaccaaatggaagtctttttacgaatcaccaatttatctttatccatgttagaccccccgatctggactggcccaggttccttttcgttttggatcaaggaagaaggaaccaagcgcggtaatacagctgatcaagttaacgacccagtagaagacaaaatacatcggcagtaacagtaaatcttgccagtcaatgtagccttgacgctgggaacttgtaaaaccaatgatgaactggacgatactgatcagcgtcagcacaaataagataccgccgtctaaaattaaagcgtgagagaaaatcatggtcaacaaatacaacacgatcatgaaaaagcagctcaacgcccatagattactgatcaccatatcgatcaataaccactgttcagcgagtttacccgtaaagatcaactgtcggttgcgaattaaaacttccaagccgccacgggcccagcgccgtcgttgccggatcaaggcgttcatatgctctggaaccagaatccatgatacagcttggggacaataagccacccgccaattgtgcgagtaaagtttccacgtcatgtcgatatcttcggttaacgcttcaacggtccagcggtgaacttctttaatggctttcttacgataaaccacgatcacacccgaaactgtagtgatatgaccggtaataaaagactgtccccgcttgataatatcgatgattccaatatattccagcaactgcagacggcccaataatgttgttcggttacgaaccactggacgtccggcaaccgcaccgacgtttgagtcgttatagaattccagcatcatgtgctttaatgcatcctggtcaatgtaagaatcggaatccaaacaaagtaggtattcacccgtggcgctatctaagccaacattcaacgcattggccttaccaccgtttttaataattggcaccactttgattggaaactgagactgatattgtttttgtaactcatacatcacgtttaacgtttggtcgacactgccatcatcgatcaaaatcagttcaattttttgatatgttaatcgtgccaccgattcaacaacttcatgtaacgttttttcctcattatgtgctgggattaacaccgacactagttgctccggctccccttttccaggctttttcaaaggaatttgacgctgctgaacactaaaaaagattgcacccatgatccaaacaagtgatacgatcatgggatacaaaactacaaatccactaagtatattcatttaaaagctcccttgacgatattctcgtcgatttctgtcaaatcgctgattgcttcgtcatatctgcttaacatgtcccattatgttagctcaaacaacaactttcacattgtacttacgcaaaacaactccgtcaaggtaggtatcattagaacatgttggacaaaaattaagaacttaattatatcggttatgtaagcgcaaccatcaacgtgatttcaatagattaagaattacttaacttgacagttaacccattttgcggatgtcttttgacactagtcgctaaggttattcttagttagtatctggcagtgaaacgaactttttaggcttgattatcccaaaatcatgcatggaaaagcaatgacttgcacaaagtggctgtgttctgcctcaagatttaccccacatcaacttgaaccgtttgcaagaaaatgtgaaaagtacgcataaaatgactttacaaaacaactcataatagtgtatgattattcttgttgtgatgccccggtggcggaactggcagacgcgcagcgttcaggtcgctgtttgggcaaccaagtacaggttcgaatcctgctcggggcataatataactagtgaaaacgtctagaaataggcgtttttattttgcatatttgtataaatggatagtaaaagtagccgtttgattttaaatctagcttccaaactacatttttaggcttttaatcacccctgacattttcgctacatttctactgttttgtgcctattaacacctacatataggtgtttctaaccaataatggtaaaattaaataaccaaatataacctgtcgaagtgcattatgttcaagaaaatcaaagataagctctatatgcttccatttttcatgccactcatcatattccacgtgtacgaatcctgctgcttcttcattccaataacacatcgtatactccgatcaacactaataacggctggcatattcgcactcctctggcattatcgagattatatcgatttctagtgaaaactatgaatcaaaactaagcagacatctctgctttttcttccagatatttggcatcacaccattatcgtattttactctcagtgtaaccgactcagtaggggtagtccgacatcaacttggactactcctttttgtagtcgcttgccatgatgtaaattaattcaattctaatgtttcaaacttgaatacgacaaatcaattattcaaactcaaatggccagatcgattttacttatactttgtgaatgcattttcatgtatattaaaactaaagatgaaccaatacttttaacgtaaaagtgctacaaatgttgcattgtaaacgttcgtggaaccttgcctaatccaaaaaatctaaactttttttctgatgaattaaaaacatttcaattctcacttaaccttgtcatatcagcacaaattgcgttttattcacttgattaaaatttaattaggatattgtatatttaatcatcatcttgtaattaaattagaaagttttataatttaattttaataactcaaggagatgatcatttgctacagacacttctatttgctttactccctatcatcgtcaccatggctttaggttatttcgcagctgcacgtcactattttaatgacaaagacagcagtatgctggttcgtctggtcatgaactttatgttgccacttagcgttttttctggcatttggagtaccccacgaaaaattatcattaaagatattccgttagcctcttggctgttagtcagcattgtttgctgttacctgatttttttagtcatcaaccgatacttactgcacactgacctacatattgcatcacttagagcgatgtcagtggcagacccttctgttccgtttattggatcggccattttacccttgattttcggtaattctttaagcgccatcaccattggtgtatgtaccttgatcattaatattatcctgttgccagtggtcttcggcgccctcagtcaaggagaatcactaggatctcgggttgtcagcactttacgtaaaccgctggtggctgctgctttactcggctttattttagcgttattgggctggcaaatgcccgaagaactcgctggttcatttgaactgctaggtaaaggtgccggtggtttggctatcttcgcaactgggattattctgtttactcgtaagatcttggttaaccgcaccatcgttgccaccgttttttcgaagaacatccttttccctatcgtcatctggggcttgatgctattactcaacgcgccttcggaattacaacgaatcgtcgtactaacgttggccattccaacggctaccatgccaaccagtcttgccattcaatttaaagttaacgaagctgagctggcttcaacccaattttggagcaccgtttgttcattcgttaccctagcagtattcttagtcgcacttagttagtcaaaaggaggatcagttgcatgtcagaaacatctattacagtaaaaaatggtcagttagtcacacctgatcatcccactattccgttcatcaaaggcgatggcattggccctgaaatctggcaagcggcacagcaagttttcgatgctgctgttaacgttgcttatacgtgcaatcgtcagatcaactggctgccacttctagccggtgaaactgcctataagaaaacggggcagtggcttccagacgaaacactgagcaccttagaccactacttagtgggtattaaaggtcctttaacaacccccattggccaaggtcaccgctcaatcaacgtgaccctacgtcaaaaattggatttgtacgcttgttttcgtcctgtgacgtattatccgggaacaccttcgccagttttacatccggaacgcgttaacatcgacgtttttcgggaaaataccgaagatatttacgccggcattgaagctgatgttaacactgcagaagcaactgatttgaaacagcttttaggtcgttacgatcaattggccaaggtacgttttccagatacggcagcctttggcatcaagccggtttctcaggaaggctctacgcgtctaattcgcgcggccattgaatacgccctcaaccatgaccgtcacacacttaccctcgtccataaaggtaatattatgaaaaaaactgaaggcagtttcaaaaaatggggttacgatttcgctgagactgagtacggtcagcaggtcttcaccatggcagaatatgaccggttaagagatgcccaaggaaaagcagcggcggattctgccttagaaagggctaaagcagagcagaaattgattatcaatgatgtgattaccgataacttcttccagcaaaccttactgcacccagaaaactttgaagttgtagcaaccatgaatctaaacggtgattatatttctgatgccttggccgctcaagttggcggtatcggtatcgcacccggtggtaacctgaactaccagactggccacgcactattcgaagccactcacggaactgccccgcaattcgcgggtcaaaataaaatgaatcctacttctctcattttatctggcgcaatgatgtttgactatcttggctggtctgaagtagcgacgttgattcgagatgccattaaagcagccattgccagtcaacacgtaactgcggactttgccacggataatcaagcgaccgtgttgagtaccagtgcgtttggtacttacgtcgctaatttaatcacctcaaagattactgatgttgatgaataatcagcatctttttttgaaacaaaaagctaatcgctatcccattgaactggaatcaccattagctgcttaaaatgtcatttttatttttcttgatctgttttttcagcaccagcctttttctttggcaatgaaataaccgtaccatagccatgcaccactaaaaacttaggcgcaacactcatccgcacgacttccgtgttaaaagaaacatccacgatgccatcgccttgcttcttctgagcttgttcaaataatttttgcttggcctgatcaaacagaccatcaaacttggaaaattcatctggcttttccgaactgagcatggtggaaaccgtcactgcaacaacgcctttaataatatgggcctgattaaacccaccagtcgacataaacatcttaccgccccctcactgcctcattataccgaagatagcagacattggcatcatttcaggtaaaaacgaattcaaatgcttgactatatccagctcatgttataatttttaacataacttaacctagttggaggtcaattatgagttcgaatcgttctttgcttagttggatcctagccagtcagtttgcggcgattctagtcgtctgttcgaaactgacgattccccttggtcccattccgttaactggtcaaactctggcagtaggtattattgcttcattgctggctagtcgaacgggacaaaaagccatctttttatatttattacttggtttgatcggattgccagtctttgctggtagcgcaactagtttagctgcactgtttggcccaactgccgggtatttatggggcttcttcgcttatgtcagcctcaccgcttggtggttacaaagtcgtcaaaaaactgtcacaacattgttcatcgccaatctatttggatctatcgtacagctgattatgggcagtctctggctcactatcagtaatcagttaagtttgaccaacgcgtttttgaccggcttcctgccatttttaattccagccgtcatcaaaatcgtcatggtggtcgccatcgttcaactgattcagcaacgcgttaacttacctttaggaaatgacgtcaattaataccataaatatgataataatcatctcgactttatagacaaattaggcccaacacgataaaatggcaacaacgaagcaatttagttgcacacgattaatccatccgtgcagcaatcggaaagaaggttcattcatgtcaaataccacgccgcgtcgattagacgatcaactttgtttcgccttctatagcgccagcaaaaaattcaatcatttttatcaggatgctttaaaaccatttcatttaacttatccgcaatacattaccttgttagcactttgggaaacctctccgatgactgtacgagaacttggcagtcatttaaatctcgacagcgggacgctaactcccctgctgaaacgattagaaaaacagggttggatttctcgcaaacgcagtgaacaagacgaacggcaagtcaacgtgtccgttactgattatgcgctggataagcgcgatgaagtctatgcacgggtcaacgactgcatcgatttaatgtcgtttgacggtgtcgattatcagcaactgatcactcaaatccatcaggtaatgggcgaattagatgatatcagtactaaagatttaattcacgaagcataaaatcagattaatttaaataggcgttatcccaatcaaacactggggtaacgcctatttatatccaactcaaaaaactaatgaatcatcgccgccataccaatcatcgcaatcaagttattcagcatgtgtaagccaatcgaggcacctaagttattggttcggcgatacgtatacgccaaaaaacatcccagtgtcatgtaaatcagataactcacaatggtggtacttgcgtgggccaatgagaaaaacacaccactcactatgattggcagccaaaaactgtctgggctaaagaacccattcattaaataacctcgaaacagtaattcttcagcgaagggagacaggaaaatacccgaaaacatcagtaaataaaagatccagtgatcactggaaagtaacactttaatggtggcattattcgctgtctgagactgatgaaagacgctttgattgactagattcaagaccatctcaacggcgattgcacccacaaacgcaatcaaaatcagtcgaagatctgacaacgtgggccaatgccaaaacgaccggtcagacacgcgcttcagactgaaaattaaaccaataatgatgacaatgaaggcaccaatatagaatatcgctaaaacactccgtaataaaatttgcgattgcgctgcgtttcgaatccaaatcaacaccactggcaccgcttcaatcgcgacaaagaacgtcgcaaatagtaacagccgtgtgaatatcgatggctttgccggatcgtttggaagtttaagttgttgcatgtagccacccctgtttgtatgtacggaagtcagcaaaattaacgttgttggctttcctcgtgattttgttccgtctgttttgactcttttttctgtgcagcatttggtaaataaatcaacaataaatacagccccgtcacgatgagcatggaaaccagccaagcggcggtccaagtaacaattgtcagtatgccggttgttacccagttacgcgtcaagtacacagtggtccctatgatcagtgctggaaataacacgattaaaaaataagccaagcccttcaagcgataacctctttttctaaattaatgatagtcctttggcatataacgttccaggatagctgtcatgccatacgtcttaaaactgccaatttcaacgtaattaatatccgcatacgctaatttgacctgccaacgtgcctttaaatccgagggatccacatcgttcaagcgcaactttttgtgtttaaccgatgcaatgaatcccgtataagttttttcggtacgacctggatggatacctaaactaacaacctggtctgccttaaacgcccacttcaatgtggcttttaaaatggagcggtgactaaaatccagttcacctaataatttatccacatgccaaatatcaacgtaatgccgctcacgtgctaacgccatcactgcgaccaacgacttgagataatcggattgtgccaccaattttgaaatggtgttgatcctaacaaccacggcaccatccgttgccccgttttgattaacccgcttcaacaacacaaacttgttatccactgcaacgatatttcccgctaaaaaatgatgctcatcaccataacggaaaattgccaccaaacggcccttcttttgggcagctgccaactgttcttgaattgtttccatatcttttgatcctccgtgtaagacatcgatcaggtccgtattcaccagttgccatttcttctgtgatttaaaggtagcaagattaggtgaatagttcaagtatattgttaccaatctgcatttttattgcaactctggcttaaatttagatatgatggcattaatcaatcaatatgaggtgaaaatatgttaaaagattttaaagcgtttattgctcgtggcaacgtggtcgatttggctgtcggcgttattattggtgccgcgttcacgtcaatcgtgacttcactgacgaagaacttgattaatccactgattggcctgttcatcggtaaaatcgatctctccggtctggttttcagtgtcggtaatgctcactttcgttacggccagtttatcgattccatcatcaacttcttgatcattgcgtttgtggtctttctgctagtaaaagttattagccggttgatgcctaaaaccagtgaaaaggaagctaaaccgtcagcttcagaagcatatttgaaagaaatccgtgatctattaaaagatcgatcaatttaaacaagcacctatttcacaattataagcgttatcccttagtctttacgggataacgcttatttaatagctgtttttcaagctaatatcacactaaaataacaatttctattttaagcttaccgccggaaatttttgccttataatgggcgtaaattatcaactattgggggcaacttaaatggacgcaaacgatgcttttcaaattcacttgcaaaaattaccgccgcaagatgaaaaaacgtttgaaacaatttatacgttgggtaacggacactttggtattcgtgcttctaatccactgcagggaaacagcagtcactttaacggtcaaccaggcatgtttgtgaatggcttttacgatttgactgaactgtcgtatggcgaaaattattcgggttatgcccaaaattcgcaaacaatttgtcaattgcccgatccgcgattcattatttttgaagttgacggtattcgttctgatgaaacaccctacgacgttaaattagtggacaaaaacctggatatgcgtactggggtgttaatggaaatctttgacgtaaaaagcccaactaataagcagtttcgtctgaccctgcaatctttcgcctctcacgcggacaaacacttatttgtgattaaatatagcgtgtcggcacttaacttcaccggtgcgttaactgtcatcaaacagcacccctacattgatcaacaaattaagttccacaccgatgacatgcgcgcttctcaacccgaaaccatgctggaccgaacctttatccgtagcaagctgcctatcatgctcatcagtacccgaaaaagtcaattagcgctgattgttgcccaacaggcgttaaatgataatcccatgcaagtcaatatcattgacgacctgccaagcttcagcaaaactttcgatttaactcaaggaatgtcacaaagttttagtttcgtctacgccatcagtttccctcatccgcttttgaaaaccactttaacccagtcctcctttgcagctgcatcagagaaacgactggcagataaatcatttaagcaattattggatgaatctgcagctaaaatcgaccaattttgggagaacagcgatgtcgaactgtcaggggatgctaccttagcaaagggaattcggtttaaccttttccatctgtaccaagccgcagggagtgacggtctgaccagcattcccgctaagggcctaacggggtccggttatgaaggccattatttctgggacgcggaaatgtttatgctgccctacttcatttataccgaacccgccatcgcaaggcagctgctactctaccgttaccatactctgccacaagcacagcaccgggcacgggagatggcggtagacaacggcgtgatgtttccctggcggacaatcaatggcgaagaagccagcagttactacccagctggcaccgcccaagttcacattaatgccgatattgcttacgctgtcgatacttacgttcgggtcactggtgacgatgattttctgactgactatgggtatgaaattatcatcaaaaccgctcgtttttggttggcatatgggcactgggcaaccgatgacgctcatcaaggtaaatttgtgattgatgacgttactggcccagacgaatacaccgccatggtcagcaacaactactttactaaccggatggcacaaaataatttgagtatcgcagttaagtattctaatcagcttaaacacagtcacccggaaaaattagtcaccttaaacgtgacggataaggaaatcaaccagtttaatcgggcggccgatggcatgtatttaccgtatgatcacgagttaaaaattaaaaagcaagatgatctgtccaccagcaaacccgtttggcccatcaaagagaccccacgagatcaatttccactcctgcttcactatcaccccatgaccatttatcactaccaagtgaataagcaggcggataccgtgatgaccgattttctgtttccaaaggaccaggatgccgctcagcttaaacgggacttcgactattacgaagccatcaccgttcacgattcttcgctatcacgggccatttttgggattttagcacaccggctgcaccatgctgacgatgcctatcactacttcatgcaaaccgtcatgatggatttaacgaactctcagggcaacactggcgacggcattcacgcagcgaatatgggcagtacttggctcagtttaatttacggttttgcgggactgggcttagaaaaagaaagctttaacctatctccagaactgccagaagcctgggacagtttacgctttcgaatctggtttcacggccggcaaatcgaaatcaccattacccaatctgctgtcaccgtcaaattattatcaggtgaacccttacaattttacttgaaacataaaacctttcagctaacaaagggacgccttgttaatcaatttttaaagtaagaacacgtcgtcaatccgtgactcataacagttagtcctcctttttacattaatttactattggttaatgataatcgtaatggttacaaaagctttaagaatacggcattcactatttttcacgagccggttatttgcgatatttgtagcaacactttatcattgacttatgaggcattaagaatcactcataggaaagaggactgattatgagaacaattgcactacgagtcaaacgagactcgatagaattgctgtattctgaaaatgataatcaagaacccttcagaaagttcattatcacttacaatactgagcagacaattggcgataacctggaaaagatcaaggtcgcattggctggtttaaaaatcgatgctgcgattcttttaaactctttagagtatgaattttccgacaccatcgtcggtattaatcacaaccgtatcgacattggcttagccatcaccaacatgatgaacatcccggtagtttcacaaagcgatgtggccaaaaatggcctcgctaaagccgttaaacacaaggaacgctataacgaatggcacttggactacttcggtgagtatgaaaagaagcgtaactatggtcaagaagccatgctgactatcggcaatggctactttggactgcgtggcgcctacgtggaagcccacgctgacgccgacaactatcctggtacgtacgttgccggagtctataatcaactgaccaccaaaatcggtgaccgagatgtgaccaatgaagatctggtcaacatgccaaatgggcaatttttaacctttggtgtggatggtcagccaccgtttacgattaaccaaaaagacattcaagatatctaccgcagtttggaccttaaacgtggcgttctcaggaccgctatgcacgttcagttatctactggccatgatttatcaattgtgactactaaagtggctaacatgcagaattggcacgattatgctatccagtacgccatcacaccgttaaactttagcggtaccttacagatttattccgagatcgatggtaccgtcactaacggtaacgtagaccggtaccaagactttgatcagcaccacctacaaattactggcatgagctcccgcgataacgagatgtacatgactggtgaaactaaaaactcccacattcatttcgttgttgggagtaatttgcgtctgcttaaagctaaaaagcagccaccaattgaagttaataatcaggaaaaccgtctgcaacagattctttctacggacgtcagtgttggtaaaacctacaactttgaaaaaaacgtcaccatttacactgaccgcgagactgctgcggattcgttaaatgaaacggctagtcaagatattgcgagcgcttcatatgaccaaactgctaagcaaagcgaagactactggaaacaggcttggaacaactttgacattaaaattgacacggatattaccagtcagaagctgacccgagttaacctatttcacagtatggtttcggcagccgccattggctcaggtaaactgaacgcttcagttggcgctcgcggcctgcacggtgaagcttatcgtggtcacgtgttctgggacgaaatgttcgtcttgccgttttacacgttacactatccagaattgacgaaacaactactcatgtatcgctatcggcgtttggacgctgcccgcgcctatgccaaacaggagaattacgatggcgccatgtacccatggcaatccggccagactggtgacgagcaatcgcaatttgttcatttgaaccctattacccaccagtgggatccggacaacagtcgcctgcaacgacacgtttcattggcaattgcctataacgtgatcaactacacgcaagtttcaggcgatcacgaattcatggataaatacggtctagaaatgttgctgtcaatcgctaaattctggatcagcgcgacaacctataatgctaaagaggatcgttatagtatcgcccacgtcatgggacccgatgaattccacgaaaactatcccaacgctgatgaaccaggactgaccaataatacttataccaacatcatggtggcatggttatttaactatctggttgaactacagccggaagtccctaagagcactttcaagagtgttcaaaagaagagtgaattcgatgattcactgttcgataaaatgactgatatttcacataagctgaagcttgatatcaataagaatggtataatggcacagttcgaaggttacttcgatctacctactcttgatttcgatgcttaccgtcgcaagtatggtgacatttcacgaatggaccgcattttaaaggctgaagacaaaacacctgacgcttatcaagttgccaaacaagctgatactttgatggcttattacgtccttaacatcaaggaagttgaccaaattctgaatcaacttggttaccatatgccaaaggagtatctgactaaaaacattcagtactacttgaatcggacaactcatgggtcaacgctttcacggatcgtttattcagtactgaccgaaatggacgacaacatggatcaatcttggtcactgtttagtcaagcactgttctctgactactacgatattcaaggcggaaccaccgctgaagggattcaccttggtgtcatgggagccactttaatgattgaaactcgtaactacggtggtgtagacagcttgggtcgtgagatcaacttgcaccctaacctaccggctgaatggcgctcaatttcatttaaacaactcatccgtgggcactggtatgatttcgtcattactcagtctcagattcacgtcaccgcagacgcagattcgaccgttcagttcaagggtaaacccgttgaattgaaagccaatcaagaaaaggtaattgattattaatttcacttaaggagtgtttttcatggcaacttttaagcaaatcaaaggtttcgttttcgatttagacggcgtcattaccgacacgtcactctaccacactaaggcatggcgtcagttagccgaaaagctgggtgtcgcttggaataaagatctagaggaaggacttaagggaatttcccgaatggactctctcgaactgattttgaagaccggtgggaaggaaaacgactattcacacgatgaaaaggttgctttagccaccgaaaagaacacgaactacgtcaacgaaatcaagaaaatgaccccagctaatattttgccaggtatcaaagacttcctggacgatttacgcgataagggctacctgatttcgttagcttctgcttccaagaacggtccaaccgttttgaagcagctgcaactcaccgattacttccctaaagtggttgatcctgctaccttgtctaagggtaagccagatccagaaatctacaccaagggtgctgaattactagacttagcaccagaagaatgcatcggtgttgaagacgctgaagctggtattcaagccatcaatgcagctcacgaaacgtcagtaggtattggtgacgctaagacgctggctgctgcggacgtccgttttgatgacaccgctcagatgacactagctaatattgaaaaagcaatgggttagtttttctaattaaacaaaaaagccactccgataatgaacatcggaatggcttttttacgttaagttgtatcacactctaaacgtgctgcaccaagcagagacttgcatctaaggggcttcggcaaaaatccccaaaaccaggattttgccgaagccccttagactccagtctctaaacgcttgtttccacactctattatctaggtttcaacccatccaacaaaaattcacaaacttcatccgtcgtcttatcaatatccaacggcgtctcactcatgataacgttgggaatcagatagcccacgatcacaccgctagccatccgaataatccgcatggagtcccaatcgaccaactcgcccttttccttatactcgtgaaacagggtatcgaccccgccctgaatcaacttgcttaaccggttcgtcagcgtggtcatgatagccggattcttcaccatttcctgaataaagatcttcatctcttggcgattatccatcgcgtaagtcatccggtctttaaccacgtatctgataaaagattcaaagctatcaaagatactttcatgcagtgcatcgataaattcgcctgcaactcgcggaaaaatatcgtgcataaacggatttaaaattgcttggagcaacccatccttggtcttgaaatgtttaaacacagtaccttcagaaacaccggccaaatgagcaatatccagggtactggtattctcatagcccttttgcgcaaacagcgtcaaactcgcttgcaaaaccttttgctgcttctcagataggtctgtcgttttgatattatccgcgaacagcgtttccacatcagtatgtttcatggcaatttctccaatttattctgtcatttttacctgccattgactgtgctgccaactcgagccaattgtgcttcagcaggatgctgattttcagacacttttgttttttcagctgctaaattcttattagcagttgctaacattaaccgaatccggttcaactggttaacaacggatgtcccaggatcataatcgattggtgcaatgttggcacccttgaactgacgtctgagttccttgaccatccctttacctacaatatggttaggcaggcagccgaatggttgcatgcagatgatgtttggcacaccgctcttcagcagttcaatcatttcacccgttaggaaccagccttcaccagtctggttacccagtgacaagatcttgctagcatcgtcggcgacttctttaatggcttcgcttggttcaaaccgtttcgaagcactcaaagccttttgcatgggttgctcacaccatttgatgacttgcatggcaaactcagcaaaccacttagccttagctgacgcgcctaaatgctgatacctgtaaatttggttgtaaagcgaataattcatgaacccaacaatgtcaggaacaacggcttcggcaccctctttttcaagtaagtgtaccacatcattgttagcaattggtgagtactttaccaaaatttcaccaactagaccgactttaggtttacgaacttcattaagcttaacggtatcaaaatcctgaacgatttcgttgacgttacgcttgaattccttgaaactgcccttttcaatggatggacgaaccaattttaaccaatcttcatgcatcttatcgatttgaccaggtttggtttcatatggccgagtccggtaaaccaccttttcgaacaaatcaccgtataagaaggcaatggcaactcgacgaagcaatggtaaagtcatcttaaatccagatgtctcttcaacaccctgatttcctagtgataatgaaacaacgggcacttggccaaagccagcatctttcaatgccttacgaatcaaaggaatgtagttagttgcccggcaaccaccaccagtttgcgtcatcatgacggcagtattgttcacgtcatacttgccgctttggaaagcttctaccatttgaccgattgagatgattgctgggtagcaggcatcgttattcacgaacttctggcccacatcaactgatttccggtcattcattggcaggttaaccacgttatagcctgaagcctgtaatgccacgtcaaccaaaccatgttggtgaatgggtgacatcattggtaacagcagtgtgtagcccttcttatgcatttctggcgtaaagtctactggcttttcgttttcatgcagcttcatcggcatgatcttccggttttgacgttccttaacagctgctttcagtgaacgcagtctgatccggatggcacccatgttagttccttcatcgatcttcaatgacgtgtacagccggttatactgactcataatttcttcgacttggtcagtatcaatggcatcgatcccgcaaccaaaggagtttaattgaacaaattccaattgaggggttttagcagctactcgtgcggccgcgtaaagccgtgaatggtatacccactggttaaccacccgtaaacctttaacatcgccaaggtgtgcgattgaatcttcagtcagcacatggaacccttcagcagtcatgatttgtgaaataccatggttaacttgtgggtccaagtgatatggccggccagcaagcacgataccgtgttcaccagttgtcatcagcatccgcatggtgtcttcaccacggttacggatttgctgcttgaaatcttctagcgctttataaccagcgtccaaagcatccttaatttcagatttactgatgtcaaatttgctcaaagcatcaaccaggttgttaacagttccctttttatcagctaagttcaggtatggtgaaatcaagtctacttgtccagaagtgatttcatccacgttgttacggataacgttggggtatgattgaacgattgggcagttaaagtgattatctgcatctttgttctcagccacttcataaacaacggctgggtagaaaatcgtcttatagccacggtcgatcaaggcctgaatgtgaccatgaacttgcttagctgggtagcaaactgtatctgaagggatggtttccatacccttttcgtattgtttagcatttccttttggtgatagttgcgcccgaatgcccaagtgacggaagaatgtttgccatagtgggtagttttcgtacatgtttaatacacgaggaatcccaatggtcccacgataagcgagcttctttcttaatggccgataactaaacagtagcttatacttttcggcgactaagttcaccttgccattatcctttggcacacgttgcttcatcccgcgggcttcaccacgttcgcaacggttaccagtaacgaagcgacgaccatcgttaaagacggtgatggtcaacgcacagttgttttcacaggcaccgcaatgcatgtattctttcttgaaactcaaattatccatttggtcaacggaaagcaacgtggtctcgtcgccagccttgtaaccctctttggcaatcaaagcggcaccgtacgcacccattaaaccagcaatgtttggtcgaacgacttcagtatccgcgattttttcgaaagcccgaagaaccgcttcattataaaaggttccgccttggcaaacgatatggtgacccatatcttctacccgacgcatcttgatcactttgaagagtgcgttcttgatgattgaaaccgacagtccagccgcaatatcaccaattgtggcaccttctttttgtacctgtttaacctttgagttcataaagacggtacaacgtgatcctaaatctgaaggatttttagccagcaaagctgcttgagcaaagtcctggatcttatagtgtaacgaggtcgcaaaggtctctaggaaggaaccgcaaccagaagaacatgcttcatttaatttgattgtggataacgcatcgttcttgatggtcatggctttcatatcttgaccaccaatgtctaaaatgaaatcaacatcgggatcgaagtagtgtgccgcacgataatgggcaacggtttccacttcaccaatatctaccatcagagcgtttttaatcagatgttcaccataaccggtgacagccgttttaccaatggtaacgcctgctgggattttactgtacatgtcccgcaggatcatcttggttttctccagcggatcaccatcgttgctatcataatacgtgtagagaatcttgttatcatcactcattaaagcaacttttgtcgtggttgaaccggcatcaataccaagaaaggcaacaccctgataacttgccaagtcacgagtttcaaccttggcttgcgcatgacgtttccggaattcctgcaattcattgtcatccttgaataatgggtccaacgaatgacttggatgcataccagaatcatcgccgttaagtaactgatccaataaattgtttaaagtcgtctctggttgatcaaaggcgtacaatgcagcaccctttgccacaaataattgtggatcttcagggaaaacgacttgttctggtgttaagtttaaggtttcaatgaaccggtaacgtaattgatccatgaagtataatgggccgcctaagaaagcgacgttgccccgaattttgtgaccggcagctaaaccagaaatggtctgattaaccacggcttggaaaattgacgctgcaatatcagcttttttagcaccatcgttgatcaatggttgcacatcagttttagcaaacacaccgcaacgactggcaatgggatagatagtctccgcatcctttgccataatgtttaaaccattagcgtctgtcttaagcagtgtcgccatttggtcaataaaggccccagtaccaccggcacagctcccgttcatccgttgttccagtgaatcaccaaagaaagtgatcttggcgtcttcaccaccaagttcaatggccacgtcagtttgagggatcaaggtttcaactgttttggtgcaggcaatcacttcctgaataaactttaattgaagtaaattagccagtccaataccgcctgaacccgtgatcgtgcaagcaatttttacatccgcccctaattcagaaattgcttcgcggaagattttttcagtggctgctttaacgtcagaataatgtcgttcgtaacgtgagaaaacggtttggttgtcttgatccatgaccacgagcttgactgtggttgaaccaacatcaataccgccaaaatatttcgtctctgtcatttcactcacctctacttgtctgataacgcaacgtctggacttaatgagttgcattatctaccgaataacctcgctttactcaataaagtaaagtgactactcacttagattaaaccatgattgacaccggtttcaatagcatattaatttattaactttatacataaataagttggaattttttgccggaatatgcttggaatattattcttaaacagagtgtggaaacaagcgtttagagactggagtctaagggggggtttggtgaaaatcctggtcttggggatttttgccaaagccccccttagatgcaagtctctgcttgttggagcacgtttagtagagcgacgcacaactcagtaaatttccgtattcaaaacaaataatccccgttctgataatgttcaccaaaacgaggattataagtaaaaataggaatatcccctacttaattaaattgaagtgtttcaaaccgttgacaatcccatcatccatattggaagtggtaacgtaagcagccttctctttagccaacttgtgaccattagccatagcaattggggtatccaccatatcaaacatctgtaaatcattcagctgatcgccgaaagcataagtatgaacgttctccaagtgagctgcctctagtaagatttgaatcccagttcgctttgaaacaccagcattcatggtatccaaagcccgtggattattccgaactaacgaaagtactcctttaaagcgttcttgatattgttcttccttatcttcattaaagacgttcataaagttgattttttcatgatggtagaaatcagggtccactttagcatccaaacgtaacagtttgaagttttccttcgtggcatcattttcctggctcagccggaatccgcggttattaaagtaccccactggatcaccttgctggttagcataatcagtaaattcatcgaggactttttctgggatcacttcttggtgaagctttttaccttgatactggacgtaactaccattagcactgacgatggtatcaagaccagtttcgtcaaggacgtattgcacttcaaaaatattacggccagtggaaataacggaaagaatattattctttgacatctgcttaatagcatcaatgctacttggcagaacgttcttctggtcatcaaataaggtcccatccagatcaaaaaatacgattgcatcatacatcattcatgcatcctcctttatccgttacattcattatactacgagtgattttgactctgggttatgacgtcttatcaacaaatcgatcttccaaaagccacgtttctaggggggtaaagcggttactatttaaaaaaataaaaagaacatgtagtatccatagaatctatggtacactatatgttgcatattttattaaaagaggggctattatggtgattattacagccggaatgattggtgttggaaaaacaactttaactggaatgcttgcggaacacttaggaaccaaagcattctttgaaccagtgggcgaaaacccagtactacctttatattactcaaatcctaagcaatacgggtttttactccagatttatttcttaaataagcgtttctccatgatcaagcaggctctggccgatgataataacatcttggaccgttctatttacgaagatgccttatttactaaggaaaataacgcagaaggtaacattagtgataccgaactgtccgtttaccttaagttattagacaacatgatgaacgaactgaactcgttaccaaagaaagcaccagatctgctcgtttatgccagcagcgattttgaaacgattctctaccggatcaaaaaacgtggccgggattacgaacaaatcgatggtcatcctgaacgagaagcttactactacaagatgtggtcagcttatcaaaaatggtatgatgattttgatgttagtcctaagatcaaaattgatctgcaaaaatacaaccttgaagatcctcagaacgtacaagttgtcttaaaccaagtcgacgaagcgctcgctaagattagaaatactgactccatctcaaacgcgatgtaacctgttaaactaaaaccggctccgatgcatgtgattatgcaccggagccggtttaatttattttaaaaaacagttagttgctgattatccaaatcagtccgaacgattaaaacgtcagcttgggcattggccacaacgtagcttgcattagaccccatcatcatccgttcaaccacgttagcaccagtggcaccaatgataattagatcaactcccaacaagtgcggcagatttttagccagttctagtttgggattaccaaacgtgacatggatttcaacttgtttaacaccatgctcgattgcttggtcacggtagcccgcaactagctgatccattttacgtttaaactcgtctaatacttctgggtccactgcaccaaaaccaaattgagacttgccaatactagtcagtttactaatattcagcacactgacaatataaagcgttgcctgatttcgtttagcaatcgcaatcgccttttgaacggctcgcttagcctgctttgagccgtctacacccaccatcacgttttgataattactaagctgtgccaatgtcaccactccttagtctggtaattcgtttgccagcgcctcaattgaacggccgtaaatcgccatggccatcattaaatcagaaattggttggaactcgtccacttggtgcatggtatctggcgtatggtccatgaataacgcgccaaatgccacaccccgtttcatcaaccggccgtacgtaccgccacccacaacttccggcttagcggctttcttgccagtcatttcacgataagcatccattaaagttgtcacaatgggatccttagggtcaacgtagtgcggtaccatctcacggcccttacttaattcaaagtggttttgatcagccacttgggtcagtttcgtttgaagatcatcggcagtcatccctttaggataacggaaattcaatacgattttccctggttggccagcttcaaagtccataacaccgacgttcatggtcaaatctcccataatgtcatcggtaaacgctaaaccgagtttatgcacgcgagaatcatcgtgaagattaccaccaacaagttctaggaacgagcgtgcatcaccaccgaaagctaaagttttcaagaatgatgccaaataagtaccggcgttgatgccgtttttaggctccataccatgtgctgctttcccgataacatggaaatgaacgccatccgtatcaatatgaacatcaccagtaactggcgcttcatcaagaaaggcagtaaaggcacttaccaatgcttcattatcatccgtttcaacaactgcatgagcatcccgtggcaccatgttttcgcgtagacccgcactaaactggttcaatcggtaatcgccgtcgtttgagccctgcgtcgtcaacgtaaaggtggcgttccccttttcaccgttgatcaatggaaattcagcatctggcgaaaagcccatggttggttctggctgcgtctcaaagtaatggttcatgccagtccagtcactctcttcgtcagtgcccagaatgaaacgaactttcttattgagtttaatgccctgttccttcaaaatctttaagccatagtaacatgccagcgccggccccttatcatctgaggtcccacgcccgtataaattaccatccttttcagtcagggtaaacggttccgttgaccaaccctcaccagccggcatcacgtcaacgtgagctaggatagcaatggtttcgtcaccttcaccatattccacaaaaccggctaaattatccaggttagtggtcttgaagccatcacgctcagccattttcaagaaggcctgaagtgcttctgctggtcctggtcccaatggcgcgtcagccgttttttttgaatcgtcacgcacactttcaatggcgatcagcttcgttaaatcatctacgtaagctgcttggtgttgcttagcagctgctttccaatcaattgacatttgagttcctccaatattggtttctcacgtactattctagcatataacgaggtttgtgaggagcaaactgctgggcttcagctaaattacaccagacttagacgcgtttgtctgaaagtatacctatcgaaattgaataccgaaatcaatcacagatttaaatcatcatgctatactcaagttaagtatttaattataggaaggcgataatcgtggaaacactcacaaacgaaattctttctcaaaccattcggattcggccagaggaaagtcataagggcacctatggtcgggtatgtttggttggcggtaatgatcactttggcggtgctatcttaatggcaactgaagccagtgtgtacagtggggctggtctaaacactactctaaccgattccagcaactttgttagcctgcacgccagaatgcctgaagcaatggttgctgattttaccaatcacgccgaattaactgacttggtctcatctgccaacacagttgtagttggtcccggattgggaacaacgtcccagagtttaagcgtgcttcaaactgtttttgacaccgttagccctactcagacactgatcattgacggatcagcgattaccctagtttctgaaaaatcccttaaactacctcaggcaaacctagtgtttacacctcaccaaatggaatggcagcgactatccggcattaaaattgccgatcaaaccgatgcggccaacgaaaccgtccggcagcaactcggtggtactgtcgtccttaaatcacatcaaaccaagatctacacaccaactggcagttatttaaacactgctggtacgccggctcaagcaaccggtggcatgggtgatacattggctggtatgatcggcggttttacagctcagtttgagaatcaaacaaatgccgttctagcagcagtttacgcgcatagtgcgattgcggatgaactagccaaaacgcaatacgtggttttacctacgcaaattattcatgaattaccacggttcatgcatgagcatcaacactaaaaagcttcgccatttcccgtttcgggagatggtgaagcttttattttaatctttatttgatatgcaacatcgttcttaatcgtctcatccgatcacctaagaccgtatcagctaaccgtgtgcgaagaacaaggtagacgtacaggtatcctgcaatcccaactgcaataaccaccacgattaaactaccaacacgtgagtcaacaaccataaacgtggccagtaaatgactcactaattgaaccaacaagtaagccacaccgcacataagcagtgagaatgccaagacaccgttcaccttcttggaaatagctggaaagtcaaccccaaaggatttattcagccagtttaggatcaaaatattagcaactaagaagccaagcgtggtcgccaccaacggaccaaagacacccatgtaatgaatgcagggccactgcaatgccagcttaacaatggtgcccaccgcaaagtaacgaaccgcacgtttattctgagaaactccttgcataatagcggaagtgacgctgaatagacctaacatgattgaaacaaaggctgaaaaggccaaaacggcagtggctaaatctttgtgagatgtcccataaaagatgatgttcaaaggatgggcaatagctgccatccctaaagcgctaggaatcatcacaaacgcaaacaacagcatagcgttcgtcagctgatggctgatatcttcacgatcattgcgtgtatacgcttcggacagtagcggaacaacggtaatcgctagtgcagaagacagcgaaacaatgatcatgatcaacttgttggcgttaacactgaacatggcgaacaaattgttcagcatcaccgttgaagtaattccagtaccgcgcataaaattaaagaaagtgtattgatcgatcaactgaaaaatagtgataccagcgccaagcacgatgaatggcaaggcttgctgcaaaatttcttgataaagctgcttcgctggaacgacaatttcatttttactatttgccaccaacgaattaaacgtcggtcggttcttaagataataccaagctagcgtcaaggtccccgcaatcgcacccacacaagcggcaaaagttgactgggaaacagcggtcacccagctaccatgaagcacccgcataatgataaaagcggagcctaacatgtaggctacccgagcaagctgctctacaaattgcgaaatggcagaaggcgccatttgctgatacccttggaaaaagccacgagaaagactcatcactggaataatcaaaactgcccaagccagtgagtgcagcacgggtacgacccgtgcatcaccaccgtcgaacattggtgcaccaaaatagagtaacgctgcacaaaccaggcctgtcagcgcagctagaataaagccatgcttatacagccgaaaaccaaccccgtattcgttcatagcgttataatgggccacttgtttcgcaattgccgatggaatccctgcaatagccgcaatcagaaagaaactatatatgttataacccttcccatagagtgcattaccttggaaaaagtaactgccaaaccagattccccaaggaatgatgtagacagcaccaagtatccgggagaaaatactgccagcggtcatccaagcggacccagtaaccatctggtcttttgaatccggcaccgtgttgccgtcttcattgtgatttgacatctcagtcattaaaaatacctgctttcattcgtccattttttgcaaattacattttattttaatatttttttgagtattgagcaatgctttctactgaagtcgttcaatctcctacaccataagctttaataataacagttttatagctggtcacgccaatttttacacttatttaataatttaatcgctaatggcaaaataaaaacacgctgatttctcggcaaggaaaaatcagcgtgtttttgtttaactcttatgccgccgtgttaacaaatcttgttactgtccaatcgcatgaaagccaatgtcatgccggaacgtatagccacttttatcaacgttagcatccagcacagcgttaactttggtttgagcagtttgtaaatctttagctttcgtagtgaccatgaggactcggccaccatgactgacaatttgctcaccatcttgactaactccagcatagctaatagttacggccgaatccttaataactggtaacggacggccattcacaactgagcgtggataatcacgagaagccacaaccgtacccagatagaattcaccattttgccattcggccacgggttgcttcccctgttttaattgcagaatcagggctcccaaatcactctttagttgcggtaaaaccacttgcgtctcgggatcacccattctgacgttaaattcgataactttaatactcgctgccgtattgatcaatccggcgtacagaaaaccgctaaacggtgtgccagcatcggccataccagataaaataggtttaataatttggtcgattgccgcctgtttcagactagcatcgacgtgcggaactgggctataagcacccataccaccagtattagggccttcatcaccgtcgcctaaccgtttatgatcctgggcaatcggcatagtaatgaaagtagtgccgttaaccatagcaaagagtgagaattcttctccttgcagatagtcttcaaccagcaattttttagacccggcagtcaataatttttcgactgcatcagtcgtctcctgtgtagaattggcaatgataacgcccttacccgcggccagaccatccgctttaatcactaacggcggttgctgcgcctgcacgtacgtcaaagccgactttaagtccgtaaactcctgataactagccgttggaaccccactattttccatcatctgcttagcaaacgtcttggatgactctaactgagctgcttgcttatttggtccgaatattggtaaatttttagcctcgaaatagtcaacgataccggctgataaaggctgctctggtccgactacggtacactgaatatgctgtttttcagcaaattcagcaagctctgagaacgccatttcgtcaatcgcaaccgtctccaccctgggaagcttagccatcatgacattgccaggcgctacgtaaacttgacggtccgacactttagccagtgtctgagccaagacatattcacggccgccaccgccaaccactaaccaattttccatgtcattgcccccaattcaatattagtgcttgaagtgacgtacaccagtaaagactaatgcaatcccgtattcgtcggccttatcgatggatgctcgatctttaatgctgccgccgggttcaacaatggctttaataccatgttttgcagcgtattcaacacaatcgtccattgggaagaacgcatctgatgccactactgcttcatcgtagcccgacttttcttcagctttgtccaccgcaatcttcaaggagtcgatccggttcatctgaccggcaccaacgcccaaggtttggttagcagtggtgacgacaatggcgttactcttcacgtgtttaaccactgtttgcccaaattccagtgcctttaactgagcttgtgttggttgagccttagagacaactttgaaatcactagcagtttcatgaaccgtatcagcatcttgatacaaagcaccaccgagaaccgtgaccatatctttttgattaggattcatcttaccaaagtccagggtcatgattcgtaagtttttcttcttagccaaaaccgcataagcatcgtcatcgaaagccggtgcaataataatttctaggaataaaacgtgcatcttttcggccgttgccaaatccactttgcggttcaaggcaataatgccgccaaaaatggaaattggatcggactcataagctaagttccaagaagtcagcaggttgtcacttaccccaattccacacgggttcatatgttttaaagcaactacagccggtttgtcaaaatcagcaatgattcgcaaagcagcgtcagcatcccgggtattgttgtaagaaagcgccttaccatgaagttgtttggcattagccagtgaataatgatctgggatcggttccttataataagcagcagcttgatggctattttcaccataacgcatatcttcaactttttcgtaagtcacagtcagtttatctgggaatggttcttcagtcatatatttagcgatcagtgcatcataagctgccgtctgacgaaagaccttagctgctaaatgccggcgataagccttatctaactgatccgcgtcaaatcgtttcaaaaattctgaataatcggcttgatccgtgattaccgtgacatcttgaaaattcttggcggcagcgcggagcatcgaaggaccaccgatatcgatctgttcgattgcttcggcatccgtcacaccgtctttttgaattgtttctttaaaggggtataagttgacacaaatgagatcgattggttcaataccattttcctttaatttagccatgtgctgaggattatcccgtttcgctaaaataccagcgtgaatccgaggatgcaaggtttttactcgcccatccagcatttccggaaagcccgtcacgtcctcaacgggggtcgcttggacaccaccgtcaaccaacgtctttagggttccgcctgtagaaataatttcataaccgcgcttggtcagttctgaaccaaattccacgatgccagttttatcagacacactcaataatgctaatttagccaaattaaagcactcctttttcaattaattgacgtactgttttcgggtataactgatgttcaacagaatgaatcttagcttctaaagttgctagtgtatcctgatccgttcgtgaaaccgcctcctgagcaataatctcacctgtatcgaccccgccatccacataatgaatcgtcacaccagttaccttaacaccggcatcgtaagcatcttcaatgccctgacgacccggaaatgacggcaataacgcaggatgaatgttaatgattcgccgcggaaacgccttgagtaaggttggtccgacgatacgcatgtaaccggccaatactaaaccggtaatgtggtaaggtgccagattttgcaataaagtttgttcccttgacgctttattaacgcccttttttggtaatgacaggatcactggaatccgatgattctttgctcgctgaatcaccggtacatccggttgatcacaaactaaaacacagattttagctggtagatcagcgttgactaacgcttcaaaattagtcccgttgccggaagcaaagatagcaatccgagcctcattcttgatattggactggttgttcacgtcgcttcaccaccttaccaatcatttggtatgccgttttttgattatctaaaactgctgagacttcatcaacctccgctggtgagaccaccaaaaccatcccaatacccatattgaagacctgtcgcatctctgctgtagtgacttcgccagcagtttgtaaaacgttaaaaatcgcgggtacctgccagctattaggatcaatcaaagcagttaatgttgctggaatcatgcggccaaggttatccgccagaccgccaccagtaatatgcgccatggcatgcagactaccagtctgaatcaagggataaacttgtttataatacaattttgtgggggttaacaactcgtcaatcagcgaatgtttcaacccagaataaacctggtttaaattcaaatcagcgtcttgaataattttacgaaccagtgaataaccattggaatgaacaccactggagcccaagccgatgagtaaatcgccttctcgcacgttcatcgaaccaagcaagcggggtttatcagcgataccaaccgcaaaaccgcttaaatcgtaatccgctgagcgataaatacctggcatttcagccatttcgccgccaatcaatgacaagccggcttgttgacaaccttcagcgatgcccttaacaatcgtcatcaccttgtcaggctctagttcacccaagccgatatagtccagaaagaataacggcttagctccctgtgccaacacatcattagcacacattgcgacgagatcgataccaatcgtagcgtgcttattggcttcgattgccagtaataacttggtaccgaccccatccgtaccagagatcagcactggctgtttaagctgactaacctctgaagtcaattcatattcagcgccaaaaccacctaagccacctaggacattggcatcgtgcgtttgactaacgatggtcttaatatcacgaactgcttcctcaccagcgtgaatattcactcctgcttgttcgtattgactggtcaaagtttattcgctccttcatataatcctagacgtgcaacttcagcatcaaagccggcctggtaatcgtaaagtggggttggatatttaccatcaaagtatgccgtacatagaccatgattaggttgatcattcaagtcaccaatggatttaactaacccatcaacactcaagtatgccaaagagtcagccccaatcatctggcaaatttctggtacggaatgattagccccaatcagctccttagtcgtttgaatgtcaataccataatagcaaggaaactttagaactggggaagcaattcgcacgtgaacggacttggccccggctcgtttaagtaaaccaacaatgtagccactagttgtgccacgaacgatggaatcatcgaccaacacaatgtccttacctgctaccacggatctcacaactgataatttcatgctgaccccgcgaactcgtttggcttgcgtcggttcaataaaggtccgggcaacgtactggttcttgatcattcccatatcgtaatgaatgccactggcttgcgcatagccaattgcagctgacagagatgaattcggtacaccaatgacaacgtcagccttaactggtgcttctttagcgatggctgctcccattcgtttacgggcttcatggacactaattccccgaatgactgaatcaggtcgggcgaaatagatatattccattgaacaaatcgataaatgagtgtcagtggtgaaatgatcaatagtcatgccgtcatctgtcacaataataacttcaccaggctccacgtcccgtacgaatgtggcgccaacttggtctaacgcacaggtttcactgcaaatgacgatggcaccgtcgtccattttaccaattactaagggccggaaaccatttggatcaagggcagccaccatcatcttgggggtcattaacaagtaagcaaacccaccccgaagctgatttaaagatgctttgagctgttcaataaaattcttttgggggctcgtttgaattaattcacccagcaattcactatcggaagtagcttgaaactggacacctttttctttcaattcatgtcgtaagtgtgtggcattggttaaattgccgttgtgggcaagcgcgaactgtccctcagccggatgatcaaaatacatcggctggatatttgcaatcccgtgatttcctgcggttgcataacgaacgtgaccgattgcagcgtgaccaggtaaagaagtcattttctgaggatcagagaaaacttcacctaacaggcctaagccacgttgacggtgaaactgaccaccctgattactcacgatgcccgcgccttcttgaccacgatgctgaaggctgtgcagaccatcgtaggtcaactgggccgcattgtcatgcccccagataccaaacagcccgcattcttcgttaagtccttttatttcattaggcatcctagagcacctccgaaagtagctttaagatcagcgcaactcgctttcaattcaccatcagcagtcgtgaggctcacttgatcttgatcagtggtgtgtcccagtaaaaccgcttggttacctgccaatgcttcaaacttggcttggtttcctgcgtctacgctgacaataaagcgtgactgagtttcgctgaacaattgtgcattcgttaaactggttcgaccttcaaagcccagactagaatcgaataacgcctctgccagcgcaacacctaggccaccttcgcttaaatcatgagcactctcaagcagattttttcggatggctttttgggtcagttgctgatgagctgtttcggcatccaaatcaaaattcagttgaccggttggcggtacttggccctgtagcttctggagttctgagccagcaaaatcatcaccagtatcaccaatgagatacactgcgtcgccagcatgcttaaacgattgagtcgtaatgtagttaatatcttcaatgagtccaaccatgccaatcattggcgttggataaattgaatgcccatcagtctcgttatacatagacacatttccggaaataactggtgtatcaaatcgttcacacgcctgagcaattccttgaactgattgatccagttcccagtagctctcgggatcatccggactgccaaagttcaaacagtctgtaattccaattggaacaccgccgctagcaacgatattacgtgctgcttcactaaccgcgatttgaccgccaacaaagggatcaaggtaaatataacgcgcgttgcagtcagtcgtcatggccaaggctttcttagtgtgacgcactctaaccaccgctgcatcactaccaggtgttaccgccgtgttcgcttggacctgtgaatcgtactgtttatacacggatttcttagaggcaatggttggctgagccagtaaagctttcaacgtctcagccggatctttaatcgttggtgtttgagctggctgactgttttccaaacgtgctggtttacgacttggttgctcatgttccacaacgtcatcgaccaaactggttaccggaacatcagtcactaactggccatgctgataaagccggtactgtcggtcatccgtaacgtgaccaactaccacagcgtccaaatcataccgggcaaagatatctaaaacagtctgttcttcacccttcttgacacacagcagcatccgctcttgggattctgataacataatttcgtaagcactcatccccggttcacgttggggaactaaatccaagttcatggtgacaccgcttttagcttttgatgccatttcagctgaggatgacactaggccagcagcacccatatcctgaatacccatcaaaatttcggcgtgatcatgaataatttcaaggcaggcatccgtcagtagtttttccatgaacggatcaccaacttggacggctgaacggtccgcctctttttcttcactgaattcgtttgatgcgaacgtagcgccatgaatcccatcacgaccagttttagcaccaacgtaaatgatgctgttaccagttcccttagcacgaccttgtttcaaatcagcttgatccattaagccaacacacataacgttaactagcggattgccatcataaaccgcatcgaacccgatttcaccaccgacagttggaatcccaatacagttaccataagcagcgattccagcaacgatttcgtttactaagtaacgattcttgggattatccaactcaccaaatcggagactatctaatgaagcaatgggcttggcacccatagagaaaatgtcgcggatgataccgccgacaccggttgcagcaccttcaaagggttccacaaaactgggatggttatgactttctgccttgaacaccactgcttgaccatcaccgatatccaaaacaccagcaccttcgccgggaccttggataactcgagaaccatcattccaaaacttccgcagaatgggcttagaattcttgtatgaacaatgttcactccacataaccgcgaataaaccggtctcagtataatttggtaaacgaccaattaacttttgggcaatgtaatcatattcctgctctgagagtccccaagcttcatagggtttttgttcacgaatttcttctggtgttagttccgtttttagttgctgcataccctcttacaccgtccttaaatgagcttgtactagtgatttaaatactaataggccatccgtgccaccctgaatatcctcaactgccctttctgggtgaggcatcatgcctaatacattaccggcttcgttagtaataccagcaatgtctgatacactgccgttgggattgttctgatacgtgaacgcaatttgatgattttcacgtagtttagctaaagttgcgtcatcacagtagtagttaccttcaccatgcgcaatcggcaatgtgatctgctgctgatcttgaaaagccgatgtaaacattgtccgattgttttcaacccgtaatggttcgggttcacagataaactgcatttgtcgattatgctgtaaggttccgggtaacaacccagcttcggttagaatctggaaaccattgcagatgcctaagacaggtttaccagtttgtgcaaacgccttaacggctggcatcaccggcgcaaactttgcaatggcaccgccacgtagatagtcaccgtaagaaaaaccaccaggaatcaaaacgacatcaaaacctgataaatcagtggtcgtatgtggcacaatagttgcagcttcatgtaaatcatcagtaatggcataatacaggtcttcatcacaattagaaccgggaaaactcaccactgcaaatttcatcattgattagccagctcctttatatcataacggtaagtttccatattcggattagctaacagttggtcgcagattgcttcaatttgtctttcggcttcatccgctgtggaaacatccaaagtaatttcaaagtacttaccttgtcgaaccgccgttacctggtcaaatgctaaacggtgcatagcatctttaattgcaacggcttgaggatctaagattgagggtttgtaggtcacgtgaacttgggctaagaacatgttttgagcctcctatttagctgtagctttcagacgtgaaagaacggtacggtagccatccattacatcaccggtatgttttctaaagacgtctttatccaatgattcatgggtagttgcatcaactaatcggcatgaatctggtgaaatttcgtctcccaggatcaagttgttatcagcgtcaaaaccaaattcaactttaaagtcaactaaggtgatacctgatgcggcaaacaacttaattaaggcctgattgattttaaagacttggtcacgcatgatgcctaactgttctggcgtagcaatctttaatgcgtgaatttgtgaatcgttgatgaaaggatcgtctaaacggtcgctcttgtaataaaattcctgaactggttgttcaaatgcctgcaggtactcagtatcaaattttctttgaaaactaccagaagcgtaatttctgacaacgacttctagtggaatcattttcatttttttaaccagttgatcactagcagatagccgcttgataaaatgcgtagcaatgccaagatgattcaaatattcaaaaattaagctatcgatttggttgttaacttcacccttatcgtcgatatgctcttttcgtttgccgtttaaagccgttgcttggttcatgtagtggacttggatcacattaggatcatccgttgtaaataactgttttgctttaccttcattaatcaatgttgccaatctttccagatcctttctgattatctaaactgactcacagatgctaacaatgactcaattgacggtcccgtcaccgtgatatgtcccatcttacggcggtcacgaacttcggctttgccatagtcgtgaagatgccattcaggatgtgtgggccagtcagtacgggctgtcagtaaatttttacctaacaagttaaccatgaccgcgggttcaaactgccgaattggtggaatcgccaacccgcaaatacttctgatatgagcatcaaattgagaaatattgcaggcttcaatcgaataatgaccggagttatgtggtcgcggtgccaattcgttgatcattaactcgcccgaagataattcaaacaattcgatacctagtacgcctcgtaggtttagcgcttctgctgtttggatagcaatatgctgcgctttgctcttcactgcatcagtcgtttgagctggaataatactggtgtgcaaaatatggtgctgatgccggttttcacttaccggaaaagtaatcacttgatcttgcccatccctagttaccatgactgataattcgcgaacgaagtcttgtttcaattcatagatccattcggtttgttcaatttcactttcaatcaggtgccaatcagtctgttcgttaatatcaaactggccgtgaccatcgtagccgccttcaaccgttttcaatagcccaggctgaccaattttttgaatcgccgcttgcagatctgccatcgatttcactgaagcaaagggtgttaccggtaatccatgctgccggcaaaacgttttttctcgtaaacggtgactcgtgatggttaataactcaaccccttgaggaattcgggttagattttcaacttgttttaacgcggtctgatccacgttttcgaattcataggttaggacatcgctttgctgtgcaagttgcgttaacgcctttaaatcatcatattcagcaacaatttggaagtcagctacctgacctgcgggagcatgatcagttgggtcgaggacgccaactttataccccattgccttagctgacaacgccatcatctggcctagctgtccaccgccaataataccaattgtcgacggcggtaaaattggactactgtaattggtcattactttcagtagcctcctttgtttgacgagttcgaaaggctcgtaattgagcctcaacgtctgagtcttgcaaagcaatgatctcagctgctaacaaggctgcatttttagcaccagcgctgccaatcgcaactgtcgcaaccggtacgccagaaggcatctgaacgattgaaagtaaggaatccataccgttcagtgctttagattgaatcggaatcccgattaccggtaacgtggtattagctgccagcataccgggtaaatgcgctgcaccgccagcggcagcaatgatcacttggtaatgttcgtcttttgctgtttctccaaaatgttgcagttcacgaggcatccggtgtgcagatatcacgtgactgtcgaaactaatgtgtaactcgctgagcagatcagccgtagtcttaacttgtggccaatcggaaatagatcccattacaagtgcaacttgcattatcaaaatctcctttgcctttgatactcatagagtaacaacagtttggataactgtcaacacaaaaatcgaactataacatcacttgtatatttaatgttcgtttttaaaccgttttatgaacttttatttgcttcatttttggtaaaaaactgtaacagaaaaaggacccgattaaccgccaattactgacgatcaatcaggtcccttagtcattcaattttaacaaatcaaatcgtgattattttccaaccacgatattaacgattttctttggtacaacgatcacttttttaatatcatgaccatctgtaaagctcttaacagaatcctcagctaaagcagcattcttaaccgtgtcattatcagcatcagttgcaacagtgacgtggccccgaactttgccgtttacttgaacagctaattcaatgctgtcaacaactagcttagattcgtcataagttggccattttgcataggcgatggtcttatcgtgacccatcaatgaccagagttcttcagtaatatgtggtgcgattggcgccagcatcttcactaagccttccatgtaaactagtggcagactatcagctttatatgcttcattaacgaaaaccatcatttgagaaatggccacgttaaaccgaagttcagacatatcttctgtaactgtcttaacagtctggttgtaaatcagatcaagtttaccgtcgttgatagtagtgacccgatcacgcaaatgattattgtcgtcaataatcaaccgccatacacggtcaagccaacgataagcaccggcaataccctcagtactccaaggcttagaaccttccagcggccccatgaacatttcgtagacccgcagcgtatcagcaccgtacttatccacgatttcgtcagggttgataacgttccccttcgacttagacatcttttcgtggtttgtcccaagaatcattccttggttaaccaacttcaagaagggttccttggttggaacaacaccgatatcgtacaggaacttgtgccagaaccgggcatacagcaaatgcaaaacagcatgttccgcaccgccaatgtagaggtctacaggcaaccaatacttcagtttttcaggatcagcaatcatcttatcgttatgcggatcgatataacgcaagaagtaccacgaactcccagcccattgcggcatggtattcgtttcacgcttccccttacggccattcttgtccactacgttaacccagtcatccaggtttgccaatggactttcaccagttccagaaggttctagctgcttagttgcaggtagacgcaatggtaattcgtcttctggaaccaaagtcgtttcgccatcttcccagtgaataacgggaatgggttcgccccagtaacgttgccgagagaagatccagtcacgcaaacggtagttgaccttcttcttgccggcatcatgttcttccaaccagtcaatagcggccttgatagccgtcttcttatccatgccattcaaaaagcctgaattgatatgcttaccgtcaccggtataagcagcttcatcaacgttgccgccttcaataacgggtttgattggcaaatggaatttatgagcaaattcgtagtcacggtcatcatgtgcaggaacggccataattgcaccagttccgtatgaagccaatacataatcaccaatccagattggtaatttttcaccgttgattgggttgatgccgtaagcaccggtaaatacaccggtcttattcttgtttaagtcagtccgttccaaatcagaacgactttcaatttcttttttataggctgctacatccgcagcttgttcaggtgtcgtaatttgatcaacaatctcgtgttctggtgctaagaccatgtatgaggcaccgaataacgtatcgggacgagtcgtgtaaacttcaaccgacttgtcttcatgaccagcaactttaaagaagatgctggcaccttcagaacgaccgatccagttacgttgttgttccttaatactttctggccaatcgatgtcattgagatcttctagtaaacgatcagcgtacttggtaatccgcaatacccactgagtcattggtacccgataaaccgggtaaccaccacgttcagtcttaccatcgatcacttcttcgttggcaaccacggtaccacccatgaaatcaggtgcccagttaaccatgatcttatcttcataagccagtccatgcttgtacaattgttcaaaaatccactgtgtccacttgtagtaagcaggatcagtcgtattaatctcgcgatcccagtcatatgaaaagcctaatgaccgaatctgacgcttaaaggtcttgatgttttgcgcagtgaagtcttttggattgtgacccgtcttcaaagcatattgttctgcaggtaaaccgaaagcatcccaacccattggatgcaaaacattgtaaccctgcatccgtttcattcgggaaataatatcagttgctgtgtaaccttcagggtgacccacatggagtccctgacctgatggatacggaaacatatcaagcgcgtaaaacttcggctttgattgttcatcataagttttaaaagttttatgttctttccaataatgctgccattttcgttcaataatactgtgattgtaagccaaacaaatacgctccctttctcatgtcggacaagctgaaaactaaaaaagcctacaagaaaacaacgtttcttgtaggacggaaattccgcggtaccacctaacattcccgcaaacgcgggctctcattatttcgtaacgcgaaaatcacgtctcaacttacttcagttcagttgaaaaactcagagacgagttcggtgtgcagccgacgaattcgcaacaaccatccgctttctgaacagcgtcacacacctaatagtcctcatcagtctttaatttttgttcagtgatttcatagtaccaaatttaaccaggagaagcaagtgcattcgggaagaagactgaaaactgcgcatttatcggttggtcaaaatcagtcatccgtgcatacatgaatcatttagattaaacgattataatagaattatccaaactttgaaaggaatatctaatatgaatcttgaacccgctgttaattacagccatacccttttaaaaccaattatcattaaaggtgataccgttgttgatgccaccgtgggcaacggcaacgatacgatttttctagccagtctagtcggcaaaagtggcctcgtattaggctttgatgttcagcaacaagcactagacaaaacagccacccagttaacactaacaggaatgacgcaccaggttcagctgattcacgatggtcacgagcacctgaatcaatatttagaaccagaacagcaaatcagtgctgccatctttaatctaggctatttgcctggcagtaataaaagtatcattactcatggtgctaccactctaaaggcattgactacttgtttaaatcacttgcgacgtggcggaatcgttgcactagtggtttattatggccatcctggcggtgaagtagaaaaagaaatggtgctcaatcacgtcaaaaaactgaatcagcaagaatattctgtcctgcagtacgggtttatcaaccagattcaccaaccaccctttctgctcgccattcaaaaacggtgaaaaaacacaaagggcttcgaagatcattacatcttcaaagcccttttagtttacacttcttccttaggcaacatcacaatttggctgccaccgtcatcgtacacccacaacgaatccggaaagctttccgcatacggaaatggtgtatcaaagctggctaccacagcctcttgctgtaaaaagtcaaaggtaaggtggttattgtgattcgttaagttgaagctgataatttcacttaactgaaacatgccttgtaaattattatcaatgatgtaccaaacttgatcaataatttcgccaggtaaggaattcacaattccaaaactagcgtatctaggacgattgttttcaaacacggagatcgtctcactttctgtttatatctagcatcaagtatacttcatttagctaaaaatatcaggcttcaggcttgttgagatggtccaactgattgatcagatagcttaaaaccacaaggccaagtgccacgatgaaaatccagtgtaacccgctataaagtatttgacgtaaaggtttaagtagtgtgctacttaacgtcttagccgtttgcggattgatcagccgattcatcatcgcaaggttggtgccctgatgtgtcgcgacaccacttgccattttaacgttcataataattccaaaaacggagatcatcagtgtttgacctaacgttcgagacagcgtattcagcgacgttgctacaccgacatcctcctttggtacctgattttgcaccgttaccgtagtcgtggtaatcgtgatcccaaaaccagttccgcagatggccgcaatcacgaagaaactccaaaacggtgttgcctgtggtgctagagccatcgctaatccccctactaaaatgaaggtcaggctgaagttgataatttgtttgggtgagcggttcaacagcagtttaccagcaataaacgatccaacaatccacattaacgaactaggagtgattgcaaaacctgccagtgatgccggtaatcccagtaatccttgggtccaagtcggtagataaacttcaaagcccatcaaaaaaccactaatcagcgctgctaccaaattttgggtcacaaacgttcgaattttaaataatttgagcggaataattgggttagcgactcgtccttcttgacgaatgaaacctaagaaactgagtaccgaaaccaataagctgagcaataaaattccccaattaatatgagtatcgcccagcacctgaaaaccaaacatgagggctaaaagtgccactgagagccaaacactcccgagaacatctaatgtttgggtactctttcggggcttttcctttaagaaaatccaaatgcctgccattgctagcaagcctaccgggatattaatgaagaatatccagtgccaagacatctgatcaacgatgaaaccgcctaaaagtggcgccacgatggatgcaatcccccaagctgacccattaaagcccatcacctttgcccgtttttcaaaggggtaaatgtcagcaatgatagtgaacgaaatcggcattattgagccggcaccaattccttgaactgcccgccagataatcagctcagtcatactgttcgacatgccagatagtgtggacccaacgataaaaatagccaacccgaataaaaataaccgcttgcgaccaaacatatctgacaacttcccgtaaatgggtgtcgccatggcatttgtcagtaaaaagattgaaaagacccagttcatcagtgcaacgccacttagatcaccaacaattgttggcatggcagtagacacaatggttccctcaatcgcactcataaacgtcgcaatgaagatagcgcccgtcactaacgggacattggttttacttgaactcataatttttcctcacttagcgctggcccgcacccccaacgcagtttgagagccatatactcccgccataaaaataacgaccagcccgagagttagtcgttatttataaaactcaattgaatttatttgcttactgattcaatctgctttagtacttgttttaattcgtcaaccttatcagtgtgttcccaaggtaaatcaatgtcagttcgaccaaagtgaccataagcagccgtttgcttgtaaattggtcgcttcaagtcgagcatttggataataccagctggacgtaaatcaaagatttgacgaaccgccttagtcagttcaacttcagaaacggtgccagtaccaaacgtgtttaaggaaaccgaaacgggttgtgctacaccaatcgcataagctaattgaacttctacctgatgtgctaaaccggcagccacaatgttctttgcgatgtagcgagctgcataactagctgaacggtcaaccttagttgcgtccttaccagagaaagcaccgccaccatgatgagcgtatccaccataggtatcaacgataactttccgacccgttaaaccagcgtccccttgaggaccaccaataacgaatcgaccagttgggttgatcaagtagcgggtgttatcatccaatagctcagctggaatgactggcttgatgactttttcgataacatccttgcgaatttggtcaagcgttgctgattcggcatgctgtgtacttaagacaaccgtatcgactcggaaaggcttaccatcatcgtcatactcaaccgtcacttctgacttggcatctggaccaagatagtccaaaatgttttctttgcgaactttagcaattcgctgcatcaattgatgtgctaatgaaatcgccaatggcataagctcaggtgtttcgtcaatggcatacccaaacatcaagccttgatcaccggcaccaatttggtccaacggatcagtctcaccgtcacgcttttccaaagcatcgtcaacaccttgggcaatatcaggcgactgttcatcgattgcaactaagaccgcgcaattatcaccatcaaaaccatacttaccaccggtataaccgattcctttgatggtttcacgaacgatatgctgaatatcaacataagcacttgtagaaatttcaccaaagactaatactaatccggtagtaactgatgtttcacaggccacacgagcgtctggatcttgtgctagcattgcatccagaatagcgtcactaatttgatcagcaatcttatctgggtgaccttcagaaactgattctgaagtaaataaatgtctttcttgcattgtaaaaattccccctatatcatttttcggttacaaggcatcttcactaagtcaagctagtgaatcctatcgggaatgaagactcataactttattattttaacacaattttttcagcatagaaagttggcttgcaactgactgaaaattattgagagttgacccgtactttgaaaatggtaagctatttatatcaaacaaaaggaattattgaatatgttagaaaatattgaaacgtttatcgttcatcatcgccgcttgcttcaaggcttattctttggcgtcattgaaatgagcggtttgttattatatgccaatgcaaattcattccaatcctatacccgaccacaacagctaccgctattattactgtcactgacgaccatccttatttttacgtgtctgtacgtgattagaacaacctctgcacgtagtaaaaccgcaccgattgttttgctgataaccattgcttttatcgttttcagcataaccaaactcccactgttggttaacatcattaacggcttagcaatcattgtgttgctgctgattcgctacttacctcgatggtttgataatgaattgggcatcgtactcctggcacttatgcttgccagcttgacggccggtaattttctattgtcgcacgattatttatcaacgagttatttaacgacaatttttctcccgttactactatataactattttttcctgccacaaaaaacctttaattttattctcttgccagcaggactcggattcttaacacttgtgtggctactttttctccatttgagtgtgatcatcatcgtcttttcgttagtcgtattgctggtttggtttctcatccaaactatgtggcggccgtccccttcccgaggtttactcattgcagcggtcttacaggcaattatttttatttgcagtcgataattaaaactttctaaagcttcccctcaaccattatagttatctgtaatttgtcatatgatgattatgcaataaccattatgtttgggggcttttgattgattcaaattaaacttgtaggggatatttggagcggtaaatatcagcctgcattaacaggtaaccgaattgttgatactgcactgctgacgcaattttgtactaaattaatgtcctggttttcacagcaaaatatacaggtaaacgttaaaattgaacatgattttagcttaccaaacgcaactggtaacgataccctttacttaatcgattcaggcattgcgaacgcactttctgaagacatgttaagtaaggttaattttctaccaattaagcatttggacttgctccatggcgatccaagcggtagctaccagtcaattttagaacggctgaaaatgaacttaaaattgcaacaatcataaaaggttaggtcaaaacatcttctgttttgtacctaaccttttatgatttaattatacgaaaagtccggggaaaataacgctgttaacataaggcttggcaatttgccttatttctggttcaatatgactgataaaataatccttatcaactttatgatttcccatccaaccgatgaaatactttggtcggtatcgtcgatttgagatttcaaaagcatgataagcctttaattgagtgccgcgataaatgacttcgatcgctgcaattccctcacagataagtaactgttcagcttttttaagctgttcgttacgaacattaaattcatgatcatttgtattatcttccaagtgcaaaataatttccatctgacaattagcttttaaaaactgccgactgttgtgtaacaagttaaggtatgagcttatcagttctttcagtgttgtttcaccgaagagcattacgggtagcctcctaaggatgtctgtctgtaagttttcgtttttatcaagcgtacaatttgattgcacgcagagtatatcatattttattggtatagacaattaaaatatgataaaaaaaagaaccaagccataaatgcttggttcaaagaatgataccggaggtggggttcgaacccacacgtcctcaacggacactggattttgagtccagcgcgtctgccagttccgccactccggcatattaagttaatgctaatagaaaattgcttagccatcccattgacttgggaaaggcggtaatcggattcgaaccgacgatggaggttttgcagacctttgccttaccacttggctataccgccataatcatgattcaatgggctccccaaactgggttagctggattcgaaccagcgcatgacgaagtcaaagtccgttgccttaccacttggctataacccaatcatcaagggcggtatgtgggactcgaacccacgcgtgccggaaccacaatccggtgtgttaaccaaacttcaccaataccgccattataccaaaaacagggatagcaggaatcgaacccgcactagcggttttggagaccgatgtactaccgttatactatatccctatggtggatgggagtggattcgaaccaccgaacccgaaggagcggatttacagtccgccgcgtttagccagacttcgctacccatccatatatggcgcgggacggaatcgaaccgccgacacacggagcttcaatccgttgctctaccaactgagctaccgagccatgtaacacatattcacttgttaatcaatattaacaacggtccgtacgagactcgaactcgtgatctcctgcgtgacaggcaggcgtcctaaccagctagaccaacggaccatcttttatggaggatacagggctcgaacctgtgaccctctgcttgtaaggcagacgctctcccaactgagctaatcctccaagatgttctttttaaacttacttaatcaacctaaaattgattaatgacccgtacgggattcgaacccatgttaccgccgtgaaagggcggtgtcttaaccacttgaccaacgggtcatacaaaaagttgttgacggagagtgagggattcgaaccctcgaaacaagcttttactcgtttacaccatttccagtggtgctccttcggccaactcggacaactctccaattaattcccggcagacttgtcgtgaacaaacttataatttaagaattatcccaacaacaaagtttgccggatatatcgcgtggcaacgtcctacccttgcagggggcgatcccccaactactctcggcgtgctgaagcttaacttctgtgttcggcatgggaacaggtgtatccttcaggctatcgccaccacactatggagaactggtgctctcaaaacgtaacaaatatcattttcttttactcgatgaacaccactactcgtggttaagtcccgaccgattagtactagtccctccgtgcatcgctgcccttccacttctagcctatctacctgatcatcctcatgggtcttacttccatataggaatgggaaatctcatcttgaggcgagtttcacacttagatgctttcagcgtttatctcatccacacatagctactcacaatgcgcctggcgcacaactgatacccagctgtgtttccattccggtcctctcgtactaggaacagctcctctcaatttcctacgcccgcgacggatagggaccgaactgctcacgacgttctgaacccagctcgcgtaccgctttaagggcgaacagcccaacccttgggaccgactacacccccaggatgcgatgagccgacatcgaggtgccaaccctccctcgatgttggactcttgggggagataagctgttatccccagggtagcttttatccgttgagcgacggcccttccatacggaccgccggatcactagcccgactttcgtccctgctcgacctgtctgtctcgcagtcaagctcccttgtgcctttacactgctacgaatgatttccaaccattctgagggaacctttgggcgcctccgttacttttgggaggcgaccgccccagtcaaactacccacctgacactgtctcccgccacgcttagtggcgcggttaagtgtgtccacacacagggtcgtatcccacctgtgcctccaccgaaactagcgttccggttctacggctccgacctatcctgtacaagttgtgtcaacacccaatatcaagctatagtaaagctccatgggtctttccgtcctgtcgcgggtaacctgcatcttcacaggtactttaatttcaccgagtctctcgttgagacagtgctcagatcgttacgcctttcgtgcgggtcggaacttacccgacaaggaattttcgctaccttaggaccgttatagttacggccgcgtttactggttctttcatttctgggcttcgccgaagctaactccatccacttaaccttccagcaccgggcaggcgtcagcccctatacgtcatcttacgattttgcaaactgtgtttttgataacagtcgcctgagcctcttcactggcggctgccactgctgcagcaccccttctcccgaagttacgggtcattttgccgagttccttaacgagagttcacatcgctcaccttaggattctctcctcgactacctgtgtccggtttgcggtacgggtagtaagatactcacagaagcttttctcggcagcgtgacatcaccacttccctacttaaattcggtccgcgcacagctgtctactcggttgaaagcatttaactaacaccagacttgctgcttgaacgcacatatccaacagtgcgcacggcttagccttctgcgtccctccatcgctcaaacatatcttactagtacaggaatatcaacctgttggccatcgtctacgccttgcggcctcgacttaggtcccgactaaccctgggaggacgagcttccccaggaaaccttagtcattcggtggatcagattctcactgatcttcgctactcataccggcattctcacttctaagcgctccactagtccttacgatctagcttcaccgcccttagaacgctctcctatcacgcgacctattggtcgcatcacaatttcggtggtatccttagccccggtacattttcggcgcagaatcaccggctagtgagctattacgcactctttaaatggtgttgctgcttctgagccaacatcctagctgtctatgcaactccaccgccttttccacttaggatacacttagggaccttattggtggtctgggtgttcccctttcgacgatggatcttatcaccaccgtctgactcccggatataaatctatggcattcggagtttatctgaattcagtaacccgtgacgggcccctagtccaaacagtgctctccccacgattctctttccgaggctagccctaagctatttcggagagaaccagctatctccaagttcgtttggaatttcaccgctacccacacctcatccaagcacttttcaacgtacacgggttcggcctccagtgcgttttaccgcaccttcacccggacatgggtagggtcacctggtttcgggtctacatcaacatactgaaacgcccgtttcagactcgctttcgctcgcggctccgactttcatctaaccttgcatgttaacgtaactcgccggttcattctcaaaaggcacgcgtgtcacccattacgggctccaactaattgtaggcacatggtttcaggaactatttcactcccttccgtggggtgcttttcacctttccctcacggtactggttcactatcggtcactagggagtatttgccttgggagatggtcctcccggatccgaccaggttcacgtgtctggccgtactcaggatcctgaactgagggtaacaaattttctacgggctatcacccgctctggccggtcttccccaaaccggtccgactaccgttactttggaactcaaatgttcgtgtcctacaaccccagaagcaagcttcctggttgtggctgttcccacttcgctcgccgctactatggaatcgcaattgctttctcttctgtggggactctagattttcagttccccacgtctgccatactaagctatgtttcactaagcattaatcatcgactaagatgattgggttcccccattcggaaaatctccggatcaaagcttgcgtacagctccccgaagcatatcggtgttagtcccgccttcatcggctcctagtgccaaggcattcaccatgcgcccttttttaacttaacctcatcacttacgtgacggattaattgagtttactcgagtaataaacttactaataaaaactcaaaatacgcggtgttctcgcttaattaatgaaattaattatataaaagaaaattgtaattatctagttttcaagaaccattctgttgattccctacggaatcaatggagaatagcgggatcgaaccgctgaccccctgcttgcaaagcaggtgctctcccctctgagctaattcccccataacaacaaagtttgttgagtgggcctaaatggactcgaaccatcgacctcacgctttcaggcgtgcgctctaaccagctgagctataggcccaataaaggttatatctaattgagagtagacctctcaaaactaaacaaagttttgtctcatgtgcaggttccgtattattcccttgaaaggaggtgatccatccgcaggttctcctacggctacctgtttactgacttcaccctattcatctgcccaccttaggcgtgggctcccgaaggttaccgaaccgaccttgggtgttgcaaactctcatggtgtgacggcggtgtgtacaagcccgggaaccgtattcaccgcggcatgctgatccgcgattctagcgattccgactcgtgcaggcgagttgcagcctgcagtccgaactgagaatggctttaagagattagcttgcctcgcgggtttgcgactcgttgtaccatccattgtagcacgtgtgtagcccggtctaaggggcatgatgactgacgtcatccccaccttcctccggtttgtcaccggcagtctcgccagatgtgccaactaaattgcggcaactgacaataagggttgcgctcgttgcgggacttaacccaacatctcacgacacagctgacgacagccatgcaccacctgtatctgcgtccccgaagggaacgcctaatctcttagtgttagtcacagtatgtcaagacctggtaggttttcgcgtagcttcgaatttaaaccacatgctccaccgcttgtgcgggcccccgtcaattcctttgagtttcaaccttgcggtcgtactccccaggcgcatacttaatgcgttagctgcggcactaagggcggaaaccctccaacacctagtattcatcgtttacgtgcatgactaccagggttctaatcctgttcgctacccatgctttcgagcctcagcgtcagttacagaccagacaccgccttcgctcactggtgtttcttccatatatctacgctttcaccgctacacggagttccactgtctcttctgcactcaagtctcccagtttccgatgcacttctccggttaagagccgaaggctttcacatcagacttagagaaaccgcctgcctcgctttacgcccataaatccggacaacgctgcccctacgtataccgcgctgctggcacgtatttagccgtggctttctggttaaataccgtcaacacctgaacagtttctctcagatgtgttcttccttcaacaacagcgtttacgagccgaaaccttcttcactcacgcggcggttgctccatcagactttcgtccatttggaaagattccctactgctgcctccgtaggagtttgggccgttctcagtccctaatgtggccgattaccctctcagttcggctacgtatcattgccttgggtgaaccattactccaccaactagctaatacccgtcggggtccatccagaagtgatagccgaaaccatctttcaaactgaaaccatgcggtttcagttttatacggtattagcacctgtttccaagtgttatcccctgcttccgggcaggttacccacgtgttactcaccagttcgccactcatccaatgctaaaaaatcagtgcagcacttcaattcagcgggatgcgttcgacttgcatgtattaggcacgccgccagcgttcgtcctgagccaggatcaaactctcatttatgaatgattgtttgtgactcattaatattactagcgaaattgacttcgcaaattacatttgatatcaaccgaaattgatataccctgcacatttgtgaaacaaaactttgttcagttttcaaaggtctacttctttactcgacttaattagtataaccaagttgtaaatcaatgtcaacgattttttgaatctttattcattcacatcaacgactcaattatgataccaactgccgaatgttagaacgattgaatattaaatgtctgaatataaattcaaataattaataatgtgttctttaacaacaggtaaaataataccagctattggcgacagggtcaagcacaaataataaaaataaccaaattattttgcaacaaactcttttagagcttcctgagcccatgcctgtcttcttttttgaatgggcttaaatccctcatgaacattacgacttgtccaataatgccggtgtcgattctcattctgtggtgctaccggtgcaaggggcacctgagtttcttccaaacatctcaacgatagcgaaattttgccagtgaattcatcaatatctaagacaacaacatcaatctcatcaccaactgataagtaatcatggatatctttgacaaaaccataatggcattcagaaatatgaatcagcccttgaacatcattgccaagattaacaaacgcaccatagggttgaatgccagtaaccgtaccatgtacgtgatcacctatacgcattactaaaacctcttttctacatatagtatacaaaaagcttgaggctaacctgccccaagccctattatcagttcagcctaatcttcaatggagacagattcaatcacgatgtcttccaaaggtttgtcagactcatccgttttcaccgtagccatctgatcaacgacatccatgccatcgactacctgaccaaaaacagtatgtctaaaatcaagccaaggtgtaccgccattctggtaagcggtcacgatctcttctggaaaatgagcatccttcatctgctgtgtcagctgctgagacatatgctgattctgaacaataaagaactgactgccattagtattaggaccactgttagccattgaaactgcgccacgaagattataaagttccttcgaaaactcatcttcgaacggttcatcccaaatgcttgagccacccatacctgtacctgttgggtcaccgccctgaaccataaaatcgttaattacacggtggaaaataacttcatcataatattttttcttggcaagtgtcacaaaattttccactgctttaggtgcttgctctgggaacaattgaatcacgacatcacccattgacgtatggatggttgcccgggggccttcagccttatcgggttgtaactgtggatagttcacatttatacctccaagttttctttcatatctattatccatgaaataagacgaaaagcaagcctcagacactggatagtatcgggcttgctcccgtctaaaccggttattgagtcataaggaattgtaacacaatcccagtactattacagataactaccctaaataagttgttcaaagcgtcctaattaagcacatctaaagttatgattcacttaaatccgtcagatgggcttttacaagcacgaattctctgatacaatatcagcaacttacatgtgaaaggaaacattctaaattatgggccaattgattgattttgtgctccacattgacagccacatgatcactattgtaaacacattcggtggctggtcgtatggcatactttttctcattatctttgttgaaaccggagttgtaattctaccattcttacctggtgattctctcctcttcgcagctgctgccttagcagctaatcctgactaccatctcagtatcgttgcatttacagccattttcctagtggcttccatcggtggtgattcatcgaacttctttattgggcgtcgcgcgggtattgcaattacacatcatccattcttcagccgattcattaaagaagaaaatttaacttcagccagaaaattctttgaaaaacatggtaaaattgctatcttcttagctcgcttcatgccaatcatccgtacctttgtcccgtttgtggctgcaacctcagactacaaataccgttcattcttacgctataacattcctgcctgcatttgctgggtactgttatgttgcggtggcggctacttcttcggtaatatcgattttgttaaagcccacttctcgctggttgtcatcggcatcatcgtcgtttcaatgattccagcatttgttggcctacttaagagtcgtggtcaagtcagcaaagattaacaaataaaaaactctagccggttattaaaccgctagagttttttatttgtctagaaagctacgtctaccccgccagcccccccacagcatgattagctcaaacaagccaaacgctaataagaaacactgcgaaaagaagctttcaggtaaaacaaggatcaccgggtcaaaccggggatcaaataaccaatcagaattacggaacagcactttgtgaaaatcaataaaaaactggttaaagttgaccaacatcagcagtgctgctaacactggtacaacagccgctatctgaaatggccggatcagcttccagagcattttcttcacggacaatgactgcaagaagtgaattgctggccatatagtcacaatcagtacgctattatttaataaaaacaagtgtttgacatcaataaagtgctgcaatccactaggagaagttggaaagtccatcatatccagcctggtgatccagggtaactgcaaatatcccagtaactgtaaatagttttggataattcgacccgtggatacttgaacaatttttgatagatggcctaatttaacgttcagccaataaagccacacactattgatcgtcaagaatataaccagcgaaataatcgctaaaaaaagggctatccattgaagtgtcacttttaatcttgttttaagcatcctcaaccgaccattcatctaaattattgatttcgtacgtgggtgcgatcttttgctgtgctacctgctcgcgtgtagataagccagtgtacactaacaacgtatccataccgaagcgaatacccgcagtaatgtcagtcttgtagttatcaccaaccatcacgacctgcgatttttttaagccaatctttttcaaggcatttgccatgataatcgtttccggcttaccaatataaatcggttgctgctgagttgtgtaggctaccatctcaaccaacgaccctgcgccaggcaacattccccgttcgtttggaatgttggaatccggattggtcccaataaactttgctccagcacggatagccaacgtcgcaatttcaaacttatggtaagtcacatctgagtctagacccacgaccacaaaatccggctgtcgttcgctcagctcaaatcccttatccaaaaaggcctgaataagcccaatttcaccaataatataaaccttattttgccctgctttggcgattccagcaacgtagtcagcagtggctaaaccggccgtatagacgttgtccggctgaacatgaatatcgtgattagttgctaaattgtcgaccacgtcaacgggtaatttggtggtgttattagtcacaaataaaaaatccttatccgctgcctgtaaacgttcaacaaatcgctttgcggcgggaattcgacgtttaccagcgtaaaccgttccgtcgagatcgataaagtaaccatcataatgtttttgcatgaaaccctagtcctctttttctcgaattgtgaatttgcggtgctgactgtgtccaaccgtcttgatagcgccatgccgttgactaacaggcgtcttcttgatgggtttaactttttccaccgtataggccttttgctgcccattatttgatcgacttggccgcttggtgtgttgtcgtcgggttacgtttggccgttcagacttattttcagtctgctgtgcattctttgcccggttagcgttacgattgcggttttgctgtttaccactattattttgatttttattagtttggttcttattagcctgccctctattcgaacgatggctactttcgcgaggcttagaactgcgcttaggtgttaccaccttggcatcggcattatgcataacaaaataagggcagcctgtattgcaggcttcgtccagataatcttgcagcgcgctaatcttcagctcgccagccacgtttcgcttatcatcataaaaaccgcgtaaccgtaactgaccaaaaccccagtcgccaactaaataatcgtatcgagaaaaatacgtgttaaaccggtcactcaattcaacccggtcaaaagcgtcacggtagtttactaccagctcataagggtgctcattgatctggtaatgcgtttcatcaacagctacgataacgccacccggttctctactggcacgtgcgtcatcaattaaagtttgcattgatttcttatccatggtcatcctcctttctaattggatattgtttagcgagatagtcgccataaactgttcttaaaagcttaccatataaaatttcattttgcccaacaattgaaattgtggggaagaacggaatgaagagatagtggtctggcatggccacggtataagtgcgcaacggcgacaacggctcaccacgaaaaagaaccgaaccatcatgatcattgtaggtaatcccggaataattcagtgcaccgaacaccttaccgcgaaaacccattcccttaattgggaaacgcaacaaaaaacgccgattcttctccatttcttggatcagccgccacaggttatccccacttaaggtcaccctcatcacgtgcatagcgtgcggtagcatctgatgcagatgatttcgagaaataatccctgcaggcaagtcttgcaagaacaagccgccatttaagatagcagcatccgtccccgcgtaatcttccaacgccgctaatccttcactgatcagccgtgaatgtccctgccaattcttttccatctttaccggtaaatcagccactttttgcgcatctaacagttgttcaccgtgattttcgtaaccttcgatttcttgtcggtcacttgtggctgcctgaagattagccgtttgcacgactgaagctgacgactttacaatctgatgattggacaattccaactgaatcgtaccaacatactcaccatattttccagccgctcccagtaaagccgattgatcatgctcaccgtgtggcagtaaatgatgcgtatgcgcacctaaaatcacgtcaatatcaggaaaacgtttagcaatggcacgatccacatccagcccaaggtgtgacagtaaaatggtgcagtcatactggcctttaaatcgcttcagcaaatatggcagcatccgctccaccgaaatgggttcccaacccagcaaaggatatgtcagcgtatagggagcagttaatcctaatactagtactctggtccccgcctttgtcttgatcacttttccgggcaacgcccacttaggttgcataatcttcggtgcgttcagtaaattacccaaaataacgtcaaaattggcgtggtcgtacaaatgtaccagttgttttttagaattacctaaaccttcattgttgccaattgtcacaccatcataatgaatctgattcatcagggtaacgttaaactgaccatcagttgcttccgttaacggatgtgcgcgatccattgcatcaccaatatcaaaagtcagtacttgattgccagctgcttcgtagcgctgccgttcttcaagtaaataacgacggatcttaggccaattttcaaagtgcgaatgcaggtcgttagtgtgtaaaattgtaattttctcagtcataccccactcctctgccaatcttatcttcttttctgaaaatcgttatatttaccggcgaccatttcttcaatctcagccatggaaaatggtgtcccaaacggtggcttttcctttaagtaatccgtttcaggggtatcaacaccaacgttgatatcctctttaatattgactgaataatgatgaatatgaccgtgtaaattaatgatctgcttaacgatgcccatcatcatcggataatgcgtcatataatactgccgacgattaactttgataatggcgccaacatcgtggaattcaaatttaggtttaccaccgtaagtataattatgctgagccaaatatttaaacaatgcacgattatcgtgattgcctttaatgagcaccaaatggccatttaactgattcagaacatccaaaatagcggcctcagctgcccgttctggtcgaatgaagtacaacgcgatatcgcctaggtgatacaccgtatcttccggtgttacccgagcattccaatggtcaataatcgtctgattcatttctgctaccgatttaaatggtcttggcgcaaaatctgaattaccgagtaagtctttatgaaaaaaatgcgtatctgcggtgaaatacagttgcacgctgaccccttctttgttcaaaatgattttaatttttaaaaacaccatgctttaagtctaccatgttacccctcggataggaaagtaactaagttgaatctaccagctgaaatgtgaaacgtagccacaaaaaaaccggaactccaagtcccggttttaaacctatttcaaacggtgcgacttatctgcttctgctcgattgataccactcttaaacagccagagggcaaagagccaaatcacggagccaatcagcgcaaccaatgtttcaaacctaaacagtagaacgactgcaaccatgatcagaaacagcaacacgaaatagtctgaatatggtacaaacggcattttaaagctgacttctttttgctttccagcagtagcttcccgcttgtatttaatatgagctaggataatggaaccccagatgaacaggaaacaagtcgtggcgatactggaaatcaaggtgaataccttaccaggaataaagaagttcagtaataccacaacagcaatgattactgccgaaaagagcattgcgttaacgggtacttgcgcttttgaccgtttagttaaccgttttgacaacttggttttaccaccatacgaaagtgaaaataacattcgtccggtcgtaaacaaagcactgttacatgctgaagccgcagcagttagcaccacaaagttaataattgcagccgctgatttgattccaattgccgcaaaaacttccacgaagggactctgatttggtgaaatatagtgccaaggataaatacacatcagggccatcaaggaacctaaataaaacaagatcactcgcataggaatttcattaatcgctttaggaataataattttcggatcattagtttcagatgcggtcatcccaaccatttcaataccaataaaaccaaataaaaccatctgaaatgataggaagaaccctttcgcaccgtgggcaaagaaactgccacgcgctaaattcatcactgaagcatggcctacaggtgttttaaattgaatcaccactaaaacaacgccaactgcaatcaacgcaatgatcgctgccaccttcacgattgcaaaccaaaattcagtttctccaaaagcttccacggtgacggcattaatcaaaactaggatcagtaaaaacgttaagccagttacccactgcggcaagtgtggaaaccaaaacttcatgtatagccctgatgcagttaagtcagccatggcaatactcaaccaacagacccaataagtccaaccggcgataaagctccagcgttcaccaagatattttctaataaaatcaatgaaagaatgggcacttaaatcagttaataaaagctcaccaagtgctcgcatgagtaaaaagcacgcgataccggcaattaaatacgccaataaaattgaaggtcctgttaaatgaattgattgtccggcacctaaaaatagcccagtaccaatcgtaccgcccaaagcaatcatttgaacgtgacgattttttaaacctcttgactgctgtttgacgggttgtgtttttgccataatactctcatcactccttcatagaagttcattatacacgtgaaaagtattggtttgttgacgaatcaactcaaaaaccagaattatggcaattattaccccacgtattcgcggtattatccttattatcgccttgatgatgtttcttcacttatgggtgaacaaaatgcacgcttatgacttatggttgaagaaaagtgaaacatcttgatttttcaatgtgacaaaaaggactcgattcaaataaatcgagtccttttttgcaaaatcaatgagctttatttagttaaacgttcaacgtcacgaacgatcatcaattcctcatcagtaggaatcaacaacgtcttaaccgttgcatccgctgttgataaatcacgttcaacaccgcgaatatgattcttttcaggatcaactgcaatgccaaagtaacttaatttatccgcaacttcttggcgaattggaatatcgttttcaccaacaccagccgtaaagacaatggcgtcaacaccgttcatctcggcgatgtattgaccaatgtaacgaacgatccggttgatgtacatatcacgagctaagtgagctttgtcgttatgatcctgaaccttttccaagtcacgcatgtcagctgagtattctgaaacacccagtaaacctgactttttgttcaagatgttgatcatgtcgttaggatccttaatgtttaatttctccattaagaaggttaccaatgaaacatcaatatctcctgaacgagtagccatcatgataccagctaaaggcgtgaagcccatagaagtatcaaaggacttgccgttcttaacagctgtaatcgaagcaccagcaccaatatgcaaggtgatcaacttcaagtcttctaggggcttacctaacatgtcagcagcgcggctggcaacataacggtgactagtcccatgggcgccgtacttacgagcaccatacttttcgtagtattcgtaaggaatcgcgtacatgtagttagtctttggcatcgtggtatggaatgatgtatcaaataccgccacgttaggaacatctggtaaaatctttctgaatgcccgaatacccatagcttcagatgggttgtgcaatggtgcgtattcagctaagtcttcaatcttcttcaaaacgtcatcgtccactaagactgaatccgtgaagaattcaccaccagcaacgacccggtgaccaacaccggtaatttcgttatagttagcaatgatctttaattcgatcaatttatcaagcattaagttgatggcttgttcgtgatcatcaacgtcttggacgttttcaaacttcttcccatcaccgtatttgatggtaacgattgaatccttcaaaccgattcgttcaatcacaccactggtgatgaccttttctgatggtacttcgaataatttaaactttaatgttgagcttcctgcattgacggcaagtgtttttcccatgtgataatctccttatgttaacgctttagtaaatcattaagttcccaatcaactattcctgcaataaactttgaaaatgcggtttgatctttaaatgacggaaattcgccgatcattaccttatcagcttgcttgacatccttaccatgccgttgcaacagcataattgattttgctgattgctgagcagtaaagagatcctttggcaaggccaacaatccttgcagataagcagcatcttgaagccatgataaaagccccttagattctgtggttgaaaacaactgactcggaactaaaaagacaccatagccacccggctttacatagcgcattgcttgttccaacagtagatgatggacaaaggaatggcctgactgggcgtgtgtcttaaaatttgttaccttttcatcgagtggataataaccaatcggcaaatcagacacgaccaaatcagcctctggaatctgcaattcccccagtgcgtcttggtgcatcaacgtcactgaagcatactgtaaagtcgtactaatatcggccactgacagtagtgattcgtcgttgtcgattccaattgcggcaaccttttcatgggtcgcatctttcaactgattgataatcgtcgtcaataaattggcggtgccaacggctggatcaaggatcgtcagttggttttgcttttcaaccagccgaatgactaaataacccatgaccatcccgatactatcaggagtcatttgatgattaccctgaatgtcatcttcacgcatggccttcaacattgataactgaatgccctgacgtaccgtttctggattcagttgaccgcgatcaacagagtcataaaggccctgaagctgctgcacaaccttatcgtccggtcgaccgtcttcgacctgaacgtgtccgtcaatcagattatcaccagattcaataaaggcgtctaaatacgacgtcgagagcgcatctttcagtaactcactcgattcatcgagcactttaaaaaacgcctctgtttctttaatagccagaattgtcaacctcctgtcctattggtttttccgcacaaatataagtttacaaatattcgtccgttaattcaagcgaacagaagaaatttaactgcgtcttcagttatttagctcgtaattgctgttcataatactgaattaagatatgataggcctctgcttgatgctgataaccttgtaactggaagagtaaaataccactcaaaaaaattaaaaacagcaaagcgagaatggtaacgaatccctggcgactattcatcatgttctccaatggcagtggttgctgaaaaatgttgcaatttggtattgacctcgatttttaagtgacgatggtcgaccccaagctgataatcggtcatccctgtgaaaagtggcatatatccccccttatccgttgtcaatataagattgtcatcatgccctctcaacaaataagcgcgttccttatccgtatgaggttcaagatgtgcttcatacgaattaaccttgtctaaagtaaaccggtactgattgccttccaattctcccagcatatgataccaagccaattgctcatcatgtttttgctgagaacgcactgctaacatttgaaagccaaattgcaagcttaatagggctaatgccgttactaccaatgcgattagcgtttcaatcaatgtaaacccagttttcatttcatcacccgtttttcttgctttaactgagcctcatattgatgtcgcaactgttgaacacgctcctgccgctgctccaattggttttccatggttgtttgagcctgaacgtaaagaatcaatccagcactaatcaatactaatcccattaaagcatcactcaggacaaacgcccgcttatgctttttcgcgatcaacatgatagaccccccaacccatttgaatcactagccggtaaatccgctgatcaatatccgatttaaagatgaccgttcgtggtgaagtggtcccgtcagaacgaatcgataacttttcagactggtccggatgtatgcttctcggtagtgccaacgatttctctttttgtgccgttcgaaaaacgattggtgaccccttttcaatactaatatcagtgctacgaccatggtattgagcctcataaagcgcctgcttccaataaccatcaaagctttcccagaacgcgcgctcggtttgcaatgacgagcgggaaaatcgctggctactaaccataacgaggaccaaaatactgctcataattagtaaggttatcagcatctcaatcattgtgaacccttcacgaaccggctttaacttcgtcgccattgattttgatcccctctttaaccgcgattttaacttgcttatcggttaggtaaccagctttttgcaactcatccaagctcgctgtcttcttttcggttgtgtctagataggtgtccaattgggcctgaaccacggtcgtcattgcgccagtgtgaatcgtgttcgcccggttcttttggtggctaatattaggaacgatgattaagataagcaggcctatgataaaaagtacgattgtcatttcaattaaagtaaagcccttcttttttcgttgcattatagtcctccaatggtatggtacatgggcaagaataagctggcataagcaccaatgatgactccgccaatcaaaataaatgataatggctgaatccaggtcatcatgacttctaaacgattagtaagccgctgataataaagttcggtcagtgcggtgagttctttaaccaactctgcctgtggtttaccgctttgaaatagtaactgcagttcgtttggtaaaaaatgaaattgcattaagacttcagaaagtggtaaaccagcagctagcgcagtttctaatttaccgcctagctgatataaaagtgtcgtcgtcttagctttacgaagtgttagcaaaatctcttgaaatcccagtccgccctgaaacataatcgtcagagttgccagaaaataatacccataatagcctttaacaattggtccaaggattggtagtcgggcggtttgttccacccgttttaagatgggctgttgtttgattgcttggtatgcacagaaaagaagcagtatcaccggcaagatcacaataccccaccaccagtttgtcgaatgcgcctgatcagaagctgctagcgcctcaatttgaggtaggataactaacttcatcccggtgatgatgaacattaatacgactgccaagatcagtgggtactgcagcaaccgtttaattttttgatgacgctgatgagctgtctgcagtaaacgacttacctgccccaaactccgtgttagctgaccatgttcttccgccagacgcaactgtaacccgatttgatcatccacgaagggttcaaaggtttgactcacggtatagccggcatggaggtgttcgttgatccaacgtaaatcagccatttgcggtttatacaagacttcgcaaaaccgaattgcgtgtcgaacagaaaagcccacccgcaataggtcactgattgtttgaaaaattttggcctgagtactgattgaccaaggtttaacctgctttaaatcgtcgatagactgctgtggaaatttggtcgttatctcttgcatgtcttagatcctcctcccactgaggtgtcattgcggtggtttgctcccatttatctactgggccactagcgagatcaagcaacgcgctcatttcaccagtattagtcggtaatagccgttgataagccacacccaccactgcctgagtgatggccgctgaatcgattcctaactgtctcaagcgcgtaacgatgcccttggcagtctgggcatggacgctgcttaacactaggtgaccgcttaatgcagcgtcaattgcagcttgagccgtttcatgatcccgaatctcgccgatgatcaatacctctggtcggtgtcttaacgccactttgatcaaggcctgataactcatatcggctgccggatttacctgtaactgtaagaagtccggtgcaacgatttcagtgggatcttcaactgaaagcacagacagtgattcactcaactttttggctaaatggtagatcgtactggttttccctgaacctgtgggaccagcaaatagtagcaatccccgcaacaaactccattcgtgtaaggttgccaactgttctggcattaagtaggctaagcgctgctcttccagaggaagtaacagccgaatcacaagtgactcttgattgataaaattaccgacactggataatcttaaatgaaccgtttgaccagctaccgtcagggttaacgctcctaactgcggtcgcctagtttcagtgattgccatgtttgctcggtacttaaagtgagcaatcaattgctgaccctcattaattgttaattctctgaccaacgacaacccattaccatgatgttcaaacaccttataagtatcatgaacgggttgaatgtagagatctgaactaccggatgcaactgcggcactcagcagcgtttggcctaattgttctatcattgcttttatcctcctgtgcctaactacgctgattgcataacagtagtttggtgagagaacaaaaaaagccgtcccttttacaggaacgactttttaagcagtttaattattcaacgccttcaggcaacgtagctgcttcataaacatcagaaacatcatcgtttgcttcaagttcatcaattaaaccttggtattgagaaactttatcttcaggaacttcagtagtgttctctgggaacatccgaacttctgcagtatccaagttgtacttttcctgcagggcatcacgagctgcagtcaaactcgacggatctgtgaagatttcaaattgatcatcgctggtcttcatgtcatccgcaccagcgtcaagtgcatccatcaaaaccgtatcttcatcggcatccaggccatcacgtaagataacgatgtagcccttacgatcaaacatataagaaactgaaccagcagcacctaaggctccaccatgatgtgtaaaggcggaacgaacagcggcggcagttcggttcttgttatcggtcaaagcggccaccatgatagcagtcccaccaggaccgtagccttcataagtgatttcttcgaacttggcaccgccaacaccagatgccttatcgatagcgcgttgaacgttatccttaggcatgttagcagcacgagccttatccatcaccaaacgaagttgagggttgtttgctggatcaggatcacctgctttagcggcttgatataagtcacgtgagattttttggaaaatttttccacgcttagcatcttgggcgtttttacgtccttggatgttatgccattttgaatgtcctgacatttcacgactcctcttttcttataatatattcgtttacacagaccttattataatatcacgcggtgaatttcaatacaacctgtctgcaatgaaaccggtaaagttttctatccccgttgaacgattgctacaataaacattgcaacaacggcaatcacctgaataatatcaaataagaaatgggtcaaaatgacttgccaaatatttcttgaaaaataataaatcaaaccaaacaaagcgccaacacacatgtacggaatcatttgaatcagctgaccatgaaaattattccagtgcaccagaccaaatgcaacggaagaaacgatcagcatcagccaagtcaatacgccacgcccacgccactgataaaacagcgcatggcgaaaaacaatctcttccgcaaatggtgccatcagcgtggtcaaactagccaccagcgccattccagccgattgaatactcaaaacgttcacagcaccagaactagcaacacccatatattgtaacgtttgccggacagccgccaaaacaaggtaagccagcaaaacaccaccaattgcaacgaatagccccatccctacgtgagtcttaaatcgctgccaatgactaactaatacgtcacggtataaatacacagcaaggcacaggcccacgaagaagataacatcgactaaaataactcgtgcccatttattagtaacgttatccgcgacaactgcacccaatccgagttctgctaacggaatggcaattgcaactagggttttaacgcttgaaatagactgccgctgaattgctgggcgtgtttcagttggccggcgcttaaagtctaagttggaatgaccattggttgaaatgacaacgttaaaccgtttcgtattaagcaaccagtatgctgccacaccgaaaaccaccgtgtacaccagactggtccaaatactcattcctgcagtgttgcttaacgtaccaaaggccaacgcatcaaacccatcaattataccgtgcgcaataatcggtaaccaaaggctgcctgtcactaagtaaaccgccgcaaaaaacgagcccagtccaacggcttcaagcatttggaccagtgtcatggttaaactgccaccagtggcattaaccaaatgaaccaaactaaacatcagaccacttaaaaagacggtcattaacggtcccacgtggtagcgctggcgcagcgtagtgactaaaatacctcgaaaaacgtactcttcaaacagaccaactgacagccctacaaaaacagccatgataacgtggcccaacgtaaattgaaattgcggattcagcgttgaatcccccaataaaacaacgattacgggtaaaactagcagccattgatgatgttcgctgctacgccaccagctaaccttagccttgggataccagtggttgagtccccaccagcaacctagagccagtacttcagtaattacctgtgtccccatttgagaaattaccggcaatcctgctgatatcagtcgcgcaacgattgacgtcagcgtcaaaatgacaatcgttgccaaaactgactcgaccgataatagcgctgctcctcgcttcatatgtcacccctccagtaaatttgacaaaaataagcaggcctacgctaccttcatttagaagatcgtgtcaagcctgcctattcagcatccaccaatgactagtgagttgatgcgcgtttcattaagccatatggcaataagacagtcttattttccactggttcgttattcatcaatttagtcagtaaccgcatagcaacggccccaatatcatacagcggttgagtaattgacgacatctttggccgaaccatttcggttagcttagtatcgttactcgtgataatctcaaagtcttcaggaacgttcaagcccgcatccgtcacaccattcatcacaccagcagctaattcatcgtcaccaatgactgcagccgttgcgttaactgattgcaatgccggttgcaatagttggccggccttataagaataatcggtttcaaaaaccagtttctcatcataccgtaagcccgcttttttcagcgcctgtttgtaacccttcagccgatagtcccgattaattgggtaatctaagctgccagaaacaaaagcaacccgttcattaccatgatcgatcaggttcttagtggcttcctctacggcagctgtatagtcgatgttaacactcggcattttatcctgatcatcgacacaacctgcaaggacgattggcgttttagagcgttcaaattctttacgaacttcatcgctgatgtcgttgcccataaagacaatgccatcaacttgttttgccattaaagtgttaagtacctgcacttctttacggccattttcatcagaattggttaaaataatattgtatttatacatcatggcaatatcatcaattccccgtgccagtgctgaaaagtagatgttcgtcacatccgggatgatgacaccgacagtcgtggtcttcttactggctaatccacgtgctacagcgttcggacgataatccaagcgttcaattacatctaagacttttttccgagtcgccggtttgacgttgggattcccgttaaccactcttgatacagtggccatcgacacatcggcttcacgggcgacgtcataaattgttacggtctgtttatccattgcgatagccctttctttattggtttaatttgttttcattgattttcagtaactcgttaaatatatcagatatattttcagaaatcaaattgaaaacgttttcaacttgataatacactcttctaaatgacttttcaagaccatagtgggagttctaactctactagcaatgaccaaaaatcaagtcaatcacaccttgactactcaattagtttctgaaagtgcttgttataactggtttcatacccattttatgtatcaataagaatcacccattttcgtgacttagattagaataattctgttttgcaaaatatttagtcacctagaccattcttctattttggcgtgtttcagggtaaatagcatccacttccgttcaataactgatgccctacaatgatttcaccgaatggtttcctaaacatgctataataattgcatcctaattcgaggtgattcctttgtcaaaattacaacaggtccaacaatggactgagcagcatcacgctgattttacctatatcagtgatccaagaaccattcagtacctcaccggcttttacagtgaccccatcgaacgggttctggcactgatcgtgtttcccgatcaggatccctttatgtttgcacctgccttagaggttgaagccatcaaagacaccggtttttcatttcctgtatacggttacttagatcatgaaaatccttggcagatgattgcagacaacgtgaaaaagcgtgtgacgcgccccactgaaattgctttagaaaaaacgcaactttcagtagaccgacttgaacatctgcagcaagtctttcccaacgcccattttaatcaggatatgacacctttcatcaatcagttgcgagtgattaaaacggctgatgaaattgaaaaattaaagattgctggtaagtgggccgactttgcttttgagaagggctttgccgctgttaaagcaggccgcaccgaacaacaggtcgtagctgaattacagtacgccttaatgaaagaaggtatcatgcaaatgagttttgataccctagttcaagccggtgcacacgcagccgaaccacatggggctactaacgccactaagtttaaaaacaatgaattgattctgttcgatctgggcacaatttggcaaggttacatttctgacgcatccagaaccgttgcgctcggcaaaccaaccgcaaaacaactcgacatctatcaagtctgcctagaagcacaattgaccgcacaggcagctgctaagcccggtattacagctgctgaactagataaagttgcccgagatattattactaaagccggctatggtgagtacttcattcaccgtctcggccacggtatggggatgagcgaacacgaattcccatctatcatggagggtaacgacatggtccttcagcctggcatgtgcttctcaattgaacccggtatttacattcctggtgtggctggcgttcgaattgaggattgtgtccatatcactgaaaatggttgtgagccattcacgcacacctcaaaagaattaacctatgttggtgaataacgagtgtgtgacaaaactcggtagattccagaatttaacgcaaataaaacccattccggcgaactttgtcgggatgggttttatttgtgttaaatggcaggaatctgagctttggcgcacgattaggcaatattgacgcattgagccaaaggacagtcatcattaatttttgctgaaaaattgattgaaatacttgccaatataaacttatggcagaacctcgtctttttttattaaattactcttggttagtatcatcagtactatctttggcgttatcgtcattctgttggtcatctactggtgtcgtcggttcatcagcaacatcagcaccgccaaaggtatcttcactgtttaagacaatgtcatccgaatcatcatccgcagaggtggaaacgtccgccaattcatcacgtaatgaatcatctgagtcttcatctgaatccgtctttggctttagctgtggatcggcagcaaacctgctggcagcgtcctttacccgatcactaacagtctgagtttgatcagagaaagtttccttaaagtcgtcccaagcatcactggcataaaaagcgtagtccacagcccgatctttagcaacgtccattttttcttgcaaatctgcttttagttctgctttatcctcgtcactcaaacgacggtaggcaacgtgtgctgcagcagccccagcagctaacccaactaaaaagccaaacttctttcccataagtcaaaaactcctttcaatcatcaatccttattttttcggccacgataagcgttaaaaatcgactcaccaagtttagcaaataaactggttgttgcggtcttcttagccgttgacttgaccttacccgttaaatcatgagtagctgaatttaattcagaaacactcgtccccaaatctgcagccgctttaaacaccggatcaattgttgctactttatggttcacatcatccaataaactattggcattcgctaaaatatcttcagcgtgcttactgatcacgtccaaatcttcagtcatcgttttcacactcttgttgacctcactgagggttcgcaccatcttcattaagaaagtaccgataaataataccaaaattaaaaatgcgatggccgcaatcaaacctgccacttgtcctgctgtcactgtacccctccttactttttactgttaggttaagaatagcattgcgaatacttcgacgcaatataaacccaccggaacaactgctttttttgagccgaatctgttacactaattgatgaaactatttcaaggagcgatcgttatgatattgaccagcaacctcacccgcttcatccagcacttcaactggcagcacattggcgaacagattgccacaacagtctttcagcttttgcttgtcaccatcggactactgctggttgactggattggtaaaaaaattattcggcatttatttaaacgctaccgaaaaaacaagttcgttgaaggttcatcaaaccgcgtagataccatgtttaccttagtgatgaatattttccagtatacgattattttcttttggatttatgcactgctatcattcatgggcgtccccgttggtacgttgattgccggggctggtatctttagtctagctttaggtcttggcgcacagggctttgtttcggatattgtcaccggtgcgtttattttgatggaagaccaaatcaacgttggtgattcagtcaaaattggtacggtggaaggtaccgtatccgccgttggtatccggactacccaagtcatcagtgcggacggtactttaaacttcattcccaaccgtaatattaccatcgtcagcaataaatcccgccatgaaatgcgagccatggtacagattcctatttttcctgactcgcccattgaccagatcaacgacatcattgaaaaagtgaaccaaaccgtaccagcacagtttccaacaatcactcaagcacccacaaatatgggaaccgtgcccttaacaaacggtcaagtagtcattcaagttgtcacctttacgcagccgggtgaacagtttgacgttcagcacaaactgctgtctgcttacttaaaggccatcaatgacgccaatattgaactgccaacaatttaccataacgatgccaagtaatgccacaatttaactcgacaaatcacaaaaaacagtaacgacgaatatccctaaactaaggggatatccatcgctactgtttttgtatacctataatgaagcacaattcatagcgtaaactcgtgcatgatcttaacggccactattattttccaccgacttcagtaacggttgaacatcatactgttcggaaaaattatgggctaaataattcatccgcttcaatagctcacgacgggtaataatgccagtaaaagttttttcatctgaaactactggtacaaaattatcgtcgatcagtaaatgcataatctcttctaaatcagttggatcctcaatcgaacgaaaatcagtttgcatcacgtcggccactgtcagtcgacgtaagttttctgacgccacgtgatccgtgtccagcatgtgctccgtaatcattgacagcgaaactaacccgcagaggtgctggtcattgtctaaaactggtactttagagtaaccgaccttcgtcagcaccaaaaaggcgtggtaacaatcattttttaccatgacattggcaacgagattagctggaataattaaatgatcatggtcagccataatcatttttttaattggttcatcaatcattcttggaattcactttacctttctagcgttggaattgctggtgaagctgagcaactttcttcaattcacgatcataaaaatcaacgcgcatttgatcaggcaaaacctcgatgatggcaaaagtaccgccaatcgacgcatattcaccccgtggcagggaaatactgccgggattaacatagagacgcccttgcgacatttcagctgctaaccgatgagtatgcccgaacagcactaccgatgcaccaatctcgcgagctttaagatctaatctggttaaactcatgctaacgtcgtataaatgcccatgcgtcataaaaatctttgtgccgtcaaccatctgctgaacttcattgggaaaatccgtaccgaaatcgttattgcctttaacaacctggacatccttgaacagtggatcatcctgcgtcatttccgaatcaccgcaatggaaaatagcatccacttgatgaccataagcttcaaaaatggtctgcagaatttcccggtcaccatgattatcactaacagctaacagtttcatgctacttctcccaccaatcatcaaactgaatcatcattttttgcgtagcccggcctcggtgactgatggcatttttttcagcgtcactcatttctgccatggtttttccttttgacggaacgtaaaacaacggatcatagccaaagccgttctcaccgcgaggcgcagttaaaatttcaccatgtacttcaccgtctactactaactttaaaccattgggcttaagcaaaactaaagtggtgtggaaagttgcctgtcgtttatcagcaggtacgttcttcaggttattcaataatttagcattgttagcagcatcatcgtgatcaccggcatatcgtgctgagtatattccaggttcgccatttaaagcagccacttctagtcctgaatcatcagctagaactggcaactgtgtgtgatcagcaatggctttggctttgatggtggcattctcttcaaaagtagccccggtttcggcaatctcacccacgtcggaataatccgctaaggttttaatcgtaattcccttcggtgcaagcatctcggagaattcccgtgctttaccttgattacgagtagcaatcactaatgtattaggcttcatgactggactcctttagtttcaaatcgccgtatgcctccagctgttcaactggaacgtggctaacattcagttcagatagttgcaaccagtccttagcaatggcactgaaactgttaacatcacccgtagtataaaacttaggacgctcagattggctgctagtattcaacaggccttcatcagccaaaagttgtttgacaacgcctaccgtctccatcccagaatcaactaacgtcacatctgcccccatcgctgaacgaattgagtcgataagtaacggaaaatgcgtgcaccctaaaatcaaagtatctactggatgcactttaaaatactgtaattgatcagcaacaagctgatttgtttgtggatcatgatacttatctgcttccaccgctgtcacgaagtcgggacaagctagaccctcaatcgaagcatttggggctaagtgactaatggcgctctgataagcgtggctcttgatcgttccctcagtagcaatcacaccaatgtgctggccagttgaaaccttaactgcggtctgactgccagaatcgatgacgccaactacgggaatcgatagcttagcctgtaaaatcggtaacgctgctgcggtagcagtattacaagcaagtaccagtgccttaatgtgctggtctaataagaagcccgcaatttgctgaacaaagtggacaacttcttcagttgggcgagggccataaggtaaccgtgcctgatcgcctaaaaagacaattgattcgtttggaagttgtttgagagcttctttaataacggttagaccgccaacaccggaatctaaaaaaccaatcggttgagatgtcatcacaatctccctttcaaatatatcttgaaactacattattatcctttttaacaccggaagcaagaaatctcagttttttttaagttccgttaattatcttgcaatttaagcacattccattgtaatcttaacgtaatagaaaagtgaatggagaacacctcatgaataatcagatttacgcacattatctttcagatcccgaaagcaccccactttttggtaaagctctctttcgagacgttgttttaaacgatctattgggcgccgatgcaggtagtattgcttactgggaaggcaaacagctggcaagacgattcaccttaggaagtatccaagatctcgttttatttttccagcaagctgaactcggtgatctgatgctgcaaaaacaaacggctaaggaatggcagtttacacttagtggaaagcccgttaccagccggctttctttacagccagatgccactttttcactggaagccggttttttggcacaaactgctcaacaaatggttggcgtcatcgctgaaaccgaaatgggtgaaaagcctaagcgagcagaaggcatcagcctgatcgttcacttagatcctaaagacgcgatttcagatccgcaagaattagacgcaatgaaaatcatcgattaacaagtatgaaactaaaaaaatggtcccattatcagcatatcaactgataatgggaccattttttgatgcctaactgcgctttaagcttcaacgtattgtgacagtaattgctttaattgatccttgctgtgatagccaacgatcgtatccactacttgaccgtcctttttcacaagaagggttgggatactcataataccgaatttttgtggtgtatctggattagcatcaacatccatcttgttgaatgttacgtcatccatttcactagatagttgttcaactactggcgattgcatccggcaaggaccacaccaagttgcccaaaaatcagtaagtgtaacacccttcgatgtatcgtcttcaaaagttttatcagtcgtttctgcaacagccataaaacaatccctcctttatttgtttacctttagtaagtgtatcagattttctcaaaagaacaagtatttagcgtttaaagcttaacgatggtcgacccatcaccaccagcattagccggtgaaaagccaaaggacttgatccttggattagactgcaagtattcagtgacaccctttcgcagtgcaccagtcccttttccgtgaatgatggtgactgacggatagcctgccaaaagagccgaatcaatgaaccgatcaacctctgccatggcctcttcgtagcggtgtccccgtaaatctaaggtcggtgatacgccattagaacgagttcgggtaaccgttgctcgcggtttcggtgcttgcttttcaggtgctgcccgttccagatcagtatcctcaatcttcatcttcaagatgcccatttggacttcaaagtgatgattatcgattttatccataatcacacctcgttgaccataggaccgcaccacgacttcatcaccaattttgaagttgtgccgcttcttttcacggtttaagacccggttcttcttcaggcgctgatcttgctgtaaggcgttaatttggcctttagcatcaatcaactggtcttccttaattactgtcttgcccgctttaagttgcttcttacggatatctttgatgatctcatccgcacgcaaccgcgtcttttccaccaacttattggcatcgtctttagcctgctccatcagctgatctttttgcttcagataaccgtcaaatttatctttcaaatctttttctagctgttctgcttccgccaagttttgggccgctgctgcagcatctaaatcagcctgccgcttttgagccgttaaatcagcaatcatattattcaaatcttgactgtcatcatcagtcagactacgagcttcatcgataatggtcgattcaagtcccaaacgtgtcgcaatttccaacgcattactgcgtcccggaataccaattagcaatcgatacgttggtttcaaagtttcagtatcgaactccatgctggcattgattgtttccggtcgattatacccataggcttttaattcaggatagtgggtcgttgcaatgacttcgctgcccatagcgccgattttatccaaaatagccattgccagtgctgccccttcttgcggatcagtcccagcgcccagttcatccaccaagatcaaactgtgatcactggcagcgcctaatattgacacgatattttcaatatgggacgagaaggtacttaaattttgttcaatcgactgatcatcaccgatatcagcaaacacttcgtcaaataaaccaacttgtgaatgctcatccgcagaaataaaaagaccggactgggccatcaactgagtgagaccaaccgttttaagcgtaatggttttcccaccagtgttaggtccagtgacaataattgccttgtaatccttacctaaagcaatatcattggcaacaactcttttaggatcgatcaagggatgacgcgcctgacgcagcgcaatctggttttccggtgataagattggctccgtcgcttttaaatcgttcgcataacgcgcctttgcgttaacaaagtctaaatgtcccagaattgttgcgttattctgaatatcttcttgataaggtcgaagtaaattggacaattccaataaaattcgccgttcttcttgccgctcagcgatttgtgattcacgaagctgattattcttactaaccactgattctggctcaatgtagagtgtttgaccactggcactttggtcgtggacaataccgccgaaatgctgcttatactctgccttgactggcaaaacgtaccgatcatcacgaatcgtcaccaaagtatcactcaaatacttggcgtttttaccccgggtatagcccgccatctgatcacgaatcgtaccttcaaaattattgatttggcgcctaattcggcgtaattctggtgaagcttcatcggttagacgaccattatcttccaatgacacacttaaccgccgactcacatcgggtaaatgaaccaactgtccgaccacgtcgtacaagcgacgcagttcaacaggacgctggtttaaatcatcaaagaacccaattaccgactgaaccgtttttaggacctggctgatttgcgccaactcagtcccgctcaacgtcccttcaatcgccaatcgttttaagtgcggactgacatcggccaacttaggaatcggaataccactttctagccggtaaatatctgccccatctttagtttcgtcaatctgttcttgaacccagtcgagattactgctgggctccaatttttttaactcggcatcacccgcagcagaaaccagatactgtcttaactgctgtttgatttggtcataggccatcgttttataaattttgttattcatcgttaactcccataactcaaatgctgttgtgactcatgatgcttactgaaatccgttaaaccgatttaaagctaggactcaggagaacttgtgtgatcatcatcctgatcctgcttttttaagcgatcataagcttcggtcttttctaattgatcggatatcgcgttaaaagctaataaaatcgaggcttcttccttactcatatcaggtgccaatttttttaactgcgcaagctgtttattcatcaaatcggtaacagcttgcatatgagcttcggttcgattgccgacaatcgtataactttgaccgtcaattaccgctttaaagcgtctgcgagctggttgtggttttttagcgttgtccaaatgattcacctccagagtctctattaaactcatttagccgctgacccaaacggaccagcggctaaatgaacgaggatgatatcagacttaaagctggcataccacctcactaatactcatctacttaggatctggtactccccagtcttgatcggaagcatcagtaccgccaccatttaagaaggtgttcagcattgactcaaccatatcccattcatcatcgttttcgattggaatcaaatcgccgccttgtggatcggcaggatcatcaccgtctgcaagttggtaagcttgaatgtccacttcttcatcgtcagctttaccagctggataaagtaaaatgtaagatttgttgtagtctggtgatttaaacgtaaacagaacgttatataattcctcgttgccgttttcatccaccattgtaatttgttgttcgtcgttgttttcactcatgttagtctgcctcacttttcttttgttaaagggcctttgcgatccaagtagttctgaagaatcaagctggctgctagcttatcgatcacttttttgcgctttttacgcgaagtgtctgcttcttccactaacatccgttcagcctcgacggtggttaaccgttcatcctcaaaatcgactggtaaatcaaatgtttgtttcaataattctccataatcttgagaagcctgggctctaggtcccagcgtgttgttcatgttcttcggtaatcctaagacgaaaccggtcacttcataatgttcaaccagttccttcactcggtcaatgccaaactgtttttcttcttcattgattcgaatgatctcaataccctgcgcagtccagccgagcatgtcactcaccgcaactccgacagttcttgaacctacatctaatcccattaatcttatcacttagtagccgtcccattctcatttaggtagaagcgaaccaattcttcaatgatttcgtcgcgctcatgcttacgaatcaaattccgggcgtcgttaatacgaggaatgtaagccggatctccggataacaggtacccgacgatctgattaattggattatatcccttttcctccaacgcttggtacacagtcaccaatgtctcatgaacatctttcggcttcttatcaccgaaatcaaaatacatggttttatctaacgtactcatgatcacacctccaccaatgctatttgttcttattttacctaatatggtcaagaacgacaatggttgtggagcgttgtaattggaatgaaatatattaaacagcaattgaacgctttttcaacctagtaagtaaagtctaacacgttagcctaaatttgacagccattttgcagcttcggtcatggcatcctgcaaacctgctgggttcttaccacccgcctgtgcgaggtttggccggccaccaccgccaccattaatttttggtgaaatcgctttgattaagtcaccggctttaacaccggtcttaatagtatcgtcattgacggccacgatcaagttagccttttcgcccacttcagcacctaatactaacacgtcggataattccttttgacgccaagtatcagccagctgacgcaactgatccatagaggaaacttgaaccacaccggtgatcaactttttaccgttaacatcttgaacgttatcaaaaatggcaccggcttgttgactagcaagtttcgcttccaaactgtccgctttattcgacaacgtcttaatttgttcttgcagttgctgaatctttacgggaacatcttcaactttttgtgacttcaatgtcgcagccgcattcgtcaagatttggtcgtgcttttcaaggtattcgtaagcatcacccgcagtgacggcttcgattcgtcgagtaccagcaccgatacccgtttccgaggtgatcttaaatagacccagttcgttggtattcttgacgtgagtcccaccacaaaattcgatggagaagtcgccaactgaaaccacccggactttgtcgccatacttgtcgctaaatagtgcaatggcgcccattttcttaccggtttcttggtcagtcaccgtagttgtcacagggatttcttcaaaaatcttctcattaacgatggcttctaccttggcgagatcttcttcagtaacttgaccaaagtgggtaaaatcaaaccgcaaatagtttggttcaaccagtgaacctgcttgctgcgtatgaccaccgaacacgtttctcaatgcttgatccaacaggtgggttgccgtatggtttttctcaactttactgtgaaaatgagcatcgactttaagcgtcatttggtcgccaactttaataccgcggtgcagcttcaaagtgtgcaggttttgaccatttggtgcatgttgcacgtcttcaacggtggcaattaaattgccgttttcgtctaaaacatcacccttatcagcaacttgaccgcccatttcagcgtagaacggtgtcttgtcaaaaatgacttgggcaacttcgccttcagtagcatccgttaactttccgtcagccacgatgtccgttattttagcattttcaacttctaactgcgtgtaaccaacgtattcacttggtgatttaacgccaactaaaacatcggattgcacacccattgaattatcggtattacgggctttacgggcgcgatcccgttgcttcttcatttcagccttaaagccgccctcatcgactgtaatgtgatcgtcaaaagcgtattcacgggtaagctcaactgggaacccataagtatcataaagcttgaaggcttctgcaccatcgatttcagacttgccgctcttcttggtttcagcaatcaatgagttcagtaaattcaacccatcagacaaggtttcgttaaagcggtcttcttcagacttcacaacttgagcgatataatcactgttttgcagcacttcaggatagtaagccttcattgcttcaccaacgacgggaaccagtttgtaaagaaaagcaccttgaataccaagtttttgaccattgacaacggcccgtctgatcaagcgacggataacgtagccacggccttcgttagaaggtaaggcactgtctccgatagcaaatgtgatggctctagagtggtcagcaatcaccttgaacgaaatatctagtttaggatcctgaccatactttttaccgtcactgtatgattcagtagcgtgaatcattggtaagaagaggtcagtttcaaagttcgttttggcattttggaaaacggaaaccactcgttccagacccatcccagtatcaatgtttttacgtggtaatggtttgtacgagccatctggttcatggttgaactgtgagaacacaatgttccagatctccaagtaacgttcgttttcaccaccaggatagttttctggatcatcttcagccaggttattgaaagattggccacgatcgtagaaaatttcactatctggacctgaaggaccctcaccgatatcccagaagttatcttcttgctctacaatgtgatccggtgccacgccgacttcttcccagcgcttcttagcagcatcatcttctggataaacggtaatgtacaatttttctggatcccagccaaaccagtcatcggaagttaacagttcccaagcccaggcaatagcttcatccttgaaataatcaccaactgaaaaattaccgagcatttcaaataaggtatggtgtcgagcagtccggccaacgttttcaatatcgttagtccgaatagacttttgagaactggtcatccgtgggttctttggcacaacggaaccgttaaaatagttcttcatggtggcaacacctgagttgatccatagcaaagttggatcatcaactggcactagtgaagcactaggcatgattgtgtgacctttgctcttaaagaaatccagatacatctggcgaatttcactgctgcttaattttttcaatatctttctcctttttaaaataataaaacaccgctgctagtaaagacgccatagacgcggtaccactttacttgcaacgatgtttgatcgtttacctcttaaggctcaatgcgctgagcaacggttatttaattctttacaagggagcactcagcatgggaatcgtttttcacatcagccaaaacgtttcttaaaagtccagccgctaagcatatcctcgcaattaatacgcatattagtatacattttttccaaaattcatgcaacctgctttaccatatcgatcaagcaagttcgcagattatttgtaacgctgtgatgaagcttttttgttctttcgattggttcggttcttttgacgcatttcaacacggtgttcaaaccattgttccttagaaatcgcctttttgatgttcttcttgtagcctggtttgacagtcctctttttcttctgaattctacccgccaatgagccagaaatcttctttgctcgaggaccacgcttcttacgccggttacggtcaaaggaatcaacaacttcaccattcttgatttgcttgggtttaaacacgattcccatatcttcaagttcctgaatctgttcttcttgatcaggcgtgtaaaaagtaatggctgttcctggcaaacctttccgacccgtccggccgacccggtgaataaagtaatcgaggtcgtcaggaataccatcgttgatcacgtgagaaacgccatcgatatcaatgcctcgagcggctaaatcagtagccaccacaaattggaagtccaggttttgaatctcacgcatcacccgtttacgctgccgggctggaacgtcaccgtggatcacagcaacctttaagccttgtgctttaaggtaatcggcaatttctactactcgttgcttggtgttagcaaaaaccaaagctaaatagggttcacccatggtcagcaactgatagatcaactcgttcttcgagtgacccttcgttggtagcaaccagttatcaatggtcggactgatcactgacttaactgggatttcttctaccactggattgtccatgtatttcttcaaaaatggccgtaacttggcaggaatcgttgctgaaaagaccatcatttgcaagtgttcaggcattcttgcagcaatttgatcaacgtcagctaagaaacctaaatcaagggtcatatccgcttcatccacaacaaattgtgcagccgtatgcacgtcgagcgcaccgtttttaattaaatcacgaattcgtcctggtgtgccaataactaattcgggctgttcacgttccaatttttcaatttgacgtttcttatccgtaccaccgacgtagttaccgatccgaatgggctgaggactgtgcttagccaattgcttcgcatccccataaatttgataagccaattcacggctaggtgttgtaatgactgcttgaacttcgtgggtctctgggtctaacgcatcgaaaattggtagcaaaaaggcgtgggtcttcccgctacctgtttctgactgaccaatcacactctttccggcgcggatcacgggaattaatttttcttgaatcccggttggttctgtgaaaccgagttctgccactgcctcgtttaaaaagggctttaaaccgaactcttcaaaagtttgactcatgttattctccttgttttgacaatagggcgtctagttctttaacgacttgcttgatttcatcatcgtcgtgagccacggcaccgctggctaaagcgtgtccgccgccaccgtgccgcttcgctaattcattaatggctggaccctttgaccgtaaccgaatccggtaagtgtggtctttagattccacgaaaattgcccaagcagaaacttccttcagccggcctggtaatggcacaactgaactagtagattcatccccaagtttgaaaggttccaatacctcatcactcagcttgatatacgctgcaccactgggtaaaatggttaagttttcgtagacgtaagctgatagtcgtgctaacggaattgaaatttcgtcttctttttgattaacatcactggcagaaaaatcgaactgcattaactcaccagctactttcatagtgtgggttgaggttgatggatacatgaatcggcctgtatcaccgacgataccagcatacagcaccctggcagcttcagccgtgcaagtcaattctggctgcatcgcagtataaaaatcgaagactaactctgacgtgctggaagcctctggtgatacccacattggatcgccaaactggtcatcgttaggatgatgatcaattttaatcagctggtcacccttactgtagcggtcatcgtcaattcgcggctgattagccgtatccaaaacaagtaccaacgcgtccttatacacatcatcttcgatcgtatccgttttgcctaaccaatcgaaaccagggtattgtttaccaaccgcatagatttttttatcaggaaaactggcttttaaaatccccgctaaccccatctgagaaccgattgcatctgggtctggccgctggtgtctatgaataataaccgtttgatgttgtttgattgcctttaatatttcagtctgtgtttcttttaatgtcatgctgagtatcacctttcaactcgcttagtcgtcctatcagtataagttgtctagtcaccgaaagcaagaagccataacgaatgacttaaaaattatttacctgtaaatcataactcaaatctgccatttttgttaactctcacgatactttcggcgctgttcatgctcgaataggtctaacgcaatgttttcaaacgtgatcggtgctaacccagtcagggtaataccaagcaaccgaaccccttctggattatctggcaacgtattcataatgtctttagccatttgcgcatacagttggggatcattagctaaaaaatcgggctgcgtagtccgtttagttttggttttaaaatcaccatagcggacttttagtaccagggtacggccgtgcatttgctgtttttttaccgtttcagctaacatcgatgcaagcttatctaactgcgtatcgacttcactgcgattggtcaaaaacggccagtaagtcgtttcgttcccaatggatttgcgttcccgctggtattccacggggcgatcgtctgcaccacgaacacgttgatacaagatttcgccaaagcgaccaaacttgttgattaggtctagttcatcccaagcgtacaggtcttgcccagtaagaatgtttaaatcatgcattttagggaccgttttcttacctactccgcggaatcgctcaattggcagctgcattaaaaagtcgtgagcatcttcagcgtgaataatggtaatgcccaccggtttgcggtaatcagacgcttccttagcaagaaacttactataagaaataccgattgaactagttaaatgagtctgatcccaaatttcggcttgtaagcgaacagccagttcaaccggatcttcgattttcaatttattttgagtcacatccagatatgcttcatcgaatgcgacagtttcaataatatcggtgtattcatgaaaaatgcggtgaatgtgatcagaaatggcccggtaatggtgaaaatttggtgtcacaaacaccgcttttggacacagttttaatgcctgctgagctggcattgccgaatgaataccaaactttctggccacatagttggcggtagtcacaactcctcgaccacctgtttgccgcggatcgcgagaaattactaagggctgtttcttataggcgggtgtgtcgcgctgctcgatggaggcgtaaaaggcatccatatcgacatgcaagatttgacgactatcatcaacatgcactggattatccaaactgacgccccctctttacaaaataaaaaatctcccttgataaaaagggagataaaagctacttttcagctttggtatcatctgtcgaatcatcagttgctgcgtctgaaggcgttgcttcagccgtttcagctttgtcatcttcagttggttcagctggtttttcttcagctgctgcggcactagtaacttcactagcggcagaacgttgggtcactgatgcgatggcatttaagtcaaagaccaaataaatcccgtcacaatcaagtgtcactgtcttagcttccatgttgatctcatcgatcacaccgtgaagtcgaccaatggtaacaacgtgatcgccctttttcagttggttcaacgtatcttgatgcttcttttgttgcttacgttgtggccggatcatcaagaagtacattgcaacgatcatcaccacaatcaacaacatgctggagtaacccccagcgttcgagcttgctaaaacgttcaaattctttcacccacctttgtctactctataatttaacaaaaattcggctatcagtctatcaaatattagaaatttttaggatttggccgattatatccgtattcttcgaagaaattagcccgaaaatccagtaaattatccgccatgatagcttcacgcactttttgcatcagatgcaacaaaaaatataaattatgataactcgttaatcgcaagccgaaactttcatccgctttgaataagtggcggatataggcacgggtgtaattacgacacgtgtaacagtcacactgatcatcaatgggtgaaaaatcacgggcgtacttagcgtttttcactgtcaggcgaccatgactcgtcatgcaggtaccgcgacgagcaattcgggtcggcagcacgcagtcaaacatatcaatgccgcgcatcacaccatcaatcagcgaatccggtgacccaacccccattaaataacgtggcttattagttggcagcatgggcgccgtaaaatcaagcacccgattcatttcagccttggattcacccactgaaagtccaccgatggaataaccagggaagtccatgctgacaagatcgtgggcggactgacgacgcaaatcctcatatccggccccttgaacaattccgaacagcccttgccagtcaggattagcgtgggcctttaagccccgttctgcccaacgcgaagtccgctcaactgaatgcttaatgtagtcataactctcaaaaaacggcgggcattcatccaaactcatcataatgtcgggtcccaggtcgttttcaatctgcatcgctttttcgggtgataagaacatccgatcaccattagaaggattcctgaagtgaactccttcttccgtaatattacggttctctgctaaagaaaagacttgaaagccaccagaatcagttaagattggcttatgccaattcatgaatttgtgcagtccgccagcttctttaactaaatcttcccctggctgaagccatagatgataagtattcgctaaaatcacaccagcacccatctcatctaactcttcgggggccagtgatttaacggtggcttgtgtccccaccggcataaacatcggtgttggaaaagtgccgtggggcgtaatgagttcacccagccgcgcaccagtatctttttcagttttgataaggcgatatttaatcgctggttccattgctattcctccgtatttaactaacaacggccctttgccattatcagcagcaaaaggtcgtcatacaattactatttaatgaacatggcatcaccgaagctaaagaaacgatagcgttcttcgatggcatgccgataagcatttaaaatattgtcgcgaccagtgaaagcggccactaacatcaccagtgtcgatttaggcaaatggaagttagtaataaaggcatcaacgacttgccacttgtaacccggtttaatgaagatatcggtccagccagaatcagctttgatttcaccattgaacttagtcccaatggtttctaacgtccgaatggaagtggtcccggtagccacgatgcgcccaccgttttcacgaacttcattcaaggtcttagctgattcttctgacagttggtaaaattccgaatgcatcttgtgatcttcgatattcttttcgtccactggccggaaagttcccaagcctacgtgaagtgtcagataaaccaacttaatgcccttgtcctgcaccttttgtaacaactctttagtccagtgcagaccagctgtaggggcagccgcagaacccggcgttttggcataaaccgtttgataccgttccggatcatcgagcttttctttaatataaggtggtaatggcgtctcaccaagtttttcaaggatctccatgaagatgccgtcgtaatgaaattcgatcatccgaccgccatgttccagttccttagttactgtagcggttaacaaaccatcaccaaagctaataacggaaccgactctgatccgtttagctggcttcatcagcgtctcccattcgtcacccttggtattatgcagtaacagcacctcggcatgtccgccagtatctggcttaacaccatagattcgcgctggcattactcgagaattattcattaccacagcatcgccgggattcaaataatcgataatgtcgtaaaaatgtttgtcagccatttcaccggtttcgtgatctaaaacgagtaaccgggaagcatcccgtttttcaatcggtgtctgggcaatcagttcgtgtggtaaatcgtaatcaaaatcttcagttgttagtgtcattatgaaggtcctttcacttgttgtcaggcgttattccaagatgttcataggccagtggcgtcaccattcgtccacgagccgttcgtttaataaaacccttttgcagtagaaatggttcgtacatttccgctaccgtatcggtttcttcaccaatatttgcagctaatgtattcaagccaaccggcccgccattataaaaacgaatcatggtttccagtagtttaatgtcagtttgatccaacccttcgtcatcaacctgcagcatttgtaaggcatgctgaacaattgtccgatcgatggagtcgtggtgttccgaaacttcagcaaaatcacgaattcgttttaataaacggttagcaattcgtggcgtaccccttgaacgacgggcaatctcgtgtgccccttcttcctggatcggcgagtttaaaattttagcagaacgcttcacgatttgttctaattcagtcgtattgtaataagccatatggcccacaataccgaaacgatcacgtaaaggtgctgataaaagtcccgcccgggtagtcgccccaatcaacgtaaagggtggcagtggaaaatggattgggtgggctgtcggtccctgccccacaacaatatcaatgaagaaatcttccattgccgaatacagcatttcttccaccacttttggtagccgatgaatttcgtcaataaataagacgtcaccaggattaagctcatttagcagtgccactaggtcacccgttttttcaatggccgggccactagtcgtcttgatacccacttgcatttcactagcaataatcatggctaaggttgttttcccaagtccaggaggcccatataaaagaacgtggtccaatgcctcctcgcgctttttagcagcacgaatataaacactcagttcccgctttaagccggtctgaccgatgtacgtcgataaactgctagggcgaagcgactgttcaatggatgtttctgcttcgtcttgtttatcaccggcaactattcggttatcttcggtcatctgctcgcccccttgacttcatccttgttactaattcgttaatagtttcagtgcagcacttaaataagcatccgtggtttgttcgggttcactttgcaacgccttttctacccgcttaatatcacggtctttataccctagtgcagttaaggcttctagtgcgtcagctaaagcagcgttgtcagttgatgaaattgaaggatgtggtttatcaaataaactatttgccgaaaactcgtctaacttatccttcaaatccagcacaatttgttgagcggttttcttcccaatcccaggaaacttcgtcaaataactcacgttgtcttggctgatggcttctacgattgcctgttggtcaccgtttgctagaattgccaaggcgcttttggcgccaataccggacactgccagtaatttctcaaataactgtttttcctttagtgaactgaatccgtataacgtctgagcagtatcactaatcgtctgatgaatataaactttggtaaggtcgtcaccgacttcaaaccgaaacggattagccacccgaactaggtaacccactccgttaacatcaagcacaatgtaagcaggctgaatgtcgacaacttgaccatttaaatactcatacatttctacgatagctccagttctataatttaagtaaacgtatgtttgcttatgagattgtaacatgaataacggccgacaggcaaggtagtctcgtaaactaataaaacccgatttatcggctttgtagaccaataatcaggttatttttaacgtctagcgtgggcttaaatgccgcacttttcaagacttaagtttaattttatccggtttcactgctaacgcaattatacccgcaacaatgcctagataataagtcagcagccgccaaagcagcattgctagtactaacttactagaattcgtgatatacgaactaaaaagtaccgtaaaggcatattcagccccaccggacccaccaggaattgggaaaatggaaatcaccatgacgatcaaaacgtgtaaagaggtgatcatcacaatattggcctgagtgtatcccagcgaaagcataataaaatacggcactaagtagtaaaacatcaactggaagaaggtaatcacgatcaccttcagcaataacttccattgaccaatgagctgaacactttcctgataaaataaatcgattttcgtatccaacctaacaatccaggcgttagtcttttctgcactagtaaaccagcgaacgggaatcatcacaatacgcatggccttcttggtgaactgcggccaaaacatcactaaaaacaagccgatgatcacggcgaagtgaatgacaaacccaaacaccacaaacaacgataagtaactcatcttactgaccatataatgaaagccaatgatcaaggcaatcaagaagttgatgacgatcatggcctggtaaacgatgaatttcatcaacaaaattgagctggctttgccaccatcaataccactttgcagcatggcaattaattgagctggctgcccaccggatgaaaagggggtgataccgttgaacagctgctcgatcaacggaatccgcagcgcacttttaaacgaatattgtcccagccgttcatccgcaaaaaccttcaccactagtccttccaacaagaagtacagtagcatacaggccaccgcaactaacagccagccttggtgaatcgtcgtaaaatcacggattaaaatattgagtttaatgtcccgtaatgagtaaccgaagatcgaaacacccagtagtatgattaggaacaatgcaattttattacgtctcgacatagtaatctatcctctttttgcctgttcagtatagaattgcagccagattttggctaatcgttcctctgagtagtagtctgcaccctgttcggctttcttttcaagcgccagaagggcatctgagtttgaactaagattagaaatgatttgatccatttcctccacgtctttagccgcggcatagtccccctcgatgatggcatgatataaatctaaatctcggagcaacacgggagtatgggtactaaacgcctccagtacggacattgggaatagctcgttataagatggcagtaaaaataaatctgccatgttgtagtaatccaccaacttgtcgcgatcaataatacctgggaaactcaaattggcaggcggattatccactacctgcttcagtttctcatacccatcagtaatgcgaccaaaagaaaatcccccggtccagataaactggatttcgggatgccgttttgctaattcgataaaatcaaaaacgcccttacgaacctgaacctgtcccgaacccaaaatggtaaatttatcagggtagccgtactgttttcgcagtgtcagccgttgctgatcatcggcagggtgaaactcttccgcactaacaaagttaggaatgtaagtcaccttatctttactgatgccatacgcttccagcttaggaataaacgacggattaaccaccaccaactgatccatccgtttgtaaaacgcaatcacataacgataaaaaacggccttcgcaattttaggtaacttcaaactaccttccaacgtttcgggcagaaaatgtacaaagccgactttacgcccccgtccaggcataaaagtcgacaagtaatacggaaagttaactgtatgataatggctgatgtcacagcgaccatatttattgattttaagtgtaatctggtcagcttcacgagttctcaacaatcgaaccaactccgtgtagacactgcccacaccctgacctttaactgaatctgccgccgaaaacattgtgatatttaacatacatagctccgtttcttatttcattattcttaattaccaacgtccgctgaactttcgtgagcctcttcatagttaagctgagcatcacggtaaaaggcaacgatttgttcaccgaatgtttcgcttgagacctgctttaaagtttgatttaaaacggtatgatcagcaattttatcatgcttaagataataaatcatcttctcaatcatttcatcatgcgtcttaaaagttgcacctaattctggatcctgcaacaggtcatccgtataagggctgcttttaaccacaatttttttatcagaggctaaagcttcaatgtaggtcagcccctgtgattctgaatcggaagccgaaacaaacaaattagtggcatgataaaaggccgaaacttcattattattaatctcaccggtaaaaatgacatggtcatccaacccaagatcatggctttgctgctcaaggtcttccttagcgggaccgtcaccgacgatcatcaaatacgcgttgggaatcgtttctaaaatggtggcgaaaccatcgataatctctttgatatttttctcatacgccactcggcttaacgataacatcatgggtgcgtcagccggaatatggtacttttcccggacgttaagttcgttttcgtccggctcgtactgttccaaatcgatcccagtcggaatcactcgaattggcgctttaacaccgtaatcgctgagtttatcgattacccgttcactaggtgcaacgacaccatctaaatggctgcagaaagctaacgtcatctgcttaacgtgtactggcttcaaaatcttaccgttagcaacgtagtgcaaatagtcctcatacatggtgtgatacgtgtggatacacgggattttcatcgctcgggcaacaaacttaccgatcatgcccatggaaaactcagtctgggtgtggacaatgtccaaattcaactctttagccagctgataggcatgcaaaaggccccgaaaagcgattcgccgatcggtaaatgaaacgaatggcacactgggaaaacgaaagatgttgcgttcgtaaacatccttctccacgtgtggatcagttgtggtaaagatatacacctgatgcccttgtttttccagctcatgccgtagtgttttgattgaagttgccacaccactcacttgagggaagtatgtgtcagtaaataaccctatgttcacgacaaaatcccccctatcattaaatccgtcttcttgttgttgataattatattggttaggtatgttgattgcaagaatagaaaaccacatttggtcaacggtttcagccttgcatgaatgcgtttattcaattaataacgataacttatcacccactaaggtgcaagccactttgacgtttcttaatttaaaaataaaaacggctcaccagaaataaaatattccgagtgaaccgtagttgatgtcattagcttgccaaattgtggcaagccattattgatcagtaagtataattgcgagtcctttagtcagtaaggccttcagccttcatcgtcttagcgacttcttccatagcttcagtctcatcgtcgccatcagcagagatagtaacatcggtgttttgaccaacacctaatgacataacacccatgatggacttcaagttgatagacttcccatcatactctaagttaatgtctgagttaaacttgctggctgcttgtactaacaaggttgcaggacgggcatgaataccagcttctgcggtaatccgaaagttgcgcttttccataatatatcgatctcctttatctgctagaaacaaattgggctatttttcattagtttcataactacatcttttatgaaataaatagaaaaacacctttactctaagagtatcaatttattcaagaaaatacaagcagttggggaaaataatcaaccgcttacattgtctatttactgtgtttggtcatggtcatagtgataaatgatcttaccgtttttctcagctttacccacaatccgtttacgcgactcaaactgcatgtaggctgtttgaaacgccatgaaatctgctggttcaactgtaaattcatctaattcacccgatttgagttgcgccatcaaattggcatagtcttcagccaaagccgtcacctccacagcacgaaaaatttaattcaatacattgtaccataacttccagtcagaagtccgttctcacagcatgaataaacgacttatttacctagaaaataccgattattcagtcaaactgcttgcaacatctgccaaaatgaagtaaaacattacttgagttagcactcgagtagtgatggtgctaattttaactgataagtgcgagcaaatgacttgcgaaaccacttgaatattgtataatgtgtttaaaggtcaagattggtcaaacatttgatcagtgactgacttgactactttaataagagaggagtcaagatatgctgtgtcagaattgtcatcaacgtgaagcgacgattcatttgtacctgaatgtgaatggtcagcgacagcaagttgatctttgtcaaaattgctatcaacttctaaaaaatcagcagaataactctaatcctggaaatggaggcgcacaaatggcacaagatccatttggttttggtaacctagatgatattttccgcgccatgcaaggtggtaaccctaatggcaatcctcaaggctatcagcaacaggtaccacctacccaaccaagcggtccccgtaacggtggcggccaaaatggtaatggcaacggtggcctactaggacaatacgggttagacctcacccaattagcgagtgaaggcaagatcgaccccgtcattggtcgtgatcgtgaaatttctcgcgttatcgaaattttaaatcgacgaacgaagaacaaccccgttttaatcggtgaagccggtgttggtaaaacggcggtagttgaaggattagctcaaaaaatcgtttctggcgacgttccgcagaaactgcaaaacaagaagattattcgctttgacgtggtttcccttgtccaaggaactggtatccgtggtcaatttgaacaacggatgcaacagttaatgaaggaagttaccgataatcctaacgtaatcctctttattgacgaaatccacgaaatcgtgggtgctggtaacgctgagggcggcatggacgctggtaacgtcttaaaaccagcccttgctcgtggcgaattccagttagtcggtgcgacaactttaaatgaataccgtgatattgaaaaggatcaagcactggctcgtcgtttgcagcctgttactgtaaacgaaccatctcctgaggaagccgttaagattttaaagggtatccaaaagaagtacgaagattatcaccacgtccactatacggacagtgctctagaagcagcggtcaaattatccgaccgttacatccaagaccgtttcttacctgataaggcgatcgacctacttgatgaatcaggttccaagaagaacttgaccattaacgttgttgatccaaagaccatcgatgataagatcaagtcggctgaagatcagaaacaagccgctttgaaacaggaagattacgaaaaagccgcttattaccgcgatcaagttaacaaacttgaagacgctaaaaagtcacagaccgataccacttcttccgatgatgaaccgcaagttactgaagaagacatgcagcaaattgttgaagagaagaccggcattccagtcggtgaacttcaaaacaaggaacagcagcagttgcgtgacttgggaagttcattgaaagatcacgtgattggtcaagacgatgccgtagataaagtatcacgtgctattcggcgtaaccgaatcggtctcaatggtactggccggccaattggttcattcctgtttgttggccctaccggtgttggtaaaactgagttagctaaacagctcgctcgtgaactatttggctcaaccgaggccatgattcggtttgacatgtctgagtacatggagccgcattcagtggctaaactgattggttcaccgcctggctatgtcgggtacgaagaagctggtcaattaactgaacaggttcgtcgccacccttacagcttgattttgttggacgaagttgagaaagcccacccagacgttatgcacatgttcctgcagattttggatgatgggcgcttgactgattcacaaggccggaccgtttcctttaaggatacgatcatcatcatgacttctaacgcaggttctggtgacgccgaagccagcgttgggtttggtgctgaagtttctggcaagacccactccgttctcgatcaattaactaactacttcaagcctgaattcttgaaccgatttgacgacattatcgaattcaactcccttactaaggagaacttgatgaagatcgttgacctcatgatcactgatgtcaacggcatgcttgccaaccaaggtttgcacattcacgtcactgaaccggttgaagcgaaacttgtggaactgggttacgatcctgctatgggggcccgtccattacggcgtgtgattcaggaacaaattgaagaccggattgcggacttctacttggagcacaatgacgttaagaacttagtcgctaagattgaaaatggtgacattacgcttgctgaagaatcaccggctgcacctgcaactagtgaaaacaagactaagaagtaatgtatgatgagagctcgactatcatttatgtggtagccgagctctttttgtattctcagcaactaatatctccgcgaaaccgtttccgcagcctaatagttggggtatactagaggtaacgttacagtgagagggggatccgcatggctttttttgatcgactacgaaaattaatgactaaaaatcgaccacgaaccccctctcgtcggagaaaaacagtttcatctgaaaaatttgggacaagaaacagacatgccagcataaagccaactcctcagttgactacccaagccagccctgaaactaaaacttcaaaattagattccgctacgaaagtaacttccgaaaaacccgttgaaactcaaccggcatccgcagtgatgctggttttgtatctggatgatcagaatcagtcactggcaaaaccacagtggctcaacggtcagctgggtgagaaaatccactttagtcctcgccatattgataattatctactgtttcacatcattggttttaccaccgtatttgccagtccataccgcatcatgacactgcagtacacgaaaaaattaggtcacccagttatcatgtattccgttgactacgacactcgggaaatgattgcgccaccggttatccaaactggcgctgtcaatcaacctttcgcctttagcacagcagtcatcgatggctttcatttgattaaggccagccgttcgctaactggacattttactgaccaggcacagacgatcattgtcatgctgcgtcgtaatagctggatggctgttcaacgaatcagtatctttgttaaattactggagagtacgcggattttaaatcaacccgatggtgacccgtatcgttacgaatttccgaaaaattcagtttggcgcgcctttattcgggttaatactcaaaacggtgaaacctggttcaatttgggtggtccacaatggatcaacggcaaaaacattactcagactgaccggccagaaaatcaacaaatcgctcaccgtaagcccctaacctttacaccagttaaacaagttgccgtcatcgattttgttgccggtcgctcgttacacacttacgaccggccaaacggccaagcagtaaagttgattgccgatggtacgagggttcaaattaccggtgaatatacggatattcatcagcttaaatggtaccgaatggccgatgatacggtcattcgagctcagtacgttaaattataatggtataaaatacaccacgatgccagccaatactgacaccgtggtgtatttagttactcttcatccaaaaccattggtgatttaactttaatcagtttcacccgcttattgatttcaagcacgcagctcggaatgaagatggcgatgaggataactagccaattaattgccggcaaagcggttaactggaacgcatcccgcaaccacgggaagattgctgtacaagccacaaaactggctgccagtagtacgccagcattcaacgctggattgcggcgaatcccctgccacgataatggtgaacgctgcttgatcggataaatatcaatcatggaacccagtgccagagtgaagaacagcatagtcatcccaactgcagggtcattattagcaagtccgaagcggcctaaactgtatacccccaaagtcaaaatgataaacgttgtggttcgaacagctactcgctgacctaaaccatccgcaaaaatactagtctttctgctaattggcggtcgtttcatgtttcgtgcttcggctggttcacgactaagatagaaccctggaatcccatctgccaacacgttgatcagcaacagctgttcggcaatcagcggtgcgccccagccaatacctaccgcaaaaatcatcaggaaaatctgagcgaagttaacaccgatcaagaattcaaccgcttttaaaatattttggtaaacggctcgacccgtagatactgcggcaacgatggtttcaaaattatcgtccgtcaaaatcatatcactggcgttcttggacacttcagtcccggtaatgcccatggcaacacctacatcagcggccttcaacgcaggtgcatcattgaccccatcaccggtcatagccaccgtcgcaccctgttgctgccaagctttaacgattcgaatcttatcttcgggtgacacccgcgcataaacactaattgcttcaatctgttcagtgagctgctgatccgtgagctcccgcaatgccgcgcccgttatgacctggtcaccggcacgtaaaataccgatttgttttgcaatggccttcgcggtttccaggtgatcacccgtgatcatcacggttcggatccccgcttccgcagcttgtgctaccgcggcgattgccgtttctcttggcggatcgatcatcccaatcaacccggcaaaaattaaatcatgctgtaggtcttcaatcggtgtattaggcatggtatcaaagtacttgtaccctactgccagtacccgcagtgcattgtgggcaaaacggtcgtgaatctggttcattttggcttgctcactagctgattgtttaagcggtaagcgatcaattgcccctttcacgatcagtaatgccctgccatccggtaattgatgaagcgtcgccatagttttcttcgttgaattaaaggggtcttcagccactcgaagcgcatcacgctcaaagtcggctcgggttaatccttcggccgccaaccagcgaacaatggctaactcagtggaatcaccaatttccacccattcatcgttcactttttcacgggtggcattggtcgccagtcccattaactgcatcagcgttttggtctgctcttgaagcggaccattacccaccgttgttggttccgaatcaaaaaccgaccagacctgtgtgaccgtcatctgattttgggtcaacgtccccgtcttgtcggaggcaatcacgtttacgccaccaatcgtttcaacggcatctacccgacgcataatggcgtgctgcttagccattgctccgaccccgtgagacaaactaatggtcacgatgatcggcaaggtttccggcactgctgccacggccagagaaactccgatcatcaaggcatccgttagtgtatcaccctggaaaaagagacctaaaatggtgataataataccacctacaactgcaactgccgtcagccgactagaaagctgattcaaccgtttttgtaatggcgttgttcgcgcctttgtccggttcagcatacctgcaatactaccgatggccgtattcattccaatagcagtgactaccatctgaccggttccctgcgtcacacccgtcccggaaaaagcttcattgacgcgatcaccgatttcagctgcttctgccaccggttccgccgttttcttaaccggttcactttctccagtcaaaacagcctcatcgattcgtaaatcggtcgcttcaactaatcgaccgtctgcggggatctgattcccccctgacagtataaccacgtcgccaacgaccagatcagcggcatcgataacctgttgttggccatcacgcatcacggtcacttcatggacgttcatcttttttaaggcggctaaggatttttcggcactatgttcttgatacatgccaatcagcacgttgatcactagaatactaccgatcacaatggttttcgtccagccgccgtctgctgcaacagccagatacgtcgataacgccaccgcaaataatagcaccagtgacgccacatcagacaaatggcgccaaatcttttgaataagtgttggcggcttttcttcctgcaacacgttgcgaccatcatcttgtcgctgtgtcacctggacttcagtcagcccactggtcaaattagttttaagtaccgtctccagttcttgacggttcctctcagcattcgtcattgtcagcagtcctttctatgggcgctagccagtctatatctacttttagtgtacagaatgcgctgccgagataccatgaattaattatgattagtattagaattcttcatgaatttaaaaaacgccacttcctgataaatcaagaagtggcgttttagataaagataaattctacaaattaacgtccatgttaaacgttaacttagacagttccaaaccatgttcaaacaaatcattcattaacttagtcgttctggccttcatctcagaaacaattagatagttttgctgggtaagatacgttgtcagttcttcaccagacagtttgctggcgactgcatcggtcttcccaatgtgctgtgtaaacaattcttgactagctgttagataatcgcggtcttcctgcacaaattctgcatatcgtgattcaaccagtaccgataacttacggtacatccaataggcactttcttggtcagcgtgcacaggggtgttcacgtaggaaggatccgtatcgttcgcgttggcaaagaatggtacgtaaggactaaaggctggtacgcctaaacaaagccacatgatggcggactgtgcttccggcacgttatttcttaattgcagcacgtgagaattttgcgtccggttcatggaaatgggccgaaacttggtcttcaacttttcgggaccattccccaacggatcatagtccgtttcgttgtaatgtgagcccaaaataaagctaatatccgccacgctgattttgcggttggcatgacaaatgaaaggcagctctgatgaagttggtgactgttcaacgtctggcatcaaataacgttgaccataccaaacccgtggtgtgttgtaatgacgatctttttcagtactggtaccaaaaatatgacggaagttccagccggattgatcaggatttaaatgatgctcggacacaaagtcttgaatgccttctgaatacataaaattatcgggatcattgaaatctactgactgaatggcaacttgattagcagtaatcacaaaagcatcgtctgggacacgttgggcaacccagtgatgacccgtcacgatttccatataccaagcttcatccttatcagcgaacaagacaccgttaccttctggcgaaccatactgtttaattaaatcgcccagtaccttaacaccgttacgagcgctagtgatcactggtaataccatcgtctgcatggtatcttcagccatgccgtcagcaactaacgggtcaaaagctagcgcgttaggattaccgtacacactttccgtagcgctcatggcaacgttgtgggcattgataccgctctcttcataaagtccaaccttatcgacctctacatttggcgtcgcctgatagcgaaccgcgttcttagggagtggtgcttcaaacccgttttgagtcgattgtaaaattttgccttcattttcttctggttgatgcatgtaaaagcgttgcggcgttaacggcaaaaacgtatcgtcatttctggcaatcatgacggaaccgtcaattgacgcgtttttaccaactaaaactgaggtacaagctgaaagatgtgtcatggaaattctcctttgaattttgtctgctattagtatatcgcaatttaattattcgaaaacactgtaagcgatttcttttttcttgtgaaactattgacaactattttctctcgtgtaaaatacaattgtgaacaactatacttaattaaatgttttaacataggaggacattttgatgaaggtcgcagtgattggttgtacccatgcaggtacgtttgcaacaaaacaaattttagcggagaatcctgatgctgaggtaacagtttacgaaaaaaacgatgtgatttcgtttctatcttgcgggattgcactttacttaggcggacaagtgaaggatccacaaggacttttctattcaaatccagatgaattatcaaaactcggggcaacagttttgatgagacacaacgtaacagctattgataatcaggcacacaccattaccgtggaagacctggcaacccacgaagtcaccaccagctcatatgataaattagtgatgacatcgggctcttggcctatcatcccaccaattcccggtattgatagcgataaggtactgctgtgcaaaaactgggctcatgctcaaacgcttttccaaaaagcagaaaatgctaagcgaatcgccgttattggtgccggctacattggtgctgaactagctgaagcatattcactcaaggggcatgatgttacattgattgatgctcaagatcgcgtcatgccaaagtattttgatagtgcgtttaccgataaaatcgaagatgaataccgtgcacacaacgttcagttagccttgagtcaaaaagttcaggggtttgaaacaaccgctgatggtgtcacgatcaccacggataaagaagccatcgacgttgatcttgcagttttatgcattggtttccggccaaacaccgacctattagcaggcaaagtagacatggccaaaaatggtgccattctaaccaacgactacatgcaaaccagtgacccggatatttttgctgccggcgatagtgcagcggtgcactacaatccaacgggtaagaatgcttacattccattagcaaccaacgcggttcgtcaaggaatcctggttggaaaaaacatcgttaaaccaacggtgaagtacatgggaacacaatcatcatctggcttggctctctacggtacctcgctttgctcaacgggattaacctatgaagctgcgaaggcccaaggcattaacgctgagcaggtcattattacggataactatcggccagaattcatgccaaccaccctccctgttaccatgtccttggtctttaatccggacacccgtgaaattctcggtggtgcgctgatgagtaaatatgatatttcacaatcagcaaacctactatccgtttgcatccaaaatcacaacaccattgatgacctcgcaatggtcgatatgttattccaacctaactttgaccggccatttaactacctaaacattctgggtcaagctgctcaagaaaaattaaccacggtaaaagcttaatcatcaagtaaatcaaaaaatcctgatactcagcgaaatggctgaacatcaggatttttttatattttctattacagtttcgacgttaacttaacgtctggatatttgtcggtgaaccagcgctctgcaaactggttttcaaacaagaacaacggatctcccgctaagtctttcaccagcaaatttcggctggaagacatgcgttcatccaactgttctggatcgatccagcgggcaattttatggcccatgggttccatcacaacgtcggaattatattcgtttttcatccggaactggaaaacttcaaactgcagttgtccaactgcaccaaggatatagtcaccagttgtgtaagaagtgtatagctgaatggcaccttcttgaaccaactgcgaaatccccttatgaaatgacttttgcttcatgacgttcttagccgttacccgcacaaatagttcaggtgtaaactgcggtaatttctcgaactgcagttttttcttacccgtataaacggtatcaccgatttggtaatttccggtatcgtaaagaccaataatgtctccagcaaccgccgtttccacgttttcacgggtatcagccatgaactgcgtcacgtttgaaagtcgcatggtcttacccgtacgccctaatgtgacgtccatcccacgttggaacaaaccggaacaaacccgcacaaaggcaatccgatcacggtgtttgggatccatgttagcttgaatcttaaagacaaaaccagagaattccttgtccgttggttctacgtcatcgccctcctcagtccggtgagctgctggttgaggagcaaacttcaggtaggtttccaagaaagttttgaccccaaagttagcaagagctgacccgaagaagacgggtgtctgatcaccactggcaattttagcttcatcgaactgattaccggcatcttcaattaattccatgttttcacgggcatcttcataccacgaattgcttttcagtggttctgaatcgtcaatgtcaccattttcatctaatggtaagtaggtcgtgccatcgctttcaggtcggaataaagcgacccgattatgataacggtcgtaaaggcccttcagttcctttcccataccaatgggccagttcataggataaccttcaatacccagcacttcttcaagttctgcaatcaaatccattgggtcgcgactatcacgatccaatttgttcatgaaggtaaagatcgggatcccacgcattttacaaatcttaaagagctttttagtttgtggttcgatccctttggccgaatcaatcaccatgacggcagagtccaccgccattagggtccggtaagtatcttcagaaaaatcctcatgtccaggggtatccaaaatgttgattcgtttgccttcgtagtcaaactgcattactgaactggtaacggaaatcccacgtttttgttcgatttccatccagtctgatttagcaaaattgccactttttttagccttaaccgtcccagcttgacgcacaacaccaccgaacagtaatagttgttcggtaatggtcgtcttacccgcatcagggtgagagataatggcaaacgtgcgcctgtttgccacgtcttgtgataatgtcatagcactattcctttccagaattggcattaaccgttcttttcaatctgatgtaccacgtagttaaccactttcagtgaacttagaccatcatcaatggaacagaaacggttataaaatttcataaacttcggatcttcactcatatcagggtgtttgagtccatcggcaatgccggaaagcaactctttttcgttattggcgatttgtcctggcagatctttttcgtaatccaggtagaaaccacgtaattcatccttgtacaagtgataatcgtacggatagaagaggattggccgcttcaagtaggcataatcgaagaaaactgaggagtagtcagtgattagcatatctgacactaagtataagtcagaaatattaggatggctcgagaaatcataaacgaaatccgtatagtcactaatatccatggcgttagcaatcaaataatgcatccgtaagatcaaaacggtatcttcaccgaactgtttcttgaaatcatctaaactaaatggcagttcaaaggtatacttacccttttcagcgaattgattatcccgatacgtaggtgcatacagaaccacttttttgtccaatggaatgcccattgattcctttaaggcagtaatctcatccggttcggtattgattaactcatcatttcgaggataaccaaccttcaagatctgattattaaagccgaaagctgaacggaagatctgagttgaataatcgttgggtgaaactaacgcatcccagcgattggcttccttcacaaaattatcgtgatacttactggtcgtcgtcccaggcatagacacattttcaatgtccaggcctagcttctttaacggtgtgccgtgccaagtttggatataagtcacgtaagacggcttcttcacccaagctgggaaccgcgcattactgatccagtaagaactcttttccagtgcccgtacccatttggaagttcgccggacaacgtagggaatctggttttgtttacagaatttcttcaacgaacggtcgattgaccaaacgaaagtaaaaccaggataaagttccgtaaataatcggtaaatggcatacggactatcactaacttgtcgaccaccaaaactttcaaagataatggtcggttgctcatacggccgatgtccagacttgaataaccagcgcatgcgctgcagattgaccttatcttggatcgtccggccaaggttggccaccgcctgtaatttttgtggtagtgccgcaaccttttcaccaagtgaaggtgctggaaattctttgatgacgatcccgttattgatatttttctcaattaaaaccatccggccacctggtaaaacggactgtgtcatctgtccttcaagtgaacgtgccagaatcacccgctgttcaatttgctgggtaccaaccgtgtattggacgaacaaatcttcaatcgagtttgatggtaaatcagtcaatggaacgctagccgtaaacagggtctttaatgagcctgccgcagttgggtaagctaatcgcgcacctgattcccgagtttttaaaatgatcttttggtccttgattggctgcccattaatccgattataaccggtaatattaagagcatcctccgttaagttgacagaatttatcgtgaattcatcctcgggttgctgagtatgaatgttaaaaatcgccattccctcagcatccgagttaacttgataataactggttagcgataactggtgacggtcactcaaatattcggattcaatctgtaaaataacctgttcatctgcagtatcaaacgccaagaataattgccaagcaaactcactttgaccaaaggcttcaaactgcagctgatcaggatcgatttggattcgaattaagttattgtccactacccgtggaacgggaaccgttactgaagctaaactattcgtttctaagagcatgactctcaaattatccagagagccgggaacgtcgatcaattcaaattctaattcttgatttttctttttttggtgtaaacctgataatattgcacgcacgactaacgaccctccttagtaattaaaaatcaactgttgcggtaaatatggggtcaattcgggattatcattgagatcaataaataaaccagaatcagcgggaacaattttctccaacaaattggcgtaaaacgagtaaacgctatcgaaccggtcgtagttttgatagcccaccacttcataggatgattgttcttctgaatcacgatagatgacacggtgctcatcgtcttcttcagaaattaattcggtaaactttaacttcgaagtccgtcccatggtataagcaaagttgacggtccgagcgtgccggataaatcggtaaaccacttgcccttgttgattcagcaataatgcctgagctaacttgccatcacggtaagttaagagtccaaactggttacctgcttcgtacacggcagcagaaataggctgatggtcagcgtaacgcatttttagtagtggctgctgattgccgtcttctttcacttcggcaacaatttcaccatcttttacgtagcggactgttggcctctccagtgcgttagtggcttcaaagcgatgaagtggtaagtcttcgaagtcagctttgaactgctccgactcagcaacgtccacacccgcttcatctgccactaaatctgccaacgacaccacgttaagctgagccagccgttttgctttgaaaattgactgaaccaaacgacgggcgatttcgtaatcgtcaaactgaatcatcgctaaaagaatggtgacctgaatctgatcgttcattagcgacttcactttttgtttaaacgtcagcttctttaagccggctaaagacgtcaccaaaaatattgcttgtttcattacggcattaacctcactttaaattgcaataaaatatccctagtcgcaactggggatatttgtcgttacattcaactgattattctttccagtcaactccggctttaaggcccaaatcttccttgattttagtggttgaaatgccctctgtccgaggtaagtaaattacttgacaataatctttcaagaaatcaaacttacccttccagtcatcgcccataacaaagatatcaatgtcgttttcttgaacgtctttgatcttttgatcccaatttttttcgggaatgacttcatccacataccggatagcttctagaatatatttacgatcttcatatgatgtatatgcttttttacctttaaccgcattaaactcgtctgatgataaacatactgttaaatgatcaccaagagctgctgcccgctttaagagtcgtacatgtcccttatgcaataaatcaaaggtgccatacgtaattacttttttcatttaaatctcctgcttaattatgaatttaaatcactgtatcctaactcgactataatatcataaattctaacacaacccaacaggccttcaacgaattatcgcttgatttaactaaacgtttaagttccggatggcggttgccctgaactttcatcccgacgttcgctttgcagctgccaaatatggtaaatgttttcgacgatcactttgaccacagcgtatagtggcacccctaagatcatgcccatcaaaccggcaatattgccagcaaccatcaaaataacaatgatcgtcagcggatgaattttgagcgtacggccaattacgttgggataaaccagattaccatcaacctgctgaacgataacagtgacgactaatactgaaatcacttcaactaaaccagagccaatggcaacgatgacagcaggcaaaacaccaatatagggtccaacatacggaataattttgcacattccagcaaaaataccaagtagtaaaccgtacttaagtcccactagactaaaaccgatggaggtaaacgtcataacaaacaaacattcaatcacttgtccaccgatatagcgagatagtgtctgactcatttgcgtcaaaatatccatcgtttgatcagcgtgtttattaggcaacatccgtctcaaagcaggcatcaatttttgaccgtccttcaacatataaaacagcatcactggcactgtcaccgctaaaatcgtcacactggtcgccatcccaatcacggtaccaacactgttagttaacccggtcataaaggttttcgcgtaattggacagaccatgttccaactgcgcagcataggatttaaaatccacgttttttaaccagtcgtactgacttaaacgtcgattcaaaccattcagcatgtcctggataagttgcacgatgtggggcacattgttaaccaaggtggccacttgttgaatcagctttggtactaaccagaataacccaccagctaaaatgccaaacaacgctaagaacaaaacggcgaccgaccacgttcggttaagacggaaacgaccaattttaaccttttgcagcagcttaacgattggattcagcatgtaataaagaattccggcgagtaggatcggcataaaaatagttctaaaaaaagtcccaatgggagcaaacagaaagcccaatttggtacagacccaaattaaagtagccacaatgagaatttccagtgaccaaaagagtaacttagaccgctgtatttgattgaacatccgaataccccctttcttatgtcgttaaagcgctattcaaaaagcgaggtcagcttgttcagctaacctcgctttgatttaagcagccccattacttgtgacgggaaagctcgagatagcgtgagtaccatagatcaacgtattctttcgagaacggacccttacgattattgatccagtcgaccaaaatcaaaacgttcgctttcaaaatcttgtcaatttcaggcggatactgccagcgacgactgaacatctcgtactcgtcaatatcaagcaaccgtttttctccatcaggaaaaaccttcacatctaaatcataatctatatactttaatgcttccttatctaagacatagggtgttgcaagattgcagtagtaagaaaccccattatcccgaatcattgcgacaacattaaaccaatagtgcttatgaaaaaaaacaattgctggttcacgagtgacccatcgccgcccatcgtcttcaatcaccaatgtatggtcattgcagccaatcagggcattttcgcttgttttaagtaccatcgtatcgcgccaagttcgatgcaaacttccgtcgtgcttatagcttttgatcgtaatgaagtcgccttctttaggtcctctagcttcgcgcgccatattaaaccctactttccaaagtgtcgggtatgattaattaaattcgcttatcattatagcaaacccaattcctcaaaacaatggctaaactctctaggactcttcctcaatcttttgttcaagccacttggaaatcaaatcaccatcgaaacctttccggtataaagcctgccgaagtttcagctgccgttcccgttcaggcttgctatggtatctacgccaaagcttttctgcttgtaccgatagcagatccagctcagtttcactatccatttcaaaactggtttcagccagtgcttgacccaccagatcaaaggaaaagcctttctcaaccaatcgctgttggactttttgtcgctgaattttaggggtcagtttttggtattgccgctttaacttttcaactagttcgtaaagccgatctagctgttcttcgggttggtagtcttcagctaaggcattatcaatcagttcgtctttcacgccacgctgttttaattgccgccgaatcacacttggccccttgtcgctagttcgcttcatggttcgtacgtaactgtgagcatagtgactgtcatcgagcagcttatcgtctattaaacgtgccatgacgggagcaatcgtagtctccggcacctcttttttaactaaatagtcgctcaattctttttctgtccgctgctggtaggataaatagttcagcgctaattcataagctttggattgatcatccgctgactgcaaggtagcaatcagttcatcggtaagttcagtcccctttaataatcgatagcgaatcagcacatcttcactaactggaaaagcataacgaccattcacataaatgttataacgaccagtccgctgttgggcctcaattttggtaatttgcaacttaggtgacgattcatctgtcaagtcatttcacactccctcgcgattttgctatactgaaagtaattcatacttaagaataggggcgactttaatggcaactgcacacgttgtgtttgcaaccatcaccgggaataacgaagatattgccgatattattactgaaaaattagaacaattaggtgttgacgtcacggagtctgaaatttcgcaaacggatgctgattcgttggaagatgtcgatatctgcgttgtttgtccgtacacttatgatgaaggcgaactgcctgaagaagggatggacttctacgacgatttggacgatgtcgacttgtccggtaaagtttacggtgtagcaggctctggtgacaccttttacggtgatgacttctgcgttgccgtggatgctttcggtaaaaagctcaaagctgctggcgcaactcaaggtgcagacaacgtcaaaattaacttggaacccgaagacgatgatattgaaactttagacgccttcgctcaaaagttagtcgatcaagcaaagtaattattttttcttgttggaaggccgcttctttttcccgtttgaagccgaccttctttttgtttgccgtttattctgccgtttatggtgagtggttcgtgcctgatccacgatgttctgcatgatatcaagctcttcgatttcaccctgccgccattcttgcacactagcattaataacaccgccggctaacagaatgaagccggagatattcatccaaatcagtaggataataaacgttccaatggtctgataaccagtaatattgcgggcaaaataacggatataaattgaaaacccttgtgccagtagtaaccagccaacagttgtcacaaacgccccaatccaaacgtagcgtaacttaactttcgctgacggcaccaccatgtatagcaggccactcagcaagaaaataaatagaaaggatatcggccatcgtaagctgccaacaaagtccgtaaaatgattggaaaggttaaaccacggctttaaataactgccaagccactcacttaaactaaacagaatggcgatgatgacgattgaaataatagctaataatatcaaaatgaaggaaaaaaaccgactaataatggcgttgggctgttcaatcccgtacgccaaattgatactgcgctgaaaagctgagaccgctcgccctgctgaccaaatcgtcacaacaatccctaacgacagcgtccccgtactgccctgctccagaaaagaacgaataatcggtgccaacgtttgaaatactggctctggcaataccggttcgatgtaccgcagcacactgttggtattaaagtgcaaaaaagcaatcaagttcccagcaatcagtagaatcgggaaaatagataaaagcgtataatacgacaataccgctgctgaatcattgacatttgcattggaaaaacgccgtataagcagctttacaaagcctttaaatccagtttgcatgatcttaacctcacagttgttgctgatgttcttcgataactttcaagattcgttctgaagcatgaccatcaccatacggattcttggcatcagccatctgtcggtaggcctgggtatccgtaagcaaggtctccattgcctcagtcactacctcgggatcagtacccactaactttaacgttcctgcttgaacaccttcagggcgctccgtttcgtctctgaggactaatactggtttacccagtgaaggtgcctcttcctgtaccccaccagaatccgtcataattaagtagctacgggccgctagattgtggaagtccactacgtctagaggctcaatcaagtgaatccgttcagtatcaccaagttccgccttggcaattttttgaacagctgggctcaaatggactgggtaaaccaattcgacgtccggatgagcagccactactttacggatagcgcggaaaacccgttgcatgggttctccctgattttcacgacggtgcatggtcagcaaaataatacggtgctgatcgtcaatctgatccagtacggcgtggtgatagttttcatcaaccgtttgctggagcgcatcaatcgctgtgttaccagtaataaagatacggtcatctggatgattttgtttcagcaaattttcccgactcagagacgttggcgcaaagtagtaatcactcaaaatatcggtcagctgacggttcatttcctcaggataaggtgaatatttgtcccaagttcgtaaaccggcttcaacgtgccccaatggcacctgatgataaaaagcgctgacgctggcagcaaaagtcgttgtcgtgtccccgtgaaccaagatgatgtctggcttgacttcatcgatgacactatctaagtgaatcaaaacccgactggtgatctgtgccaacgtttggtttggtttcatgatattcaggtcataatccggtgtaattttaaaaatgtttaaaacttggtctaacatctcacgatgctgggccgtcacaaccgtaataggtgtaaaatgggttgaatcttgttgcatccttaatactattggtgccatcttaatggcctctggccgggtaccaaaaactgtcattactttaattggtttcgtcattttaatactcccaggtgatgaatttaggtttcattcagtctcaattttaaattgaatcaacgcctataattgtaccagaacccttgttctagagatacaattctacacaattttacacgctaaacacattattcacagaaaattaatcttttttaactttgttattacacctatttgccttatgatagaatttaagcctaagaagggaaggttggatatctatgcgtaccctcagcctgatcgtgccctgttataacgaacaggaatcgatcaacattttttatgatgctgtcgctaaagtatttgacaccatcaacgaaacatctgagcgctatcagccagaatatttatttgttaacgatggctctagcgacaaaactttgccaattttaaaggaattacaaaagcaacatcctgatactgttcattatctatcgttctcccgcaattttgggaaagagtccgctcttgcttgcggactagatgcctcaactggcgatttagttgccgtaatggacgttgatttacaagatccgcccgaattactgccaaaaatgatcgatttgattgaaaatgacggttacgattgtgtcggcacgattcaagaagaacgtcgcggacaaggccggattcgtgcctatctatccaccaaattctaccacgtgatcgatgccatttcgcaggttcagattgaacctaacgcgcgtgattatcgtttgatgacccgtgaaatggttgatacgatcacttcgttacccgaatataaccggttctctaaggggatttttgcctgggtcggttttaacacaacctaccttaaatacgaaagccagccccgcgcagctggtacctcacactggtcttttatgcaattagtcaactacgcgatcgatgggatcgttgacttttcggatgcaccactaaagatcgccacctgggttggtggtatttcttgtgttctagcagtctgcggttttattttcgttatcgtgcgcgcactcatggtgggtgacgcggttgctggctggccatcaatggtttccattatcctgttgcttggtggtattcagctattcagtttggggattttgggcgagtatatcggtaaaatatacctcgaaaccaaacaccggccaaagtatatcgtgcaagaaaaaaagtagaacaaggaaactaatatgcataccttatggcaattatttaaaaaatacgagtcagtaatcagctatttatttttcggtgggttaaccactttgatcaacattggcgtgtttgactggctgaaccattccatgaattatcaaattgcgaacgtgctggcttggctagcttccgtgattttcgccttcatcactaataagttatgggtcttcaactctaagtcgatggcttggaagaccttcctatgggaaacagcgaccttctttttcttccgcctgctttcactggcggtggatcagttgatcatgtatgtgggaatctcactgctttcaggaaatcctctgattgttaaaattattgataacgtgattgtggtgattctgaattacttcttctcaaagtggattatctttaaaaaataaaaacaacctgagcaatcagtccttttactggttactcaggttgtttttatatccacaattaatgactatgctgcaaatcttgcagaaacgttgcaatcaaactcaactgatcaggcgtataccgatcaactaattcctgatgctgtttatccagcagttcgttcagctgattttgaacagtaaccaccttcgtaccgactttagttggctgataaactgccttacgctgttctggcgctgatttggtgacaaagcccagccgcgaaagtttattcatatttttggcaatcaccccaaaactcagatccatagcctcaaccaattgatcttcagagaccggtgccaagtccactacttgttgcaaaagtttcaggctcagggtcgataattgcgagatggcatattgcagatcccggttggaaatatgcagttgaagccattgccgctcgaaattattatcctgagcacgggtattcataatgtcgatcagtgaattttcgatgtggcgtttataaaaatctaatttatccaaagtacatccctcgtttttctgtcaaaaaaactatatcataatttagggaactgagaaagcggtttgacactaacgtcacccaatattatgagttaaaatccacgtgacaaaacaaggcataaaagacttgaaaccactttcaaaatgcttcacaatgaacgtgagctaataattatcgaaagagagctgatagtatgtacaatcacattgttgtaccacttgatggtagtcataattctaaattagcgttgtctgaagcactaaaattagttaagcaattcaacgcagagctgaccattgtaaacgttgcagacgataaacgcttgatttatacggttacgggaacgggtattgcaaatactggcggttattataaagaattgaacgaacgtgcaacagcaattctggctgaaggtcaaaaactggctgaagatgctggtgtcacccctaagactgaaattctccatggcagtcctaaacaagtcattgctgtcgaataccctgaaacgcatgacgttgatttaattgtgatgggtaaatcaggtactgacgccatcgaccgcttgctggtagggtctaccacggctgcagtggttcgtaacgccctgaccaacgtgctggttatcgctgaacccacaaatagctaataataactagcctttacaacaaccccaatccatgagaaaatattcagtgtgctttttggccccatagcacaactggatagggcacccgcctcctaagcggctgatcccggttcgagtccgggtggggtcattattttaatatctgattcattctaaatccttcttaatcattgatgtagaaggattttttattcctttaaataatggaaaacaggtaaaaataatattccggctacatcgcagcgcatttaagcactagttcaattatgatataattacccttattcaggggggaatttataatgaagaaacgtttgttattgtttatggcatcagttttagggataatgggtgtcgcttctgtctcaaccaccactgccaatgcggctagttggcataagggcacgcctactgcaatcaggcaccaatacaattataagaaggggcaatattgggaatattacgctttcaagaagagcacattccggtatcaaggaatgggaatgccttattttgatgcctataaacttaaatataagacattgaaacaccacgtttacgagatcactggaaaagataagagtcgctacagtggtggtcaacgcataattcgtggtggcggtgcagaaaaactcaaagtcacaatcaaaagttcacaccgcatctcgattcacaactacgtgaccggaacaacctatacttacaaacgataattaaagaaggatgcctggctatctgctaggcatttttcatgaaaattgatgtattttagacaattcgcattatccaattatagcgttacaaaaaagcatggttctcagccttattacagctgagaaccatgctttttcatttcaacattaatctaattattttcttgctcgcgcttatgccgcattcctttacgcttagaatgcttgttatgccccttctttttcttagtgggctctggcaaagctgccttgacccttggctttcggctagcaggttgcatagcggtaggatctgtctgcacttcaccggcaaccttagcttcagcgacaatcgtttggtctgaattgatcgattgagaaggctttttaaagctggtactcaatcgatggtcttgataataaacgggcaccaactcatagtcagtatcctttaataaccgcctcaagtcccttaaatcatggtcatcaccaaagttgaccacttgacctggctcacccatccgacccgttcggccgacccggtgggtgtagtcgatagcggtactaggtaagtcaaagttaaccactgcaggtaatttggcaatatctagtccacgagccgccacatccgtagataacagcaatttaacccgccctaaccggaaatcagtcaacgctttttgccgttctgtttgacgctgattagctgataacgttgcaacgggtacgtgatggtgtgtcaaccaactcttagtctgctgcaaggaaccaacgtgattgaaaaacacgagggctttaaactgtttaactgaggttaatttccccagcataccggcctttttcaggttaccaacttctagcaagccgtgacgaacctcaccttgtgtatggtcaatatcgcgcacatcaatgcgtgtaactggtgtcccaaaccacttttgcagttcggctaaaattggcgtctccgttgccgagaaaaagcccaattgaacttctgaaggtacgttttgtaaaatcgtccgaaccgtatcaaaagtctcaccatccagcaaatcatccgcttcatcaataatcacggtttgaacgtcgtgagtcttaagttttcgatcttcgattaaattcaaaattcgaccaggagtaccaaccacgacttctggatgctttttcagctgctccagttgtcgcttaacgttagcgccacccgtaatcgaagtaacctttaaatcgaccagcgtggcgaagcttctcgtgacgttagttgattgcatggccaattcctgtgaaggtgcgataatgatggcttgaatcccttgaccaggtgctagccgctctaaaactggtacaacaaaaccaagcgttttacctgacccagttggtgccaatccaagcacgctgtcaccatttttcagtggctcatagacagcagattgaattggtgataattcatcaaaacctaatttttcgaatcgatttttaaactgtggaatcataataggatcccctcatttctcattagttgtcccgttcgtcgtaaaaaacaattttaccagattgacgtaggttaaacagcattttattgacctgaacactcagattcagccaacgtaggtagtcagtctgattttgaatattaccaggctcgttgatgaccctagcaaaatcccgtacctcaggtaacatcacgttttcagtaacgggttcactgattagcgtcttcttgcctgaagcatcaaagtaattcgcttctcccagttcgccagcatcatcaatttcgatggtatccttcagaccataaatttcagacgccatgtacgagttagtggttttaccaaaattaagtgttacgttaaattcagcgtactgtaacacagcaacacctttaccatcaacgccagtctgaataaactctgggaagtagttaaattcgtttggcataccaaacaacgcaatggcatcatacaacggatatacgcctagatcctgcagcgcaccaccagcaaatttcaaagagaacacgttgggttccttacctgccaatacctggtcatacctggaactgtacttcatgtaggtaaagttagcgccttgaaccaccggcatcttttttaattgcgcttcgatggcgtgaaagtttggcgtatgaatgtttctggccgcttcgaaatagtgcagttcacgatgttgccgcaaaagttcttgaattcgttccatctgagcctgattctcgaaagctggtttttcaacaataatgtttttacctgcttcaatggcctgttttgcctgttgaaaatgcaaactatttggtgaggcaatataaaccgtgtcaaaatgaccttgggtaaagaatttatccaaattggtataggtctccgcgtcaccgtttttttgactaaatgcagttgcagtatcctggtgtcttgaatagactccggttaactggtacagcccagaggtttgagccgcctccacgaattgctgagtaatccagttagtgccgatgatgcctaagttgatcattaaaaacgcccctctttctgctgttaactccatgatagcagttccaaacgcaaatgataattagaagtcgattttattttttaatttaaggtaaagaataaggaatcatttgataaacatgttaaaattaaataagagaaaaggaggaggcctcaccatgaatgcaaaagaattcatccattctagccgatcattactacaaaacttcattcggccttctcagcggtcatctaagcgaactgcaaaccaagtcgctaattcccccatgatttttatcggttcatggaaactgcgtcattccgagacagccaggacgcattctttagtgattggtcctgatttaaccatcagcattgatcaccatacgattccctgcaaagtggtttcactcaccaccgatactttggtattactagatcactatggctatcacatcaccattacagccaataataatattccggttaaaatgtttgatgaagctgacgatgtgatttactatatcgtctcaaacacaactaactgaactaaaataacctgattattcactgcctattagtaacaaggcagcgaataatcaggttattttggtttctattgtgtgctccatgagtgccattgacgctgcgaaccgttaaaaaccgatgcgggcaccgtttgcgactgaccattcaatttaacggtggctttttcatcataggtaatgaaaacgacttggccactttgatgcgatagactcgatgtctgcagccacgttttataccgagcaagtgatgtttggttaaccgactgccagatatttggcgtgcaccaaataatgatgcgtttatcatagtgttgctgcagtaatgaaacaaactgcaacaactttttttgtggctcagattgccgcaaatatcgtgcattatatttaccgtaagtagtaacttgaacggcaatcggcagctgcccttcacggtagcccacttcacgttcaaagtttttaaattgcgctttaggtgaagtggtatagctatacacgtggtaaacgcctattttaagactgctgccctgtgagcgatcataattactttgaaattgatcatcggtataagtcgcccctgaagtcgaccgcaagtacgcaaactgaaaaccctgctgcgaaagttgctgaaaatccacaaaaccatttgcctggtccaatgtcactcctctaacgcggtaatgactcagctgctggtcgcgataatgccgatagccaaaccagccgccagcaatgatgatcaaaatcagcaagattgaaaagaagcgtaatcgtcgtgaacggttacgcaactgtctataagtattggtatagattggctcaatccgtcgtcgtttcacacctgctcatcccttgtctggttcatcatacttcttattctaccatgcttttcaacaattgcaggtttgcgaaaaaataacttaagttctcgtctgattaatggcttccttgacccgactcatcacagcttccgtcttgttggacagtttaacggcaacgatcgtgaacagactgtcgatcatggctaactgagcaattaacgtatacatactgtcagaggtcgtggacatttggtcggccaatgaaagcatgaccatgtcagccctttgcgccagcgaggaacggccataactggtaatggcaatcacagggacatgattattatgcaactgctttaacacggtcaacgtctgctggttttcaccggaatgcgagatcataatggcacaatcgttctcgtccatttttgctgcctgcatcagttgcacgtcaaaatccggatagtattcgctgttaatagaagttcttaaaaacttatggtaaccgtctaaggcagctacggaagaccctcctaacccgaagaaagccagttggtgacactttaaaatgtgatttgaaatcgtttccaactggtcattatgcagtagcgaccgtgtggaaattaaagcgtcgatcattgcttgaaaagtcttctccgtcatttctttaggtgtatcgttagggtcaatttttttaaacagactactgtgattaacatctgatggcacattagccaaatcaagactgaattcacggaagctggaatagccaacagccttagcaaaacgggatattgaagctgtggaaacgcccactttctccgccaattcattgatcgttaaatcgctgaccatttgcggctgggcaaaaatataatccgcaattttttggtgtaatttactcaaattgggatagtaagacctgatactgctgatcgctgattgtgccaaattagttgcctcctacgttgaaaccgactaggtaaatgacgtgttatcgctgaaataacactgtttatatatgatacgagttaaaattccatttaaaagctttcaaacctattttaacacccagtattaacaattggtatggacaccttgttcactttatatcaagtattttagcgattactcaccaatttgtaaataattttctaattaatacttgaattgtgaaatcttttttcatataatgaacaggttgcttcacaaaagtacttatttgagacatttattcttgtaaacggtttaaaagtcatttacactcacattgcaagttcaaatcagaaagggagtcgtagaaaaatggactatatgatcggtgttgatataggaacaaccagtgttaaaactgtgctgtttgacaatgtcggcaaagtacaaggttactccaacaatttgtatccgctttatcaagatgtaccggatatggccgaagaagatccagatgagatcttttccgccatcgttgatggtttaaccacggttttacgtaaggcaaacttaagcgagggtgagttgaagggtgtatcattttcagctgccatgcacagtctgattttgttggacgacaaccataaaccgatgactcgcgccattacttgggcagataatcgtgctgttaagtacgcggatcagttacgcgaaaacggtattggtaaacaaatttacgagaaaacgggtacgccgattcacccaatgactcctttcactaaacttatttggctccgtaacgaacacaaagatttatttgacaaagcccgttggtttgtgggaattaaagaatatgtcatctacaaactattcggtgtcttaaaagaagactactccatcgctaatgccactgggatgttcaacatcttcaagatggactgggatgaccaggcacttgaactagctggcgtgactcgcgataagttgccagagttagttgataccactgatacagtttctggtatgaacgaagactacgctaaggtgattggcattgatcctaacgtgccattcgttatgggtgcttcagatggtcctctagctaacctcggtgtgaacgccattgaccccggtgttgttgccgttacgattggtacttctggtgccgttcgggtggtcactgacaaaccgaagatcgaccctaaaggccgggtattctgttactaccttgcaccaaataagtgggttgttggcggaccagttaacaacggcggtatcgtcttccgttgggttcgtgatcagttattcgcaccagaaaagattactgctgaacagatgaaagtcgacagttacgacctgctgactgagattgcttctaagattccagctggttcagacggtttgatcttccaccccttccttggcggcgaacgtgccccaatctgggatgctaacgcccgtggttccttcttcgggttaactcgcaagcatacccgtgctcacatggttcgggctgcactcgaaggcatcgtctacaacctttacaccgtgctgattgccttagaagaagttgttggcaagcccgtcagcatccaagctaccggtggttttgcccgctcagctctctggcgtcaaatgttagctgatatctttgaacaagacgtcaccattcctgaaagtgtcgaaggaactgccttaggagctgctgtgctgggaatgtatagtctcggtttgatcgatgacctcagcgaagtgaagaagtttgtgggtgtcacaaatgtgcaccatccaaacccagaaacttacgacgcttatcgcgcacttgtcccaatctacatccgtttgagtcggcaattacagactgagtataaagcgattgctgatttccaacgcagccaagatgctaagaaaaaggcatctgacaacgatctttaatttattatgggtatcatcatttaacttcaaaaagggtttcttattgtccgttgctgtgaaacgtcacgaggggcgtttcacaaaactgatttctgaaagggttttctaactatggaaatactagcgttagttatcgggattttattcctgttagttttgattattcaattcaaaatgaacacctttgtctcgttgattttaacttctgttttgactgccattctccttggcatgccactcaccaagattgctgccagcatcgaaactggtattggtagtcaattaggtgaattatcactggtctttggttttggtgccatgctgggtcggttagttgccgacgctggtggtgctcacaagattgccacgactttaatcaataaatttggtcggaaacggcttcaattagctatcatgctcgcgtcattcattattggtattgcgctattcttcgaagttggtatggttctgttagttcctatcgtctttgcaatcgccgttgaagctgaagtcccaattctttacttgggtattccaatggcagctgctttgtcagttacccacggcttcttaccacctcatccagcaccaactgccattgccgcagctttgggtgccagtgatggtaaggttctgctgtttggtattatcgttgccattcctgccgcctacattgccggcccgctgtttactaagttagccgaaaagtttgccccttctgctttcaagcaaaaaggtaacttgagttcattaggtgaagtcaaagaaatggccccagaagatgaaccaagctttggcatttctgttttaacctcattattccccgttatcttgatggcgattaccaccatctacaagatgaccgttgatggcggtacaacgccaactaagaacccaacgatgctggatcaaatcgttgccttcatcggtgaccctgccattgcaatgctgatttcattactgtttgccatgtggtcaatgggttgggctcgtaaacgggcaaccaaagacatcatggaaaccgttgaaaatgccgttaaatcaattgctatgctactattagttattggtggtggtggtgccttcaagcaagtgctgattgacggtggtgttggtaatgaagttgccaagatcttcactcactcaagtatcagtccattgattcttggttggttagtcgccgttgttctccgtgttgctttaggttctgcaaccgttgctgctttaactgcagctggtattgttgctccattgatgtcagctgctggcgttgaccctgccttgatggtacttgccattggtgccggttcattagccgcttctcacgttaacgatgctggattctggatgtttagagaatactttgatttgacggttaaacaaacactttcgatttggacggtgcttgaaacggttatctcagttgtcgggatctgcatggttatgattcttaacatgttcttccactaataatttttcactaataattatcatgaatttctaatgtgaaacccttccccggtgcgttgtcaccggggtttttctttgctataattggttgctattgaattgggaaggacggaagttattttgagtgaaccaaaattaaaacgtgaaatcggtttatttaccgccctatcaaccgtgatgggaaccgttattggcgcaggtgtcttcttcaaggtcgctagtgttgttgaagttacaggctccgccagcatgaccttagccgcttggatcttaggtgggctgctcactatctgtgccggattaaccgttgcagaattagctgcggcaatcccacgaaccggtggtgcaatcaagtacattgaatatacgtatggtaagctacccggctttttaatgggctgggcactgatcttaatctactatcccgcaaacattgcagctttgtcgatcatcttctccactcaggtcttgaatttattcagtctgccgctgatttggcatctaccgatcgccattgcctgcggactgagtattacactcatcaacttcttaggagcgcgagtcggtggggcgttacaatcaatcacactcattttcaagctgattccaatcttcattattgccatctttggtcttttctcaaaggcccatgtcgcagtatcactggtaccaatcactgctggtccgcacctcaacttttggactgctttcagcagtggtctgcttgccaccatgtttgcttatgatggctggatcagtattggcaacgtggcgggtgaaatgaagcatcctgaaaaggaccttcctcgagcgatcgttttagggttagtcttcattaccgttatttacgccaccattaactttgttttcctgaagagtatgccggtaagccaaattgcgggtaacttaaatacagcttcagagtcggctgaaatgatttttggcccaatgggtggcaaactggtcaccatcggtatcttggtttccgtgtacggtgccatcaacggctataccttaaccgggatgagagtaccacttgccatggccaccgaagattcattgcctttcagcaagcaattacgaaaaatttctcgtaagacctacgtcccttattatgcgggtttcgctgaattgggtatcgccatcatcatgatgtttatgggctcttttgatacactgacggacatgctggtctttgtgatgtggatctttaacatcttgctgttcatcgctttatttatcttaagaaaacgagaacctaaacttcgtcggccgtaccgagtccctggttaccccgtgattccaattattgccattctgggtggcctgtttattctaatcatcaccatttggactcaaacaggtttagccgtaacgggtctcattttaacgggtattggcattcctgtttactattaccatcagcataaacgcgacaaaaccaaaacaaaataaatcaagtcctctttgtgagggctttttattttgcagaatttgagaacgattttggtcagtgctaaactgaaaccggttactaaatttaatgtaatgatgggcagatgtaataacaatgacaactgaattggaaaaacagcaaaatggtgagttgtatgatgcacatgatccaatttttaaacagtataaggatgaagctaatcaattcttgatggcatacaaccaaactccctatgatcaagcagccaaacgcaggcagcttttagagcattcactcggcagtatcggcaaaaacgttacggtggggacaccttttctgtgtgattttgcccgtaacattcacttaggggataaaatctcaatcaacatgaactgttcattcatggactccggtgaaatctggatcgacggtgaaaccatgattgcaccaaacgtccaaatctatacagggacccatccagttccgctttcacagcgtttgaatgaacaatgggatgaacaccctgaacagcatttcgtgaaaacccgttccctacccgtccatatcaagcatggctgttggatcggtggtggcgtcattattcttcccggtgtcactatcggtgaaggtacggttattggcgctggcagtgtggtgaccaaggatattcctgatcatgtggttgccgtgggtaatccttgtcacgtcctaagaaagattaaggaataataaaactgctcccaagtgatgaccacttaggagcagttttattatgcacaattaagctttacattgcctcatcatcacccgtatccggcaatggtaaatctggaaacatatgcttcaagtattccgtagcaggttcatcgggtacccgatcagcctcaaccacttgcgtaatcgagttaaacgtcagcatcagcatgattgcaccgttttcgtcgcgaacggcatagtatctgatacccaactgaatggcgcggaaaacgagctcttgagcatgaatgttcaatcgagacattcttggcagcaactgttccgtgccaacgcgttccgccttccacgctgaagccctttgattagcaaaggtcattaaactgccgctgtcgtctaaatgactcactagcttagcagatggtgtgagttctggatgtgacatcacttcagcaaagtcatcaatcgcgttaatcagctcggtgtgtgcctttagttgaactgctagttcatgtagccgacggaagaactgctgcccttcagcagccttgaacgttgcttgagtaggtttctcaagtgcaacccgttcattatctgcttcagcctgctttagctgatcggtaatcttatcgtcatccaccggtgtcactaaagcgtaaataaatagtagtttcatcaagtaaagcgcgtgccgactaatcccgtttgaccggaatggtgttgtgtctaaacaacgaaactcaaggtaccgaacacccttagttgacatctggctcagttcatctactccgcgcaaacgaactggaccgtaaaattcagcctgactgtataattttttactctcaattaaactggaaagtcggtcaacaaagtgtggtaacgattggtaaacagttgcatcaacgccatccgcaggtagattagcatagccaaaatgactatttcgaatacttcttactggatgtgataagcttgccggttgttgcttaaagaagccgtcctcagcaactggtgaagccccaaacaaataagtaattaaccaccgattcaagactaggttttgtgccattctgaaatagagtgcgtttcgaaaatcagtgactcgctgaaattcgccttcataatgggcgtaaagtcggttgatcaccggatctgggatgctgtagttcaagtgaacccctgtcataattttggaagccacaccatatttttcagtgagataatcacggtaatccttgaaagcaggccgttcgaagtgtgctttgataaagtccgtgtcatcagcggtgagccgtggtggcatgctcaaaggccagatgcggtccccaccctgcatcgagcgatagaaaaccgtctgcagcgtgtctagctgatccaataccccaccaatatttgggttgggatctgtaataagctcggcttgtgtctctgcaaaatccgtttgcaaataaggatggaaggtccgcgaacccagcatttgtggatgcggttcacgactgagctgtccctgcatattgacccgattttcctcaatttccagtcctactaacccatgatacagttgttcactgacaccttctgctttaatgacgctcaatagattgtctaacatccgagatcccccgcttgtgtgtgcttacgttgaatcgattataaattaaaacacagtgagtaatcaagggcttgaagcataaaaaaagaactacggagaccgaaatcttcatagttccattcattaaataaattttaatccttttccaataacgtaacggattcgatatgcggtgtttgtggaaattggtctacgggctgaatgggttcagtcacgtggtagccttcttcagcaaaacgttgaatatcacgaaccagcgttgatgggttacagctgacataaacaatcttcttaggttgcattgctgctgcactatggatcaacgtttcatccagccctttacgtggcggatcaacaacgatcacatccggcttcaggccctgtttctgccattcagccatttggtattcagctttattggtagcgaaatgcaaattcgtcaaaccgtttaacttggcgttcttcttagcatcttccacggcagttgaaacaacttcaacaccgtagacatccttggcatggcgtgccatggctaaggaaatcgtcccgataccacaataggcatcgatcacagtttcgttgccagttaaaccagctcggtcaatggctaactgatacaatttttcagtttgtaccggattaacttgatagaaagattgggctgaaatctcaaagcggttgcctaacagtgaatcgtgaatcacaggttcgccatataagacgtttgtgattggtccaagaattacgttagtaggccggttattgacgttttgaataatgctggtcacttctggtaactgctcagaaatctgttccacaatggcctttgcacgaggcaaagtgtggctattggtgatcaggccgatcatcatttctttttcgtagtaactctgacgaaccatcacgttacgaatgattcccttatgcgttttctcatcataagctggcacgttttcggcacgtaaaatgtctcgaacgatcacaatcgctttatcgatccgtgggtcttgaatatagaaatcagtcaatggtaccaaatcgtgggaatgctgacggtaaaagccagtttccaactgtcccttaaccattcgaactggaatctgtgctttattccggtaatgataaggtgtttccatcccaatggtttcagaaacactgaggtcaagtttattcttggccagtaatgattcgatttggtgctgtttaaaacgaagctgtgctgggtagaccatatgttgtaaaggcgcgattcctgcctgggcaagcttacggtccttctcatcgatctcagcccggtctggtgaagtagtcaaatgttccaaaactcggccaaaaccaaagctcttaccgacttttgtcaccacaaacttaatctcttcacctggtaaagcgttggcgataaacaacgaataattgtcaatcttaactacgccgttaccttcataggtcagatccattacggtacccgtgtacgtttcgttttttgctactggtgcttgtattttcattaaaatctccttgttttaaccaaaagaaaggttttgctgccttacgtatcatacagcaaaaccctcccaattaatacctaaaaaattatttctttgattcttcgctctctggcagttcttgaaccccagccaagaatttacgctcagcttcaagaatttcaggcgtttcggtttccacagcagcatccggaatatcatccagattagcataggtttcgatgtgctgcttcaaattaacgaaggtcattggggcatcgccaccatattcaccatctaagttaatcatgattttggaatcgcccttcggtttagcttcaaccttgtgcactttacgataaataatccgcggatcgttaatgtgcttaccgccgtttaacacaagggtcaacagacgcaaaatttcagctaaattactggttttaacaatgatcatggtaaacttaccgtcatttaacgaagcatccggcacgatctgttcaaagccaccgaccgaattggtcaatgccagaaagaacatggaagcttcaccgtcgtattcttcgccatcatatttaagatccaccttaaatggtcgaatccggggtagtaattccgctcccttaaccaagtaagctaagtaaccaaacaacgtttttaagttggatggtacttcataggtcaactcagttaagcgaccgccaccggcaatgttgacgaagtacttcttacctgctaacccaatgtccattttaatcgtttgattctttaaaacgaccttggcagcagctaatggatcctcacgtggaattcgcagtgcacgagcgtaatcattcgtggtaccagccggaataatggccatcttaggccgtttcttcaagccagcaatcccgttgacgacctcgttaatggttccatcgccaccggctgccacaactaaatcaaagccttcgcgacttacccgttcggcttcgtcacgtgccgaattaggagccggggtagtagcaaacgcactcgtctcgtaccccgcctgttcgaagactcctaaaatatcgatcatatccttcttcaaagcctcccggccggaagaaggattatatatcactcgcgcacgtttccgcataagtgtttccctccaatattaaacaactaacgtttactttttaagtgaagcaatcagcagcttgttaaccacttgagggttagccttaccgtgagtttgcttcatgatttgacccacaaggtaaccaacggcacggtctttaccattgttgtagtcatcaatagattgctgattatcagctaaaactgagtcgatgatgggttgcagttgagctgggtcagataactgaaccagacccttttcttcaacgaaggccttaggttctttgccttgggtgatcgctttaaagactttcttagccatcttagatgaaatggtcccatcagtgatcaagttgatcataccggctaagttagctggtgtcagcttagtgtcctgcaaatcggcatgctgttcgttcaagaaggcgttaacgtcaccttgaaggtagttagcagctgacttaggatcagcaccaagtttaaccgtttcgtcgaagaaatcggccatttctttagtttgcgtcagaaccatggcatcgtaatcagttaagccaagttccttgacgtaacgctgacgacgactacccggcatttctggcatttcagcaccaatctcgttgacccattcatcactgatgttcagtgctggcagatctggttctgggaagtaacgataatcatcggaaccttccttgacacgcatcaaaatagtctgaccagtggtctcgtcaaaacgacgggtttcttgttgaatctggccgccagacatcaggacacgttgctgacgctgttcctcaaacgctaggcccttgcgaacgtagttaaaggagttcaggttcttcagctcagtctttgtcccgtattccttttgaccctcaggccgaatggaaatgttgacatcgacacgcatggaaccttcttccatcttcacgtcggaaatcccggtaaattgaatccgttgacgaagtgcttcaaggtacgcataagcttcgtcaggagaagcgatttctggcttcgacacgatttcaatcaatggtgtgccttgacggttcaagtcaacgtatgaataatcgcgttcatgggtgttcttaccagcatcttcttcaatatgcatttcggcgataccgatgcgcttcttttcaccatcaacctcaatttcaatccagccatcatgagcaattggcttgtcagattgggtaatttggtaagctttcgggttatcaggataaaagtagttcttccggtcgaagtgagtatgtggttcaacttgggcatgaagcgccaaagcagccatgataccggacttcacaacacctttattggtggttggcaaaaccccaggatagccccaatcaatgacgttggtgttagcgttaggatcatcaccaaactctacgggagatggactaaagatctttgaattggtttttaactcaacgtggacttcaagtccgatagttgttttaaaattcattagttattacccccttgcttaggtgtttgtttgtgaaaatcggtagcttgttcaaagacgtaacccgctttataaagcgttgattcgtcaaatggccgaccgatgagttgcattccaactggcatgcctttagcaaagccagcaggaatcgacatccctggcaatccagcaaggttaacggggatcgtcaaaatatcgttcatgtacatcgtcattgggtcagaaacttcttcaccaatcttgtaagctggcgttggcgcaactggacccatgatgaagtcatgatctttcaaaacggcttggaagtcgttaatgatcagtgtccgtacttgagcggccttcttgaagtaggcatcgtagaaaccagctgaaagtgaaaatgtccccagcatgatccgacgcttaacttcatcgccaaagccttcgctacgggagttcacgtaaacgtcttctaggttcttaacgtctttagaacggtgaccgtaacgaatcccatcaaaccgttgtaagttagatgaagcttctgaactagcgataatgtagtaagcagcaacaccatacttgttgtgaggtaatgacacttcgtcaaccgttgcacccagttcacggtatttatcagctgcagccaaaatcgcatctttaacttcttggtcaacaccttcgcctaagaattccttaggtaaaccaattttcatacccttaacactggtttgatagttcaattcagcagcaaagtctggcacttctttagttgaagtggtcagatcatggtcatcgtgaccagcaactgcggatagcaaaatagcgttatccttcactgttcgagtcattggaccaatctcatcaagacttgaagcaaaggcaatcaagccccaacgagaaatgcggccataagttggtttcatgccgacaattccgttaaatgatgatggctgacgaatcgaaccaccagtatcggaaccaaatgcggcaaccacttcgccggaagcaacggcagctgctgaaccacctgatgaaccaccaggtacgcgggtgtaatcccaagcgtttttagtggttttaaaagcagagttttcagtggaaccacccatggcaaattcatccatgttggtcttacccacgttaatcacacccttatcgtttagggtgctaacaaccgttgcatcatagactggcacaaagttttccagcatcttagaagcagccgttgtggttaatcccttggtgacaatgttgtccttgattgctagtggaataccagcaagaatgttatctggatcaacacccttttcatccatttcggcagccttcttcaaagctgcgtccttgttcaaagccaaaaaggcgttcaagtcagggtcagtagctgcaatgttatcaaaagtagccttaaccaaatcagtcacactgatccgcttagccactaaatcatcatgcagcgatgtgagatctttttcgaaataattcatcgtttctactcatcctcactttcatcaataatcgttggtactcgaatgtagcctttttcagattctggtgcgttagccagtaaggcatcgcgctgtccccagttgtcggcaacgtcttctctcataacgttgatctggtcgctgacacttgaagtgggttcaatcccttcagtatcgacttcgtttaaggtttcaaataacccaataatttcatctaattgggtggtaaagtacttcagttgatcgtcgttcagacttaacttcgctaacgaggcaacgtgttgtacctggtcttgatcaattcgacttgccatcaagtttccctctttcacaagaattctgcgtaaattacgctacacatcaaatatactaccacaatatgactcaaaatagcactggttttaaggttcaaaccagtgctatttttgattgacgcaaattttaatcaataactattgaagacgtgagaagtaaacttcttcgcgccgttgtcacgactcaggaacgattgaaccccttccgtggaactgacagtgatgtcaattggtgcgttagaaggcaagtatttttgcgcagcctgttgcagatactgcgtaaaactaataatttcagtttgactatagaattgcgttgtaatgttaacgttcatccccgtcagctgtttattagtgtaatgtgcctgagcagtaaccccactcaaattagggaagtagttttgaatttggcttttaaagttttcaaaggaggcttcatcgtttgaattaccgctacctgagttaccgttagtggctttagaagacgttgttggataaacgtaattctgttcgctgattggcttccatgagctaactgtcgttgccccagctttattgtttgaataagagaagaaactgcccccaactaagctatccgttggtgcctgtcgataaagtgcaatcgtgatcggcacgttcttcaacgctggtttttgacgtagacgagcaagcacttgattggcaatctgacgaccttcacgctgggcttctgctttactgatcttggtttgataagttgaaccaaagttcttcttttcgtaataatcaacggagttcatacccagaccaatggtaacgccggacagcgtcaatttcttgccgttttgcttcataaagtcttgttcttccatctgttgcaggtagattggatttcgagtattcggatcagttttaccgttattgacagggtttaacccatctggattagacttcgatttacgccccaaccaattttgaacggtactggtattcaaatactgtccctcttcaaaaatgtatttgcttggtgaataaacctttttagaaacggttaacagaccactttcaaaactcttcaggttaaactgattatcgttttgagaaacattgacgccacgagacttgctcgttacataccggccgtttttgatgacactttggtagtcgccggcagctgcctgtccagtaagctgagtacccttattgctactattgccactggtgctggcaccgttagaactccctaaattaccacaggcgcttaaaaagagtccgcagattgccatcacaaataaggctttaaatcgtttcattacttctttcctccatcttcagactggcccgacatctcggctgcaaaccgttcttcgttccagactggtacgtcgagagcttctgccttggttaacttactgccggcatccgttcccgcgatcacaagatccgtcttttttgaaacactgctcgtcacatctgcaccctgcgcttccagccaagcactggcatcaccgcgtgtcatactggtcaactttccggtcagcacaacgcgcttaccgctaaagaagccatcagccggtgcagtttgttcagtacctgacgtgtaagtcatattgacaccacgttcttcaagttcgtgaaccagttgacgggcaccctcattgctaaaataagtcaccaaactgtccgcaatcgtatcgccgactgagtcgatctccgcgatttcttcttgactggcagccatcacattagccatgttattaaagtgagcagcaatgagtcgagcagctttattacccacgtgacgaatccctaatccaaataataagcgttctagcgaattattgcgactgttatccagtgcatttaataaattattagcagatttttcaccaaacttatctaaagtcactaattgatcaaaggtcaggtcgtataaatcggcaacatcttcaacgtatttcttctcaaataactgactgatgatccgtggaccgagaccgtcgatattcatggcattccgtgaagcaaagtgcgtcatctgttccgtcaattgttttggacagcgcggattaatgcaacgtagtgccacttcaccgtccaaatggaccagagtagcaccacaagatggacactgcgtcggaatcacgtaaggttcgctgtcggctggccgtttgctaggaatatagttcgaaatttcaggaataatatcgccagctttgtgtaacattacagtgtcgttaatgcgaatgtctttttcggtcaggtaatccgggttatgcaaagtcgcccgagccaccgttgtgcctgccaattgcaccggatccatgatcgctgttggggtgaccacgccggtacgaccaaccgtccattcaatatcgtgaacaatggttgcggcttcttccggtggaaatttatacgcaattgcccagcgaggcaccttaaccgtggcacccattgaccgctgtacgggcagtgagttgaccttcaccacaatcccatcaatgccgtacgataaatcatcacgctgctgcgtgtattcatcaatataagcgttgacctcgtccatattatgagccacccgataattcgggttggtggtaaacccaagttcagcgagttcatcgatgagaccgctctgggtccgcgtatttaacggttcataatcagccacgttatacataaacgtgctgagttttcgttctgccgttatcttggtatttaactgccgtaagctaccagcagcggcgtttctcggattagcaaatactgacttaccttcagcgtcccgcttcttattcagttcaataaaggacgccttgggcatatagcactccccgcgcacttcaatggtcaaaggtcggctcaactgagtgggaatcgacggaatcgtcttcaggttagccgtaatatcttcaccgatctgaccgttaccacgagttgatccttgaactagcttgccgtcaacataacgcaacgaaattgccagaccgtcaatttttaactcacagttgtaagtaccagcctcgttttccgtaatgtggttcacaaaatcagccaattcttcctttgagaaaacgtcgcccaaagacagcatgggaatgtcgtgagtcaccttggaaaaatcagttgaaacgtttccgcccacgttttgagtcggtgaatccggtgtaatcaaatccgggtactttgtttcaatggccactaattgggcgtatttttgatcataaacggagtcttcaaccgttggggcgtcctcactgtaataagcctctccccaagcacgcagctgcggtcgaagttgttttgctaaagtctctgcttctgcttttgttagagaatcaagtgatggttccatttcaacacccctgttattcttctacctttgtaattggcgcaaaggcagctaatagtcttttgacaccttcttgcggaaaggcaatatccagttccatatcttcgccagtaccgttgatcttaaccacggtaccagttccccactttttatgggtgactttatcgccagttcgccaagcttgtttgtcagcaccagtgccgttgtttacggtcactgaactagagcgcttctggtgataagtcgtggctgtggctgatgctgttcgtcggtcaaatggtgtccgcagtgaagtagcgcccgtttcgcctggcgctgttcggttatccatttgcagtaaatccggttcaatttcttcaataaaacgggattgcggatttcgttgcggacgaccatacagcatccgtgaaaaagcgttggtaataaagagccgctgcttagcacgggtaatccccacgtaagccaatcggcgctcttcttccagctgatcatggtcttccatggcacggctcaatgggaaaataccgtcttccatcccaatgaggaagacaacgggaaattctagtcccttagcggcatgcagcgtcattaaggtcacttgggcgggttcttcatccacatcatcctggtcggaaaccagtgccaattctgctaagaagtcaacaatccggtcacccgagtcgctctcgtcggcatcgtaactttcatcaaatttctgtgtaacggacaaaaattcctgaatgttttccagacgggtttcagactccaaactgcgagatgcttgcaacgccgctttatagccggtagtgtccaaaatttgttcagttaattccgtgacggtactgtctttaacaatggcctgcaacttttgaatcgtggttgcaaaaccgccaatggcaccccgggcgcgactggaaatatcattggccacatcaacgttcatggctgcttccaattctgaccagccgttatcctgcgcaaatgcccgtaatttagttagtgaaccagtaccgatcccacgtttaggttcattgattacccgttccaaactaagggtatctgcaccgtttgccactaacgtcaagtaagccagcatgtccttgatttctttacgatcatagaacttatgtccaccaacaatggtatacggcacattggccttgaccagcgtttcttccatcacacgagactgggcgttggtacggtacagaaccgcaaaatcaccatattgataatgctgttcacgcattaagtcctgaatctgagaaacaacgtatcgagcttcatcgttttcactttggccacgataataatgaatcttttcaccctgttcgttttcagtccagaggtttttatccttccggtaaccgttatttttgatgacttggttagcggcatccaaaatggttttggttgaccggtaattttgctcaagcatagtgacgtgagcatccggataatccttttcaaagttcatgatgttttcaatgttagcaccgcgccaaccgtaaatactttggtcggagtcacccacaacacacaggttatggtgctcacgcgccagcatattcactaacgtatactgcgcatcgttggtatcttggtattcgtccacgtgaatgtactggaacttcttttggtattctgccagtacatccttattttcattaaataactggatggtcagcatgatcaaatcatcaaaatccatggcttgattacgctgcaacccgttttgataagcgtcgtaagctcgtgcagtgacctcatccatgcggttaccggcttcctgagctaactgcttaggggttttaagttcgtttttagcgttggaaattttgcctaagattgcccgtggatcaaactgtttcgtgtccacgttcatatcagctaatacccgcttcattaacgtccgctgatcaccagtatcagcaattgaaaacgctctgttatatcctagcttatccgcgtgacggcgcaaaattcgcacacacagcgcatggaaagttgaggcccagacatcattgccttctggccccaacagcttgacgattcgttcgcgcatctcacgagccgccttgttggtaaaggtaatggccagcacgtgccaaggcatcacgcccttttcaatcaagtaagcgatccggtgggtcaagacccgcgtcttaccactaccggcaccggccatgatcaacagcggcccctcagtatgttcaacagcttctcgttgttccttattcagttttgctaacaatgcagattcagccacaatattattcctctcctgtttgtacggttactccgcgctgatgatttagctatcagcgcgcatcttaacaaattcactagtaaaattgtcgcctatcttgaatgataaagcaacacttttatgggaaaagttaaacatacgttcgcattaaaaaaggcaccctcttgagagtacctcttgattattcaatttcagaatctgtggaaccctgtgaccagatctcggtatcttccagttgctccagcagtttgttgatatcgtcgccctgaaccagaacgtgacccgctagcttttgaccgtcaaaatcttgatgaccttggcggtagaacgagaagtgccagttgggtttcaacgtccactgtgttcgcatggcgttggcctgatgctgtgtaaaagccgccatcaccgtgggtttcaaaacctggacgtcgcttaacggcatcccagcgatagcccgtaaatgctgctcaaattgactaaccgttgtggctcggtcaaagattcggccagcttcgccaaaggttggaatgatctgcttaacgtagatcgaaccgttctcgttgatcataaaatcaacttcaaacacaccgacgtacttcacgttagccacgatttcgtgacagattcggtccatttctgtttggacatccggatcgatggataccggtaaataagcccaagccatgatgccgttttgacgtttgacctcaactgtcgggaacaaactagcttccccgtttgcagcgcgcgcaacggtcacggtaaactcccgtgaatagtccacagtggactctagaatataagttccccagtccatcagacctgccgcttgcgcaatatcagtctgagtccgaatcgtcatttcttggccgtgaaccagatccttttgaatcggcttaagaacgcttgggtaaccaatggaattaatcgattggtaaacatcatcaagactgacgatagtggcgtacggtggaatattaacgtttagttgttcgtagaatgctcgctcaagtaagcgatcctgcatcatcatctgaaaatcagagccctgcggtaacagggttgattcttcaatcaccgagagaacgtccggactaagatgttgagaatcgtaagtgaccagatcacaacgttctgcgaaatcagtcaaccggtcatggtcagacagttcgccaacgattttaaaatcagccaattgcagcatttcgctagtttcatcagggccatatgcgcccaccttaaaacctgcttggcgtgctgcggacacgatcattggtccgtctgtactgtcgccgattaccccaatggtgcctcctggatacaaaacatgattgtccaaatttgttcactaccttcttatcaataaaagatgatcttttattttcattataactttacttacaaattgtactactaaatcgctgaatctttaaaaagtcttatgcccgagtttactgccgaaaacgacggcgaacctttttgacccagaaaccgccagaaatatatttcggctcgtaggtgatgataaaggctttgggttcgcggtcattgacaataccataaagtcgctgttcctgatttctaggcgtcagaatatctaacaccaaacgatcgccttccagaccttccgcgtggctctgagtcaccccaaaaccgcttgaacgaagaattttgggcagttcactgtccgtactggggagaataacggttgccatgatgtagcccagagccaacttatcttcaatccaaatgccgactcgaacaccgacaccgtaacccaaagcgtacgcgataacattccagacgttatccaactggttcaagaccatggccaaaccaaccacgtaaactgtgatttctaccacactcaaaattggggccaaattacggtagcccttcatggtgagcatgaatcgaagcgtgttcaacgtgatgtaaacgaaactaatgacgaaaattgaaatgatagtccaaatcatggtcccgcctccaatcgtacaataccaactgactagcgaaatagcagtgatacagccttacttcgtgtcggaatcagcaaaagtgacctggttgtcgtccaacgaagcgatgcttgccagagcttccaaatggatgccttgatccagcaccattttgtgacccttctggaaccgcttttcaatcactacgccaacacctgcaacgtccacttgtgcggctttacaaatttccagcataccttgtaccgcttgaccgttagccaagaaatcatcgatgatcagcactttatcatccgaatcaataaaccgtttgtcaatactgatatcgttgttgacctgcttggtgtacgagtagaccgttgccgtataaaggttatccgtcaatgtcagtgaccggtgtttacgtgcaaataccaccggcacgttcatctgaaaacctgccatcaaagcgggcgcaattccagatgattcaaccgttaagatccgggtaaccccttcattttcaaacagccgcttaaattccgcgcctatttcatacattaactggggatcaacttgatgattcaaaaagttatccacttttaacacttcaccgggtaaaacagtgccgtcgcgtttgattcgatcttctagtaacttcatcgctgatttcctcctaataacgtccagtcgaacgtttctaacttatgattagtgtactcgaaaaatcacggttttgccaacttgaaagcgaccttaccagcctaaaatagtgcctaagccaatccatacgatgcaaaataatgccataatcaaagaattttgaacggcgtacttaaaggtttccttcttcacttgtttagccagaaaagcacgggtattacgataaattaggggaatgctgagtaagactaacacgctcataatcggcaagtagcccagaatgacgctgataatcaagcagatatacccggcaacataatcaccgacgaaaacttttaacatggtcggcttgccaaagtaatacacgatcgttttacggttcagcgtcttgtcttcttccgcatcgcacaggttatttgccagcatgatgttagcaatggcaaacaccgcaatgccagacgtcagcagtactttaaagaatagtgaccaagttaacgactggactggataagtattgatgtaaacggagatcagggtgatcacaaagcccatggtcagcccggaaaatgcctccccgaaaggcgtggtagaaatgggccgtggaccagcagcatagcagtaccccactaaaaagcagaacacgcccattactaataaaggccaactcgtttcaatgaccagcagaatccccaaaatagtggcactaccagccattaaaataatcagattacgaatcaagttaacggataaatggtgaacaccgataatgttggttttccgtttccactcagcagcttcagcggttgcatggcggtaatcagaatagttatcgtgggcatcaactgccatgttaaagagcagcatggccacgaaaaacgtaatcgccaacggccagttcacttgaccaaacacatagtaggaaaagaagagtcccatgaagaaaggccacacggaagcaatttttgctttagcctccactaattccaaaaaaacatttacagacataaaaaaacctccaaaaaataatgatgccaaaattgacattgatgcgtgagctttgtatcttaaacatagcactttacaaaggaggaatgaacagtaactgttttgctgtaaaaggatatcaatctttgtaaagtggtgcttctatcctattccgtattcttataagtctggtaaaaaatatcaccaggttaaagttagaagttaaattttctgtattagctgatagcttatatgtagtgatttatatgaatttcattaaaaggctttttaggctaaatccatcccgtataatatgagagacacctcaccttggtgattaaattcaataaggcggaacagttgatgttactcacttataaagtcgaaattaagccgactgaaaaacaagcctggcagattgattgccatattggtggcagtcgttgggcctataacctgtttttggatatcaatcagcaacgctacgaaatgggctattgctacttaaatgcttacgcttttagcaagtggtttaaccatgaatatctagaagctaaccctgatgatatatggatcaaggatttatatgccaaatcggttaagcaggcttttattgacgctgatatggctatgaagcgatttttcaagaaacagagtggtttcccccattggcggtcgtttaaacgggggcaaggcagttactactttgttaagaacagtaaaacgcagatcattgcctgtcagcgtcaccggattaagttacccaagctcggctgggttcgtttaaaagagttgggctacattccgacagactcagaacacttcgttattaaacaaggccggattaaattcaaggctggtcggtattacctgacctgtttagtggaacaggctgaattgtcaaagctagaactgaccggtgatcccatcggcattgatcttggcctaaaagaatttgccattttaaatgatggtactttgtatcctaatcaaaataaaagtagtcgcgtaagacgcatcagaaaacaccttagacgcctgcaaagaaaaatgtcccgtcagtatcaagcactgaaagctagaagacagaaagaagggaaatctgctactgattttaatctagctaaaactcagctgaaagtgcaacgcttgtatcaacgattaaccaacatccaatctgattatcaaaataagattatcgctactgtggtgagaaccaaaccgcagtggatagccttagaagacttgaatgttaagggtatgatgaaaaatcggcatttagctaaagcagttagttaccaaggcttttataactttagaattaagctagtttctaaatgccagcagttaggtattccggtacacttaactggccgttttgaaccaacttctaagttatgccatcaatgtggttataaaaaagttgatttaaagctaagtgagcgcacctatcaatgtcctaaatgttgttataccgcagaccgtgatattaatgcggccctgaatatcagggatactgaaaactttgaattcgcctactaaaacgggcttcaaaggatgtaccggcggctagccgggaattaacgcttgtggactatcatatcaactgtattagcgagcttgatgcgaggcaggataggaagaagcaagaatgatctataactttttataagttatcagtagcagaatttcgatgaacttatcattttgggcagcgaccccacaggttcaagagcaacttaaacagttacaacgttacctgcttaagaccattgacctgccagaccaacccatacatagtaaaatactaaaacttcttcagtcgggtggcaagttcctgcggccgggcattttttacctgtttgccgaactgggtcccaatcatgatccagatcagctattagccggtgccagtgctcaggaactcttacatctggcacttaaatttcacgaccaaatttccgatgacaagctgaaaattcccaatcccggtcacaatcagcaacgcaatgccatttacgccggagattatttgttcacccgctactttgaggaaattttgaagacggcgccttcctcatccgaattttctaatcatttaaaggccatgcagcgcattcttaccggccatttagatcagttgcagcaccgttttgacttcaccgaaactgtagccgactattttgcggaaattaaccagcgcactggtgaagcctttcaatttagtgctgagcagggtgccagaattgcgggagcaacccctgaacttgttacgcttagcgctgaactgggaacaacgataggtgatgcgtatcaaatcagtcaggacattcaactcgcttttaacgatcaacagaatttgctggctaacctgcaaaacggccagtacccgttaccggtgattttgagtatgaaccagcctgagattcgccaattgcttgaaaagcgtcaggctttaacgctagaaaacgttcagttaatccaaaaccaacttgatcagccagcagtcgaagctcagtaccagcatctaactgctcacattgatgacctgctaaatcaattgcctactgggaaagtacaaacggatttacggcggtttgttgggcgattgctttaaatcttacctagccgaaacgtgttcaaacaagcagacagctgcatgtaagggacccccagcacaaatcccaaacccatggatttatgctgggggtcccttacactccgctatctaaacgcttgttttcacactctatttattttccctcatccaactcatacaacttcctaaaccgtggctcctcctgatacagtgcccgcggtgtcccctgcatatcaaagccgccatcttccagaaaacgtacctgatccacatggttaataccagccagatggtgtgttacccaaataatggtcttatcgtgcaagactttaaacaccgtatccaataactctcgttcagtgatgggatccagactgaccgtgggttcatccagcacaatgatcggcgcgtcctgcaagagaatccttgccaacgacagccgttgccgttcaccaccagagaaccgcgagcccgattcctgaacttctgtgtcatacccatccggtagagactcaatcaacggcttaagttccacggcttcaaccgcggccttgacttgttcatccgttgcgttcaaattaccgagacgaatgttattcattactgacgtatcgaacaagtagggttgctgatctaacaccccaaaaagctgggcacgctgatcctgcagttcactgaccggtatcccgttaatcgtaacagtaccagttgttggcgcctgatcacccaacagtaatttcagcaaggtactcttccccgttccgcttggtcctaacagtgcgatcttttcaccccgtttgatctgcaacgaaacgtttttaagaatttgcttgtcatcacccggataactgaaagtcacatgatccacgctaatttcattaaccggttcgctcaactttgtctgcgcaatttgtttaggctgatcgttggatagctgattgacccgttcaatggactgttgatagactggccattcactggcaccctgactgacttccaagaatggttcaacaatcggaaacaacgttagcgcaaaggcggctatccagttagccatgcccttgctggccgtgaagaacgttcctgaccagatcaataacgtcagtaccgccagcatgaagaaaaactggacgccaaagccacgccaccactggaagaaatggtccttgcgccgcagtgcagcaatctgcttgatgggtttattctgcaacgccataaaatcatggtaacgcccagaaatcacccagtcagtgagccccaatacttcatccgtcaaactggtatagaaattagactgaatctgtttttgcttaaactcacgtgcaccgttgactgcgacagaaagcagtggcatcaccagcacgatcacgccaagcaatagtgccatcagtaaggctactggccaactgaaaacacctacgccaatcacaataatcaggtatagtaaccagccgatgacgataggaaagaccgttcgcagatacaaattctcaatgtggtcaatgtcatccgctagaatacttaaaatatccccagtttggtgggtttgcttgattgcggaagccttcacttccacggcttgatataacttcttccggaaatcggaaacgatccgcagtacccaattatgagaagtgagccgttctgagtaacggaaaactggtcgggcaaccccaaacgcccgtgccaaaactacgggcacatagatataaataattgagtctggccgccgtgccgcttcactgatcaaataaccagagttaaacattagcgctgcagcggagagaaaggtcatcatgccaagaaacaacaccagtatcagcaaccatttatacttacgtaggtatggcatgacccaagtatcatgagcaaatgtctgtttaatcgagtgcatgtaatccccccatttcagcacgcaatttcgtgtatgggccatcatgcttcgctaattcagtaggtgtcccctgttccactagcttgccgtgatccatgaccaagacatagtccatttggttgatccagtgcaaccggtgggtagcgaagaagactagccggttatccaataaaggcagcatatcttccttcaaggcagcttcagtttcgatgtccaagtgagccgtgggttcatcaaacagcaagatcttccggctgtcatccagaaaggcccgggctaacgcgattcgttgtgcctgtccgccactgacgccacgagaaccttcgccaatcatggtgtctaaccctgctggcatttcagcgatccagtctgacagtcctgccttatcacaagctgctttaatcgtcgcgtcatcagcatctggctgataaaaacgaacgttgtcacgcagcgttgcgtggaacagataaggtgcctgcggaatatagatactgttatgctgccaaacttcttgacttaaatgcgctaacttttgaccatttaaactcacgtgatctggttcatctggggtcaagaatccgccaatcagattgatcaacgttgatttcccagatcctgatgccccaatgatacccactttttgaaaaccgtgaacgtcaaaggaaatatgactcagtgttggctgatttgcatcttcataagtcagcgaaacatcatcaaatttaatcgcagaatcatcgtgccaggttaactgtttcagttcgtcacgctgcttagtttcaggcgtctctaaaacatctaacacggctttcaatgcgtttttaccattcaaggtcgcgtgatagtcgttggcaaagttacgaaccggcaaaaagtaatccggtgccagcgttaaaacggtcaaagctggcagcaacataattttgccatccattaaatcaaagcctaaaaacaccgcaaccacggcaactgataatgtggtaaaaaagtccagtgcaaaggtggacgtcatagcgatacgcagcgttgccatggtctccttacggtaatcttcactgaccgaatacacgttgttcgcgtaacgcttggataaccccagttgtttcagtgtgccgagccctcttaaggtgtccacaaaattattcgataatcgctggtaacccgcatactgccggtcagctttgctctgagctgccaagccgagaatgatcatgaacagaataataaccggataaatgatcagcaaaaaagcagcttccttccactgcaaaaaggcaatgtagagcaaaatgacccacggagtgatccccatatccataattttgatgataatcaacatcagatacgtctgtaccttgtcgattccctcaagggccatggtgaccgtgttgcctgtaccgtttttctcaactagacttggccccaagcgaaacagtttcgtcattaactgttcacgcatctccccagtggtcttctccacaaagggataaaacgttcggttctgagccactgtaatgagatggcgacacaaaaagcccagtgcaaaaacagcggtaggcgttacaatggttgccaatggtttgagctcccataactgaaccaccgcaatcgacagcgcccgcgcctgaatcacgatcataacggcctgaatcagcgtcaaaatcgcaatcataatgattcggggtgtgatccccggaattttaaacaaacgcttatctatcaagttactcccctccaatactatacaaagtatagtgtatcattaaaccgctttcatgtactatgatttggacgtgaatcaattgtacaaatgccattttcaacaaaaaaattcccgagctctaaattcgaactcgggaatttttttaaacacctattaaaatctaagccgcttttggactcttaagccgtttgtaaaagacccagtaactccaaatgaagtaaaccagaacgatcggcagaatcgagaaagcaacaatggtcataatatgcagtgtgtacggtgaacttgaagcatctttaatcaaaatagaatgggcactgttcgtcgcaatcatgacccgtgggaataacccgttaaaaatcaagaccacgatgctgatcaatgatagcccgctggcgataaaggcggtccagttgtgcgctttcaaaacaccccaccatgcaatcaaagtcagcagtacgagcacaatcaaaattgaccaagtagataccggcttcttagcgaagaaatcagttgagatgtacagcagcacaacaaacaaaacctcacccacgatcaaaacggggtataaaagtttgttccaggcctgcgcccggtcacgtaacgtccctaacgtcttaagctgtaagaagttcagaccgtgaatcaggcacatcagcgtgacagccacgccaccgaccagtgagaaccagttgacatacgtggtaaagctgccaaagatgttaccttcagcatccattggcactccttcaatcatactggtgaacatcatgccgaataagaaagcggcgcagaaactaccaatagtggcagcccactcccagaaattccgccaagtttcagtcttcatgttggcacgaaattcaaaggacacaccacggaaaatcaaggccactaaaatcaagaacaagaccaagtagtagcctgagaataacgatgcataccacattgggaacgacgcaaacatggcaccgccggccgtaatcagccagacttcattgccatcccagtgaggaccaatcgtttgaataatggtatcgcgttcggcagtgttgcggccaaagaatcgaaccgccatcccaattccgaaatcaaaaccttcgaggaagaagaaaccgctaaacagcacaccaatcagtaaaaaccagagaatttgcgcactagtcatggttaaacgcctccgttccataaggatcttcgactttaccttcagtatcctccgatgagtaaccgttcatttgaacagcatccggtcctgctttgagcgcccggtgtgagagaacaatcatgaccagtcctaatcccgcaaagagtaagaagtaaacgatattcgtaaatagcagcgatccaacggtagacgtcggcgaaacagcgtcagcaatggtcagcaagccataaacgacccacggataacgaccaaactcagtgatgaaccagccggccgtgttaaccaagaacggtaaccagatcatgagtcccataatgtacaggaaccagcgctgtttcatgatggtctgggatttctttcggttgaagaacagaccaacgatggcgactaaggcaaataatccgccagcaactgccattaaacggaagctccaaaacagtgtcttcgtcggtacgtagtaattcatattcttcccgaacttcttatcgtaagtcgcgtgaagttccttattaacagtgttttgacccttaaccgttcctgaaaatttgtgataacttaaaatattcaaaacgtaaggcacatccaaagaagacgtggttttatgctgcttcgtgttgaagctgctatagattgcccactcgcccttattggtagagtccttgtacaacccttccattgcggcgaacttcatcggctgttctttgatcagataccgcgtctgaaagtcccctgaagcaacggaacctaaacttgcaatcaaaccaatgaccagtgctatgttcaatgacttccggtagaaggaaacgtgatccttctttaacagacgccatgctgagcaacccgccacaacgaacgaagcggtgatgccagcccccatgagaacgtgaggtaattccagccataactgcgggttcttcacaacggcactgaaactggtcatgacgacccggccagtggatttgttgatggcaaagcccacaggattttgcatgaaactgttagctgctaggatccacaccgctgaaagcgatgacccaatagcaaccaaccaaataaatagtgcgtgaatccccggcttaaagcgttcccaagtgaacatccacagaccaataaaggtcgactccaagaagaaagcagccaacgcttcaatggctaatggcgcaccaaagatatcacccatgaaccgtgagtattccgaccagttcatcccaaattggaattcttggatgatcccggtcaccacaccaactgcgaaactatataggaacattttgccccagaattgggccatcttcttatacgtttcgtcttttttggccacgtacattgtttccatgacggcgacaacgaatgctaaaccaattgaaaatggtacgaagaaaaagtgaaacacagtcgtcatggcaaactgaaaccgcgataggcctaaaacggttaaaccagcatttaacataataccccccctaacaaaagtttctagactagttacgaaatgcacataaacgaacagtctagtgaattatcgcaaaagcaccccgcaataattcagatataatagtcctatgttacaaacctaattatatcgactgataatcgaatcttcaactgtaagcccttacaaatatcaattaaattccaaattttgccttaaaaagttgtcaattcattgacaaatcatcaattttcgagtaacttatatgaatgtttaattttgggagatgagttcaatgaaaattggcgatcaagtaagtttcaagctggaaggccaagactttaccgggttcatcgataaagcataccagaattcctttatggttacgtttaaaagtgatgatacagaaattttggataagtatcacgatcgcgttgtgatcaacaagaaaaagttgaaattaatcaaagcagcaccagagacggatcctgaatccgataacgatgaagtttaattgcgagatctaaaagcgtccgatattcagccaacaaaggctgagtatcggacgcttttattagattacctgaattgtattttacttatgatcacctgaacagttacaatataagatgtgttattcaataacgaaaatcattccattatgatgacaccgaataaatgaaattcattcaagggagcaatcgctatggggtcagtaaatatctgggcgtcttttatcctatcattacttacaaacatcattgttcttagcggatcaatttcagttttaatctggttggagggcctgactaattcttggatgaaccgtttcagaccaattgtggaaacaatactaggtacactttactttgcttatctttggggggaatcatggttaaactctaatattgcaccaactgctttcgggatgcactgggcgtttttaaacatgctgattgtcagttcatttctgcttaacgtgcacttgaatctgtggtttgaggtcgtgattgaaggcctgatgatgctaggttatgttttcttctattcaccaaacttaaatacctataccctcatcgcgagtttagccttcatcgccgtactgtatatcagctaccactggggcagcacgtttattaagtacccaccgctgatgtatctcgggatggccaccatgggggcggtttcgtttgcactgatcatcagtatcttcgcggcaccagccgacccctatttttggctacgacagatctcggctctggtcatcctcagcattctcgggattgaatataccttagctactacccgacaactagaaagaagtcagcgcgtcgctaagttggcaaaactggacggtttaacccagttatataactttagtaagttcgatgaggatctggaccgtgcgtataaaaatttccagatgaatcaagagccttacgctatatacgagttcgatatcgacctttttaagcaagtcaacgatcactatggtcatctggtgggcaacaccgtacttaaggcagtggcactagaattagcccattttgcggccaacaccccttatgaaactacagcctaccggattggtggcgaagagttctgtttaatcgtcaaggcggattgttctgatcaagcattcgctgctaaattagctaatcacgtccgccagcgaatcagcaagctatcctttctagtaaacggttcatcgatcagtgttactgtatcagctggacaagctaatagtcagcctgatcaatacaatgcacatgatatttataagctggcagatcgcagtctatacctgtcaaagcagcgagggcgcgaccgagtcacgttagagggctgtacagtgaatggtagataggaacctaatagtcattaaaaaataagcgttatcccgacaaaaatcggaataacgcttattttttgatttgctcatttaattacgcatttaagcctaaagcctttacttgaccctgcacgatttgatcacacagatcatcgtaacgaatcccatccgcttcagcttcttgtggcattagtgaaagtggcgtcatccctggtaacgagttagcttcaatcacatacaagccattatcgttccagaaaaagtcgattcggccgtagttacttaatcctaacgctttgaaggtcttcaacgcgatttgtttcatctcatcatgcacatcgtctggaatatccggcggtgtcacaaacttagtggtgttacccgtcacaaatttgtgttcgaagtcgtaccaaccatccgtaacgatgatttcaatagcggacaaggctttgccgttgaccactgccatggagaactcacggccatcaatgtattcttctaccagaatctcatcgtcaaattcaaaggcttcttttaagtccttcttgaattcatcatcgttcttagcgatatacatcccaacactggaaccaccattggcaggtttgattactactgggaaaccaaacggcagtacaaccgtaccggaatcctctttacggatattgacaaacttagcggtctggataccgttatacagcataatttccttagaaacactcttatccatcgtgatgccggaagctaaggcaccgctaccagtgtacggaatattatttaaatcaaggacagcttgaaccttgccgttttcaccatcaccaccatgcagaccgatccacacaatgtctgccatggctaaaatatctaacacatgcgggccaaacagctgtgtcgacccgtctggacgtagcgcgttgatcacgtcatcagtcataatctcatctgagatattgagatcgatgtcttgttcctcactcataaacaagtttgccattgactgctcgtcagcatctggcaagcctagaaataaatcgaccaaagcaacttcatagcccttgcgccgtagtgcattcgctactttagcactagaagatagggacacgttgcgttccgttgagcgaccacccgctaataccacgatcttcataattttttcctccgcttctttcttagaatcttaagtatagcagaaaagaattcacggagctagattttggcaaacggtctcattgaattattattttacaaatcgaagcaagggtttactgatcaacggcaccagaatacctgacataatcgcttcaggaatcccgttagtcgccatgataccaagtagccacggcatgaaagccttaacgttcagtttatcaaggggtaaccagcccatatagtacatgcctgccatgaagcccagtaccagcaccgtgttgaccaacgatccaataatgccagtcaatgaaagctgccacacctttgcctcgtggacgttacgtaccatcttcagcaatgcccagccactgatgagtcccaccaacagtcgtggtaacactgagactagcggattaaccaaaacataaatggccatgggactggttggccaaacaaacgcccgaatccagttgataaatccccaggtaaaaccgacccaagcaccatctttgggaccgagtaaaacggcggcaatgaccaccgtcacttgaataatgacaatactaaacggtcccaccggaatataccctaaaaacgggaccatactttgaataaaaacaattgcgataaataacgataggattgaaatgcggtaagcgcgactctgcgtgttgatgttgttcccctcctcacatggctcatctaatttgcctatttagaacgactatcattttaccgcgattagttgcatttaacaatcaataagcgacgagtaatttaccatccaaacatcaccgccgatcggacaacataatgccgtggcttttaccgtttttaacggccgtaaaaggcagtgccataggtttatactggtaagtatctcaagcaatctttgagttcaaattagttataacggtactttggttcaatccgtcaatataacctaatcatgtgacaaaactcagattcctgccatttaacgcaaataagacttattccctgcaaagttcgctggaaataagtcttattcacgttaaattctggaatctaccgagttttgtcgcacactcaaatttaagccaagccttgaattgcccgactatacgcgttagcacccttcattgcggccacaacgtcctctggggtaacttcaaatggcatctcagacatggtatctgctggcgcggtggcaacttgaccaacttgcagcagctcatcatccgaaacatctgcgatacctaagtcagcaaaggtggttggcagacctaaggctaaatcaaattccaaataagaattgatgtcgtcggtgtcgcgcccttccaagaagagctgggtcaacgttccaaaagccactttttcaccgtgggtcttttcgtgaagtgcttcattagatagcgaagtcaacccgttatgaatcgcgtgagcagccgctaaaccgccgctttcaaacccaacgccactcatcaaggtattggcttcaataatcttgtccagtgccggggtaaccgcgtgagcttccgcagcatccaatgcctgtgtgccataagcaaagagcgtttcttcacatttctcagcaatggcattccctaccagcgtctgcttagcattcagcatggtctgaccattagccttagccaccgcctgcgcttcaacgttggtggctaaagcatccgcgattccggaagctaacaggcgagccggtgcgttggcgactagctgagtatcaactagcactaggtcagggtttttgctgtagaaacgatatttctcaaaactgccgtctggggtataaatcaccgacaaccttgagcatggcgcatccgtagaagccagggttggtaaaatggccactggtaacttcagattatccgcaatggccttagctgaatccagcgtcttgccaccgcccagaccaatgatcaagtcagcaccgaaattcttgccaatttctgtgatccggtcgatttctttttcggatgcctcgcctttaaaggtcaccttgtgaacgtcaaacttttgctgacccaaataatcgataaagtctttacccacaattttgtaaacggtggcgtctgccattacaactggctttgaacccagtttatgcagcgcttcagcactgtcgaataacgcaccgctaccttgaacatacgttgatggactaccaaaaatctttgtcatcggtgattacctccaatattttattgacactaccattataacccatatataaagccgatgtatgcggtttcattatttccagtaaaaatcagcagttaaatggttttaaatactttatttttaaactttttaaagtagaatgaatatagaagcaaaaaagtagcaataacttggagggaacgcgtatggcaaagcaatttacaattaatatcacaaatatcatttggagttttgaccgtgaaaatcaccaagttaatttgctactggtcaggcgaacggaccaacccttcgaacaatactgggcactgccagagaccgagatgcgaacagacgaaagcgctgatgaagccgcgcttcgcttagttcgtgaaaagattggcttaaaactggctagcttccatactgaacaactagcaactttcactcaccctgaacgaacaccaggtcaacggaccctttcactcgcctacatgacgttcttgccggaaatgcccgacttagttccaggttacggtgcaagtgacgcacgctggttcagcatggcatcaatgggagatcaaaacacctttaacaatggtcaatatcactttgccaccacaccgattacggttcagactgactattatgccgcgctggctgagcgaaaggctgatccgcagacatcattagcttttgatcacgattggattcttaaaattgcttgcgaccgaatcacgaataaattggattatcaacctaacattctgttgattttaggctccatgttcaccctcaaacaagcaagacgggttttttccatcttcaaacacattgagctggaagatatcgacaactccaacttcaaaaagaaccaccgtcatatctttgaaatggtgggaacggccgctcaaactcgtcctggtcgccccgcaaaggtctttcggcttcgctatctctaatagacggattaagtggttttaccggtgcacgtgttgtaccggtttttttgtttcaacaaaaaacggcttaccaacatcctattcaggatattgataagtcgtttttacgtgacttagtccacgttgccaaacttaacgatgattactcatcatcacgtttcttacgcttgaagccaagtgcagctaacaatccgagtaggctcaggccaatggttgcacccgcagcactctcattttcgttcgtttgtggcaatttgccttgagcatcggcctgctgagtctggtcagaaacatgactgttcgtgccagctacagtagcttgcttgccgctcacagcttgaccttgcgcaacagtagtattaacaacgccggtactgccagttgaacctgtcgaagaaccaccagtcgttgtttgaccatgggttgattcagtttcagttccagttcctttgtcaacgcctgttgtggtgttgtcgccaccattagttggtgtttctggtgttgtcgtgcctgttccagtaccagcaccggtatcagtggaaattgaattgtcaccgccgttgttatttggagtaaccacaacgttcactgaaccaccatgatcgacggtttccacaatcgtgctgccagttgtttgatgggtcaactgaataccgcctgtcggctcattattgaccaacgttgtgccaccaattgtggctgtcccacctggcgtaaccgtctgactaggcaagcctggttgaccatttggtgtttcggtaaagaccgcattcccagtcttatcaatgacaaccacagtttgatcaccatccggccaagtcttatcaacttgagtaaccgctccactaccgtcaacagtcgtcttcgtttgaccaccatccacgtcagtcgtcgtggttgtgacgtaatagccatcagctggggttgaaacgccaccagttacctgcgtcttgaagtaagtccgagttccatctggtgtggtaactgtttcgccagtcgtgccagtagttgggttgccgttggtatcagtgccagttgtatcatggccgagagttacgccatctggctcattattagtaacagtcgtcttaacagtcttcaccatccctctagcggacacataacgacccagacagccagaactgccacaagcacatggacgaccgtgacggtacatattgagatggccaagttcagccgccgagttggatttaccatacatcatccgaccgttggtaatcatcgccgcaccaaggccagtacccagcgtcaccatgagcacgtcttgcttgcctttaccagcacccaacttccactcgccatataggttaactctgacatcgttatccataaaggtgggaacgtggaattcatcttcaatcaactggatcactggcacgttatcccagtgactaaagttaggcgaaaaaatcgacaatcccgctttaatatccatctgacctgggacacctataccaatagctttgatttgatcagtacccgtttgcattttaatcaataactgtttcaccccagtaatgagattactcatgaccgtctcactattcgtttctgattcggtggcaacttttaattttgtttgcacagtcagatcctcgttgaggagaccaattttgatattagtgcctcctagatcaacaccgatatacataaacccatcacctgcctgtaagcgttttaatgataataccataattgtaccaccaaggacactaaccttgaattgtgctcatataaaaaggcccactcgtcatgagctggccttccgcaaacccactgaatccagggtcgactatttactctttggtttgttactttggtcttctttacgaatcttatccgcagtttccagaatgtattgacgtaattcatccttaatctcagggtgagttaggccgtattcaacgttagtcttgacgtaaccaaacttgttaccaacatcataacgttggcccttaaattcgtgggcgaaaacccgttgcgtttggttcaaagtatcgatggcatccgtcaactgcacttcgccacccttaccaggcttctgcttggctaacacatcaaagatttcgggtgtcagcaagtaacggccaataatggcaaggtcgcttggcgcatcttctacagccggcttttcaacgaaacggctgacgttatagaggtcagtatccactttatcttgaggatcgatgacaccataagcagatacttcgtcatgaggcacctttttaacggccagaattgaagcatgggtcttctcgtattcattgatcaattgcttggtcaatggtacttcatcgctcattaaatcgtcgcccaacataactacgaagggttcgtcggcgataaatgacttggcgtaacgaatggcgtcccctaaaccattaggatatggctggcgaatgtagtacaggttcatccctgctgcagccgtggtttcttgaactagatcaagcaacttcgtcttacccttttccttcaagttctgttctagttcaggtgcagaatcaaagtgatcttcgattgaacgcttctgtttcccctcgataatcagaatatcttcaatcccactggcctttgcttcttcaacaataaactgaattgttggtttgtccacaataggcaacatttccttagcaagcgctttggttgctggcaggaaccgagtcccaagaccggcagccggaatcaccgctttacgtactttcatgatgaaatctcctctattaacagaatagtgctgattacagctatctttcattttacactatgtacaggataattagggatattttaatcaaatcttcaaatttctccccactcagtgtttaacttcattcacttgttcaaagatctcccgtacccactgactatcaccgccgccttgatactgctgttctaaggcagcaaatcgtagcttagggaactggtaccaatcatgtgttttcagctcattcagcatgccagctgagcccctttcaaccccgtgaatcatccgcttcacgtgttctggacgcagataaccgagttgctgagcaaaggtgaagaaagcagttaacgttggctgaatttgaccgtaatcccattttttgaataacaagcccgggaataattgttccagcaacgtttcgatatcgtgcatcccggtatttttaatggttttgcgctggcggttgtaaagggcatcggtgaagatcatgacgtacatctgcagttctccctcactgctctgttgaagcaacggcgcacactcgggagattgcacaaacaactcgaaccactggctgacgtatccgcgcacggattcactagtggctgattgccactgtggcagtgactcttcggcaccatacggtaatagataagctgccgtcaccggccgcatgagtgcggtcagctgatcatagttcatgtcaatatgattggtttcagcttcaaccagcaaaaaggtcgtcattgattcgtaaatttggtcggtcagtaacgcatccatcccttcttgataggcactgctgaggaaccgaaaaagcccgcggtgaacactgccggcattccattggttgaaaggcaccttgaccttttgcgccattaacttaaaaagaccgtgaacggccaccttagtgacttgcttatccatcacatccgtcagttgatgctttcgcaaaaaccgaacaaacccaccccattcacgtgaaaaatcatcttcgtacgctaccaccatcgctatctgccccattccagaaaattagtacccgttaatattattatagcaaacacgtaccattatcaaagtttaattaggcacattcactgacatttgtcctataattggggcaaaaaggggatgtgtgagatgcggcaacgattattcagtggtgcctttgcagaaacgttgcaatacgtgatagcgagtttactgggtcccgtgaaaacgcggactggcagtctaaaacacacggtgactatcaatcatcagcaatatgcgtctaaatacaccgtcaatcaaatccgccagcgctatcacctgcgttaccagaccaagcggatcaatcaccagctggtctacgtaaaccgggtctggctgtataccaccacggctcgcagcggcgtctgggattataagcaccctactaagtccagtcaggtcacccacaacggccggttcatcgtattccgcacttggatgagtggcagtgccagcaagctgacctatgtcagtctggatacggggaaactgtatacggcagacgtcatcaatctcaaataaaaaatgattatcagtcaattttggctggtaatcatttttttattcgcagttcgcgttattgggtaggcagtcgcaggccacttctgttggcgcggttttggctttctcagtcaaggctgcctgtaatttttgaatgtcggtttgggtcagctccacgtgctggatcaggttcaacagcgtctcgcccttcttcatggcacacaggtggtcaaaaagctgttcggctgagccgttcatagcttcggtctcactgatagtggccgtgtagaggaaccggcgatcctgtttctcggtctgcagcaggccctttttcaccagtcggcgcaacagcgttttgatggtcgagtctgaccacgaccgcttagcctgcatcaggtcgatcagctcacgggaatagagttgtcctttagtccacacgatgcgcatcagttcccactctgatggcgtgatctcctcaatggaattttgtaccgcttcgctcatggttattttcctccgtttacagttgtaactctacatgcagtttaccatgttcgcgcattaagtcaatcaattaacttgtttcatcttcattatacccacccccaccgttccggtctatacctgaagtcagtttagttgtcatcgtcaaccatatccgtataataagcatcaaagttgccaccaggcgactgactaaggaggaatgaacggtaactattttgctgtaaaaggatatcaatctttgtaaagggggtgcttctatactatggcgtatttttaacctggtaaaagatatcacaatgttaaagttaggcgtttaattttccgtattagctgatagcttatatgtagtgatttatatgaatttcattaaaaggccttttggaataaatctatcccgtataatatgagggacacctcaccttggtgattaaattccataaggcggaatcactgatgttactcacctataaagtcgaaattaagccgactgaaaaacaagcctggcagattgattgtcatattggtggcagtcgctgggcctacaatctgtttttggatatcaatcggcagcgttatgaatgcggttatcactacatgggcgcttatgagttcagtaagtggtttaaccatgagtatcttgagagtaatcccgatgacaggtggatcaaggatttatatgccaaatcggttaaacaggcctttatcgatgccgatacagctatgaagcgatttttcaaaaaacaaagtggtttcccacattggcgctcatttaaacgcggtcaaggcagttactactttgttaaaaacggtaaaacgcaaatcattccttgtcagcgtcaccgaatcaagttaccgaagcttggctgggttcgtttgaaagagtttggctacattccgacagactcagactacttcgttatcaaacaaggtcggatcaaatttaaggctggtcggtattacctgacttgtttagtggaacaggctgaactgccaaagtcagtactgactggcgaaccaatcggtattgatcttggtctaaaagaatttgccatcttaaatgatggtgctctgtatcataatcagaataaaagcagtcgcgtaagacacatcagaaaacgccttagacgcctgcaaagaaaaatgtcctgtcagtatcatgcactgaaagctagaagacagaaagaagggaaatctgctactgatttaaatctagctaaaactcagcggaaggtgcaacgcttatatcaacgattaaccaatattcagtcagattatcaaaataagattattgctactgtagtgagaaccaaaccgcagtgggtagccttagaagacttgaatgttagaggtatgatgaaaaatcggcatttagcgaaagcagtgagttaccaaggcttttacaactttagaattaagctagtttctaaatgccaacagttaggcattccggtacacttaaccaatcgttttgaaccaacttctaaactgtgtcaccaatgtggccataaaaaagttgatttgaaacttcaagaccgggtgtatgaatgtcagaactgcaactatactgaagatcgtgatatcaatgcggccctgaatatcagggatactgaaaactttgaattagcctactaaaacaggcttcaaaggatgtaccggtggctagccgggaattaacgcttgtggactatcatatcaactgtattagtgagttttatacgaggcaggatagggcgaagcaagaataatctataactttttataagttatcagtagcagattgatcatggttaaagtaggcattaatgggtttggccgcattggccgattagtattacgccgggtgttggagctaaacgacccggatattgaagtcaccgccatcaacgatttaacaacaccgtcgatgctggcctatttgtttaagtatgacaccactcacgggacggtaccctacgacgtatcggctaccgacgactcactgattattgacggtcacgcctaccgcgtctatgcggaacgtgacgccaagaacatcccttgggtagacaacaacgatgtggaactggtgctggaatgtaccggcttttacacctcagaagaaaagtcacaggcccacttggacgccggtgtgaagaaagtcctgatttccgctccggctggtcccatcaagaccatcgtttacggtgtgaatgacgacaccctcaccccagacgataccatcatctcggcgggttcctgcaccactaacgccttagcaccaatggcttacgcgctgaatctggagtttggcttagaggtgggcaccatgaccgtgatccacgcctttaccagctcgcagatgattctggatgggcctaagggcagcaagctgcggccgaaccgaaccgcatccgctaacaccattccccattccaccggtgctgccaaagccattggtctggtcatccccgaaattgacggccatcttcaaggtcatgcgcaacgggtagcggtgattgacggttccgtatgcgaattagtttccgtgctggccactgagaacgtcacggcggatcaaatcaactcagcgattaaaccctacacggttaacaacgattcctttggctggaacgaagacagtatcgtttcttcagacatcatcggtgatacccacgggggcgtgtttgacccaacgctgacggaagtcacttctaacggtaagtatcaggtagtgaagaccgccacttggttcgataacgagtacggttttgtttccaacatggtgcggacggctaaggcgtttgctaatgcgcagaattatggtgaatagattgaactgaatttttgattaacacggctgattatttggccgtgttttttgcgtttagtggacaccgtgaacgcttggagtatcgaagttagactcggccttggcattggtggtcttggtgaccaacgcgtctggggagccgtagtagccgatgtacttggtaccattgactgttatgggctttgccataaggttatcgatgtttagggcaatttgcttgtgctgtgaaacctgtttgacagtaccgctgttggctgtgccgaactgccatttttgagcagtcagcgtgatggtttcgctggtgacttgcttgccgcttttgtttttaccgactttggcagtgactgggtaagctttggcggctgtgaagtgaagctgtttcgtggattgcttgaattggttatagcgctgctgatcctgtttagcctcgttgttcgcttgtgcgatgcccttcttataggtatattgatccgagtttttctgattggacttgtccagtttcagttcaccttggtaattggtctgctgactctttagggttctgttgaaggcagttcgctcattgtttttggctaaggtgaccgtttgggcgatactctgattgtttagttttttgagtgagatcccttgtacctgatagtcggtgactttgccctttcgttgaaccagaatatcgctgacctgactgttaggctttggtgtggccgtattaagtcggtaccagacctgctgttttgaattttgcgccgtggtggcgaaggccactttactggtcttggcagcatccgttgagtgaccgcatcccgctaaactgagtaacgctaccccagctacactaattaaggttaattgacgtaaacgtaatttcatgatcattttcccctccaaatgaacgttctatctttaccttaacgttgcgtttggccaaatgcaatccctctaatttaccaatatagcggttacatccagattgtgccttccatcactagggcgttcgttgtaagatgtaaaggttgttataatatgactgtaaataacttatagatgtcttaacacactactactgaaagaaggcgcttttgtgtcaaaacgaaacatcttcatcgtcacctgcgcgttactcctatccaatgccatgagtgggcttgataacaccattattaacaccgcgttacccgctattatttcggaccttcatgggattgagttaatgggctggatcgtcgccgttttcctgttgggaacagccgtcagcaccctgctctggagtaaattaggcgaacacatcggtaacaagcaggcttaccaattggccgccatgttcttcgtggtggggtcatttctccaaggaatttcacccaacatcgtttttctgattatttccagaacgattgctggaattgggaacggtggtgtggtgtcattgccctacatcatttacgctcatttatacgaaaacccccgcaaacgcatgaaagtgctgggcttcgtgtcagccagttacagtatggccaccattattggcccgttagtcggcggctacatcgtggatgcctttagctggcactgggtattcttcttaaacgtgccggtgggcttagtttctgctatcctggttcagatttattacaagtctaacccgaagtaccgggtggacagcgccgtggattacgtgggtgcctgcctcatgagtgttggcctgattgcattattagccggcattgaaatgattggcagtgtcagcacgacggtggtcattgccgtgattatcttcgctgtgatctgtctgggtgtgctgttacactacgaaaaccgtgtagaagaccccatcattccccagcgactgtttaagaaccggccgctgatgattgatttcgccctatttatcctcatctggggtgcctttctgggctttttaatctacagtcccatgtgggcgcaggcgctcttaggcaccagcgcgttgattggtggcgccacccagattccaagttcaatcactgattttctgggctctggttcagtggcccctatgcgtcgttttctcagaccacagaaggtaattgctatcggaattctcaccttggtcttgtccttcctgctgatggtggtgatgggcgtcaaagcgccttactggctgttactggttgccggtgtgtttgaaggcttcggtaacggtgcctgctttaacgaactgcaggttaaagtgcaagaagatgctgacagtaatgacgtccctattgccacatcctttagcttcctagtccgcatgctcagtcaaacgtttatggcctcgattttcgggttgatcatgaacagcgctttgcgtcgtggcgtgaacgcttcaggcggccaaattaccatgaaaatgatgaataaattaagtgacgctcaatccgttgggtcgttacctgctcacttgattccgcaaatgcgggtaatcctgcataacgggctgcataacattatggtggtgtccttagtgctgatgctgattgctggcggaatcaatatttgggcacagcggttggagaaggttaagtatgcgcggttggaagcggctaagtcggcttcttagattgagaatgtattaggtctcattgccgaaacgcgttccaaaaggcatgcctccgttttaggcttcattgctgaaacgcgttgcaaaaggcatgccccggccgtataagtcaaaaaagcggtatcccgaagaaccaccgggataccgctttttcgtcttatactctggggcataagcgcctttttccacgctctacttgtccctctcaatcaattccctcatcaccgtctgcaaggtctccgcaaacggcgcattaacatccacatggctctgatccagcctctgctgccaccactgattccggatatctacaatttttggcaccacctggctaccggcttccgtgattttgatgacgttagtggttcgattatccacggattgggtctgcgacacgtagcccaactccgacaagcgcttgatttcccgggtaatttggcccttattaatcaccaatctttttgctaattcgttttgactatgctctccctgctgctccagcaacagtaatatgtaggcgttggtgacgtttaaatttaattgtttgtaaactggttgcgtatctcgctgaaaagcgcggtgaataatggaaaaactctgagcgagatctcctggaaaagtttgtaaagtcaaaatgatccctcctgttaatctgcgtaattgattcaattataccgtttggtgacgcagtttgaacattaagtttaaaatatcgtgagttttcgttgtgaaatttctcaaaagagttgtgtttgaggagaaatcatcgacagatcaaccgttaaatccttgacgatttcaatctaacattcttgacaagcgctggaaaatagattaaattagtcagcaacaaaataaaagtaaaaaccaccttttaatttaacctattttaagtgacttttacttttactttaaaggcttcatcatcttatatctaacagaggagagactagcatgaaggaaaacggtatcgagaacaagggtaatcgtttcaatatgtggaagattcatctgtcagtagcaaccgtgacactaataccagcagccgtaggaattaactacgtggctaaggcatttgcggaagggttaaaattaccgctgtggttaggatctttggggacttatttagccagtatgctggctggccccactgccggcgcaatcagcggctttatcaacaacattatttacggcttaaccctatcgccagtttcaaccgtgtactccatcaccagtatcgccattggtatcgtcgtcggggtgttatttaaccgcggctggtttagcaacgctaagcgtgtctttgtttcagctattttaatcgccttaacttcagcaattatttcaaccccactgaacgtcattttctggggcgggcaaaccggtattccgtggggcgacgcactgttcgctaccatgatcggtaatcacatcaacatctggattgcctcgttcactgacgaattcgtactggatattttggacaaagtcgttgtggcctatatcgccttcttcatttaccgtcaattaccgcaacgcatgatcaactactttaaggacaatcaataatggaaattcgggataatagtctttcgaaaatagcgaaaatccgctggtataatttgatcgatccagtgactaaactgctggtggccctctttttaaccatgctgtcgtttgtattcacaaatctgtacttcgaagtcagtctggttttgatttctttcgtgctattactcttgtcccggttgtcatccgctaccattaacgcggtgtacttctgcttatttctcatcgtcactatgattttgattcaaggcttgttttacagtggcaacgtgcatccgttattttcaatcatgaacattacggtctaccgcgaaggtgcgctttacgcggtgaccatgagtgcgcgaatcctgatcattatcttcgccatcggctttttcatgagtaccactacaatttcggaaaacgctaagtacctagaagccattgggctgccatacaaactggtttacctgctcatgtcagtttgctacatccttcctcagattcagcagaacatgaaaaaaatccagtttgcggaacgcgctcggggcatcaacccgcaaaaaacggtggcacaaaaggtgcgctcgattctgccgatcctgattccgttgatcatcaaaacctttgatcaatccatcaaccgttctattaccttacagttacggggattcgacagtccagaacgaacccttgccacaccgaagtaccactacgttagggcgcggttcaatcattatctattgagttttctcactatttttctaatcgggtgtaaactatggcaaatattcagcagatttctataactcatctcagtttcacctatcagcatgataccaatactgtgctgcacgatatcaatgtatcggcaccgctaaacagcatcatcgggattatcggtaatcataacgcgggtaaaaccacgctgtgtcgcgttctagctggcattattcccaatatgatgggcggtgatttactgggtgacatccacatcggcaacttatcaccaactaaaaactggtctgtgctcaatcggcagaccggttttgtgctgcaagatcctaatagccagctcagcgggttagcagataccgtggccgacgaaatcgcctttgacctgttaaaccacggggtggctgaaaccaccattcaacggcgggtggcggacgttgccgctcaaatgcagttaaccgctcagctgcagcagtcccctaactcattgtcaggtggtcagttgcagcggttggcgattgctacggccattgttaccgagcctagcatcctcattttagacgaccccactagcgaaatggatccgcaaggtcgtgctgacttcttcaattggctggcaaccattaaggacaccacgattttcattgtttcaaatgaaattgacgatttgtgtgaaattgctgaccggctatgggtgttagtggacggtgaactggttcgtaaaggcaccccgcttgaagtggtcaatcaattgaacccagaatggcagattggcacgcctaaggtttaccaattagcaaaactcatggattggtcgctgggtgctgacctgtttccggtgaatatcaatcaactaagggggtgtgtccatgaccagcattcaaattgacgggttaaagtatcagtaccccactagtgactttaaattggctattgaccagctgaccattacggaaaacctggtggcgattgcggggcaaaatggcgcgggtaagtctaccctgtttaaactgctcaccgggctggtgcatccgcaagctggcgaaattcacatcaatcatcgggacttagccagcctaacgccggaagaccgcctaaagaccattggcatcgtgtttcaagatcccagttcacagctctttaacgccacggtggaaaaagaggtcgcctggagtgtcctgcaggttgaaactgacgctgcggtagtggctgatacggtcaacgatgcgctggctacagttggcctgacagaactaaaagataagaacccctttgatttatccatgccggaaaagaagctcctatccattgccacagtgctagctgttaacccgcagatttacttatttgatgagcccatgatctcgctggattggcccagccaacagcttgttacccagctgatgcagcgcctggccgaagaaaagcaccaagtgattgccattactcatgatatggactggctagcagcaacctttgcgaaggtggatgtgctggctaatggtcaagtcatttttgagggaaaatctgaaaccttcttcggtgaatctgatttaactcaaaaaacggggttaatgacaccacggatcatgcagattgcccaagaagtgtttgatgactcacgggtgtatttgacgccggaggattactttgagaaacatttggagaagcattagccttggaaaggcaaaaagaatctagtatcaaaacacctagtgctttgatactagattctttttgtcatcctacccgcataggatttctaataaattatttcatatctgacttttgaaccagtaggattgccatattgcaagtatcaacaaaatcaattccacgtgcatattcatttgctttttggtaattagcccacaacttctgcaagtttacactatcttttaattcattgagtattccaatgtaatgacctatttgattctctgttcctcgcctagtagcagttgcgtgaatcgcctggttcaaaacatcaaatcggatttctacagaatcctgatgttcaagcaaataaagatcatagaaatcttttaatcgtgtatttgcatccccacgactcacaattgtctctaatttctctgcaataatggtttcaactgtgtatgacatgatttgcaccgttcgatcctccaatagcattttgtgagtatatcgaatggcatgctcagtaatgacatctccagttgaaatatcgatttttacatcaacttttgtattgtaaacttgcgcttgaatgtgcatccgatatcctgagtattcatcatcttctctgatatcatcagttttgacaattgaaagattaatgatatcttccgggagatcaatttcacaaatctctgtaaaaacctcaatcatctttgttttagtgaccggtaacccagtaatagaagtatcaatatctcgtgttgaacgagtatcagtaccaatcatggaggctatcagaaaaccgcctttcagtatgagattgttttgatatcgggaatgagcaatgcggtctatcaaatcatctagaactacttcttgaagcataatttgaggtgtaatatttctttgtttagctaattttcttatgtttgctaggaactgtttttgattagaaaacctgagtttcacagcaaaacctccatgtaccttcttatttcatcttcaactttaaatgttttggcataatccataagtaactgaatgtttctgcccctcatgtgaacataactattcattgcctgcttgattgtctccgcatcagaccgatccctagtacgaagaatatcgcataacgttcgttcgacattgtaaactttaacagtgtttccactgggagttttggtctcagtgatgccgatttcataaagttctttcttttgccgatataattttactggtgtattttctattttgctataagcatagggtaaaggtaaattcatttcataaacactaggcgttcgatcaatcattccgtacaaaaacaatgctgtgtctttgaaaaaaatgcccttggatagccgatattgtaacgcagccatatcatcgccaaactcaaaaggagaaatatatacacctggcgctattttatcaagcagtccacgagcaaacatatttcgaagcattctagatgaaattcccattgattcagcagtcttagcattaatctgtccggcattttttgctagatattcttctattttatccttctgagtcatcaaatcgcctcctaattaaagtatccgttttatactcacattatagcatattgtgagtataaaacggataacttgactccaatcatctttcaactctgagtaaagtaaatcaactttatgattaaaaataggtaaaaaaaacacccttccctccacatggaaaaggtgtttcttttgaacgcaatataacgagtatattaacgctttgagaattgaccagccttacgagctttcttaagacctggcttcttacgttctttcatacgtgcatcacgagttaacagaccggcacgcttgaggggaccacgaaaatctgggtctacttcgagcaatgcacgggcgataccgtgacgtacagcgccggcttgtcctgagaagccaccaccattaacgtttgctaaaacatcatagttgcctagagtttcagtaacgttaaatggttgaacaaccacttcacgcaagttagcgaatggaatgtaatcttcgattgctttgtcattcataacgattttaccagtacctggtactaaacgtacccgagctactgagtctttacgacggccagtgccgcgatattgtacttgagccaatttgaattcctccttaaattaggttagtgatgtctaaaacttcaggcttttgagcagcattgtcatgttggtcgccagcgtaaacgtgaagcttcaagccgatcttgtgacctaatgaagtatgaggaagcatacccttaacagaagtttcaatcagcttttctgggtcatttgcacgaaaatcaccagcagtgcgttgctttaaaccgcctggatggttcgtatgatggtaatagatcttccgtgaagccttcttacccgttaaagcaactttcgaagcattgatcacaatcacgtgatcaccagtatctacatttggggtgaacgttggcttattcttaccacgtaagatgtttgcgacagctgaagcaagacgtcccaaaggaacatcagttgcatcaaccacgtaccacttgcgatccacgtcacctggtttagccatatatgttgtacgcacgattattttcctccaatttcagtgtttgtttgacatccgttaacaagtttccggggcttatcgtggggcaaacaataccaattaacatagtacaaatttctgccccttaagtcaagggttttccggatttgttttctttcttgtgaaaatctcagcgctgacgctttggcagctttgtgggatgcgccggatcatcgccttcatagtagacgtgtttgagatacagcccgctggccggcaccgtccgccgagcagcacgccggtcattgatccggtacaggttttgaatatcatccactggccgagtgccagaaccgatttcaaccaatacccctaccatgatgcgcacctggttgtagaggaagccgttaccataaaactcaaacaccagctcattgttagcctggtctaaatggcatcccgcttcataaatcgttcgaaagtaagtccgggctgaagacccagaagccacgaagctggtaaagtcgtgctcaccgatcaaatcttgagccgcctgattgatacgatccacatccaccggaaacttccagtgaccggtgtaattgcgcttgaagggattgcggaattcccccagatccattcggtacacgtaccgcttaccagaaacgtcatagcgggcgtgaaaatcgtcgctgactatgtcgacgtgcaggacctccatatcgacaggcaacatagaattcagccccttacgcatgttttcggccgttaaatgatacggcatatcgaagtgaaccacctgccctaaggcatgcacgccggcatccgttcgaccggaaccgtaaaccacgatggccggtgtaggatttttggccatcttattgaccacccgcgttaactcgctttcaatggtccgcttgtgcggttgccgttgaaagccagcaaaattagtgccgtcataggctaatgtaattttatatctcaaaaaaattattcctctcaactaaaataacgtagtgcgaagaccgcacctaaactgatgacatagatcaccaatgacacggtgtctacgccatgccacttcaactgccggtacttggtccggttttcaccgtcctgatagccccgagcctccatggccgtggaaatttcaatcgcccggttaaacgcgttgacgaacaacgggatcagaatcggcacgatggtcttgattcgctgacgcaaaccgccttcaccaaaatcgaccccacgagaacgctgggcattcatgatcttttcggcttcatccatcagcgttggcacgaaccgtaacgctaaggatagcattagtgccagcgttgctactggaaaatgaactttccgcaacgggctgagcagtgattcaatcccatccgcgatttccagcggttcagtggtaaaggtcagaatggttgaaaccaagatgatcaaaacaaagcgcattaaaattaagccagcgctattaagaccattttggctcaccaccagccagccccactgccagtaaacgtgaccgccagcgccaaagaatacttgaatcaaaacggtaaaaatcatcagccaaaataagggcaataacccacgaatataaacttttaatgggatggcggacgcagccaccgaagccagtaacagcaccgtcatgatcaagtacgtccagaaatcattggcaaagaaaaccaccgcgatgtacagaaaactcaggactaatttagcccggggatccatgcgatgaacccaagaatgcccaggaatgaaacggccaaacatgactttattcatggctgtttgcctccttttgcaactgaggtgccagttcatcagccagctcgtcaacagtcaacggcatggtatcaaactgaaacccagcctgctgaagttcgtaagcaaacttggtagctgatggcaggcccaactgatgggcttctagccatttaggatcactaaagatttctcgcggtgaaccttgcttgatcaattcaccatgacccatcaccagaacatggtccgcgtagtttgccacgtcatccatttggtgagtaatgagaacaatggtcaatccctgttcgtcccgtagctgtgtgactaactgcataatttccagccggccacgtgggtccaagcctgcagtgggttcatccagtaccagtacttccggctctaacgccagtacaccagcaatcgcaacccggcgcatctgaccgccagaaagatcgaagggtgaacggctcagtaaagactcgtccagtcccacttctgctgccatccgtttagccagcactgtcgcatcagcttccgaaacgccaaagttctgcgggccaaacgcgatgtctttgagcaccgtttcttcaaataactgattttcaggaaattgaaacaccatgccaacttttttacgtagcggtttgagatgcttattgttagtttcattggtaatcacttggtcgccgatggtcaccgttccagaagaaggctttagcagcgcatttaagtgctgaatcatcgtggatttaccactaccggtttgacccaccaccgcagtaaaggatcccggcgtaatatgcagatcaatattcttcagggcttggacagcgaagggtgtgccagcctgataccagtaatttacttgttcaaacttgatctccgtagccaatcgactaagcccctttcgtctaaataggtttgtggaaccgcaacgtggcgttcctgtaatgcatctttgaccttttcgggaagcggcacatcgagtcccatctcaaccagctgtttgccatgactaaagagttcctctggggtagcctcttccacaaagtgaccgtcgtcgatgaccaccagccgatcagcattggcagcttcatcgatatcgtgagtgatagaaagcaccgttaagttcagttgcgctttaagctgctggatcacagctaaaatttcctgcctgcctcgcgggtccagcatactggttgcttcatctaaaatgaggatcttcggggcaatggcaataatcccagccaaggccacacgctgtttttgaccaccagaaaggttcgccggttcacgattcttatacgccagcatgtccacctgtttcagtgcttcgtctaccttagtcaccatggtgtcacggtcaatagaacggttctccatcccgaaggccacatcgtcagccaccgttgcacccacgaactggttatcggggttttggaagaccatcccaactttttccctaatttgccagaccgtgtccggactaagtacttgaccatcaatggtgatcttaccagaatcagccgccatcagcccaatcagcagtttggctaacgtgctcttcccactgccgttatggccgacaatggccacccagtcaccagcctggatctcaaagctgacgtcatcaatcgctttggtatcagtattactatattgataatttaaatgttcaacttgaataatggccattacatattccccatctttcgaaattcacacgtcattataacaaatcttgcccctacattgatactttcacaagcatttttttaataatggacgggtttattatttggaatgctcaaatatctagcctataattagataagtaggagaacgctttcattatttacttttaggaggtatatcaatgacaaagaacattgttgtcgttggtgcaggcttcgctggggttttaacaactaagaagcttgccaaacgatttaaatctaatgctgacgtgacgattactttaatcgaccgtcattcctatttcacctacttgaccgaacttcacgaagtggccacggaacgggtagcgcctgacgcagttcaatacgatttacagcacttattcaaacatgctaaaaacgttaagctagttaccgacaatgtcacccaagtggataaggacaacaaaaaggtgatcgctgaaaatggtgaatatcccttcgacagcctggtcattagtttaggtggggaacctaatgactttggtacaccaggcgttaaggaaaatggttttaccctctggtccatggaggatgccattcgtctgcgcacgcacttggacgatgtggttcgtcgtggtgcggcggaacacgatcctgaaaagcgtcaagcactgctcaccatcgtggtctgtggctcaggtttcactggtgccgaaaccattggcgaactgattgattacaagaaggtcctggcaaaacgctaccgaatcgatgagaacgaaatcaaggtcattttagttgaagcagcgccaaccattatcaatatgcttgaccggaccaacgctgctcacgcggaaaagtatatcaaggataacggtatcgaagtacgggcatcatctgcaattacagccgttaaccccgattcagttgaaattaaagagcaagatcccatcgctaccgaaactttgatctggactgctggggtcaagaccaaccacactgctgatgaattcggtattgaaaccggtcgtggtggtcggctggtcaccaataagtaccttcaagcgcaaggctttgaagacaagagtatttacgtggccggtgacgatgccaacgcaactgaggaaggtgctgaacgtgccgtacctcaaacggctcaggaagccgaatttgaggcttatgtcgtggctcacaatgtggcagaggacattaatggcggttctagttacgaggccttcaaggacaaaaatatgggcttcatggtttcctttggctaccgttacgggattgcccaagtcttcggtggcaaacgcattcgtggctggattgctacctgcatgaaacatggcggtaacctactctactttatgcggattcgttccggttacgccatgtggaagtatctgatggatgaaatcttcaagacggcaaataagcggactgttctaggcagcaacaccgcaacgaacaccaacgtactgtggacattgccattgcgcttattcttcggacttggattgttctttgacggtatgagtaacatgggcggtactgctggctggatgaccagcttatcgccaactatgggcaccattgaattgatccttggtgtgctgatcttcttcggcttggcaacctggtgcgccaacttcttagtcattttaggatttctattcctagttcacacttggcccgccagttggatactgtttgtcgccttcgcgttactaaacggttccggccgaacattcggtttagatatctggttcgtaccatggttgcaacgtacttggggtcgttcacgttatggtatcccgcgttcaatctacaaacaaaaataaatcctactaaaataagcatctcccgtttgattgggggatgcttatttgtctgtctataaaactgaagacacaaaaaaatcactaccgaataaatggtgcacggacaaaaccgcattcaagctagactcgaattcatcatcatcatagcgctttataccataaactcggtgtgattctattgcgatcagcaatagagctgatcacgattactgctttaaagctttaatactacttaattagtcaacaagttgcagaataaccatttgtgcgccatcgccacgacgaggcatggtcttcatgatacgagtataaccaccattacggtcagcatacttaggagcaacttcgctgaataatttttgcaatgctgtagagatttggatgttatcgccatcttctttaacatcagcaactacatcacgaaggaatgctgcggcttgacgacgagcgtgcaagtctccgcgcttacctaagctgatcattttgtcagtagtagaacgtacttctttggcacgggcttcagtggtcttgatttggccatgaattaataattcagtggtaagatcacgaagtaacgcacgacgttgtgaacttgttcgttgcaatttacggtaactcattactggataccctcctttttatatttatactagtcttctttacgaagtgataacccgaggtcgttgagctttgccttgacttcttccaatgacttccggcctaagttacgaaccttcatcatgtcagcttcagtcttgttggtcagctcttgaacagtgttgattcccgcacgtttgagacagttgtatgaacggactgataaatcaagctcttcaatcgtcatttcaagcatcttttccttgtgggtctcttctttttcaaccatgatttcagcgttcttagcttcgtcagttaaatcaacaaacattgctaaatgttccgtcaaaatcttggcagctaaactgattgattcgctaggagtgattgaactatcggtccaaacatccatggtcagcttatcatagtcagttctctgaccaacccgcgtgttttcaacctgatagttaacacgttcgattggggtataaatagagtcaataggcaaaacgccaattggcatatcttccttagccttgtttcggtcagctgaaacgtagccacgacctttatttgcagtcattcgcatgtggaaggttgccccttctgcgacagtcgcaatgtaaagatcaggattgagaactgtgacatcactgtcagcagcaatgtcaccagctgtaacttgggcaggtcccttaacgtcaatttccattgactcgatttcatcatcagggccctcaagcttaagcgaaatcttcttagtattcaaaataatctgagtaacatcttcaacgacaccttcaatagtagaaaattcgtgtaagacgccatcaatttgaatacttgtgacagcagcaccaggcagcgatgaaagcagaattcgtctcaaagaattccctaacgtagttccgtaaccacgttcgagaggttcaacgacaaatttgccgtaatcgtcgctttcttcaattttgtgaatgttaggcttttcgaattcgatcattcttatcttttacccctttcaaaacgcgttgagccatataaataagtcccatcttgtagtcgtatgcccactaaaacaggatacactaaactcgacggcgcttcggaggacgagaaccattatgaggaactggagttacgtcccgaatggcagtaacttcaagcccagttgattgtaaagcacggatagcggcttcacgaccagaacctgggcccttaacagcaacttcaacagtcttcataccatgttccatagagttctttgcagcggcttcagcagccatttgtgcagcaaatggtgttgatttacgactacccttaaatcctaatgaaccagcagaagaccaagcaattgcgttaccttgcatgtcagtaatcatgaccagagtgttgttaaatgttgagtgaatgtgagcaacaccagactcgatatttttctttacgcggcgtttgcgcgaagtttttctagttgccataaaatgtcataccctccttttagtaaattatttctttctacctgcaacagaggtctttttacctttgcgagtgcgggcattgttcttcgtgtgttgaccacgaacgggcaagccacgacggtgacgcataccacggtatgaaccgatttcttgaagacgcttgatatccaagctaaccttacgacgtaagtcaccttcaacttggtagttgtctacggctgcacgaatcttatcttcatcttcaggggcgagatcacgaacgcgaacgtctggtgatacaccggtctcttcaatgattttttgtgcagtagtgttgccaattccgaaaatgtaagtcaagccaatgacaattcgcttgtcacgtggcaagtcaactccagcaatacgagccattaagttgcacctcctatattattatgaattatttaccttgacgttgtttgtgcttagggtttgctgagcaaataaccattactcgacccttacgcttgataatcttacaatgatcgcacattttcttaacagatggacgtactttcatgagaatcaaaacctcctatagtcctaatgcaaaccaaaaaccaacctacttaaaccggtaagtgatccggcctttggtcaaatcatacggcgacatttcaacagtaacacggtctccaggaagaatccggatgtaatgcatccgaatcttaccagaaacgtgcgctaaaatctcatgaccgttttcgagttcaacccgaaacattgcgtttggcagtgtttcagtgactttaccttcaacttcgatgacgtcttttgccacgaacgtacccccttgagtgttttatgactatgattaaatagtgcccggacttgcccaataataaattgaggctaacctgagttagtttaccacaccataacttttgaagcaagaacttctatactgagggcatttaggcaagttgactaagaaccgctttgatatctttgtaaacatcttggatgtcgcgatcaccatcaacggtgtgaagtaaacccttcttctggtagaagtctaccagcggcgtgttcatcttcatgttgacgtccaaacgattctttacagtttcaggcttatcgtcttctcgttgatagaagtcatgaccgccacaaacatcacaagttccaggaacctttgtaggattatagaccttgtgataagttgcgccgcatgtccggcaaatgtaccggccagatagtcgttcaatcagaacacttggttctacgtgaatgttgataacagcatccacgttccggccaagttcagttccaaactgatcaagtgcttcagcttggtcaattgttcttggataaccatctaacatgtagccctttgcgacatcgtcttggcctaaacggtctttaacgattccgttagtgacttcgtccggaaccaattcacctttgtcaataaacttcttagctgcaagtcccatctcagtttcatttttcatggcttcacggaaaatgtcaccagtcgagatatgcaagatatcgaagtcttcaacaatcttctgggcctgggttcccttaccggcaccaggtaaacccattaaaattaaattcattgacatgtttgtttcctcctagcagttctctttaatgacaagatggtgtgctgaaccaggtcatcacaccattactcgtctcattcagctggacggggatcttgaatgaaaccaacgtaagtccgtttcatcataagcccttcgacctgttggatcgtttggatagcaacaccgactacgataagtagactagtaccgccaagtccaatcgattcattcagattccaaacgttttgagcaactagtggaatcaaagcaaccaaccctaagaatagtgccccgacagtactcaaacgcatcagtaagttagatacgtaaacttgagtttcatgaccaggccagacacccggaatgtaacttccttgtttctgtaaattctcagataatttttcagggttaacctgaacgaatgcatagaagaacgtgaacaaaataattaaaatcgtgtataagattgtcccgctcgttgtctgcatgttaaagatattggtcaatacttgataccaggtatcttcagagtggttattcgcaaacgccatcaaaacagtttgtggcgtcgcaataaacgaacttgcgaagataacgggaataacaccagcgacgttaacctttaaaggtagataactgctatctggatcaccggaaacacgacgcgtatattgaattggaatcttccgatcagcttgttgtacccaggttacccaagtaacaataagcaaaacggcaattacgacagccaagacaatcaatgcaccgatccaccaatcagaagcagataagttttgaaggtaagtttgatataactgataaaccccggttgggaaccgagcaacgatacccgcaaagataatcattgaaaccccgttacccaaaccatggtcggtaatcatgtcacccatccaagtggttaacatggtgccaccagtcaaaatcagaccaatcatcgcatacgttttaacaccagggttttgcaccaaatttaaactacttaaggtgttgaacccagcagtaatcccaattgattgcacaaacgctaggataatcgttaaataacgtgtgtgttggttcagcttacgccgaccaacttccccttgcttactccattctacataacgaggcacaatgtccatttgtagaagttggatcacaatttgtgcggtaatgtatggcgaaacccccatcgcaaagatggaatagttggttaagccaccaccactgaacatgtttaaaatgctaaccaatccagaagacgcaacgctttgtaatgcctttgcgttaactcctggcacagtaatgtaggagccaagacgaaagacaaccaaaaccatcagtgtaaagagaatcttattccgaatgtctttaaccttaaacgcgtttttcatggtcgacagcattaaatcacctcagttttaccgcctgctgcttcgattgcggcactagcacttgcagagaacttttgtgctttaaccgtaagcttctttgagatttcaccgttacctaatactttaacggcgactttttcgttcttaacaagaccagcttttactaatgctgcaggtgtaacttctgcaccatcttcaaaacgatcgttaagtgtttcaaggtttaccaatgcatattccgtacggttcatgctagtaaatccacgctttggaatacgacggtacagtggcatttggccaccttcgaaaccaagacgggtcttgctacgagccttttgacccttttggccacggcctgatgtcttacccttaccagcagaacggccacgtcctttacgcatacgcgctacacgtgatccttcagatggttgtaattcgttcaacttcatgaatgaaggcacctccttattaattagtttactttacttcttctactctgattaagtgtgcaacttggaacaatgcaccacgggtagctgcgttgtccggacgaacaacagagctattaaccttctttaagccaagggcttcaacgatcttacgttgtttaggaagacggtgggcagcactatgaatcaaagtaacttttaaatcagccatgttgagatcctcctattcagctaagtgttgaactgaaacaccacgtaaatcagcaacctcttcagcacgcttgagttgtttcaaacattcaaacgtagcacgaatggcgttgattggtgtatcagagccaagtcgcttacttgtaacatcagcgacaccagctaattccatgacggcacgaacagcaccaccagcagtaactccagaaccttctgcggcaggctttaacataatccggccaccatcgtaagttccgagaacttcatggggaatggtagtacccacgattggaacttggattaagttcttgcgagctgcttcaacagccttacgaatagcttctggaacttcttgagctttaccagtaccaaagccaacgtgaccgttgtgatcgccgacaacaacaagagcagcgaaacgcagacgacgtccaccttttacaactttagtgattcggttgattgatacaacgttgtcttcaagatccaacttctcaggatcaataaactttgccattagtggttattcctcctttttagaaatttaagccgttttcacgagctgcttcagctaacgcttcaacacgtccgtggtataagtaaccgccacgatcgaaaacaacttcggaaatctttttagcagcagcacgttctgcaacaagtttaccaactgcttgggcttgttcagtcttgttacctgcagctatttcactatctaaagtcgaggcactgaccagcgtcacacccgctacgtcatcaattacttgagcgtagatgtttttgtttgaacggaaaacatttaagcgtgggcgctctgcagtaccagaaatcttgttccggacacgcatatgacgcttttgacgtgtcttgttcttatctggtttcgaaatcaaaatagtcacctctttaaattatttgtagaatgcttatgcagcattatttaccagttttaccttctttaaggctaatgtgttcattctcgtaacgaatacctttacctttgtaaggttctggtgaacgaacggcacggatttcagctgcgaagtcaccgacttcttgcttactgataccgctgatgttgattgtgttgttatcaggaacttcaacctttaaagttgaaggaacgtcgatttcaacggggttggaataaccaacacttaaaatcaacttaccctttaattgggcacgataaccaacaccgacaagcttcaaggtcttagcgaagcccttagtaaccccttcaaccatgttgttgaagttggcacgagtggttccgtgtaaggcacgggtcttgttgttgttatctggacgatcgaagttaacttcgccatcagaaacggtcatggtgatgattggtgagaatgtacgagtaatggtacccttaggacctttaactgtaacatcgttaccgtcgcgttttacgtcaacaccatctggaatagtaactgtcttgtaaccaatacgactcattgagtggacacctccctgctttttaaaatattaccaaacgtaggcgagtacttcgccaccgattttctttgcacgtgcttctttatcagtaacaacaccttcagatgttgagatgattgcaattcctaatccgttaaggaccttaggaacagcatcagatttaacgtaggtacgtaaacctggctttgaaatacgcttcaaacctgaaatgacgcgttgcttatcacggccgtacttgaggaatacacggatgataccttgtttgttatcatcgatatattcgacgtcgcgtacgaaaccttcgcgcttcaaaatttcagcaatgtcgcgcttcatctttgatgcaggaacttctaatgattcgtgatataccatgttggcattacggatccgagttaagaagtctgcaattgggtcagtcatagacattaacgtttatcctcctttgttatgaaatcttaccagctagctttcttcatgccaggaatttgacccttgtgggcaagttcccgtaagcaaagtcggcataagtggaatttgcgataaactgaatgtggacgaccacaacgttcgcaacgtgtataagcttgtgtcgagtacttagctggacgctgactcttaacaattaatgattttttagccacaataataccctccttacttagtaaatggcatgccaagctgcgttaacaactcgcgtgattcttcatctgtatttgcagtagtgacaacaacaatgtcaagaccacgaacacggttaactttatcataatcgatttctgggaaaatcaattgttcacgaacaccgagcgtatagttaccacgaccatcaaaggcgcgagaactgataccatggaaatcacgaacacgtggtaatgaaacgttaactaacttatctaagaaatcatacatccgttcgccacgtaatgtaactttggcaccgatagcgttgccttcacgtaaacggaaaccggcgattgacttcttagctttagtaatcaaaggcttttgacctgcaatcaagcctagttcttcaactgcttcatccaagtttttagcgtttgtagttgcatcaccaacacccatgtttaagacgattttgtccaacttaggtgcttgcatgattgaagtgtagttaaacttttcaatcattgatggaacgatttctttgttgtacttttcttgtaaacgattagccattagttaatttgtcctccttccttgattatttgtcgatggtttcgccgctctttttagcgaagcgaaccttcttgccgtcttctacgcggaaaccaacacgggttggttcgttggtagaagggtcaaggagcatcacgttagatacttgaattggtgcttcagtatcaatgatgccaccttgaggattagtttgagaagctttttgatgcttcttgatcatgttgataccttcgacgatgacacggttttgagcattaagggtcttagtaacagttccttctttgcccttatctttaccgctgatcacgcgaactttatcaccagttttaatgaacatcctgtttggcacctccttattttcgaacgattagagcacttctggtgcaagagaaacaatcttcatataatcattgtcacgtagttcacgcgcaactggtccgaaaatacgagtaccttgtggactcttgtcatcacggattaataccgcagcattttcatcaaatttgatgtatgagccatcggcacggcgtacacgggaagtagtacgaacgacaactgctttaacaacgtcaccttttttgacaacgccacctggtgttgcttgtttaacagttgcaacgataacgtcaccaatacttgcataacgtcgctttgaaccacccagaactttaatagttaaaatttcccgggcaccagagttatcagcgacttttaaacgagattcttgttggatcacgttagtgtcctcctttcacttctaagtaaaacagaatacgataaatgtcgaaactagatagtaactgccttttcaacaactttaagaagtcggaaacgaacagtcttagataacggacgtgtttccatgatttcaacaaggtcgcccatcttggcttcgctgttttcatcacgaactttgtactttttagtgtacttgatccgcttaccatatactggatgcatcttggtagtttcaacggctactgtgatcgtcttttccatcttatcagaaacgacacggccacggtatgtcttacgagcgttacgttcttcagccattaattattcctcctttatcgtattctttacttgtttaactcttgttgacgaagcacagttttaatccgtgcaatatccttacgaacctgcttcaaacgagcagtattttcaagttggccagtagccaattggaaacgaaggttgaataattcgtctttgtagctcttttctttttcgagcatttcagcagtggttaattctttaatatctttagccttcatttgattcgccacctacttcctcgcgagggatgatcttcgtacgaactggcagtttcatagctgctaagcgtaaagcttcatgtgcaacttcttcagaaacgccaccgacttcgaacataaccttttcacgtttaaccggtgcaacccatcctgcaggagcacccttaccattacccatacgaacaccaacacccttttcggtgtaggatttgtgagggaaaatcttgatccaaactttaccgccacgcttcatgtaacgcgtcatagcaacacgggctgcttcaatctgacggtttgagatccagcttgaatcaagtgcttgtaaaccgtaatcaccgaaagcaactgacttgccgcctttagcagcgccacgtaacttaccacgatgttcacgacgatgttttactcgcttaggtactagcattgttatttccctccttgctcgttatttttattagcgttaggcttgtcgggcaaaatttcgccacggtagatccaagtcttaacacctaatgaaccataagttgtgtgtgcttcaacccaggcataatcgatgtctgcacgtaatgtatgcagaggaacggtaccgtctgagtatgattcaacacgagacatatctgcaccgtttaaacgaccggcaacttgggtcttaatacccttggcaccagaacgcatagtccgttgcattgattgacgcatagcacgacggaaagcaacacggccttcaagttgacgtgcaatgttttcaccaactaatttggcatccaaatcaggcttcttgatttcgatgatgttgatgtgtactcgtttgccagttaagttgtttaattccttacggagattttcaacttctgacccacccttaccaattaccataccaggtttagcagtgtgaattgaaacgttaacgcggttagcggcacgttcaatttctactgttgacactgaggcatctgcaaggcgtttttcgatatatttacggattttaaggtcttcgccaaggtaagcagcaaaatctttttcagcataccattttgcttcccagtcgcgaataatgccgacacgtaatccggttggatttatcttttgacccacgcgttatccctcctatttttcagatacgacgattgtaatgtgacttgtccgcttgttgattggtgaagcagaacctttggcacgaggacggaaccgtttaagggttggcccttcgtcaacaaaggcttcgctgactaccaaatcagcacggtctaagtcaaaattattttcagcatttgcaactgctgacattaacactttttcaacgattggtgagccaccacgaggggtgaacttcaaaatagcaatcgcttcagccacgcttttgcctctgataagatcaatgacaaggcggaccttacgtgaggcaatacgaactgttttcgcagttgcctttgctgatgtaacttgttcagccattagctaatcctccttattatttagcagtagtagcagtcttcttatcgtcgccagagtggccacggaaagtacgagttggtacaaattcacctaacttatgaccaaccatgtcttcttgaatatatactggaacgttcttacgaccgtcataaacagcgattgtgtagccgataaagctagggaaaatcgttgaacgacgtgaccaagtcttgataacactcttcttgtcttgatctttttgtgcatcgatcttcttcagaagatgttcatcggcgaatggtcccttttttaaactacgacccattagattaccctccttacgagtgagattacttatgcagtaagtagattactttctgcctttacgacgaatgataagcttgtttgaacgtgctttagtagaacgcgtcttcttaccaatagtcttcttaccccatggtgataatggtgatggacgaccgattggtgctttaccttcaccaccaccatgagggtgatcgttagggttcataacagaaccacgagattgtggtcgcttgccgacccaacggttacgtccagctttaccaacgttgatcaattcatgttcttcgttaccaacagtaccgatagtggcacggttaacagctaagaccatccgaacttcgccagaaactaaacggatcatagcgtacttgccttctttaccaagcaattgtgcgcctgcaccggctgaacgaactaattgaccacccttaccaggcttcaattcgatgttgtgaatagttgtaccaacagggatgttttgtaatggaagtgcattaccaaccttgatatctgcatcaggacctgattgaacttgatcgccaaccttaaggccttttggtgctaagatataagatttagttccgtcagtataaactaacaatgcaatgttggctgtacggtttggatcgtattcgattgccttaaccgtagcagtaacgttgtcttttgtacgcttaaagtcgatgatacggtattgagtcttgttaccgccgccacgatgacgaaccgtcttcttaccgcggttgttacggccagcagtgtgactctttgattctagtaatgacttttcaggctttgacttcgtgataacttgactgtagtcaaggctagtcatattacgccgaccattactggttggtttgtatactttaatcgccacgttgattccctcctatattagtatttgttattcttcgccgaataacttaatttcttctgaatctgctgataaagtgacaacagccttacgacgcttcttagtgtagccttcgtaacgaccttgacgctttaacttacccttaacgttcatgatgttaactttaacaaccttaacgtcaaagatttcttcaacagcttttttaacttgagtcttcgtagcacgtacgtctacgtcgaatgtataacgcttgtcatcaaacaaagcagtagatgcttctgtaatgacaggacgcaaaataatatcacgagcttccattatgcgagcacctcctcaatctgagaaagagcagcttgagttaacacaagtttgtcattattgatgacatccaatacgttaatccccttggcatcaataacttgaacgttagccaagttacgagctgccaattctgcattcttgttgtcttcctcaagaaccactaaagtctttgttgaaacgtttaaactagataatgattttgcgaattccttagtctttggttgatcaaagttgaatgcatcaacaacaactaacgaaccgtcagcaaccttctgtgaaagtactgacttcaatgccaaacgcgtaaccttctttggaagatggtaagcgtatgaacgaggtgttgggccaaagacagttccaccgccaacccattgtggtgaacgggtagaaccttgacgagcacggccagtacccttttgacgccatggcttcttaccaccaccacgaacagcactacggttcttaaccgcatgagttccttgacgttgtgaagcacgttgcatcaaaacagtatcaaacacgacgttttcgtttggttcgatgccgaagatagtgtcgtttaaagtaacgtcaccattttggctaccgtcttgcttaaataatgtaacactagtcatttacgtttcctcctttcttatttcttaggtgcgcgaacggcactcttgatttcgatgaatgacttgttggcgccaggtacgttacccttgatcaacaagacgttgttttcaacatcggcacgaacgatctttaagttttggattgtccgagtattgttacccatccggccaggtaatttcatgcctttgaagacacggttgataatagcacctaatgaacctggacgacggtgataacgagaaccatgggtttcaggtccacgtgattggccatccttgtggacgttaccttgataaccgtgaccctttgttgtaccggtgacatcaacgtattcgccagcatcaaagatgtctgccttaacttcgtctgctaccttgtaatctcctagctcaacatctctgatttcatgaatgaagcgcttaggagtcgtgtttgcttttgctacatgacctttttcgggcttgttgctcaaaacatcgcgtttgtcttcgtagcctaattgaattgcatcgtaaccatcgttttcaactgtcttaacttgtaatacaacgttaggagtagtttcaacaacagtgactgggatcaattcgccattatcagtgaagacttgcgtcatccctacttttttacctaagattccttttctggtcatgagtacacctccgatataatgtaatttttttgttctgaatctaaattataatttgatttcgatatccacacctgaaggcaagtctaacttcattaatgagtcgaccgtctttggtgttgggttaacaatatcgattaaccgtttgtgagtgcgcatttcgaattgttcacgcgacttcttaaacttatgtggtgaacgaagcaccgtgtaaactgtccggtctgttggtaatggaataggaccagaaatttcagcacctgtacgctttgcagtttcaacaatcttctctgcagattggtcaagaatgcggtgctcgtaagccttcaaacggatacgaattttttgttttgccattggattccctccttacgtctattttcaaaataagactaactccgtgaaaattaccgtcacaccccgtggcaaagcggccgggtgtgccgcaacctttcacatcatcgctttgctatgctaatccagggcacacttgctccccgaaatacagcacctatatataatactaaataaatagcggtttgacaaggattattgagatgtttttgaaattgatgttaaatccgttaaattttttgtataaaattatcttttcctgtttcttctatagtatatgtatgaaaaaagacgctgcaaaattgcaacgtcttttttgaagaaattaatcttcggcaggagtcccgccgttcttcttgataatttctgcttgaattgactttggtacagcttcgtagtgatcaaaggtcatcgtgaaagtaccacgaccttgtgatgctgaacgaagagtagtagcatagccgaacatttcagccagtggcacgtacgaatgaatcatttgtgcgttaccacgtgcttccataccgtccacacgaccacgacgtgcagtaacttggcccatgatgtcacccatgtattcttcagggacaacaatgtcaaccttcatgattggttccaagataactggatcagccgtcttagcagcattacgtaaagccattgaagcggcaaccttaaaggcagcttcactagaatcgacttcatgataactaccatcgtataacttggccttcaagtcaatcaatgggtaaccggcaagaacaccgttttgcattgattccttgataccttgttcaactgatgggatgtattcacgaggaacaacaccaccaacaatggcatcttcgaattcgaatcctttaccctcttcattaggggtgaattcaacccaaacatcaccatattgacctttaccaccagattgacgaacaaacttaccttgtgcagaagtttgcttagtgaaggcttcacgataagaaacttgaggtgcaccaacggtagcttcaaccttgaattcacgtctcatacgatcgatgatgatatccaagtgaagttcacccatcccagcaatcaaagtttcaccagtttcagggttagtttcagccttgaatgtaggatcttcttcagaaagcttttgcagagcgttgttcatcttatcttggtcagccttagtcttaggttcaacggcaacctgaataactgggtcagggaattccattgattccaagtgtaatgggtgatcaacatcagtcaaagagtcaccggtagtggtgttcttcaaaccgatagcggcagcgatatcgccagagaagacttctgggatttcttgacggtgatttgaatgcatttgcagcaaacgaccgacacgttcacgcttgtccttagttgcgttcaaaacatatgaaccagattccaaggtaccttggtaaacccggataaatgtcaaacgaccaacgtaagggtcagtagcgatcttaaatgctaaagcagcaaagctagcgtcatcgttagccttcagttcaacttgttcaccagtatctgggttagtagcgttgtaaggcttaacatccaatggtgaaggtaagtagtccactgtggcatccattaacatttgaacacccttgttcttgaatgctgaaccagcaagtactgggaacaattcaaggttcaaggttgctttacggatagcagcttttaattcggcaacaggaatatcaacaccatcaaggtatttttccataatgtcgtcatcaacgtcggcgatttcttcaatcatcttttcacgacgtttagcagcttcttctttgtagtcatcaggaatttcaacagtatcccattctgaaccaagttcgtcttcgtcgtagatatcggctttcatatcaagcaagtcgataacaccttggaagttgtcttcagcaccaataggcatttgaacagctaaggcgttagcttgaagacgatctttgatggtttgtactgaaaagtcaaagtcagcaccgattttatccatcttgttaacgaacacgatacggggaacatcatagtcggaagcttgacgccaaacagtttcagtttggggttcaacaccggcttgggcatccaagaccgcaatggcaccatcaagcacacgaagtgaacgttcaacttcaacagtgaagtccacgtgtcctggggtatcgatgatgttaatacggtgacccttccattcagcagtagtagctgcagaagtgatcgtgataccacgttcttgttcttgttccatccagtccatttgtgaagcaccatcatgggtttcaccaatcttatggattttaccagtatagtacaggatccgttcagtggtggtagtcttaccagcatcgatatgagccatgatcccgatgttacgggtcttttctagtggaaaagctcgtgtattagccatgttaaatctgtaactcctctcaagattgttcacatttataaaaaggatggctaaattaaaaaataattatagccatcccaacaattttcactatcaacatttagctagcttgcgcgtagcccaccgaagtggtgctgacagcaaacaaatttgcaaattaccaacggtagtgagcaaatgcacggttggcgtcggccattttatgcgtatcttcacgctttttaacagatgcaccagtgttattggcagcatccataatttcgcgagctaaccgttcagtcatcgtgtgttcaccacgagaacgtgaatagttaacgatccagcgaagacctaatgttgaccgacgttctggacgaacttcgatcggaacttggtagttagaaccaccgacacggcgagccttaacttccaagaccggcataacattcttcatagcttcgtcgaatacttcaacggggtcgttgccagtttctttcttaattaaatcaaatgcaccatacagaatttgtgatgcagtgcctcgcttaccatctaacatcaagtggttgatcaaacgggtaaccatctttgagttgtagattgggtcaggaaggacttcacgtttttgaacgtttccttttcttggcattacttatatcctccttgttggaacttagtgtttaggtttttattccttaggcttcttagtaccgtatttagaacgtgattgacgacgatcttcaacaccggcagtatccaaagcaccacggatgacgtgataacgtacaccaggtaaatccttaacacggccaccacgaatcaaaacaacactatgttcctgaaggttatgaccgataccaggaatgtatgctgtcacttcgattaagttagacaaacgaacacgcgcgtacttccgcaaagctgagttaggcttctttggagtcatggtaccaacacgagttgcaacgccacgtttttgtggtgctgggttgttcacttgcttcttcttgaaactgttatacccgtagtttaaagctggggcatttgatttagaacttctagatttacgacctttacgaaccaattggttgattgtaggcatctaagagtcctccttccttagtctagttattttaagtccacacatccaggtgattcatttttgggcaaaaataaaagcggatgttgatcctttatcgtgccatgttttccgtcagcatgtctgcaaagcagaaaccggtctacaaaaagcacctttaaaagaataccacgcttcgtcgtttaatgtcaacgcaaactgtcaaacatccgcaaaaactcgcctttttcttaaaatgattcctgtatccaaatccgtaattaactctgaggtgatgaaatgttattgtttcaagcaattttgggtgccatcctaggttcatttctatttgccagctattctcggaaacagactggcgctaatatttaccggccagcccgttcttactgcgatcactgtgctgaaacgattacctggtacgacttagtgccgattatttcctatttagccctacgtggtcgctgccgttggtgcggctttaaaatttcgcgagcgtcactttactgcgaaatctttttcggctgtctcctgctgtgctggcaacccacttttttgcgaaccggctacgtgatcatcggtggcctactattttttatggccgttagcgatgtgcgtcattttaattatcccgcaaattatggttactggttaatgctgtgcacggctacagtatacaccctatttcgaccgcaccatttcatttttatcttcatttttatttgttggttaatcctacaattttatgagccaaaattagtttggctaggttctggcgatttggatatttttctctgtttggtgatactgcttggtctaacaccttttgcgtggttactattactaagcagttttttggcactaattgccggacaattagcgaaacaacgccgcttgccttttataccgtttatcacggtgggatatctagtggttcttttcttcatttgatagatggcattggtaatgacgtatctttatcttcttaattggaacactagctaaccctattcttacaataccttcctagtttaatcatgccaaaataacggtgctacgatatttggagttgataggcaagttgcctctcaactcctttttctataccattatttatatttgagcacacaaataggacatcacactatttcgtgttcaccgttccgaccaaagaaaagagaaatggagttagtgtaatgtcccttactagtaagtctatccgattcgcacttgaaattacagacccaaatatcatttttactaaagatgccgagattgaaccaattcaaggtgttacatctctagtttattatgtcaagctaagcgtccttccagaacgctgtcctcagtgtgtttttagtgaccggatcgtccgctatggatttgatcaggaacgtatcatcgttccgagttttagctaccgaccaacttatttaaagcttagctgtcaacgatttcgctgtaagcactgtactgccatctttcaaaatcggaccgactacgtccgtccgcattgtgtcattagcgaaccagtccgccaaatggctctatttgatgcgctctcaaaccgttctcttaccgatatcagtcaacgctatcacaactctgataaaaccgttcaacgcattattgatgaagaagccgaacttcacaattatcatcaaacaacctggctgcctgaacacctcgcttttgatgaatttaaggcgaccgataaaatgaacttcatctggggagacagtgatcaccgcaaaatcggctctattctgccatcgcgtacctcttatcaaataacgaaatactttgaccgtttctcacttcaggttcgtcaacaagtaaagaccgtttccctagacttaaacgctgggtatatcaatctagtcccacgtctgtttccaaatgcgaaaatagttgtggatcgttttcatatcgttcagatggtttcaactgcgctcaacatggttcgcgtacaggtgatgaagaccgtttcaaaaagtagtaaagaataccgctttatgaagcgcgaatggaaagtctttttgaagcgctttgaggaacttgatgccgttagaccaacgtaccactccagcgtcggttattacgatacagtcgttaacctgattgccatgtgtcttgatttagatcccgacttccgtaccgcatatgaaacttatcaagcgatactttcggcagttaaggagcgtgatgtgactgcgctcgaacgaactctgaacaattattacacgctaaataatcgcatggatcaatcgattaaatcgctgaaaaaatatcagaaacaagtctccaatgctttgcgctatcactattcaaatggctttcttgaaggtattaacagtcaaatcaaaaagattaagaacactgcttacggttacagaaactgggctaactttattaaccgtatttttctggaacgtgtttggttcagaccactttctaaaaatattgtaaattaaaaaagtacttagaccaattaaggtccaagtactcttataaagctaaatcaactctacttgacgaagagccaaaataacccagattccggccatatcacaaaaagccccgctccgacaaggtacatcggaacggggcttcatttgttacattctggaatctaccgagtttttcggcacactctccaaattacttagcttcttcttccttcatccggcgttccaactcattgattgagtagacaccatcagttgaagatccgccaacttcctttggcttgatcttacggtaatcaggcatcccagtaccagctggaatgatcttaccaataataacgttctctttaagaccgaccaatggatcgttcttaccgcggatagcagcatcggtcaatactcgagttgtttcctggaatgacgcagctgacaagaaactattagtttcaagggcagccttagtaatcccaaggataactggacgagcagtagctggtgtgccaccggcgattaacgtcttgtagttatgatcacggaagtcatcgatatccatcaaggtaccaggtaagacatcagtgtcacctggatccatgatacgtaccttacgaagcatttgacgaaccatgatctcaacgtgcttatccaagacagccacaccttgcatccggtaagtcttttgaacttcactcagcaagtagttttcagtagaaagaacatcacgaactcgaatcaattccttaggatcaactgacccttcgttaagtgcagcaccacggtgtacgaagtcgccttcggtcaccttcagttgagctgtaattggaagtgtgtaacttctcgtatcagcttcacctttaatagtgatttccttagtccgttctgctgggttttcttcgatagattcaaccgtaccagtaacttctgtaatctcagctttacctttagggttccgagattcaaagatttcttgaacacgaggaagcccttgagtaatatcttcgtttccggcaacaccaccggtatggaagttacgcatggttaattgagtaccaggttcaccgattgattgagcagcaacagtaccaactgcttcaccaacttcaacttggtcaccagtagccatgttacgaccgtagcaacgttcgcaaaccccgtgagaggtattgcaagtgaagacggaacgaatagtaactgattcaatgccagcatcaatgatccgttgagcagtagcttcatcgatcatcttgttagcaccgatgatgacttcgccagtcttaggatcattaacagtcttcatggtataacgacctaacatccgatcgtacaatggttcgatcatttcgttaccattcttgatggcacgaatagtcaaaccacgatcagtgccacagtcttcttcacgaacgataacgtcttgagcaacatcaaccaaacgacgggttaagtaacctgagttggcagtcttcaaggcagtatcggtcatccctttacgggcaccatgggtagaaataaacatttccaaaacagataggccttcacggaagtttgcggtaataggcaattccatgatttcaccgttaggagcggccatcaagccacgcatcccggcaagttgcgtaaagttagaaatgttaccacgggcaccagagtcactcatcatgaaaattgggttttgtggatcgaagttatggatcagcttgtcttgcaaggtatccttagcatcgttccaaacaccaataacacgttcgtaacgttcgtgatcggtaatcaaaccacgacggaattgtttagtgatcgttgccacttgtttgtgggcatcttcaataatttgtggcttatcaggaacttcggtaacgtcaacgattccgacagtcaagccagattgagttgattcgtcataacctaagtccttcatccggtcaagcaagagtgacgtttcagtcactttgtattgcttgtagacttcggcaataatgtcactcaggaaccctttgttgaatggcttaaccacttcagcatccttcagataatcatgaatatcttcacccttatccaagaagtacttgtctggtacgtaaccgttcaagttggtatccgttggttcattcaaatatgggaatgactgtggcaaaataccgttgaagatcagtttaccaacactggtaaccatgatcttgctcttttgttcgtcagtgaatggcttgcccttcaaagaactggtttgaataccaacacgtgagtgccagtgaactaacccgttacggtatgcgagtaccgcttcgttagcatctttaaagatcatgccttcgccttcacgaccggcttcttccaaagtcaggtagtagttaccaataaccatatcttgagaaggcgttacaactggcttcccatctttaggtgccagaatatggtgggcagcaagcatcagcaaacgtgcttcagcttgggcttcatcagataaaggtacgtgaatggccatttggtcaccatcgaaatcggcgttgtaagcttcacaggccaatgggtgtaaacgcattgacttaccacttaccaacactggttcgaaggcttgaatacccaaacggtgaagcgtaggtgcccggttcagtagaactgggtgttctttaatgacgtcttcaagaacactgtaaacatcttcgtcttcacggtcgatcttacgcttagcgttcttaatgttggaagctaacccgcggctaactaattccttcatgatgaacggcttgaagagttccattgccattggcactggcagacccatttggttcatccgtaatgaaggacccacatcaataacagaacggcctgagtagtcaacacgcttacccagtaagttttgacggaaacgaccttgcttccccttcaacatgtgtgaaagagacttcaatggccggttacctggaccagcaactggacggccacgacgaccgttatcgatcaacgcatcaacggcttcttgaagcatccgcttttcgttttgaacgatgataccaggtgcatgaaggtctaacaaacgcttgagacggttgttacggttgataactcgacggtacaaatcgttcaagtcagaagtggcgaaacggccaccttccaactgaaccattggccgtaagtcaggtggaataacgggaatggtatccattaccatccactccggcttgttaccagaagtaacgaaggcttccaaaatgtccaaacgacgaacggcacgcgtccgcttttggccagtagcttccttcaaggcttcctttaattcagtaacttccttagttaaatcaacatcgcggagtaacttcttaatggcttcagcacccatttcggcagtgaatccattaccgtactcagccttcttttcacgatattcacgttcagaaagcaactgcttcttttcaagtggtgtgttacctggttcaagcacaacgtatgaagcgaagtagataatctcttcaagtgagcgtggactcatgtccagcacgagacccatccggcttgggatacccttgaaataccagatatgagtaactggtgcagctaattcaatgtgtcccatacgttcacgacgaactttagaacgggtaacttcaacaccacaacggtcacaaacaacacccttgtaacgaatccgcttgtacttaccacaagcacattcccaatctttggttgggccaaagatacgttcatcgaatagtccgtctttttctggctttagagttcggtagttgatggtttctggcttcttaacttcaccatatgaccagctccgaatcttgtcaggcgatgcaagtccaatttgcatgctttcgaacttattgacatcgaccaatggatcgacctccctttaattaatctttagcgttagtgtcagcttcatctttgctagctgcttgagcttccttagcctcagtagccttcttttgttcttcttgttgctgtgcgaacttactcaaagcgtcaacgttcacaacgtcgtcatcttcgtcgtccatatcgcgcagttcgatttctttgttatcagaacccagaaccttcatgtccagacccagtgattgtaattccttaaccagcacacggaaggattcaggaacacctggcttaggaattggttcgcccttaacaatggcctcgtaagtcttaacacgaccaacaacgtcatctgacttgtaagtcaaaatttcttgcagggtgtaagcagcaccataagcttcaagtgcccaaacttccatttcaccaaaacgttggccaccaaattgtgctttaccaccaaggggttgttgggtaactaatgagtaaggtccgattgaacgagcatggatcttatcgtcaaccatgtgggccagtttcatgtagtgcatcacaccaacggcaacacgcttgtcgaatggttcaccggtccggccatcatacaaaacagtcttggcatcatcagccataccggcttccttaacagcagaccagatatcttcatctcgtgcaccatcaaagacaggggttgaaatgtgaataccgagtttacgagcagccatccccaagtgaatttcgagcacttgcccgatgttcatacgggaaggcacacccattggactcaacatgatatcgattggggtaccatctggcatatatggcatatcttcttgagggataacaacggaaacggtccccttgttaccatgacggccggccatcttatcacccacttgcagcttacgcttttgagcgatgtagacacgaaccatcttgttaacgcctggagataattcatcaccgttttcacgagtgaagatccggacgttttggatgataccgccaccaccatgaggcaccttaagtgaagtatcacgaacttcacgggccttttcaccaaagatagcgtgaagtaaacgttcctcagctgatagttcagtgacacccttaggcgttactttaccaactagaatgtcaccatcatgaacttcggcaccaatacggataataccttcttcgtcaaggttcttaagtgcatcttccccgacgttaggaatttcacgagtgatttcttcaggtccaagtttagtatcacgtgcttctgattcgtattcttcaatatgaatagaagtgtagacatcgtcagtaaccaaacgttcgctaatggcgatggcatcttcgaagttataaccttgccaagtcatgaaggcaactaatgggttttggcctaatgccaattcgccatcttccattgatggtccgtcagcgattacttcgtcaggatcaactttgtcgccaaccttaacgattggacgttggttgtagttcttaccaccgttagaacgttggaacttcattaacttgtaagtgtctaatgcaccgtcttcgcgacgaacacgaatttcacgggcatcaacatattcaactgtcccaggttgcttgcaaagtaaggcaacaccagagtcatgggcagctttatattcaataccagtaccaatcaatggtgagtgaggatcaagcaaaggaacggcctgacgcatcatgttagcacccatcaaagcacggttagagtcatcgttttccaagaaaggaatgcaggccgtagcgaccgagacaacttgcttaggtgaaacgtccatgtaatcgacgttttcgatactagtttcaatgttttctgattttgcacgggccataaccacatcgttaacgaatgaaccgtcatcgtttaatggtgagttagcttgtgcaacaacgtaattatcttcttcatcggcagtcaggtaatcgatcttatcggtaaccttatgagtcgtccatgaaacacgacggtatggcgtttcaataaagccatacttgttgatccgagcataactggaaagactgttaatcaaaccaatgttaggaccttcaggagtttcaattgggcacatccggccgtaatgagtatagtgaacgtcacggacttcataaccggcacggtcacgagtcaaaccaccaggtccaagggctgaaagacgacgcttatgcgttaattcacccaatgggttggtttggtccatgaattgtgacagttgtgatgaaccgaagaattctttgattgaagcaacaactggtcgaatgttgatcaattgttgtggtgtcacagtcgtggcatcttgaattgacatccgttcacgcacaacacgttccatccgggataaaccgatccggaattggttctgcagtaattcaccaacagaacgaatccgacggttacccaagtgatcgatatcatcggtgttgccaataccatcttgtaaatcaaagaagtagttaacagcagccaaaatatcggcaggagtgatgtgtttgtacttcaaatcaatgtgaccattaccgatcactggaatagcacgttctggatcgtcaggtgattgcaccatgatggtctgcaacgttactggttcagtgacaaccgcttcgtctgaaggcgtgtaagttaccgtcttaaagtcttcacggtcaaggtaaggagtcaagttcttcaacagatctttatcgatcaagtcgcccttagaagccaacacttcaccagtatctggatcagctaaggtttcagctaaagtcaaaccaagcagacggttcttcaaaaccaacttcttgtttgtcttgtaacggccaacaggcgccatatcataacgctttggatcgaagaaacgagctgtcaacaagctccgtgatgagtcggcagtcttaggttcacctggacgtagacgttcgtagatgtcctttaaggcttcttcaacacgagaatcttcgctgtttttgtgaacatccttttccaaagttgcagaaagactgtcgttatcaccatacatcttgatgatttcgtcatctgaaccgaagcctaaagcccgaactaattcggtcattggaatcttacgagtccggtcgatccgaacataagataagcccttagcatcggtttcaaattccagccatgcaccacggttaggaatgacagtggcaccgtagaccgtgcggccgttcttgtcagtatcttttgtataataaacgccaggggaacggactaattgagaaacgataacccgttcggcaccgttaataataaacgtcccttgttctgtcatcagtggaaaatcgccgaagaaaacatcttgggatttaatttcgccagtctcatgattggttaaccgtaaagtgacatgtaatggtgccgagaagttggcatcgtgctctcttgcttcgtcaacggtatattttggttccagtaattggtaatcaacgaactccaatgaaagattgccttggaagtcttcgataggcataatgtcatcgaacatatccttaaggccttcatctagaaaccactggtacgaattcttttggatctcaatcaagttaggaagatccaaaacttccttaattcgtgcgtagcttcgtcgggtccggtgcttgccatatttaaccaagtgtcctgccaagttgttcacctctccattttattcagcggactgaaccaaatattacagtttgattacatttcaaatgaaaacgtattctcaccggttttttggcaaaaaaaatccaaaaataagaaatcaacttcttacttttggtttttatgagaaccgttacggacaatatatcgcaacgattcatttcagttcacagttacatactgcagatagtatacctgctactgattcagttgtcaactggttatgcctgctcagacactaaaccatgtaaaatgaaatctaacagcaatcgaatgtgttcttccgccgtcatgttggcgccgccaattcgatgaaacttactaaacagcgggctcaaactggtaatgtaaaactgggcggcttcggttggctcgatactctgacgtaggttaacatcttcgctcttaaaatagttttcaatgggtgtcacgtaatccgtttgaaaaatcgtccccagctgctgcatattttctggtttaagatccgcaaagctggaatggatcaccgtaaagatatctcgaggatgcttgtcagtcagtacctgcgtaatctgaattaatcgctcatcagctggcactgtagccccctgctgattaatcgcatcaatgcctgacttaatctccagaccaaccgttttgatcacctgcaaaaagagcacgtctttgtcagcaaaatgatgataaagtgccggctgagtaatcccgacaattttcgcaatatctcgcgtggaagttccttgataaccacgagacaaaaagaggcttcgagcagcgtctaaaatggcctgatgtgtttttgctaattgcacttctctcttcaaatcatctactatcccttccagtttaccgtatttaatctgattaccattttagcacgaatcccctcgttgcggtaattatactagtttgagtgacacaaaacaggctgatcgatcatccctaaagacaatcgatcagcctgtttacatttatgcctttacttactgccaactgtttcattggtcttagtttcagctttttctggttgtttaacattgacggtaatcttaccgtgactggcacccaaggttaccatgttacccgtcttaatatcacctgacagcattgcttcactcaagcggtcctccactttagtttgtaatgcccgacgaattggacgtgcaccatactcagggtcgaacccggcatcagcgatcacgtcgattgcagctggcgtaatcttgatgtcgattccttgtgccttcacacggtcagttactgtcttagccatcaacttgacgatttggtgaagttccttcttttgaaggctgtggaaaatgaccacttcatcgatccggttcaagaattctggccggaaactctgctttaatgtttctcgaatggtagcagccatggcggtgtaatcgccagacttatccttggcagcaaagcccacggtcttttcgtcccgcagtctagttgcacctaagtttgaagtcatgatcaagatggtgtttctgaaatcaactttacgacccttagaatcagtcaagtaaccatcatccagcacttgaagcaacaagttaaagacgtctgggtgagctttttcaacttcatcaaataggacaactgagtaaggtttctgacgaactttttcggttaattggccaccttcgtcgtaaccgacatagccaggtgctgaaccaatcaaacgactggttgagtacttctccatgtattcactcatatcaacccgaatcatgttgtcttcagaaccaaacattgcttcagctaaagccttagcaagttccgtcttcccaacaccagtagggcctaaaaacatgaatgaaccaattggccggttcggatctttcaatccggaacgagcacgccgaatagctcgagaaaccgccgaaacagcttcttcttgaccaacgacccgcttgtgcaaaataccttccaggttaaccaaccgttcctgttcagtccggttaagttgtgtggttggtacaccggtccattccgaaaccacttcagcgacgtcttcgccagtgacgttcagattgtacttctgaccagattcagcttgcttttcagccttcttatccagcttatccttcagcgcaatctcctgctcacgaatcttggcagcttcttcaaaacgctggtcaaggatggcagcttcgcgttgatcagacaagtctgaaagtttagcctcttgcttagtttgattatttggcttatccatctgactgatacgaaccttagcggccgcttcatccatcaagtcaatcgccttatcaggtaggtaacggtctgtgatgtaacgcgttgatagcttaacggcttgttccaacgcatcatcagtaatgttagccttgtgatgttgttcgtagcgaggacgcaaccccttcaaaatctcaacggtttcgtcttcagtgggttcgtcgacttgaacggtagcaaaccgccgttcaagggcagcatcagattcaatgtacttttggtattcatccagcgtggttgccccaatggtttgcagttcgccacgagctaaggcaggcttcaaaatgtttgaggcatcgatagcaccttcagcaccaccggcaccgatcagagtgtgtaattcatcaataaagaggatcacttcgccatcgttgtaaatttcttcgatcactttcttcaggcggtcttcaaattcaccacgatacttggtacccgcaaccaacgaccccatgtccagcgccattaaccgcttgttttgcatatcttctggaacatcacccttaacgatccgctgtgctaagccctcagcgatggcagttttaccaacaccaggttcaccaatcaaaactgggttattcttagtccgacgactcaaaatctgaatcacccgtcgaacttcgttgttacggccaaccgttggatccatccggtcgtcacgtgctaattgtgttaaatcacgtgccaatgaatccagtgtcggtgtaccgccctgttgcttgcgtccacgttgattgcgacgcttatcctggttttcagttacgcccaacttgcgtaagattaccttgcgcgcctgagctaaatcaatatttaaattcatcaaaattcgtgaggaaaggatcgtttcatcgctcagcaaggccagcaataaatgttccgtgccaatttttgtggcaccaattcgcttagcttcttcaccggcaacggaaagcatatcctttgcctttggtgaatatggcaaataagtatccttatcaacgttgttaagggtgccataacctgtgaagcgttcgatttcttcacgcacatcatcttcactaatggaaaattgctgtaacaccttgtttgcaatcccatttttttcaattgtgagtgctaaaagtaagtgctctgtgccaacagcttggtgcttaaagtacttcgcctgttcttgggctaatgccaagacgctctttgcactgggggtaaaaagattatccatgtaaattcctcactttcttagctctcatagcgtagatgttttaagatactcactaaaatacgcgccctcaagccgttctcttccgcacggttttccatttgcaaggtatccttacttaagatggttaaaataatattagcctctctacgaccaatcacaccactctcgtaaagtccctgaaccacagcataaccatcacgttgcccaattgaatcaccaatcgtttcaatcaatgagtctaaaacatcggtatcatctaataggttaaccttttcgattcgaatatagccgccaccgcctcgcttgctttcaaccaaatacccattggataaagtaaaccgggttttaatcacatagttaatttgtgacggcaccacattgaacaaatccgcaacttcagatcggcgaatttccacgtgctccgtatccgacaaaatctccttcaggtacttctcaataatatcggaaatattttgattttgcacgctactccctccattcaccaacttagcaatcatgtttgactaatgttgactttcattatacgaatgtttggtgaaattgcaaaggtttaaactttaatttatcgcctaaatgcccaattttctccaaatcgaaaaagtttctacctatagtaaaggtttttcggacctcacgactaatatttcaaattatttcttgggtatctctattataaagcattcgtcaataaaactctcgttaaagcgattatgatgagactcatgctctcttctgcatacaaaaaggacaagtcactcaccaaaatctatattggtaagtattttaatcatttttcctaaaattagttgtcactgcttttagttcaatacattaacacgcaaaaaagaggttatcatttctgataacctccgacgttcggccgtaaatcgggaaaacaggatttgaacctgcgacccctacgtcccgaacgtagtgctctaccaagctgagctacttcccgtttgttgtatgaaagcaacaaaaatgcacccagtaggagtcgaacctacaaccttctgattcgtagtcagacactctatccagttgcgctatgggtgcaaataaatattaaattaagaaatgccgaggaccgggatcgaaccggtacggtcatcactgaccgcaggattttaagtcctgtgcgtctgccaattccgccaccccggcaggaacaaacgttaaaagcggaagacgggattcgaacccgcgacccccaccatggcaaggtgatgttctaccactgaactacttccgcacaatgccgactagaggattcgaacctccgacctcctcattactagtgagatgctctgccaactgagctaagtcggcgaaagtgaatgttgctatttaattgtaatgcgggtgaagggactcgaacccccacgtcgtaagacactagaacctaaatctagcgcgtctgccagttccgccacacccgcatggtgatactggttaatgagccgtgacagtctcgaactgtcgaccctctgattaaaagtcagatgctctaccaactgagctaacggctcaatggaggatacagggctcgaacctgtgaccctctgcttgtaaggcagacgctctcccaactgagctaatcctccatgaatgatgctcaaaaggtgaacaattacgatcgacctctttgaaacaactattacagtttatcatccagcaaaactgctgtcaacaactttttttaaattggtgaatagttattcagagcaaagtgttccgtgtttcaactgcaaaaactatattacacgtattctctaaaaaaagctacccctttttcaaaattatttaaactattttacaacgcggattagttgctctgtattgttttcaaacttgaatttttttttcgtatcacttctttccctcacgctgatgctttgtaaatccatcattagtaccaatgcataagttatccatttagctttataaaaatgtatttatcagtaaagaaatagtcgataccagttcaaaacaccggtatcgactattgaattagcacgcttattctttaacgatcttcgtttgaccgcccatgtatggttgcagcacttctgggatgttaactgtgccatccgcattttgatagttttccaaaatagcggcaacggtccggccaactgccagtccagaaccatttaaggtgtgaacgtactgcagcttaccgttctcatcacgatattggatgtgagcacgacgagcttggaaatcagtacagtttgaacaacttgaaatttcacgatacttgtcttggaatggtaaccaaacttcaaggtcatgggtcatagcggcagtgaaactcatatcactagtggtcaacgtgatcacatggtgagctaagcctaattgcttcagtaagtcttcagcatggttggtcatcttctccaaggcgtcccatgattgttcaggctttgtaaattgaaccatctcaaccttgttaaattggtgtaaccggatcaagcctcgggtatcacggccagcactaccagcttctgaacggaaggcaggagtcaacgctgtaaacttcactggcaacttttcagtatcgattacgtcatcacggtagtagtttaccaatggtacttcagcggttggaatcaacgtttcatccgcttccttcaacgaataaacgtcttcggtaaacttaggaaattgaccagtaccaaacattgacgcactgttgaccatgtatggtggcaatacttcagtaaaaccagccttttcgttttcgtccaagaagaagttgtaaatggcacgttccagacgggcaccctgaccaatgtagtacaggaagcggctgcctgaaaccttggcaccacgttcgaagtctaaaatacccaatgcttcaccaatttcccagtgagacttcggcttaaaatcaaaacttggaatctcgccccatttgcgtaattcaacggagccgtcttcagtcaacccaactgggacattgtcattaggaatgtttggcagacgagaagccttatcatgaacttcctcagcaatctcagtcagctgttcatccatggccttgatgtcagcactcacttgcttcatttggttgatcttatctgaagcatcctctttattacgtttcagctgagaaatttcatcagagacctggttacgcgtggccttcatggtttcactcttaacgatcaagtcacgtcgcttttgatcaactgctagcagctcatcaatttcagccgcctcaacgccacgggtagctaacttttccttcacaaaatcagtttcgtttctaaccaactttaaatcaatcatgataatacccctctcattattctggcccgcaaaaaaagcttccgccccaaaaattgggacgaaagctcgcggtaccacccaagtttacagactagctgcacactcaatttcggtaacggtgattaaccgtacaggattaactgtccgctttaatgtactggagtttcgatgaacggttctcagcaacccgtctctctgcgcatctacttaaaggtacatcgcgttttatcatgcattcattgtaaaatatttacccgttaaaagcaactcacggttaaagattcagttcggccatcttttcatcaaccagtgacagaaccttcttttgcgccgcagggtcctcaacaaagtccagttcatccccattgatactcatcttaggcgacttgtcgtaattcttgtaccaatcgacataacgagcgtccaattccttgtagtaatcgtatagctcaggatccttatcaatttgttcgtatgaccggccacgtttctgaatacgagacagcatggtgtcaaacgaaatattgatgtgaatcagtaaatctggattcttcttttcctgggtattcggtaattcttccatcatgttttgaagtagagaattatagatatcggattcagtctgagtcgcacgccctaaatcagcattcagcttgaataacagagaatcctcaaaaatcgagcggtctaaaacggattcgtcatctttggcagcagccttgatactatctaagcgcttgtttaagaagtagatttgcagtaaaaaaccgtattttttaggattttgatagaacaacggtaaaatctcgttatcctctactgattcataaaaagctggtttatttaagtgacgtgcaagtagctgggtcaaactggttttcccagccccaatggttcctgaaagtacgatcattaataatttctcctttaacctcaaaagtcagtacttcatattgtatcattgctgacggtaaatgcaatatattgtgggtaattttaaaaagagtgtgaaaataagcgtttaaagagtggagtgtaaagggtcccagcataaatccatgggtttgggatttgtgctgggaccctttacatgcaactctttgcttatttgagcacgtttatgagtgtgacacgattcagtggatttcaggatttcacattgtttaaacgtgttcaaacaagcagagagttgcaaataagggccaaacaacataaatccaaaaccaggatttccgttgtttggcccttatttttcactctctaaacgcttgttctcacactctgcttaatcttcaacttcctgccgtttatgaggtgcaacatccacctcgtctaacggaattaaatgtgtatggtgccgaatcttgtagtagaaaaacagaataaagaacagtggcacactgagatacgtcaccgcaatctgctcccaatcaaaatgagcaaatgccgaggtattttgacccacaatcactaacacgcacagtaccagtgccaaaagtggtccaaacgggaacatcttagcgtgaaacttcaactctgataattgatgtccctgcttgataaaggcacgtcggaaccggaaatgagaaatagcgattcctaaccaagcgataaacccggtcaaccctgaagcagcaaccagccaagtgtacacttctggcccagcaatactcgtgataaaagcgatggcacccacgaccgtcgttgcaatctgagcccgtaaaggcacgccgtttttagtggtgtgctggaaatacttaggtgcgaaatcatccaatgataacgagtaaagcatccgtgatgaggcatacatccccgaattagccgccgaaataacggaagtcaggataaccgcattcatcacactcgccgctgcagccaaaccggcacgttggaagaccagcgtgaatgggctaatggcaatatcgctggcggaagaccccagcaattttggactggtatacggaatcaagcacgcaatcacaaaaatggccaagatgtagaacagtaaaatccgccagaatacttggttaatcgcctttggcacactcttctccggcgtagcggattcaccggccgtgatcccgactaattcagttccctgaaacgagaacccagccacaacgaacacgctgagaatagctggtgcgccacccacaaatggggcttgtttataggtaaagttacttaagccaactgcatgaccgcccataatcccaaaaatggttaagaaaccaacaatcaggaaaacgataacggtcacaaccttgatcatggccatccaatattccgtttccccaaaggctttaacggtcagcgcgttgatcaggaagataatcactaagaccgatgtgctccagatccaccctggtacgtttggtaaccagaacttcatgaccaaagcagcggtgctaatatccactgccagtgtgatcgcccagttaaaccaatagttccagcccatggcaaagcctaaagccggatcgacatacttcgttgaataggttgcaaacgaccctgacactggcatattagttgccatttcaccaagggaagtcatcaaaaagaacaccatgactcctaacgcaacgtaggccagtagaccaccaccgggacccgcctttgaaattgctgatccgctggcaacgaacagccccgtaccaatactaccgcccaaggcaatcatcgagatatggcgcgttttcagtgaacgcttaacctcgttgtcattgccgcctgtttgattcgccatttatttacactcactttcacatttattttaagcaataaaaaaggccgcctgcagctacctgcgagacgacctgaaagtcattctaccgtaggaagctctccgcagcacatcactgcgacagtcctagttttcttaaaactagtcccagctccccgcgttatcagtcacgtcgagcttcggcaaattaccctttcacttccaatcacagaacctgaccgttctcctgaaagttactctttcaattcgcgcctcttcttaatagtattcatattaaaccggcatcatttaaattgcaagcaaacttcaaccttcacgatccagtcgatagatgatttccgttttccccggttgatacagtgcgtgttctgaatgtgtaaaagtgtcaacgtaatggaagccgcttttttccaaaacgtgttttgaccgagtattatcatctaaaatgctggcccagattgtgtttaacagttgccgatcaaaaaccaccttaatcaagttttgaaccgcttcagtcatataacccttgccccaatacgaacggtttaacacgtaccccagttcggccgcatcttctgcttgttcaccattggaggcaatcttcggataaaaaccaatgctgccaaccacccgctgagttgacgtttctacaatcgcaaagatcattccctgagtaatagcggagtgaagcagataagccgcatccgtcttttgatgtgcatactgaaagcctgccgctttagcattctcgcgatctttgacaatgtcatagtagtcatctaagtctgactctacgaactgtcgaatcatcaaacgttctgtttgtatactgatcattattaaccgttccctttttctagaagtccaaaatgcgttaaactattagtattcagcgttagttaagacgttgtttgtgttaattttaacatagattacgattaggatgatgactatgcaaatcattaaagaatcacttggcagcaataccgccgcctacttacaaggctacctgagagaaaaggaccctgataacccggatcacgtttacccagcaatgatcgtggttcctggaggctcctatacccatattcctgaacagcaagccgaaacactggcaatggcctttgctaatatgggctatcaggcgttttacctgcgctatagttttgttgatgaaaaacagccgctccatcccgcacctttgatcgaattggctaagtcgatgtcgctgttaaggcaaaacgcttctgaatggttgattgacccggaacgaatcgcgattgccggcttttccgtcggtggtcacattgccgccctctacaacgactactggcactcccaatggttaaccaaacaagcagcagtcactgctgacgagattcagccacaagctattctgttaggctatccggtaatcagtccaaaactcggctttccggttaaagaaggcatgttagcgcaatggactgacgatccagacaccattgcggcagatgaacacgtgaacaatcaaaacgcgccaacgtttatctgggcaacaactgatgatccgttggtaccatcagccaatagtctggcctatgccaatgctttaggccaagccaagattccatttgaactacatcttttccgccatggcccacatggactagcactggctaaccatttgacggcttggaaacgtgatgctaatcaaccacacgttgctcactggctcaagctagctgaagaatggctcaacgcaactctttaataacagattcaatcatatctccaaaagtttctcagaccattttaatctgtttatcgcgaataactgtgaaattactccttgacaatcagcctattcgtctctagaatgagaatcaaattacaaatgccatgagtagtcaaagtagattctaattttagagatcattcgtaaggctgagagaatgaaccgagtcgaaacacagctactagcagttaacctgaacgattgaatttattagggatagccggtcacccaccgttaagcggggcaagttatttaacttgctgaggtagttattgtgaggtagctacgaacagaggtggcaccacgagattatcgtcctctcaaagattaatttctttgaggggattttttatttggaaaggaagctgacgaccatgtttcaattgatgatgtttcacgaaaatacactcattgcaggagtcaaggaacatcacctgcatttgcggcgacatagtctgcacacaaaattgtcggaatagggaagtacaatttgggaggaaacgcatatgcaaaaatcaatcaagggttttattggaacagcacttattttagtcagtgggattgtcttagccggttgcggcaaagcaacttcacaggtcaaaaacactgcaaccatcatggaacaaacggatatctcgtcgttggattcatcacaaatcaccgatgtgggtgcgctggagaccgttaataatgcacaggaaggcctgtatcggttaaaaaacagtcctcaggtggttccgggtatcgccaaagcaatcgtgaaaccaacgaatggtcaaaccgtctacacgtttaagctacgtcaaaacttaaagtggagcaacggtgatccgttgactgccgcagattttgtttatgcttggcagcgagcggtgaaccccgcaactaaagcggccgatgcctacatgtttctgccgattcaaaacgctaaacaaatcgagaagggaactttatccgtttctaatctaggcgtcaaagcagttaacaaaaccactttaaaggtcacattagctcagccaaccccttacttcaagtacctagtagcagctgttccattcctgccgctcaatcaaaaagtcgttgaaaaatacggtcgcgcctatgggacttctgcagctaaaaccgtctttgatggcccatttaccgttcaaaactggaccacatcatccgttaactggacattaaagaagaaccctaactactgggataaaaaggcagttaaattaagtagtgttaagttcgaagtggctaaatcacccgaaactgccctctcactgtatcaatcaggtaaactggataacattatcctagctggtcaacaggccgcacaagaaaagaataacaagggctacctcagctaccctagcggtgaaaccgactacctcgcctacaatttccgtagcaaagcaatgcgcaacgctaacattcgtaaggccatttcactggtagtcaaccgtcagagtttaactcaaaacgtgttgaaaaacggttcaaaagtgccttatggactagcaccagaagaaatttccaagaatcctagcaatggcgctgactttgctaaagattccagcgtcaaggaatccgttgcatataacccaacccttgccaaacagtactgggcaaagggcttgaaacaattgggcgtcaaaaagctgaacttaaaactggtttgctacgatgtcgattcattcaagaactcagctgagtatattcaggctaacgctaagaaatacctgaagggtgccaacattgagatcaacgcacagccaaaggtacaggccatcacgaccatgcaaaaaaagcggggctacgatatcggctttaccaactggattgcttcttaccctgacttaaacgaatttttccaattattaaatacaaacaatgtgaataatgccggtaactattccaacaagacttacgatcagttgtactcaaacgccaacgttaaggacgtcactagtacccagaaacgttatgacgacttcaaacaggccaaccaggttgcaatgaaagaccaagccattgccgccttgaatcaaggccaaatcgtacggttgaataaacccggtttaaaaggaattgcctacgcacctgcacaagggatttcactaaagaatgcctactgggcaaagtaaaggagcgttttcaatgacaacattaattaacgaaaaacaaatcttagcagacttcgagtacctccacccccgtggtgaaacagcatttaacgaagtcaacacaaccaattatttagccaaacgcttggatgaaatgggcgtcagttacgagcgtttcgatgattttaccggactgatcgccacaattggtagtggtactcccatcattggcttacgctcagacattgatgctttgaaacaagaatatcagggcaaaacccaagtcttacactcctgcggtcacgattctcacatgtcaatggtgttggcagtagcaaattattacgcagctaatccagaaaaagttcctggcacactaaaaattattttccaacctgctgaggagaccgttaccggagctgaacgagtgatcaaaagcggtaaattaggcaagctggattacctctacggactgcacgtctgcgctaaaaacgaagtaccagataaacacgccgagcccatcatcccagatattgcaacacggacgtattgggtaacgattaccggcaaaacggcccacgccggtcgaccagaactaggtgccaacgtaatcgacggcttcagcacgttgaacgaaaaatttaagcaaataaaattggacactaagcttccctattcggtaacgactaccatgattcaagctggggaatcctccaatatcgttcctgataaaggaaccttcgcagtggatttgagagcccgcaccaacgacatgatggacgaactccaagcacaggcctttcaagcgatgaaagacgtctccgtcaacggtatcaacgtcattttagatggcaacgacctttccccagcagcaatcccaagtgaacctgccattaataacatgaaacaggcaatcactcaggtgctgggtgaagacggtttggttgaaccagcaccgacacagggtggcgatgacttccacttttacgcctatgatggcgtggcaaaggagtcaaccatgcttggcttgggttgtgatttaacccccggattgcacgtacctggtatgacctttgaccacacagcaatgtttgacggtgccaagattttaattaacgttattcaaatgacggaaaagtaacacttccatcaaacactaaaaaagcattggctcgcgccaatgcttttttctataattgctaataaattgaacgatttaataatctaacctgtgatagtttaggtgccagccagcggtacaaccactcgctgatctgtaaccaagcgtaagccaataacatggcaccaatggtatcagttggataatgagcgccaaggtagacccgtgacagcgccagcaagatcaaccaaataatcattacggttcttaccacaatcgcctgccagtctttttcaatcatcggtacaacgacgatccataaaatggcgattaccaaggtcataccaaaaacgtgaccgcttgggaaactgaacccattgtcgctagctaagtgaccaattggccgttgccgttgaacaatgtgctttaccagcgtcgcaatgacgtcgccgccaaacaacgtgcaaagcgcccatagcgcgggaattcgatacttaaatccccataacagaaaagcaataatcagcacccagacaatatcaaacgtcggactgcttaaaaacgaaatacccttcatgatgacttctttggtgccagtttggtgtttttgaatctcttgaataaagacaccgtcaataaattccaataacccagattgagccatgacgacagctgctagaaaagcgaataagccaccgctgacaagcaagcgaaacggccggtcacgctcttgttcaatgatcattgttgtttcctcccattgttgttaacgatttaacactgcgcaatcgagtatagcatacattatcacacgcctgatatcagattttgattgttagtagaaaatttagaaatcaagaagcctttgaaatgtatccggatacaccaattttacgcatacaaagttaggtaaaagtatgctaaagttgttgaggaatattttactgattgttcaagagaggaatttatcatgattcaaacaatgctcataatgatggctgtcggcctatttgctgggattgcgggcgcaattcttggccttggcggcggaatcatcatcacaccagtcctgactttaatgatgggcttagatatcaaatatgccattggcgcaagtatcatcgccgtcattgctaccagttccggctctaccattgcttacctgcgagacgaagtattaaatctgcgggttgctatgtttcttgaaattgctacaacaattggcgggatttcgggtgcactgttaactggtatcctcaatcccaagtatctctatctcctatttggcgctttgctggtcttctctggttggaacatgtggcggaagttacgtcgtggtcaagaagtcatgaccaacgtcaaacctgatcggattgccaccaagctcaagctaaacgggtcttactttgataaatctgagttcaaacgggtagattatcaagttgaagatgtcccccaaggcttcctggtcatgctaggtgctggacttgctagtgggatgctaggtattggttcaggtgccttcaaagtcaccgctatggatacgtttatgaaaatgccgctaaaaccttcttcagcaactagtaacctcatgatgggtgttaccgcagctgccagtgccaccgtttacttcttcaacggttcgattttgccaaacatcgctgttccgctggctttaggaatcctggttggtgcagtcatcggttcacgtgtcatgcaagttttgcctgcccgcgtcattcggatgatttttattccggtgattttatttattggcctgcaaatgctttacaagggaataatcggaggttaatcacatggacgatcaatcacatcaaaatagcgcaaccgaaaacgaaatggaacatatcgaaatcatcattggtcgaattctgcaaattggcgtcatcatcgcagcaatcgtgatgctgtttggcctaatcctcttgctgatcaacggcggtaatggtggttatccagttggccatcaacctactacgatcagttcgattctttctggtaccgtggctttaaaaccttacgctgtcatgatggtgggcatgttttgcctgatcatgacacccgttttacgagtcgtagtttcaatctatgctttctacaaagaacacgacacgctttacgtttggatcacttctattgttttagtgattttgtgtattagctttgttattgggcatacggtttaaggttactttgctgaaacgcgttctagggcttagagtccggccgtgtaacaaaaaaataggtatgtccccaagttcagggacttgcgcgttttatttatattgcccaaacgcgttcaacaactctgattccggccgtgtaacgcaaaaaggcgaagttcccaagttcagggaactccgcctttttgcgttacactctggaatcaacccgagttgtttcacgctctataattttggattattcctattctcatgactccacctactcgaaaattgcaccatcaactttgtttgcatcctattcaccatttccgccaacagaaagccaaaagcaatcgaccccgctataatggccacctgcaataagaaactaatggcctcccccacgtttcccaacgcgaagttttttatcatctggtaggcctgtccacctgggacgaacggcaccagcgccggaatattaaagttgatcaccggcatccgcttatacctagcagcctgcatactcaaaatgccaataatcagcgttcctagtagattggcaaccgcaatacccagattagccgctatacataaccgataagccagaaaactgatggttccaatccagcccccaaggttaagtgaccgtcgcggcacattcattaaaacgccaaaagtaacggttccaatataggttaaaatcaaatctgtgattaatttcagcatttgtccaccctcacacagcctgcaggatcatggcaatcccactgccaatcgcgatggcactcatcaatgcttccataccgcgcgcaataccactgaccaaatcacccgacaaaatatctcgcaccgcattggtaagcggtacaccaggaactaacggcatgacacagccaatgataatatcatcggcattagtacctaaatgatatctgacagctagaattgctaaagtaccaattgcggcagaggctaaaaattcacttaaaaagcgaattttagcaatgcgattgatcacgtaaaaaataccccaaccaatcagaccaatgacacaggtcactagaaagtctgggtagttgtgcctgaaaaccacttctagggcaccactcactatcccagcagaaagtaattgaatccagaggggaaaataatgggaatggtgatccaaaacagttagctgctcctcgaactgtaccaaggtgattttgtggtcagcaaaatcacgtgataagtcattcaccattgtaattttctctaaatcgatcgaccttgatgtcaccggttcaatttgggcgttttcttcacccgatactgacatcataataccggtgatcgtcacgtacactttgctatcaggatacccggcattggatgcgattcggctaatggtatcactcacccttgcgatttctgacccattttcaatcatgagacgccctgcatgaagcgccgttttaatcatcaaatggccctgatcattcgtcatttcagctgcctccgttcgctatctctcaactagattatacgtgcatcaattcacttacgctatccttaattacgggattgattgaattttactttaatttgacaaatcattatcaatagttaatgcttaatataacgttttagaaatgaggaaattcccaaatgacctactatctgtgtgccattttcactttaattagtgctaccgtcagcttcgggtttgctattgaagcctatattaccgctaaaaaacagccaaatcattcatcgactaccgcacaatatgccgtttccagaagtctggccctgctaattgtttcgattgggttggtgatttttgcttcgaaaccctatctcattgcactggcagtggcaatgattctcgttcaactctttgatggcttaattggactaaaagtcagccggtttaaaaccgttggtccgttgctgactgctttagtgaacagtgttttgttactgatgctaattaaataaaggctgtgtttagcctacctagcctaaacgtgtcaaacaactcagattctcgccatataaggacaataaataaggtatccgttaagaacacggataccttatttattgtccttatattctggaatctaaccgagttgtttgacactctgttctattccacaaaaatataatgtgccgccttatacccaatcgtcaaatcctgcttatcagttaagttagtcaccaacacaggaccttcaaagggatcgtgcttgttcacctttaacttgtcgccaatatcaagtttgatatcgcccagatacgtcagcagatcatgattatcaataaaacgcgttaccgttacggtttcaccgtctttaacatcgtttaagatcaagtgggattcgctgtcaaaatgtccattacgatccggaatcgtcccgccatggggacactttttaggatgagccagcgcgtcatccatagcgttagctaatttttcactggtaacgtgttccagcttttcagcttccacatccaaatcaggtaaggcaaagtccaacttattaactaaaaaagtttcccataaccggtgttttcttaccagagtaactgccttttcacgaccagtatccgtcagtgaaattccagcgtagggttcgtggttaacgagtccctcctcaaccattttgttgatcatttcagttactgaacccgctgcaatgttcaaactaatggcaatttgtttattcgatactttttcacttgcgccaccaagctcaaagataatttttaaatagtcctctttcatgggtgtcatatacttcattactccttgttattcttcattttgccgttttaaaagttgctgatcaagatcttcattcaaaatcatttcttcaccgcgtccacgcacatcttcggcttgcagcgtcacgtggcaaatgccgtactttttagccagaatttcttctacttgatgataaatgggctctgcctcactcagcaacatatctcgcatgttgatgtgagccgaaaacatgattcggttttcatcgatcatccagatgtgaatgtgatgaacacttgtaataccatcaatctgcattaaatcttgtttaatggcatcgtaatccattttcggtgcaccctgcatcagaatcgtaatcgtatgacgcacgattggccacgactcaaacgtaatataagccgccacgatgatggtgataattgggtcaataatagtgacattgtaccactgaatcatgaatgcaccgaaaataacgccaactgacgataacgtatcactcagtaagtgaagataggttgccttcatgttcaaattatgttttgaaccacgatgcatcaagattgctgacgctaaattagctaccaagccaatgacagcaacgcccatcatcaattcaccattaatggtttctggatggctgagcctcttaacggcttcaaccaccaaaaaaatggaaactacaatcagcaacagtgcgttgagcatggccgctaaaatctgcgcacggccgtaaccaaacgtattgcgctcgtcctcatcccgtaaactaatccgatgtgctatgtagctaataacaatggagaaggtatcgccgagattatgaaacgcatcagaaagcagcgataaactaccagacagcagaccaccgactgcttctacgatggtaatgaccccgttaagtacggtcaccgtgaaaaattttctacctgacatgtgtttgtcttcagccataccaattccccctagaggataatactatcacatttttagggaaaatcatccaagaagttagggcaaccgtcaaaaaaacgttcaccaaattggcgaacgttctaaatgatttaatgggtcttaacaagtgattccgttttagtcagcttttcataggcaaaatcgcgaattgacgtctgttggtcagcaaggacttcaacggtacctgtttcactgaagcctgccttcttgatgacgtgttgcatacctttgttatctggatgagtatcaattcgaatacctttaatggaagagttatcttcgatttccttaaaaattgccgcgaacaatttgcctgataaaccttgaccgcgatggttggcagacactgccacacggtggatggcaacgtacgtattgtcgtgcgtcagccattcgccatcgatttcttgataactttcgtctggtgccggaatgactgcagccgtacctaacacttcgtagccctcaacaagcactaccgtgtggccgttttgaatgtcattaaccagcacattggtattgggatatcccccctgccattgatcaatgttttgagccgccaggtgagtttttccatcctggatgattgattcgatttgtggtaaatctttcatttctgcgcgacgtaaatacatttgttccacccctttatttttcacaagattttgatatcttaaactatatatctggtgatgtctagcaaaatcactccgaattttcctaataatttcattaaggattttctaatttgggaaggttgataaaccgctgttgaaagcgggttaaaaactgggtttcttaggaaagttggggtaggaacttgcactactggtgagacaacaaaaattcaaaaccaggatttatcctttttagctacattgcccaaacgtgttccaacaagcagagacttgcacctaagcccctcctgacacaaatccaagcccgggatttccccttcttggctacattgccaaaacgtgttccaacaagcagagacttgcatctaaggggcttccggcaaaaatcctaaagaccaggatttatgccggaagccccttagactccagtctctaaacgcttgtttccacactctgcacaaaaaaagcccccccagtttttcactgaagggactttcccagtgacagggtgcctggccagcactgagaaaatcaatttcttaattttcacttacccgtcattcagatacgattactggctcagctttacactgaacactcaaagcgcattgtagcgccatccatggcaaatttgtcaagtttagcgactagcgacgtttatcaaactacatttaaagacaaacttcaaaagtatttccagtatcagccagtcatatcctgtcactatagtaagaataacattatcaaaccccgttgggaacctatttaacctgcttttgcgtgaatttcattatgatgccgtacaaaaccatactgagtaaaatgaccacgaacgttgccccaatagtattcgcgataaatgacacgtgtttgagtccgatgtaacaaaccaccgacaccgcccaaactaaaatagcaatccagttaacgccaccttgataccaatactggccgtgcgcctttgagaagtcatcaatttgataattccggtgacgcaaccagaaatagtctgccagaaaaataccaatttctggtccaagcaccatcccgataccgtccagaaacgctgtaaaaatcgtcaggaacgatgccacaaaaatcggtaagaatgtgactgccgtagcaatcaacgtcactacccataaactcaccgtcagacttaaccgacgcgtcatgtttgttaaagcggagccggctgacatgaggttcaccgcgttagcagtggtactagtcaaaataatcacgatcatggctaggaaaccaagtcctaatttactggcaatcgtacttggatcagaattattcggatcaaagtgattcagtgtaatggccgtcccaatggtggcaatcaaaccaataaaggcgaaccagaaaagtcccaagttcgcgccaaggaaggaagcttgggtcgcattcttcttcacaccggtaaaccgagaaaagtcactggctgcggttacccaagctaagttgaatgctgctagtacatcaaccgcggcgcctggcgtcatttttagattgtgaggtggctgccaactcatgatttcatggaaggagacggttttaaatacgacaattgattcccagatcacgaagataaacaccaagacaatacccacgcgttcaatcatttgcacggagcgttgtcccactgaaatacttaagaggtggaaaatactcatcacgatgatacccactgccaagcccatcgtaccgcctggtttgccatagactggccaaccgaacaaatcgtggaacaagtaactcattgaggtggcagcaataaaggtatttaccgctgcccagccaataaactgaacgagattaatcactgacggtaacaaactgccacgcaacccaaacgatgctcgagtcagcgtcatggcggtcagacccgttttataacccatataactggcggctgccagcaacaaatatgaaataataccagtcacaatcaaagtcgttgaagccgttaaaaagccacaggcagcaatcacaccgccaatgtaccaagtcccgttattggcgttggcaccaacccaagtggcaaacatatcccagtaagacatgtgccgcgcgctcatcggaattgcgggcacccgtcctaacccattctttgccaactcaaccactcctcatctcgaattatagtaaaaagacacccctatgcccgcaggtatagaggtgtcgtatttatgctgtcgccagcgccgaccctttattagcctcacgggactaaatttaaaaggtttattgatttcattcagtatagttttccgcacgagcgttgtcaatacgcccataaaaactcaccttagttcgcaatctcgtgccactcggcttcatcagctcgagaaatatcgttcaaaaacttcaaaacacgttgggcacgtttttcttgttgcgcgaacaaactgttcagaccagcaccagtggttaacggctgacccaacttcaactgtttatcctgacgggtgccttccgcaaaggcaaccaccatctcaccagtatcaatcgtggtaaacaggaaaaacagactatatggatcatcatccgtcagatacgcgggcatcgcccagataccttcctgcaattcacgcagttcagaattaccgaacttataatccaggtgattttgctggttgatcggtgtctttaaaaacagcatcatcttagtaaacttatcatcgccaagctttaaagctgcatcatcattttcactcattattgaccccctcttaaacatttatgctctatcttaccagtttttgaccatgattgtctgccgaaattttcggcaagcgctaaatcatcgaaacatcaaccagcttgtttgaaatctcacttgacgctggcaaatttatactgtaaagttaacggcaattgaagaccaaataaattcagacagggagctgatttttgatgacgagtttagcaacgactattggtggcagaacttttgacaactgtatgatgaacgcagcgggagtccgttgccaaaacaaacaggatttggacgcactggtggcctctagcgctggcgcatacgtcactaagagtgctaccccacagaagcgagcgggcaatccgtcacctcggatgcacactttgcctaagggcagtattaattctatgggtctaccgaataacggcttgtattactacttaaattacgtgattgatgaccaacgtaaacgtcctgacgctaccaattttctttccgtagccggcacaagtttggaagataacttagccatgctgcaccagattcaagaatctgaatacacgggcttcgtagagctaaatttatcatgccccaacgttcctggtaaaccacaagtcggttatgactttgaccgggtcaatactgtattagataaagtttttgaattctatactaaaccgttgggtgtgaagttgccaccctactttgatctggttcactttgaccaaattgcggcgattttgaaccaatacccacttacctttgttaactcaatcaacagtattggtaacgccctagttgtggacccacaaactgaacgggtcgccattcggcctaaaggcggctttggcggtatcggcggtgcttctgtgaagccaaccgctttagctaacgtacgtgggttagcattgcgcttaaaaccagagattaagattattggtactggtggtattttaaacggtgtcgatgtctttgaacacattttgtgtggcgcttctatggttcaaattggtacccaatttggttatgaaggcaccccactatttgaccgcctagctaaagaactccgagagatcatgaaccaaaagggttacacgaatatcaacgaattccgtggcaaacttaaaacatttgatgattaattttagtaagagcataaaaaaaagaactgtttcggcaatgtttgtcgaaacagttctttttattttggttgatcccgtaattcagctaactctgaacgaatctcagaaagaatttcaatctgtaacttttcaatctctagggtgtgcggaatctgattttgagagagatggtctaacttagcatgtaggattcgtaattcgtgttcggacttcaagttaacgtggtagtcgttttcagcagccattcggtcacgatcagccgaacggttctgactcatcatgatgataggggcttgaatcgcagaaatacaacttagaaccaaattcagcaaaatgaacggaaagtggtcaaaatgaacgccaaataactgcagtccattgactaacatccaagcgatcaggacgaacacgaagataccgatgaaaccccaactaccaccaaaacgtgccacgttatccgccacccgttcaccaacggtcagactgtttgtgagggtctcattcacatccgtaatctcataatcgtcgctttgcatcgctcgtgtcaattttcgattaattttttgactttgttttaaatccgagttgatcatggcgtccacattggccaatcgatactttaataaatgatgaccgcaaataaaatccgtcacctttgccttgggataatcgcgcttgacccgctgacgaatcgccgtggataaatctgcaaggtacagcccttcatcaacgtggtacgccttgccgtccacaatgcacgttaccgtctcattttctgacatggatttcaccccttctgctcaatagtttaccgcaaaaccgttgatcacaaaatgcttgttttgcgattgatgaaattaaaaacacccaccgcaaaatacgtaactgcggtggatgttaattggaaattgtctgagtacggtgtttcaaatttatggcgacaaactgatgtctccagcaacggtctattctgtaactaagtccttgtcaacaaatggtttcttggcagcctttaaagatgccttcatttcagccatgtgcttaacaaacttgtcgtccttaaggtcacagtcaaaccacgataattcggaaaggttttcgtccatctggtccaaaatcttcgcaatcgcctgctgtgactcatcattagttgtcatcaaattcactccttagtagtttttacaattgccataatacagaatttctagggaatagcaagcgttttacactaaaaagtttattatgagatgaattcttaatttaccgtctttttcaacattctttactcagataaacatgcattgaattgcatcatttttcaaattgctcacttaatcacttttaacatatcagccggtagatcagcttcaaaatgacgagacgcgtcggtgactggatcttgatagtctaattggtatgcgtgtaacgcctgccgtttgagttgatcctgagggccaccgtaaagtgcatcgcccagtaacggatggccaatggatctaaagtgtgcccgaatctgatgcgtccgaccagtgtgtagcaacacctccaccagcgtccagttctcactacgctgacgaacccaatattcggtttgggctgacttaccatctgccgcaacaatctgatcaaaaccatcatctgaacgtctcaaaggggcatcaatcatgtcgtgatctttctctaatgggccactaacgatagctaaatagcgtttttttaaccggtgatcagctaattgctgattcaaccatgagttcgccagtcgatgcttagcaatcagaaccaagccacttgtgtctcgatccaatcgggtaataatgtggggaacgagattttgatcacccgtatcaactaaatggccctttactcggttgaccagcgtgtcggtccggttacttggaccggggactgaagtgagtccagcaggcttcaaaaccaccatggtattttcgtcttcattaatgacctgcaagggtgccgaactgacaggcacttctggatcagctggctccactggcacaaccagcgtcagcgtatcgcctagctgcaccttaacggacggttttactgaaacgccgttgaccaagatttgtccgttactttggttcagttgtgtaaacatccggtgactgacgccatgttgctccagtacttgtttggctgataaaccagcttcgtccaccgtccacgtaaattccatttaactttaccccaatcctatttatcggcttctagccggtttaaaattcgtcttaatgatgggtagcggtcaccatccaaatgatacttaacccgaaactgcccaatcatccgatcagaatacttatccggatccagcttcatggtgttggtatccagcggtgcttcatccgtcactaccgcatccaacacgatcggctttttatcaccagctgccaagtggtgcttgatggtttcaacagcagctttcagggtatcatcgttggtgactcgcaaaccaatagcacccatattttctgcgacaccagcccagttggcattcataaatttcagtgcatagtcactttggccagctttcgccttttcttgacgaataaagccataaccaccgttttcaagcaccacgttaatcactggtaactgatactgaacttgagtcaaaatatcctggacaaccatcgaaaaaccaccatcaccagaaacggtaatcactcgacgatccggataagttaactgagcggcaattccggcagataaggcgtaacccatagcaccgaaccaagatgacatagtcataacctgtccatcgccaaacggcagcatccgcgttgaccacacggtattattaccaatatccagcccataaacggtgtcggcagtgactaattgtgacacttgccgcaacacggcttccggcgtcagcaagccattcggacgcgcggccacccgttcatccaaatatccgtgccaattttcccgtgccgtgtgacaagcctgcaagaaatgactttctggcaaggcttcagcttgagcttgaagcacttggtttaagtatgttttggcgtctgcacgaaccatctgggtagctgggaactgttcacccagtgcctggccgtcgcaattgatctgaaccgttttaattgtttttggcataaaccgcatgaacggatagctagtcccgaccatgacaactaagtcagccatgtgcatggcttcaaaggcgggttgcgtgccaatggtcccctgagcgccaagattattgacgaaattagtaggaacataacccactgcaggtgccgttgtgactactggtaagccgaatttttcggagaaggccaccacttctgactgagcatgacgaatcccagttcccaccagcatgacaggatttttcgcctgtttaatcagagaaatcgtttcggcaacttgctcatcggttccagcgagaacgggttgcgactgactttgaatcggtaacgcttcataatcaatttcaacgttagccaaatcatctggaataatgactactgacggcgattgggtatcataggctgcttgaattgccgcccgaaccgttcccggaatctgcttcgcatcactgacttggcgatgaaaggtatccagacttgaaaacagctcatcttcgtccatgtcctgcaagtaatgggtattcatcacactggtggcaacgttgctgatgatcaccagcatcggtgtgtgatccattttggcatcacataaaccgtagatgagatgaacggcacccggacccactgctgccagtgccacaccaattttgccagttaacttcgattcagccgctgcagccagcgcgccaacttcttcatggcgaacctggatgtaagaaacgagatcctgttcagcggcaaagccatcaatcaacgaatctgcgggaatgccgtagacgtgatcaacgtgccaatttgccaattcttttaccagtgcttcggatgccttcatctgtgtcatgaccgttcctcctacatataaagttacctttattttaccatgtttacaccgcaaaatattttttcgcggacacttgtcatgtaaaaggtcagcgcaaaatctgcaatccacttctcaataaaatccgctgtttaaatctcctggagtttcggttatactaattaaaagaacgtttgttcggaaagtgatgtgaatcagttgaatcccacagagttacaagcttatctcaccgctaatagtcaggttgaagcgcgcttcatggaaagggcattaccctatttaaacgatgaaaaccttaagcgagcaccagcacgccgttacaatagtaccgtggtgcagcgtcaagcagacaaactgtatggtcaatttgtcgaacaggtccatggcaagattgcccagcaactacgcggtgagcagagtcaacaagcgtggctcagactcattgaacaaaataatttactggaagaactagaagattccatgtcagaacttagcttcggtgcggaggaatagttcgtattaaaaaacagacagcgtctcaaccgaaagattgaaacactgcctgttttttgtctgaaacttgcttttaactatttaacctcgctggcaacagcttgattcacagcgttcttttcggcttcaatcaatgctacccggctttcaatcactttaatgtccatagtgatctcacgcgtcaaacctggtgtattgagttttggttcgaagaaggctttgaattcagctagtcgatccgccgtcttaaagactccagcggtaacggtgatgtaagttgagaattccatatcgccaccaaccgtgtcttccagccattgccaatcagtacggagccaatcccacgcagcttgttcgccatgaggattagcaagaacccctctaaaccagccacggagatcttgcggtttgatgacatccgcattttcaaactgatcaatggttttcttgatcaacccagcatctggcgtactggtcaaagcagcacgaatattggccttgtaactgccatccgcagtctgttgatagtcagctaataactgatcaaacagtttttcacttccatagtgtttaacctcgttagtcaaaatcaagccacggatgtcagcgggcaacgttgctaactgcgcttggttgtcctggaaaatctgatgggcagccgcaatcgcatccgcattttgcgcgtataatgccgcactcaaaatcattggtcgtgacagctgatcatcgatggattcaccagctaccggcaaccagccaagccgtttaacttgagcggcactgagctggtcaaacaattgctgcagctgtttttcttctgttgaatcaggcaaaacaaacttctttaaattattcgctaacgtatacaaagcggtgatgaccactgcttcatgactatcagcaaatcgtttcaacagtggtacaacactagcgtaggaaatttgccggccttctgctaacaacctgagatcctgcattaattgtaactgtgtaatggcatcgaactcatccacgtgagctaaaatatcgttcagtaatgtctcatcgtaatgtacgataaagtgagaattgttccccacgttcacacggaatggttctccaagacgctgacgaacatcatcataattacctagagacagtttagcatctttgaaaatagccggtgcctgtgaatcattactattcaacggaatttgccattggcgaccagtatccttgccgtcaccgataaagaattggtgctgtttcaaggtcaactgaccatcgacaacttgcgcatccaccactggatagcctggttgttccaaccaagagttcatgatagcaccaatgtctaaatcagacgcctcaccaagtgctgaccataaatcggcaccggttgcgttgccatactggtgagcttcaaagtatttctttagccccttacgcagcgcatcgtcgcccaataatgaacgcaccatcaccagcatccgagcaccttttgcataaacaatagcactgtcaaacagcgcatcgatttctgcggggttctccacttgaacgtgaacggattgaacaccgtcagtggcatcacgattcagggccattggcgcctcactggtctggaatagttcccaaatgtgccaatcaggttcaagggcatcgaccgccacgtattccatcatgttggcaaaactttcattaagccataggtcatcccaccacttcatggtcactaaatcaccgaaccattggtgagctaattcatgagcaatgactgtggcaacctgctgtttcatttccagcgacgtgttgtcaggatctaacagtaggtaggcttcccgataagtgaccaagccccagttttccatagcgccagctgaaaagtcaggcagtgccaattgccatgaatgtggcagtggataaggggtttgatagaagtcttcgtaaaattcaatcgagcgcttggcgatatccaacgcaaagtccagctcattggccttgtgtgctttcgtaccaaaaaccccaaccgtgacaccgctcttggtcttagtttgtttcgtttgcagttcaccaaaggcaaaggcaatcaaataagtggacattttcatggtggtgtcgaaatagtggacaccattttccgtgcgaacttccggcatgttactgatgattgtttcgccggggtgttcgtcaaatttgatagctaaatcaaaggtagccttagcttctggttcgtcaatccctgggaaggcttggcgggcaaaggtcgtttcaaactgagtgccgatgatctgtttcttttcaccgttcacttcataatatgacgggtaaatgcccatcatggagtcggtcaaaggtgcggtgtaagtgactgttagcgtcgtttcaccagcctgcttgaggttgatgcgaatagcttcagcaggttgatctaagttaaaatcaaccgcctccccatccgcctcaacagcagacacgttgagaaatttctgatgcagggaaattgccgtttgagaagcatttcccgtaatcgtggttttaccggaaatcaattttgtttcccggttaatatctagatataagttgtaatgacttggttgaaaagtctcataaaaatggtttgttgctgtcatagattggcccccatttaatggttagaatatatctattatacgactttccttattcagcaggtaatttgaacgcttcacaaattaaatcgtgtaatgccaccttgcttttcctaatctccaaaacagtgttaacgaatcgtattaatccccataatcaccatcaaaaccgccatgatcacctgaaccaccgcagcatgtgatgatttggcgatccgcttcattaacaacggtgcaattaaagcgccaacagcagccccaagcatcagtggtagccctaactgccaatcgacttgacctccactgatgtgcatcagcgcaccaatgatacttaacccaactaggacataggaagaggtagcaacggcttgaaaagtattcagcccgagaattaatagaccagctaaaacgggaccaccaccgctcataccagcgattcccaccattagaccactcaaaacgccgtacatggaagccattaataaggtatgggtcgtgtgtgaagtccgatcaccttttcgaataatgattctgagccctaaaataaccaaaatcagtcctagtgcccagcgataaatgacttctggaatatacggcgccaataaagcaccgatcaccactgctggaatagcagaaatcagcatttgattgccaattcgaaaattaatttgtttctgacggtaatacccccatgaaccgataatcacagagggcaacgaggtcacaagagacgtagcggctgctgatagcggtgaaatcttaaatacggaagctaacagcccaagataaatggcccctccgcctccgcctaaggaaatcacaatgataccaacgattaaaccaacgaatagtaagataaccgtattcacattaacgtcttctttcatgacctatattttagtatttacaccttgtaattataaatgactttgtgtaaaattcaatccaaaggggcgaatatttttgacaagtcggactttaaataagacgaaaattatcaatacggcaatggatctgattgcccaacagcaaccgttaaccttctctaacatcagcagacgattaggcatccactcacaggcactctacaattattttcccgatgttacagcgctaaacgcctcaatcgatgaagcttataacgctgacttgctggccaaattacagcagcaattactggggctatcaggtgaggaagccgtccttaaatttgccttcgtttgccggcaatacgcgcttgagcgttttaaactcacgcagttcgtcctggcaattcctcgtgaactattaaatacagaccccgttcaagcgccaagttcccaagctttgagacaaattttataccagttattgatgaaaattgacatgagtgatgaactccgcttgaatgctacccggatgatccgtaatctcattattggcgaaattgtcaatgtcggccgtggctggtttaaaaacgatgcggtcaacgaaactgatagttttaagcaaatgctgttggtggcgttgcatcacttggaggaactgtaacgagttcatttaaaacgtgctcaaacaagtaagagttgcaaataaggcacaaccaacggaaatttagattccagttggctgtgccttattctccactctttaaacactctatttcacgccatacaattgattcactttattcgtagtcgttttaccataaacaatcgtttggatattcttcgtaatccgagcaatttttggaaaaccgctaaaaccagattgaccatgaccgtgagtcataatggcaatggcgtaccgctgaccgtttggtaaagtaacgataccagcatcgttgttatacgaccaaagccagccaactttatcagccgtcgttgaacccttcatagcctgattagctcctgcgggaataccggaacgataaacttgacgactcatcagcgacaacacctgactacgatttgacgcattattgaatggggagcggccctgatccaatttacgcatcacggacaccaaggttgcggaagttgttctggcagctctattcgaggcaaacggatgtgagtaccagccctgtttcttaacgaaactattcatgttgctcaatccatatgaacttaaataactttccgcaaagccattttgactgtgcaaaatcatttctttaaatccggttgatttcagcacactcttgttcagcgtccctgaattaattcgggataagatattcgtgacaataaacattttataagtgcttgctgaggtgtaagctttatgtgcgtttgagctctcaacggctaactgacccgctttgtaaaagctggcagtactgctggcacccgcgggagtggaagacttcgcccccagattataaaacgaaacgctaactgtaccgtctttagtgaccgaattaatatacttctgcaactgctgtttgactgcgctttgctgactgctaacctcttctttagccggtgcagcgtgtacggaagtgctgacaaaactaaccccaagaaatagaacaactgcggcaacgataaaaatgaacgcttgaagacgctttttcgaagactgctgatatcgcgtcatcctcgtctgtctgtccatggctggtcattcctttcagcttattttactgttattatacacttttaaactggtgattctcagcgtttagcatatttgtcatcatcaaataaaaaagcttcaaatcaacgtttttagtattaaacggtgacctggagccatattatttaaaaaaataaaaatttatttagcagcagaaatctgaatagcatcctcgcggtaatcagtttcatgatgcagcatctctgctaacacagttgctaacgaaggaatactaattggaccaccagaaattgaccgacccttaggatccaaaacagcgtgctggagagtatcgtcatacttgaagaaatgaatcattaacaacgtactgttaagactgccagcttcaataatatcagcggcctcgcgttgattttgaacataaccccgttcagttacttcatcaaagccaaatgtggctgctaatgctagattctcactggaaacgtctttatcgtaaatttgaaactgagttgaccagaataaacgggtcacacccgtctcctgcatagcttgaactagcggcttagcataagtctccactttgaaaggaccaagtgttgaaaaaacaacatcaacgtccttcaaagccatctttaaatcagtaacttttgtggcatcaccaactgcatgttcaacaaactcagggtaaataacacccttttttcctcgatcaaacgcccgaatagtaacgtctggtaatggtgctaattgctttagtacggcttgtcccagaacaccagaactacctagaattaaaattttcatacgtcgcctcctgtatgttcataatatcacataatatatatacttggcatatttttttataactttaatatatattattagcaaaccagcacttcatagtcatcaaaagagctctttccaagcttgacagttcaaaaatgtttctaaaacgttagaaatgctggtattaaaaaacagcctgtccgcttatcactaaatgacaacggtcagactgctttcaattaaagcttgaaacatatcagtgaattgattggaaacccaaattaagattattgatccagatactctttagtcgaagcaataatttcttgcaaccccttcttagcatctgagaagaacatgctggtcttatcatcagagaacagcgagttttgaataccagcataaccagtactcatagaacgcttgatgacaaccaccgacttcgatttatcaacgtccagaataggcatcccagaaattgcggtgttaggttcacgagcagctgggttagtgacatcgttagcaccaataaccaaggaaacatccgtgttttcaaacatggaattcgcttcttcaagctgcttcatttggtcgtatggcacgttaacttcagccaacagcacgttcatgtgaccgggcatccgtccagcaactgggtgaatcgcgtagttaacgttaatgtcgttatcagtcaataacttggctaattcggcgacttcatgttgcgcttgggcagcagccagaccatacccaggaacaatcataacgttcttggcataggctaattgcaccccaatatcatcagcagaagtttccttaacgttaacgggaacttcatcagcactagtcgatccgccgctatcaccagtcccgaaaccaccagcaatgatgttcgccactgaacggttcatagcagcagccatttgcaaggtcaaaatggtaccagcagcaccaactaaggcaccggcgatgatcaagacttggttgtcgataacgaaaccagccatggcaaccgctaaaccagtaaaggcgtttaacagtgaaacgacaaccggcatatcggcaccaccaattggaatggtcattaagataccgaagacaagactagcaacgatagcggtcactaacgtccaaacgttggttggaaaaccaacggtcatgacgatggcagctaagataatcagcaccacaatgccatttaataatttggcaccaggaaaagtaattggcttaccggaaaccttaccggccaatttacccgtggcaatcagcgaacctgagaaggtaatgctaccaataatcaggtctaagataacgggtagtgaaaaggcaactgatagtgaagcaccagctggcttactcaaatagtcaaaggtaccaatcgcagcggcggcaccaccaccaacggcgttaaacagactaaccagttgtggcatatcggtcattttcacggttcgagctcggtaaacaccatagccgaccccaagaaccaaggcaaccaacagcacaagccatgcggtcatcgtggtatcattctttttcaaaacgatcaagaaagtcataataacggcaagaatcatgccgacaaatgacaaccggttaccgttacgggcagttttaggtgtccgcatcatatgcagccccataacgtagcaaaccgcactaattaaataacacagagaaacaagcgtcattaacccagacatcacttgtcgcctcctttgttacccttgtccttaggcttcgagaacatttcaagcatccggtcggtaaccacgtaaccaccagaaacgttgatggctcccagaaaggctgcgataaaggcaatcacataaaaggttggcgtatcggcttcaagagcaactaaaatcgcacccacaacaaccacaccgtgaatagcattagcaccagacatcattggtgtgtgcaacgttgcggggattttactaataacttcgaatccaactagcagactcaaaacaaaaatggcaagattcgtatataattcctgactcattctactcagctcccttcgactcagctgattgatcagtcttttcgtccttaactggctcgtccgttggcagcggatcaagcttaaggacttcacgcaaccgcgagttaataatttcaccattcgttgtagcggtcagcccactaaagacatcatctttaggatcaatggccaggttgccatctttatcaaccatggcgttgataactgactgaacgttcttggcgtataactgcgacgctgagttagaaagctcgctggctaaattattaccgccgataatcatcacttgattgtcagttgtaaccgtttcgtcaggtttactgccggcgacattaccgcccaattcgctggcagccaagtcaacgaagacggtcccaggttgggcgttatcaacactttcttgggtaaccatcagcggtggcttgtgtccaggcacctgagccgtggtaataatgacatcattatcggcaatgaaaccagctaactccttttgctgggcagccgtttcttcaggggtcaacgcccgcgcataaccgcctgaaccagccccgttggaaactgaactggttaagaaagtcgcacccaaggattcaacttcgcccttagaagctggccgaacatcgtaaccggaaataatcgcaccaagacgcttagcggtcccaatggcttgtaaaccggcaacaccggtcccaagaactaatactttagctggcttaacggtcccagcagcggtgatcatcattgggaaatacttcgagtaagcatcactggcaactaaagcggctttataaccggcaacactggattgagaactcaatacatccatggtttgcgcacggctgattgtccgtggtaagagttcaaacgacagtgccgaaactttcttatcagccaactgctgcatcttttctggcttgatcagcgaactcaataaacctaacagcacttgtcctggtttcaaggcattcagcgtttcatcgctaggtaagttaatgaccgcaaccacgttagcttgagacaacgcggtttggcgatcaacgacttccgcaccagctttttgatagctgtcgtcgttgtagtacgaagcaatccccgcacccttttcaatgagaactttcataccagctttgatcagtcgcttggtgacgtctggatcgatggcaacccttttttcgtggggctgctcttcttttaaagcagaaaccacaatactcatgaatactacctccacttcaatgtttggaaacgttgtttatggcgcttaagttcaccatgactagccattccgttcaacacatgaacgaaataaatgaaagcgtttccaatttcagcttaacagaaaaggtacctagagacaatcacccctagatacctattctgcgttatttaacttgattcaattatgccttagtgttctcagggtgaccctgtaggtaaataacgtgagtgttcaagaattcatcgataccgtgacgaccatcgtcaccaccgatacctgattccttccagcctgagtgagacccgttcatggcttcgaagttgaaccggttaatgtaagtttcgccatcttccaattcgttagcagcacgttgggcaacatcaacatctttagtaaagattgatgatgtcaaaccaaagtcgctgtcgttggccatttcaatagcatcatccaatgtcttgaaggtaacaactggcagaactggaccaaagatttcgtcttgaataatttcggaatcctgcttgacgttggtaatgaccgttggttcgtagtagaaaccgttttcgatttgaaccttatgaccaccagccgtaatcttgccaccagcttcaacggcacggtcaaccattccggcaaccttgtccaaagcagcttggttgatcagagggccaatgccagagtctttatcagtgattgggttagcaaccttgattgcagacatcttgtcactaagcttcttgatgaattcatcagcaaccccttcttgaacgtagatccgttcacagttgttgcaaagctgaccattgttgtccacacgtgaatcaatgattgattgaacagcgagatcaatgtcagcatcgtccatcacgatagcaggtgctttaccacctaattccaatgagaccttagccatgtgggtagcagctgatgccatgacacgcttaccagaatcaacagaaccggtcaaactaataataccgatcttcttgttcttggataattcgtcaccaacaactgaacctgggccagtaacaaagttaacaacaccgtttggaattccaactttgtcgacgatcttagcaaattcaagggctaagtttggtgtatctgaacttggcttcaaaacgatggtgttacccgttaccaaagccggacccattttacgagcaatcaggaagaatgggaagttccatgggagaatcccagctgcgacaccgattggttgcttggtaatcataatgttttcgttagcattgtcagattgaagaatttcaccttcgtaagtccgtgcagccgaacccatgtaatcgaaatagtctgctgagaaggtaatttcagtcgttgctaatgaacggatcttaccttgttcttcttgcagcatatcgatcaagtgatcttgatccttacgaatttcagtcgcaacatcatgtaaatactggccacgagtagcagctggtacaaatttccatgatttttcagcttcataagcatcatcaatggcttctttagtttcttcacgggtagcacttggcaccgttgaaatctcttctccagttgaaggattgatcacggttaaaagtttgcctgatttagaatccttaaactcaccgttgatatacatttgataatgctttaaacctgtttttgtttctgacacggttattgcttccttccaaaatgcaaactgtattctacaacaaacgtctcaatcacttatttgcctggtacgtagtctggatcgataaccaagattggcttgatggtcttaccactgcctgaatcagcgttagcttcgttgatttgatcgaacttgtagaacttttcggtcttgtcgaaatcgaacatgccagcctggtagaacttaatcaaacgaggaatatcgatttgtggaacggcatcgcccatgttgacaccgataactttacgatcgtcaacacaaaggtcgttccaagtatccaaatcaacgtggttaggggtaacggcgatgcatgctgaagtcccaccttgtgctaaggcttggatagaatcttccataaccttcttaacaccggtagtatcaaccgcaaagtcaacaccgtgaccatccgttaatgacttgatcttttcaacagcatcttcactcttactgttaacaacatcagtagcgcccaattctttagccaactttagacgtgagtcaacaacatcaaccgcgataactgttgtgcagccagaaatcttaccagccatcatagctgccaagccaacggcaccagtaccgaagacggcaatggtctgacctggtctcggcttcaaggtgttaagaacggtaccactaccagtgacgtagccacagcccagaggacctaatttacgtaaatcaagatctttaggaactttaactgcattagcttcacgaacaatggtcgttgtggtgaatgaggattgatcaaacatgtcatcaacttgcttgccgttttcagtgaagtgagcgcttccatctggacgtacacctgacaggttattagcagcgtagttcaggcactgtgtcggaacacctctcaagcagttcacgcaacttccgcaaccatagaaggaaagcacaacgtgatcgccaaccttgaagtttttaacttctgggccaatcttttcaacgatacctgaaccttcatgaccgaggataattgggtaaccaatttcggcatcacccttacgtaaagcttcgtcagaatgacaaatccctgaagctaccatgtggatctgcaagtcgtcagcttgcattggtgctaattcgacgtcatcgcgcatttcaaatgaagcgccttttttatcaacaactgctgctttaatacgcataactccatcatctccaaatgattaatttgacaaaataattaaatgaaagttgaagtgaaagtcaatttacaaatcattcttggaacatatcactataaccagaatgttatagttctacatatgcttaagaattgcttgtgaactggttctcatttgcttacaccttagttatagttcatttcagctaaattttaaagcgtttacatcaatcttttcgattatatttgtctaagaaaaactttgagattgttattttatcacatgctgggtttcagttttaaatcaaagttttgttctagcctaacgtttgagttacgatcttatttggttcaatacttttatctagcctaaacgtgctttacaactcagattccggccatgtaacgcaaaaactactccgacaaagaacgccggaatagtttttgcgttacattctggaatctaccgagttgtaccacactctcctaaacgtgctcaaacaagcaaagagttgcatataagggctcaaagcgtaactttcccaaagttcagggaaatttacgctttgagcccttatactccactctttaaccgcttgttttcacactctgtttcattcaccagtttgcaaccactttccccttgggaccaaattcatggtaataaaggcctaagcccataattgcagtgatcacatccgcgattggttgtgacacaatgacaccctgataacccataacggatgccatgatgaaaatcacaacggcaaacaccacgccttgacgagaaactgacatcaagaaggcatcaagcggttggttcacagcctggaacatagtggtgaacaccatcgaggccccgatgaacggcgtggtgatcaagaaccagcgcaacatgtaacttgcggcgtgcacaacgttttgatccttcatgaataatccacacagggctggtgaaatcaccattaatcccagcgcaataataaacgcgaacacgacgttaactaacaggtcaaactgaataatcttggttaaccgttctttatttctagcaccatagttatatccaatcagcgcttgtgagccgaaacagaaaccaacgagcaccatgataacaatggtttcaaccttgattgcaatcccgaagccagcaactttggtggcaccatagatgatcaaaaaattattcatgagtgccgtgcccagcatggtcataaagttcgttaccgaagctggtaagccaatcatcagtacgtctttaacctcactaagaggaatcttcattttgttaatatgaacatgcaaataacgcgcgcgtcgcacagtgtacccaatcaagatggtatccgtaactaagtacccgaacacggttgccaacgcggcccccgctgcacctaaatgaaagccaaagataaatagcggatccaagaaaattttcaatacggtacctgttgccgtcccaatcatcgactgagtggcaagcccttcagtacgaagcgtattaatgggaaccaaggaaataataatcagcacactagctgccgccataatttcataaaaaatattggcgtactgatatgtactaggtgtgacccccaacagtgataagccttcttttcgaaacacaaacaggccaatcatcacaatgatgccaagtgcaagcgcaccatagaacgaaaaactgttgacgcggccggccagcttgtattttttctggccaagtaactgcgaaatcgctgaactagctcctagaccaaacatatcccccagtgcgatcatcattgaaaacaacggggtacacagcgtgattccggcaaccagattagcgttttgcgtctgcgcaataaaaaaggtatccgttaagttataaatcatggaaataacggtcccaaaaactacgggcaaagctaaggtaaagtaggcttttggaatcggtgctttttcgaaaagctcaataatgttatcatcccctgtttaaattcataacaattatgatatcacaagataagtttaatttggagtcaatttcgaacaaaaaccccgtttgaatgggctttcaaacgggattttactaattagttttggttaaaaaatcaaaagtagcagcaatcgccattttgttctctacaggtactggtgcttggagaatttccgcagcagtctggtgcagatcattcccctcattggcatactgaccatcattaatcgccatggtacgtacgtcgattgtcttgggttctaaatgaaactgcaagccaatcacgttatcacccagtataaagccctgattctgcactaaatcactggtaaataacaactgcgcttcagcgggaacttcaaacatctcttcgtgccagtgcaacgcagtcaactgtttgggtaatcctggcacacggttactttgaaggtataccggcgcccagccgacctctttatgcggtgcttttaaaacttgataccccagcgttttagcaatttgctgggcaccataacacgcaccaaaaatcggcttatgctgtgctaataactgtttgatcaattgccgctcatttttaatccaatccgcatcatcattgggactcattggcccacctaaaatcactaacagatccgtgtcattcgccgttggcagaacaccgtcgaactgatacgggtggtaaatatagacttcatggccccggttggccgcccaatcaataatgctgcctgggccttcacttggtgtgtgctgtaaaacgtttattctcattgataacgaccttcatttcaaattagaagtattgatatcatcataccattagtgaatgatcgtgagtttgcagtaattgcttgatgtattgggcaatattgacaaacgcgtcatccgctgtgtcgcgataattgatggttgaggcgagactcagcaaagtaaccggtaatggcatcaaattaaagttccgttccgggaatactttttcagccgtgtacaacgtggtgaccgtcgctgagctaggaatattgttgaccgctctcagggcatccgccgcggttggaaccgtcattgcagtggtcaacgtgacatcttcctttttaaaactcagatcgacgtaccgttgaaacgcatcatagccggcaaagccaatgtatgaatgggtatttaacgctttaactgaatcatattcaaaatcccggtaaagcttgtcggggtcgtatcccttacagtgactcgagatgaaaaagcataactctttatcgggcacatgaatgtgtttaaagtgcgtatccagcaaccgtttgccaactaaaatatcaatatttttcgtctcaatttgcttgccaactggcacatcgtttagcagtttaatattaattggctgattcggatgtgcagcataatatctggccaagccatccgtcacaatatcactcaaaaagggatccgtgacggcaacgtggattggctgctgaccccgatcaacgtgggacattaaactttcattcagccgattttcttcatcaacgattgcctgaagaccattgatcatagtgatgccagcatcagttaattcaatcggtttcgtacgggttactaaagtgacgtggtgttcctgctcggattctttaagtagcttgctaatgtatggctgactaataaacaaccgatctgccacgtcagacaaagtttgtgagtattcaaccgtttttaaaatactcagtaacgtccgatgggtactcatcctatttctcctctacttaaaattatagccatttggtaataatttttatcttaatagttaatggtaagtttcgcttttagcaactataataacacttgtaagtgaattgtatcacaaaaattataactggagtgaataatcatgacgaatcgtgttgctcaaattttgaagattgaaaagccaatcattcaaggcccgctactttggctaactgacgctaaattagttgctgccgttagcaatgctggcggcctaggtgttcttggatttaacgctgggcaaaccaccgttacccgttcacttgaagaaactatggaccgtgcacggaatgaaattcataaaactcgtcaattaaccgacaaaccatttggcttaaatttgtccatgtctaacgacccaaacgacaccttttttgaaccaactctgcaattgatgattgacgaacatgttccggttgccgtctgcgcaggtgatttaaatgctgatcaagttgcagaaattaaacgggctggtatcacagttgtctttcgtccgctgacaccaaccgttgaaatcactaaacaagctgaggctgctggtgtcgatatttttgttgcgactggttttgatgagggtggaactgtgccaaccaaggtcattggtaccctttcagttgtcccaatgatcgccgatgctactaaggacatgcccgtaatggctgccggtggaatcgtggactcaagaacggcaaaagcggtgttcgcattaggcgctgagggcttatatgctggtacggccttcatgatgtctgaagaaagccgcatggctcaaaacatcaaagagttagcccttaagtccgatgccgatgatttactcatgtaccgcactgttcccgcatattaccggtcattaccaggagaaatgccaaacaagatggtgcagttagatgctgagggtgctagtcgggaagctatttaccaaaccgcatcaggctatgatggtatgagacttggcatgcttgtaggtgatctctctaaagggttcgcgtcatttggattaggtatttcacaaattcataaaattgaacctgtctcagtgatcatggaccgccttaacgcaggtgtaccagtggaaaactaagatttcaatcataaaagcaactttactgtcagcgactaactgaatggtaaagctgcttttgtgttatcagcttatttagccgaatttgacgatttgtctctcaattgcatatcactgttgtaataccgcggataggccagataacaggcaattacgctaccaatactagtagccactaacagcatgaaggtgaccatgatctgatacatgatagccttagtggggtcaacaccggcgaaaatcaaacccgacatcataccgggcagactaacgattcccaccgttttggctgaatcaatcgtcggtgccatcccggtccgaatcgccatttgaacgatgtgcttggaagcctgcttcagattagcaccgagggccagtcgctccagcacaccctgccgctgatcgtggaagctggtattcatgctgcggtaagccagtccgatggccaccatagcgttactagcaatcattcccgagatgggtacgatttgactgggcgtaaaccgcaccgcacccgctaccactaacaacagaatcgtaattaatgtggcagtggcaatcgctaacagactaatggcaaacgcgtggggaatgccgttagctcttttattcgcgttcaaagcggcgttaaagataatgattgccaccattaagcctgtcagccaaattcgattgaccttaatgatgtaggtcaatacgtagccaaccaccgtcagttgaatgaccgcccgaatcacaccgatgatcatatcgcgttccaggccaattttttcctttaagttaatcgctaaggcaatcacaaccagaataactgcgaaggctaacgtcgtaggactgacaattaaattattcatgagcagccacctcgatcttcccgtcgcggatcctcatcaaatcatccgcagccgcaatttccgactcatcgtgagtgacggatagcacggtaaccccactttcacgataggattgaatcaagcggtgaaccacacccttggtatcgacatccagtcctgctgatatttcgtccagcagcaagacttgtggcttaaacagcaggtttctcaccagcgccactcgctgtttctcaccaccagacagctcaatgatgggctgatccagcatctctgcttttaactcaaccgaatccagcgctgctagcgccttagtttcatcaaaggtttgattgcgaatctcaaacggaaactttaagttgtcccgcacagtttcaccaaacaacgttggctgctggaaacagtacgacacctgttgtcggtataccggtttaggataggtcgactgtttttgaccattgaacttcaccaccccagccgttggcgtcagcagcgttgctaaaatacgcaaaaacgtacttttccccgaaccggatggacccgcaatggttaaattcgcacccttttcaatttgaaccgtaatgtcttgtaaaatctgattgctaccatttcgataccctaacccctgaacgtcaaagattggttctatcatcataatccccccaactatttcattgacccaagtttagcctagaaagcgctttttttctagcaacttgtcgtggagagctaagtggttgattaaaaattaaaattgacattcaaatttgccaatgctaaactaacctcaattgaacaaacttggtcgatatgtcaccggatatattagactataagagtgatggtattcattattctacccgtaggtacggcgctgtaaagcgttacaagggttgaatggtggataccttttttcttttaaacaatcctgaggaggttttctcgtgcgtgtattaactgcatccgatttagagcaagtactagattttccaagtgtcatcaccgtggtcgaagatgcctatcgggaaaaagccaccggcgacggcaccatttggccgatgatctaccatgaatttatctcagatcaggccgacatggatattcgttccggttatctgaagtcacagggtgtctatggcatgaaattactgtcctggtttgcgggaaacgatgccaagcaattaccagaactcaacggtaccgttaatctgtacgatgaccaaactggtttgccaaagggaatcgtcaacgcggccgctctcaccggttaccggactggcgctgctggtgcagtggcttccaaagcactagccaatccagacgccaccaacctcctgctggtgggctccggttcacaggccgcctttcaggtgatggccgaactcaccgtgctgccaaagttacgtcaaatcaccatcgttaacgtggtgtcaccggaaaatgctgaggcactggctcaatcacttgttgaaacgctcaccaaccaatttctgccagcgattgatagcaacagtgaggaacatcaacgacttgccaaacaattagctgcgcttaaagtcagtgctagtgatgatcttaaagcagcaactcgtcaagccgacgtcatcgttaccgcaacgccttcaaccaaaccgatgatcaaagctgattgggtcaagcctggtactcacatcaataccattggtgccgatatggccggcaaacaagaagtagacgaacagttattcagttccgctaagttctacgtggatgaccgtacacaatcagctagcgttggggaagcccaaacggccgtgaaagccggtatcgtcaccgaagaacagctaccagaaattggtgaattgctcgccaaaacgactgaaaatcagtgggacccacaaaccgtgacgttatttgacagtacgggcattgcactgcaagacatcgcagcagcaaatctcgcattgactaacgccgctaaattaaacctcggacaaactatcaatctttaggagaatacgattatgaaaataaaaacctttggcgtcgaacattggatgaacgaatacgaagaagatgcaacctataacttaggcgaaacctgcgtctcaccactgtccttacacgcgttactcagcttaaccgatactgatgaaaaagcttttactcagaaaatgttgactacccgactaacttacggcagcattgtaggtgctccaaaattacgtgcgggcatcacgcagctttaccaaaacttgagtcctgaaaacgtggtcactactcatggtgcaatcggtgctaacagtctggtactgacaaccttagttgaccctgacgatgaagtggtggtcgtgacgcccacgtaccaacaactccaatcaattccagaaaccatcggcgcaacagtccggttgcttgctctgaagccggaaaatgattacctgccagacatcgcccaattaaagaccttggtcaacgataaaacgaagctgatcgtcctaaataatcccgataacccttcaggctcattaatgccgcaggaacatctgcaacggatcattgaagttgctaaatcagttgatgcctacattttgtgtgatgaagtttaccgtcatttgacccaaaccgatacctactccccttcaatcatcgacttatacgacaagggaatttccaccagcagtatgtcaaaggtcttctcactggccggcttgcggttaggctgggtggcaactcatgacgaagccttcatgcaaaccatcctgtcgcaccgtgactacaacactatcagttgcggcgtcctggatgaaatggtggcggaagttgccctgaatcataaagataccttattgaaacgaaaccgcggtatcgtacggaaaaatttagctctcttagacgactgggttaattctcagccgcatatcagctgggtcaaaccccaagctgggacaacggctttgctgcactacgacttcgctctgccaagtgagcagttctgtgaccaattatttaaacagaccggcgtactgctagtccctggcgctgaattcgatgaggaacacgcactacggatcgggtatgcttttgaaagcaaagaactgcaaaccggattggataaactaagtgaattcatgactggtttgaattaacaaagcgagtctaaagttgatcaatactcaatattaaataaattcagttaatctaacatttgcttaacattgttcaaatgattaagctgttttagtgtattgactaacgtggcaatgagtctaataattgaggtatgattgaatagagtcgatggtaaaatacggatggttgctagtggctatttttgtgatgattaaacttgtcatttaacagaaaagagatttttactttgagtgaagacaatcttgaacctttatcaattactcaactggagcctgacttatggcagctgcagctgtggttcgtccacgcttttttgatccatgatgatcatgacggctggattttaattgattctggttatccggtgaaacccggtcacccaaatatggtggttcgtgccctagaccgactaggcttgaagactactgatatcactcaaattctgattacacatggccatccagatcacatcggtaacgttgctttggtagctgcgcaatcccacgcaccaatttggatgggtgccgctgatgcaggtattttggaaaaatcattcccaatgccacccgttcatcgacacgatggcagtcctggtaagggttgtccctattttgaaccagctccggtcactcaccacattcatggtgatactcaaattccgttagccggaggcattacagcgattgagacacctggtcatagtgctggacaggtagcctatctttggaaccgtcacaacggcgtcttatttgctgccgataacttgattaatgaaaacgatgaactcgctattgcgcctggcaatattgattttaatcaagtgcgtcatagtcttgagaagttgagttactacgaattcgataaactgctcgtcagtcatggcaatgatttacttgcaaatgccagctttatttacagaaacctttggctaccaaatttgataccacaaacttttgatagtgttgattcgaaaaattatcaaccacaaagcattcacgcgtaaccacggtcaaaagcgaaattaaaaatcctgaagattataaaaaactgtaacatcaggctatattgataaaagtttcacctgatttctttaactaaaagacaacttataatctagtctaaaacaccaaaatgcgtattccgacgacaaagttcgacggaatacgcattttggtgtttaattctggaatctaccgagttgtgtcacactctttaattgggcggctgatcatttacgccgtcaactccaagaaatggtttctcaccaaagagagcctcagcagctatcaccgctgagactctctcattcctataagatcacacctattgcttttccttcactgcatgcttaaagtactgtgcttcagcttctttccgtaacctcactgcttcgttaaaatcataggtcgcgtggttcaacacgtacctgccgtgaaacatcaaccgggcaacgaagcaatgcgattgcttgtcgtaagaaacaccgatgacgccggtgcggttacgcttccccttatataagctggagtagccgataccatcttcgttctttagcggattcccctgattagcgataaacgacggattttgcttcgctgctttgctggatagttctcggcgtaaacatccgcagctacgtgttatcccgtgtcgcagcgcataaccgtctgcttccacgtaattgccgcaatcgcaaaggcacttccagcgagcgttcccattgttcgtcttgttcttagctctcccaagtaccaataagcgaccaaatttttgattcgtgatgtcgattagtctactcatatccatcatgtccccttcatgatattaattagtttgatactcgctcagttacgcgttgccgcaactttgcctagcgcctgaatgtagctgtcaaactgcacttgttctttgacccacggtgctttcggattctggtccgtcagcttcagatgatccactagtgcctggacgtttgaccaaatatcggcgttgtgctgaaccagtagccagaatgcctgatccacatgcgcacgctcaatatctggaacctgcttgatcaaggtataataccgcacgcaggctttggcgaactcgtcgatgtagatcttcgggtcgatcatccgcaaggtttcaaaatactgactcagcatggtgatctgctcgacggaaacggtcgacggcatcggtgccatcacttcggaccggatatcgcggctcataaactgcgcgtaggcaatctcgttaacttcaatatccgattgggagagactgttgaccagtcggctgtagaattcatccgagtacttcccgaccgcttgccaatgaacgtggtattggttcaggaaattacgattgaaccagcgcccccgtgccgtcatgaagtcacggccaactttgtattcagtggttcgcgtccgagtcatgtcctgttcaagcaccagtccggtcagcacatccgcagcaggattctggtcggccatggtactgaacgtctggatcacgctggtctgattcagcagcccatccggccccatgaacatcacgtagtcaccggtggcagctgccaccccttgttcgaaggcttcttcccatgacaaaacgttattgggattttcgtagtgaatatcgatatttttgaacagtctgaattggtccacatccctcaaccggtactgtccgttatctaccaagatcacctcaacgtcacggaaatcaatccccatttgattattgatcgatgatagcggaatcgctaaatcatcttcccgtgcatcgtccaccgcaataataatactgattcgttttgccatagtcttctcctccttgtatttttactatgtatgagaaggcggctgattcgccgtcttccctataagaaagactgcattatcgcgggggacattgcgatatgcagcctctctcactatgaatccgagctagtagtcatgggggttaagttggaaatgactagtagagggactcgtgatcattatcgtcgctatcacgacgcttgcgacgagtgatgccgtaagccaaggtagcttccataatagtcatgccgacacccagcattacgagtgctgaagccgatgtttcattggtttgcggcaaagtgctttgagcagcagctttaccgttaccagttgccaaaccattaccgttggtagtattaacagccgtaccgcctgcgacagcttcgtggatggttgaagcaccaccgttgccggcttcgcttgtcggaaccatgccgccgtcagtaccagtagtcgtgtcaccaccagtttcggtaatcacaccggtgttaccacctggagtcgtggttacagcagtgccaccgtcagtaccagtggaagtcccggtgccattaccgttgccagtattgccgcctggaacagccgtaccagtaccagtcgtcttagtgacgtcgttgtcaccgctaccgccattgttggtaatgttagtgatgttactatcaccatcgttgccgtcaccgccattgttggtaatgttagtgatgttactatcaccattgttgccgtcaccgccgttaccagtattaccaccattattaccagctggagtagtcgtcgtggtaatcgtcgtggttgtggtcgtcgatccatccggatgagtaacaaccgtcacaatcttaatcacagtggtcgttgaaccatctggattattagtgactgtctctgtcttagtggtggttgtagtatcacctgtattgccggtgttactattatcgccacctggcgtcgtcgtgttcttaccaccggctggagtagtgacaacgttgatcgtcgtggttgaatcttgaccattttcacctggagtagtggtcgtcgtcgtggtggtcgtaatcgaaccgtccttgttaggaacaatcttgatgatcactgtcttaaccgtctttgaaccgtcaggattagtcgtggtcgtcgtcgtggtctcagtctttgaaccatcactgttagtggtcgtggtcttctcggttgtggtattagtcgtcgtgttagtggttgacgtcgtagttgaactcgtcgtgccttgaccattatcaccgccaccgttgacgtttacagtattattgttggtaatatctggaacatcgctacctgaaccgttgttgccagtagtgctgttaccaccgttaggaacagtgattgaaccagcgttgctgccatctgggtaagtgaagtagtaagtggtggtgccggtgtccttatcgacaaccgtctttgaaggatcaatctgtggtgtttgaccatccttaccatctttaccatcaacaccattcttaccatccttgacggtgtaatcgacaccgttcagtgtgtaggtccagccatcaacgttgccgtcagcatcgtagtgtggcgcaacggatggcgtttcaccatctttaccgtccttaggcgcatccacagtaccgacgatgaccttttcaccagcatcgttagtgtagtagaagttgtaagcaaccgtgttgccgtcagcatctttgacaggttcaacgtgaggtgtcttgccatcagcaccgtctttaggtgccttgacagtaccaacagaggtttccttaccattctcgtcagtaacgtagaattcgtaagaagtggttccatcttcgttcttgacagctttgacttcaggcgtttgaccgtccttgccatctttaccgtctttaccatcagcacccttaggaactgtgaccgttgagccatcgctgaaggtaagcacaatgtcgccattctcgttaggaacttggctaagaagtgtgatgtctttaccattcttaacagtgtaatcctgatcaccaagagtgaaggtccagccatcgacgttaccatcactatcagtgtgtggtttaactgaaggcgtttcaccatccttaggtgcttcaaacgaaccaacagtcttggttgagccatctggattagtgatgtagaactcgtatgacttagtaccatcagagttcgtaacttccttaagctgtggtgtttgaccatctttaggtgcttgaacagtaccaacattcttagtcgaaccgtctgggttagtggtgtagaactcgtaagtggtcgttccgtcttcgcctttaacagctttgacttgtggtgtttgaccatctttaccgtctttaccatccttgccatcagcaccctttggaaccgtgacttgtgagccatcgctgaaggtaacaactgtgttgcccttatcatcagtggtggttccagtaactttgatgctgtcaccgttcttaacggtgtaatccttaccatcaagggtgaaggtgtaaccaatgacgttacctttatcatccgtcaattgtgttaccgttggcgtcttgccatccttaggtgcatctactgtaccaacattcttagtcgaaccatctgggttagtgatgtagaactcgtatgacttagatccatcagggttcgtaacttcctgaacctgtggtgactgaccatctttaggtgcctgaacagtaccaacattcttagtcgaaccgtctgggttagtggtgtagaactcgtaagtggtcgttccgtcttcgcctttaacagctttaacttgaggagtttgaccatcttgaccaggatcacctttgtcacctttgtcacctttatcacctttatcaacagtaactgttgacttgtcgctgaaggtgatgacagtgttgccatctttatcgagtgaagtgccagtgactgtcaatggtgttgcatctttaccattcaaaacagtgtatggaacatcattcaatgtgaaggtgtaaccgtcaaccttgccgtcagtgccagtgtgtggggtaacggttggtgtttcaccgtctttaggtgcatcaactgtaccaactgggactttttcacccttatcgttggtgtagtagaagttgtaaccagtcgtcttaccagtgtctggatctttgataggttcaaccgatggcgtttgaccattaataccatctttaccatccttaggtgctgtaacggtacctttatcagtggtagaaccatctgggttagtgatgtagaactcgtacccagtgacgttgccatctttatcctttacttccttaaccgttggtgtttgaccatctttaccattagctacttgaataacttgtgtgctatcctcgccacctggcgtagtacttggcgtagtgatggtgatcgtagtgccgataactgtcttaccgtctttgtccaattcaggtgtagtggtaatcactggtgtaacaccgtctttaccattggttccattcgtgatagtgccaacagtcttgccgtcttcagtgatggtgtaaccagtgaccttaccatcttcatccttgatttcggtaaattcaggtgttgtaccatctttaccattggtgatggtaccaactggcttgccatcaatcgtgatgttgtagctagtgttgccatctttatcggtaactggtgttagtactggtgaagaacctggatcacccttgtcacccttatcacctttttcaccattcaagacagtgtagtcaacaccattcaaggtgtaagtgtagccatcagtcttaccatcagcgcctgtgtgtggtttaacggtcggtgtttgaccatctttaccatctttaggtgcatcgactgtaccaacacttgtggtagagccatctgggttagtgatgtagaagtcatatgaagtaacgttaccatcatcatcagtaacaggtctaacatttggcgtctgaccattggtaccatccttaggtgcatcaatcgtacctacagggacgtcatcagtgccatcgcccttaggacccttgacatagaataccagttgcttagtaccgtctgggttagtaacttccttaaccgttggtgtttgaccatcaacaccatctttaccattatctacttcaataacttgaggttcattatcggttcctggttcagcgatagtgatcgtagttccgataaccgtcttaccgtcagtatccaatttaggtgtcgttgtaacgactggtgtaacaccgtctttaccatcagttccgttcttgatagtagcaacagtcttgccatcttcagtgacggtgtaaccagtaacattacccttgtcatccttggtttcagtaaattcaggtgttgtaccatctttaccattagtgatggtaccagctggtttaccgtcaatcgtgatgttatagctaagaacattaccatctttatcggtaactggtgttagtactggtgaagaacctgggtcaccttgatcacccttatcacctttggcaccgtttaggatcgtaccggattccacaccgtcaatgactagtgtttgtccaatggtattgccttccttatcgacaactggcttggtggttacaactgaaccatccttaccattggtaatggtacccttaggttcgccattaacagtaatggtgtaaccagtgaccttaccatctttatccttggtttcagtaaattgaggtgttgctccatccttaccatcgtgcaaagtaccagcaggtttcccatcaactgtgattgtgtaactaccagttgggttaccttccttgtctttgtcagcagtgataactggtgtagcaccgtcgtcacctttggcaccagtagcaccgttcaaaacagtggcagtaactttaccatcaaccaggatgttagtcccaaccttggtgataccatcttcgccgaaggcatcttcagtagtgaccgttgagccatccgtaccattcttgacttcgccgaccttggtaccatttaccatgatatcgtaaccagttgctgtctgagtaaagcttggtgttgcaccatctttaccgtttgaaacagtgaccttgtgaccagcgccatcagtaatggtgtaaccagtgaccttgccatcttcagtggttggcgtgatgattggtgaatcacccttctcaccttgtggtccttgagcaccgtcatcacccttagcaccgtttgaaacgttaaaggtcagtggtgctgtatcatcagttcctgggtatgaaatcgtaatggtattgccagtaacattatctttgccatctttgattggtgtgacatcaatctttggcgtaaccccatctttaggtgcagcgacagtaccaataggggtatcgtcagtgccatcacccttagggcctggaatgtagaatacataagacttagtgccatcggcgttaggaacttccttaacccgtggagttagtgttttaccgtcattaccgttccaaacagtctgagtagtatctgggtcgccattagcatgcttaatcacgaaggtagttccgccattcggatgatcagtagtagcatctgctggtgtggccgtaatcgtatcactagctgtatctggtaaagtaatggtttgagtcttaccatcagcgccatctttacctgggaaggtgaagataagtgccggtttcttgttgctatcttgtccgagagtaacgtctggtgtaccagcggcgttaccatccgtaccattcaatacatcaaatgatgtcgatgttggcttaccttggttatccattgaagtaatagtgactgtcttgccaattacatttttagcagatgtaccatccgtcttgtcagttgttgtcacaactggtggattggatacatagatagtcttagaagttggatcaccgttctcgtcgaaggagttcacggtaatcttgttaccaatgaccttatcgccatcttttacttcttcagaatcaatcgttggtgtctgaccatctttaggtgcaggaatcgtgacaagagtcgtatcgtcagagccatcgcccttaggacctgggatgtagaactcgtatgaagtaacgttgccatctgtatcagtgttcgttttcacttttggtgttacaccgttattaccattccaaacggtctgtggcgcatctttagtgccatcagcgtgagtgatcacgaaggttgttccaccattaggatgtgcatcagtagccgcttctggagtagctgtaagcgtatcgccagtctttggtaaggtaacagtttgagtcgtatcatctgcaccattctgacctggataagtaaagataagcgttggatttttatctttatctgttccactagtaacagttggtgtagtaccattcaatacatcaaatgatgtagatgttggcttaccttggtcatccattgaggtaatcgtaactgtcttgccaatgacatttttggcaggtgtatcatccgtcttgtcagccgttgttacaactggtggattcgatacatagatagtcttagaagttggatcaccattctcatcgaaggagttcacggtaatcttgttaccaatgaccttatcgccatcttttacttcttcagaatcaatcgttggtgtcttaccatctttaggtgcaggaatcgtaccaagaggtgtatcgtcagagccatcgccctttggacctggaaggtagaactcgtatgaagtaacgttacccttgtcatcagtgttcgctttcatctttggtgattgaccattagtaccatctttagtagttacttgaccaataaatggcgttttagctgctacaagatcgtcataggtgactttggtaggatcaattacagtaccatctgtaccctttacatcacccgagtagaagtaagtggtgtgtgtacccttatcagtatcatcgacagtaactgcgtgaattgctggtgcagcaatcttggtctgatcagttggtttattatcttgataaagtgagaacgtcccatcgccattgtcgtgcaaagtcaacttaggtgtttcaccgttagcaccatcttgaacatcaacatggccgatttctgtatcgtttgcttttgcgatgtcagcttccgtatgctcagtaccctctgcaggtgctggaagttcagcaccagtatagaagtacgtggtcttcttggctggagtagtaccagcagcaggtgtcgtcactgtaaatgagtgaatatctacaggcgtagcagtatcagtaccacccttaccattgttaacagtgacttgaccaatactcttaccagctggaatatcagccgcagtaagtggcttatcatcactaggctttgtcccatcgctgtgaacagttactggatcaccagtgtagaagtaagtcgtgtgcgtatcaccgctatcaactgtaagtgagttgatttttggcattgagatgctgttagaggtattgtccccatatttaattgcgaacgttccgtcgccattgtcaacaagactcattgatggcagatcagcatccttaccatccggaatatcagtctccgtcatattagtcttatcagtatttgtcttatcaccatcagcatagatgaagattggggtgtagccattcccggtgtcgttaccatcagcagtcttgtcaacatgagtaccagcaacaatcaatggagtcttgcctgctggcatcgtgacaggatcaccactaggtttaccgttgaccgtgagtgtaaaggtaccatcatgattatcttgcgtacctaccagtggatcatcaactgtaacgtgaccaacttctgtatcctgattcttttcgatatcagcttgagtcagctgagtaccctcagcaggatctggaatcttggtaccagtatagaagtaagtcgtgtgacttgctggtgtggttacattaccattagtatcagtaacggcaggtgtgtccacattaaatgaatagatatttggtgctttaccatcttcaccattttgagcatcgaaagtaccaactggggttttaccgttatagatagtgtaagtggtcttattatctttagggtcagtatcagtattcttaacattcaaatcaagtgttggcgtttcaccattcttcacagcaacttgaccaatcaaatcatctgctggaatgtctttaggatctgtgaccttaggacccttgtagaagtaaaccgtgttgccggtaccagtttctttaccatcagtatccttgtcaggaaccgtcaatgattgaatatcactggcacttggcgtatacgttaccgtcgtctccagatcttcagggttgccttcaacatctagcggaacgttttggtcatcgaccttagcgttatcaggtgtgtaaccatcaagcttaggtgaatcaacagaagtgaagatcttgtgaaggtcagtatcagcggtaccatcaccatcttcatcagaagacttaacgttgtatgacacaatcttctgactcttaccatcgtcactcttgataaccttcgtacctaacgtcaatgtctgaacgagatcagcaccagcagacgtaccatcatccttcacatagtgaattgtccgcttaacggttacatcaggaccatccaccgcttgggtcatgtcgacgcctggtttagctgtgtagataacccagatatcttgaccgttagtcttgtactgtgcgtctacggcagaatcatcaggcaatgtgttgaattgcccaccgttaacgtcggcagtcgcgtagtagtaaagtttgctggtatctaatgaaccattgccagtatcaagcgtagtcccatctgctgccttaccatctgttgtcttcagggtaagaggagcatcgatttgactagtgtagtcctcaccaacattaccagtgagcgtcttatcaggtgctaacttaggaccgtcgacattctggtaaacatagtgcaccgttgccgttgctgtttgtgccttgtacgatacatcccgtgtaaccgtcaaagcagagttatcagcatcagctgcaacctgaacactagccgttccgttatcgtcatctgagccaggagttgaaacagcggtgtcataaccagtttggttcttcttctcgctgtcagttaatgggccaaatgaaactgtggtcccatctgtactgccgttgcgacctgatgggttcgtggtccatgcagagtaggtgtacttagcatcatcatcgtcacccttagttgggtcaacagtaactgtccggtacagcgtctggttgctgatattaacgttttgttgcgcaaccggatcaccgtagttagcaacttctgtgacttgcttagtcaactgatcatagttggtcttcgcatcgtcaccaggattgcttggtgtgtaggtggtggtgttaaccgcaacgaacacgttgatatctttcttcgcagtacccaagacgccgctgaagtcaccgttttgaactaacttgtagccattagctgcatagtcatatggtgtgtagttagcggttgcaatctcatcgtcgactttgccggaaatagcagcagtagcgagttcagtaccatcagttgcttggtaactgccatctgttccagtagcggtcttacccgtaacgtcaatgtagtgcacagtagcaccagcagagtcgttagcggtgtaaataacttgatagaacgagttggttggcttagccgtggttgcggttaagttgtcagcaccagattcagctggttgagcagtgtagccgtcaactgttggagaaggaactagcgtgtagttgccgtctggtgtgtaagtcgttaacttagtgacttcgtcatagtccgtgccccacttcatcggttgaacattgtcaccaggagtcttagtaccagcacccgcgtaacgaatcgtttgagtggtagtcacaccagactcatcaggtgtcttggtatagtggatgtgaaccaagtgaacttgaatatcgtcactggtgtttggatcagcggcaaaagtataatcgacttgttcggcctggttatcagctagcttgtagccttctggaaccttggttgttgcagccgtggtatcgaaagtaccagtacctgctgttgaaccagtttcagtaaatggcgtaccaactaaggcaccacccttttcgtcgtccacgtattgaacttgcagatgagcttcaccagcggtataggtaaccgtggccgtcttatcagttggttccgtggtcgtcccgctattgtcaatcttgacggatgactgactagcagtgtaaccagcgtcggtcaaatcaggactgtcaatctcgaagtcgccttctggtgtataagtcgtagtaccagtaactaagtccttattcgttccccacttaaccgtttgcgtcttagctgcgggtgttgcgtcaccagcacctgtataggtaactgttaaggttgttgaaacaccggatttgtcaggagttttaatatcatgagcgtgtttcagcgggatgttctgaaccttttgatctcctgctgttattgtgtagctgtaagatgcgtttggatccacaggttcatatccagtgatcggtccatcactatttttaagatcagtatcaagatttggtttatagctgtcttcggtacccactttaccagacttggtaacttgatcaccaacaggcttgtcgccgtcatctttatctacaaattggaatactgcctcagcatcaacagcctctgcagttaatgtaacaacctcgtttgttggaacttcaaagtctgcagatttactaatctgtcctttatcaaccgttgttacggtatcatccgctgctggcttgtcatcagcagtatctgctgttccttgagtggctgttgtggctacacttgcggaaactttataccctgcagcaactgtagttgaggttgctgcgtagcttggagtaggaacttcgccagtctttgtttgaccttttgaagtaacaaacgcattagcatcagcttcactgtcaaatgcaatgtattgattatcatcagtttctttatcatcagtagaaactgttacccagtaaatcgtttggtctggtacctcggtcatcttatccgcattaggcccagaaagagtgaatgtacgcttcgttgtcgatgttgtgtacgtcgcagccttagtaaccagcacgttaatggcgtcattgccaacctcgttttttgggtcttttggcgtgactgcatagctggtaacgttagtcgtaggatccacagcagccttgtaagtgaagtcttgactgttacctactaattgatagtcggctaatttgttggtagtcccgtctgtatcaagaatgatcggtaattcatccttagtaatggtataagttccagtatcaccatcagtaacaggcacattcaagtcagccaggccgctgcctaatacttccttagtcgagctatctacatagttgactttgattgtgtcatttgctttaacgttttcggtagaaatgtttaactggctaatagcacttgttgtgttagtcaatgcagtccaagtattaggccactgaatccccaaatggagtgtttgattataataactactactcttatcggtaacaagccccttcatggcagtaataagcgcactcaattgttggggtgcgactaccatatcgattttcttgttatctttactaatagcaaaagtgttgtcaatttgcgcgttatcgtgaggtgcttttgcatcatctttagaatcgatttcggcttgatactccgataatgctgaacttggtactagggcattacgagcgtcatagataccgactgaataagtgagcccgttaaacgcagctggggtcttggccagtcctgccccgattgttttaccttgtcggtcgaaccctgcgtacacattaggattcgtcggatcggttggaattggagtagttgttgaagtcccatctgagttccacgtcgtcttattaggattaggttggtattgataataaagtgcagatggttcattaataatccgctttgtaccttcaaccgttgaattagcagcccaaagataggcactagaggttataacccccatcatgtaccatccgggttgatctggatgttgggtagcatcggggtcagttgtaatcggaaccgttgcaagggtcccatcctttaacccccaggtaacagtatcctgaagtctaggtgaatctttgatataatagtcatccatccctaaagctttagattccgtctgcgttgtaaattggttcactgaccaaccattagtggtagcagcagccgtaattttagctaaatcgtcaggtgtcacttcagcggtgttggtcaccgtcaaaatgttatccattaagctcaatttgattgactgatcactcaaactgtctttaagactgctggttaaggcagctgtgtcagtgccatcagtggtaccagctacaactgtaatttcttgtggttgccccgtcttttgataggcagctgttgcagcagtcttggcactatcgatatcagctgcacttgcatcacctaaatcaatcttgttaacatcatcagtagtgacagctttggcagtactgttgttatctgcatcagtactgttgtttgttgtcttatcttctgtagtagaagctgcactggtagtcgttgctgcgtccgtcttagcagcggcttctgcagcggccttcgtatcggtagctgttggcgcagtcgtttgactatcagtagaaggctttgttgtggtagcgtcctgagctgttgaagcttcagtcgtactgtcagttgaagcactctgtacagctgttccctgttgatcctgggtagcagctggagtactagtattgtgtaaagtgaactgcttagctgcagtcaccgcctgacttgttgtacttgagctaacattactgccatcagtggatgtcacatccgcctcggcttgtgctggtaatgcaaacgctgaaatcccaaatgtcagcgttgccattccagcaactagccaacgtgttccagccttatagagtttatatcttacttttctatcagctgaatcacgttggagcttatttctattgaacttatacttttccaatgaaatttccccctcgtaaattttccgatgtactttttaaggtacacccgaaaaagtataaaatttgaactgaggcaatcgtctcagttcattttttattaggaggattttcatgatttatggttatgcacgtgtcagcagtaaggatcagaatctagcccgccaaatccaaacattatctgagttaggcgttgataggatattcaaagaaaaggcctcaggtgccaatttatcccggccagtcttaaaacagctcttagctatcttggaaccagacgacgagatcaaagtcatcagtctggatcggctaggtcgcgatgtgaatgacgtgactaatgtcatcatcgaaatcaggagtaagggcgcacatatcgactttctggatgtgccttcttacaaagaaattgatgatgaaaacacccgcaacttactgagttcaatcaccatggaactgcaaaaatacctggcggctgaagaacgtaaaaaaattcttgaacgccagcgtcaaggtatcgcactagctaaacaacggggcgtctatcaagggcgccctattctttatggaccagatgtctccaatctagataggagaaaacagtactttgaaattaaacggttattgaaggtcggcacgccattacggcaaattcagcagctgactgggcgaagtatgacactgattcagcgaatcaaaaatgagcttacaaaataattaaaattaggaaaattataaatatggtttacatcgtaattcactttgttaatttcgtattatttatggtactataatttattcaggatattcaataattattcatgatatgtaggataacttcatcttgacccggttgtactttcgcttatccggtgatatattccattatgagtttagcgaactagaaattctatcttggaggaggaaggatttgcgagcgaaactgctagtttactgaacaatttgcaaagaagtttttgtatgtttatgggtgtaccctaaaaaattatgctcatgacctgcccttaatcaaatcttaataaatatacacttttaaaagagtttgtcatttttttcgatttttttaaaaaatttggaagagactcagaggttgccgacttatacagctaaactgcctttaatcgtttgctttgatacgctgcgtgacagacagaactcagtgcttgctttcaaaccatctagctaaaagaataaccgtttagaattccgtttcgggtaactgcctgtaccggtagtggttaagatcatcatcgacttcatcggttaactccataaagccgactttgccaaggatgagaccccgtttatatttctcaatcttagtcatgagtttttgtagagtttcttccgaatggtactcgcctaagtctgccatatcaaacgtaggacagatcatcgctgtctgctgcttgatgaagctagcgatggtcttgcacaaggcttgacggaattcgactgaacgtctcggcatcggccactgcaagaccagatgatggtcaacgatcacacggctgcagtcatctggaaagtcccagatatcgcgtttgtattgccagcgaaaccaggaccggttagtagcgaccactggccccgcgggcatgagccaaaaatcacggcagacgtacggtacccccctttctattttcagcgcctttgccatcgtgtagcgaatatcattgtggtagtccatggggaagtactctcgtagacgtttcagcagccgattaggtgtcggccggactttgatcagccgctggtcatcatacaagatgatgctattatagtggctttgagtgtaggtgcagttgatgatggccaaaacgtgatcccagtctggtaggaacttggtatcctcgctggcgggaaccacctcgtcaagttgcagtttgtcggggatgagatagccttgttgttctacgcgcgttcggcactcaggcgtaaggtcaagaaaataagtcatgtaatgtgtactccttttaaatttgatttatggtacgagagcatcataactggaatagaccaaaatgggaagtcaaacgaatcggcggtggctggcgaattgggctatcgggacgctgatcgattaggtggtcggtatgggagatttggcggtgatttatagcttagttgtgattgaattttgaagaagtgggctataccatagctttccctagttatatgtgagcatgtttcggctgagtcgttagttgagttttaaagggtatcgattggtattttgaggtgtctgaggcagaaaaagttttttgaactttatttatttttggggcgttttgggaggcatcgatgaaggtgcgtagacttgacttggttccattctctggtaaaatactaaatgaatgaacgttgtcattaatgacacaagaaaagagagcccctgtgacggactctcttttttggtgctctggttggttttcatcgcccggtctccgctaacgtttccggtccaaccaattagcgaatatcgctacaagaataccggaaataacgctggcaagtatcgtcagaataaacgttgtcactaataacacctcccttctccgtaatcagatgtgtattacttcgaaagtcgggcgaccttagtagtctatagaacttggatagtggttacaagagttgttgggaatttgacacaatgtttcgctggatgctttggcagtggaatggcataactcgaggggtacgatggattcaagacactgtttaatattgagttgcgtatttaagatatcgagctttacttaactgaaatctctggtacaatgaatttggcaaattctataattaatccgaacagaaattaaaaagcccaaagcaatcacttacaatggtagtagctaattccaaccaatatagggagtgattactttgggtacatctactttatcacgtcaacgtggcgcactagcacaactggtcaatgaggggaataaatcttacccaagtaatggctgacgcctaggcgtcgccaaagctacgattagctattgagttggaccgggttaaccttatgatccagaattagctcagcagatgcagatcgcaaaaggcggaattgcggtcgtcgttcgatgctgacggcagcattagcgactttaattaccaatcactacgattaacctgtcaccagaaaccattgcggccgcttataacttgagccactgcgtcaatttataattggcttaatcgtggctggctccccttcaattgactgatctccccaatcggatgtccgccagcaccgagtgagcgaaatcgtgggaaattacaagtgggacttccatcgaacaacggccaacaactgttaatcaacggttacttttggtcattgggaagtagatacggtgctttctagtcgaagtgagtcacgatcatgtctgttccattcgtagaacgtaagacccgacttctagggccatcaaagcccactaatagaacggctaaggctctaaacaccgcctttggcaagtttatgggggcctcggtccccaagtaatccattactgttgatcatggtaaagagtttgccaattatcaggccttagaacaggattatcagatcaaagtttatttttgccatccatattcaccatgggagcgaggttccaatgaatattttaatagacggttacgctggttcttcccgaaaaagaccaatttagccaattaacgactgatgagatcctagcagcacttgaactaattaatcaacgaccattaaaaatacatcatcaacagactgccattgaaagattccgggcttgttcggattaaacttgtaatttgccatttgaataaagtaaatcatgatcaacacagaaaagagagccctgcaacggctctctttttttcttggctgaattttgtcgcccgttaattgactagcgtctccgactcagccaattggcgaatagtgccacaaggatgccggagagcacactagcagcaacagtaactataacaaggcctcccttctccgtaatcagatgtggattactttgaaagtcgggcgaccttagtagtctatagaacttagatagtgattacaagatttgagggaaaattgacacaatgtgtttatttacgatttcagactgtgatgcacgtgaacgcaggtatacttagcctgacgtaattttctggttcagtactaagtgtactttatcattgatgcacaagaaaagagattgcggtcttccttattaagattgtttgaatctactcattcacttaattatctccggatcactatgggaaaagaattagtttgtcaccgacaataattgtagcatgacatgttttttatcaggaagaggataatttacttcaactaaccgcatctccagatgcattttctgtatcgactagcgggtttatatcgacacacttttactaccacgtgttatacttacaacatgacaaatacagatgacgatttttcatttgcggaacaaaatcatccgctttataaatcactcgggaatcgctcattaaagcgggtatacttaaatgatgagaagtattcaggtatcattattaacgcttacaatacaccgcaacagctgtttgaagtagaaactttgcttgcgaaaacatatatgattgataatggtcctgaatctttagaccgcgttcaagctgttaaaattaatattaatggtgtacaagttgatgctaacaaaattatcgtatcaaagaacagaaagtttgtagaccagtttatccttaggcaaattgatactatcatcccaacacttggtgacttaataacatttaattctcaagctcaaaaattgtatcctgaaaagggtgtctatggtttactgggattaaaatctaaagaggatggtaacagacttcaatatacgttggaagccgcaggaaactcagttcactttggtcaagaagaattgcccactgttgcaacgaaagctgctttcatctgggaacgtattgctggtacacaagccttccaaaacggtaataagcgaactgcaatggttgccatgatggtgatgttacactctaacggatatgacttcatgttccatccaaatatgaaacaagaacttgtttctttttccattaaaattgcagaaaaagcagttgacttagagcaaattaaagaatatattattaaaaattgtcggatcaacactcgccacgagacatggaacacgcttcaactacttcaacaagatccgacaaagccgacacaatgggggtaattattgtgaagaatacaaacattacatttagtattgagcacgcagatttaaatatccaacctactcatctttcagaagaggaaaagcaacgcattattgatgcatcagcggctgaaatatttgggcaaccagtcgtacaggacacactacgagaactttctaagctttaatttcgccgaaccttttaaagttaaaaaacgacctgactcctttaataggaatcgggtcatttttttatgaaaataatgacatatttagtttagttaaacaggctgtaatccccagttgcaactaaaacgagaaccaattcgtcgtgttcaatgcggtaaataacaagttaccatgcaattcgtggtcatccatttgctttaaagcttcaatatcatactcgtcaattgcgcgcaagcaaagtgaaacaagttcgactgaatagtgcttcctctataacttcttaaattcgcgtttgaaggtgggcagtcctttaatcttcatcgaataacgctacaagaatgcgatggatttaaggcactggctaacaggcaggaaaagagcgccctgtattgagcgctctcttttctatgtctattaagatttaaagtttaaacagcttttcagcagtcccgtgcgccatcatttcacgatccttatcgttaaatggcgcatcttcaataaaggacttcactttatctgccatcttaacgtatggatagtcctcagaataaagcatatggtcggcacccatttcggtgtgaaccatctgcaactgtggtgcagtcagcatccctgaagggccaacgtagacattcttacggtagtagtaagaaaatgggtgtggcaattcggagaaccggccgaacacatcgagccgttcgatgaacataggcacgaattcaccccagtgacccgagatcaacttcaagttcgggtgcttttcaaataaaccagaaaagactaaccgcgccatctgaacaccctgttccatgtgccagccccacgcagcaccggccatcatattagccatcatgtcgctgtatgctgagctatcaaataaaatcgctttttggtcatccgtcatgacaccaggatgtaagtatagcggcacatccagcttttcggccgtagcgaaaatcgggtcaaacttggcttgatctaaaaattgaccgttgatggtaccactaatgatggcgcctttcagacccagcttcgtaaccgcacgttctaattccttggcagcttcgtctggaacattaactggcaaagcagctaaaccagctagacggtcaggatgctgcgaaacggtttcagccagtgagtcgttttgcgccttgcaagcatcaacggttttatcatcaggcaatacttgtggtgaattaccggcatcggaaataatttgcatgtcgatgccatacttatccatataagcaattcgactatcagcatccgtcagatctttgttaagcttctcttgaaagggattgttattaggaaccttggaaaattcgttgaattctttaacgttcttattggtatcaaaatgttcttcagttgtgataattttcaattgaaaatcgcttctttccattaatgtcaaatgcagtcatctttactgtcagtattttaacatcagttatttgcgtgcgcaaacaaattcgacggttcttattcaatccttattaatcgtgcttcttgatcccaatattgctttaattctggcgatttcgcaattagaccatcattaaaaagttgtgttaaattatggaaaaacagcggtgaagccgttgaaaagtgttgtacaacagactcgattgtttgaaactctttttctgataaacgcaccaattgtttttgatgcgtctgtatatgagcaacccccgatgtactgaccagcaaattgctgctccatacgatttggttgatgatttcaaagtcattttccttggcatcccgaataagaatgcttgccgacccaccagcttcaataaaattggcaaaccaaaacgcataccgattgcgcaggaaaatattacgcagtggtaatgcgcgcagttgctgcagatacgctgttaggggcacattttgctgattcagcaacctttcaatcgtctgcagtgctgttagcgtttgctcataattaccgcgacttacttgacctgagaaaaagtcggtttctttttctgactgcagattcacgatacttaagattgcccgatttgttaactgaagccgtttttgactggctttaatggccattattaaatcagaaatagaatcaaattgcgtatctgtcatgatttaatccgcttctttcatccttactcactgtttaaatactagctttttcgtccggtaataggggtcactatacatttgaaccttgtagtctttatacgactgtgcatatattgcgttgccatacttataataaactacccttgtttcaccgccttgatacataccgctggctttgccccaacccctaactaggtaagcatcagtcccaaccttacgccatagcatatcactggctttgattaccggcattccggaactggcactttccgtgttgtatggccgaattttaatgataccaccaaaacctaagggactattcttaggtaacttctgctggtaggtaccttggatttcccgtggcgttccaatatgccatccctgagtccgtaatacaatgtagcctgccaggatggctgcaataaacagcactacgattgtagtcaaaatgccgattaaaattttaacccattttttcatgatcgattcattccttatataacaacttatctagtaatcagttaattctaacgtcactatatagctaaatgaatcttgtttcaattttcaaaaaggacaaacatttctcattataaatgactaaatcttcaaattttcactatctaattatcatacagattagtaataccatactaatttcccttaaaaaccgcatattcgttgactttgaaattgttgtcaaactatacttgctatggttaaaactaactttctcaatctatggaggctgatcaactatgacaagcatcaataatgtaactgtggccggttccggcgttttaggtagccaaattgcttaccaatgtgcctaccgtggcaagcaagtcaccgtttacgatatcaatgatcaagcaatcgaaaaggctaagtctcggattgctggtttagaatctagttacacccgtgatttgggtacttccgcgcgggattttgctgaaggtctctctcgtatttcgtacactactgacctaaagacagccacagatgatgcagacattgtcatcgaatcagtgcccgaaaagccacaaatcaaacatgacttttacgttcaactatctgcgattgcacctgccaaaacgatttttgccagcaactcctcaacacttgtaccgagccagttcatggcggatactggccgaccagcgcagtttttgaacctccattttgctaacgaagtctggaagaataacactgctgaaattatgggctcactcaaaactgatcctaaagtgtatgatacggtggtcgaatttgctaaagaaattggtatgctgcctatcaagctcaaaaaagaacaacctcgctacatcctcaactcaattctggatccctacctggatgccggcctaacgctgtgggctaagggtgttgctgatccgcacaccattgaccaaacctggatgaaagccactggggctcccatgggtcccttcgcagtcatggaccatgttggtttgcgaaccgaatacaacatccattccgtattggccaaagaatcaaataataccgatttgataaaagcaatgaccatgatcaaatcaatgattgatgatggtcacctcggagttgagtctggtgaaggtttttacaagtatcctgacccactgtatgaacaagaatcatttttaaaagtggaataacttaattttcacgacaaattaaaacacctcgcatagccattgataatggttattgcgaggtgttttttacaactctcttaattttgccgacactattttgctaaagcaccaacccgagctaattccttagttaaggcatccaccgctgcatgcaggttttcgttactagaagcgtaactaattcgcaatgcttgcggatcgccaaatggtgcgccgggcatcagaccaacatgatacgttttggccaagtgacgcgcaaaagtaaaactgtcttgttcacattgttctggaattttggtgaaaatgtagaacgcccctttaggcgccacgtaggtcattcccaacttatccaatgactgcgtgaggtaatcacgacgctgttcataaattttgcgcatagcagcggcgtcattttgaccgtgagtcagtgcttcaacagctgcatattggacgattgacgttggtgtcgtcacttcaaactgatgagccttggcaatttggtcaattacccctgttggtccgaacacaaaaccaattcgccagccggtcatcgcatgagactttgaaagtccgttaatgatgatcgtttgtttcggcaaccacttggataacgtgtagtgtttaacgccataggtaagttcaccgtaaatttcatcactgatgacccaaatattgttatctcggaatacagggactaaggcagccaactgttcttctgtgtacactgcccccgttggattggatggatctgtgatgacaacgcctctgacagtcacatccggatgtgcagcaatggcatccgtcacttgttgaggtgtcagtacacagtcagtgtcagtcgtatcaatcatgatcggcactaattgattgatcccagccatagccttgtaaacaggataagctggcattggaattaaaatgccatctccgggacgaaaaagcgtcttaaacgtagctgataagccttctgtagcaccaacggtacagacaatctggtcagccgtgtattggtagccaaacttgtcgcggtaatacgttgaagcagcatcccgcaactcctgaatcccccagtagaagggatagtgcgactgattagcattaatagaggcaatggcagcttgtttaatgtgttctggcacattaaagtctggttcaccaagtgtcagtttgactatatctggatcctcactgatttcgtgatcaaacacccgcaacgcggaaggcttaacagataaaatatctggattcaattcattgatttccataaaaatgatacctccaagaaatttgttaacgcgcaataatcaatgaatattgagttgaatattcattgattattcccgtaaatgactagctgcaactgccagaattaccaagcaacgtatactagtaaacaaaggaacgtagacaagtaaactaacatgggcatgtaagtatttattcattaatttttgcatattaattattcattaaattttaattagtgaatacaattagtcacatcccccttgctaacaaactaaatataccagcttttaccaatattttccagtccactttcaaattaaactctaatttaatacttgaattttttatcattaggtgattaaatacaaataaacgaaaaggagtgagtctatggagaaacaaacaaatatcaatgccgatggcacaaaaagaaccttatctaatagacacgttcaaatgattgcgttaggtggtacaattggcactggccttttcttgggtgccagtacttccattaaaaaaactggtccatcaattattctggtttacattatcattggcgccttcttcttcttaatgatgagaggaattggcgaaatgctgtatcaagatccgtcacagcatacttttattgcgtttatcactcgctatctcggtgaccgcaccggttactttgccggttggacctactggattggccttgtgtgtgttggtatggcagaacttactgcaaccgctaattacgttcagttctggttcccgcacgtcccaggctggctgattcaaatcgtcttcttggctattttgaccgccgtgaacttgattgccgttcgactgtttggtgaagcagagttttggttctcgacgattaaaattattgcgatcttagccatgattgctactggcttcttcttgttattcagccattttaagactcctactgggacagttaccctatcaaacgtgacgtctaacttcacgctgtttccaaacggtgtcaataacttcattggtgcctttccaatggtcttctttgctttcttaggaatggaatttatcggcattaccactgctgaaactaagaatccacataaggtcttgcctaaagccatcaacgaaattatcgttcgaatcctgatcttctacattggtgctttgttcgtaatcatgctgatttacccatggcgcagcctttcaaccactcaaagtccatttgttcaggtcttctcgctggttggacttcgggcagctgcagccgtaatcaacttcgtggttctcacatcatctgtctccgcacttaacagtatgatttattcctcaggtcggcacttcttccagctagccattgaatctcacggtccattcatgcgacacttccagaaaatctcaacgcatggtgttcccgcactggcaattctcatttccactgggtgtgtgctgttatcaccattactcagcgtgctacctggtgtttccaacgccttcagtctgattgcatccgctactagtgacctctatctgattgtttacgccctgacaatcgttgcgcattatcgttatcgtcgttccgcagactttttacccgacggcttcttaatgccagcctataaggttgttgatccactgttgattgtcttcttcggcgtggtttatctcagtctgttcttcgatccaagcaaccggattccagcactcttgggaatcgcttggtgcgtgattttcggtttcttcgcttcaagagagaaatcaacggtatcgcatgcaaatactgcagcggttaatcagaagatagtttaattaagtctattaaaagggattgcactttcaataagcgcaatcccttttctatacctcaaaataatggtagtgttcccagatacttgatatcttgacgttctttagctgagccttccgccaaaactgctagtcggttaataacctgtgcaccagcttcctgtaacagcttttcagccgcctgcagtgaaccaccggaactgatcacatcgtccacgatgatcactcgtttgccctttaatttaactgcatccgtcccatccaaaactaactgctgattggcagaagtggtaatggcttgaacgggtatggtcatcggagaaaccatgtaatccttcacgcccttacgtaaaacaaagtagcgtttatgaccgcttaaccacgtcatctcttgggctaacggtattcccttactttcaactgtcacaaaataatcaaaatcaaggccaatagtcttttccaacagctgttcagccgcccaatgagtcaattcagcgtcgcctaacaagacaaacgacgcaattgtcacaccatttggcaatgtcatcacgggtaaatttcggacaaatggaccaagttgtaaccggtaagtctctgacatggaaatagttcctcctcaaataccaactttaagccgacaattacacccataggatagaacaatcctgcgatgattgaaacctaaaatagtattttcacacaaaagggctgtggcaccggtagatattggtaagtgtttcaatactgctttctaacctgaaacgtgttcacgagagcagagactggcatctaagtcacctctcctttagctgaaacgcgttcaagcaagcagacagctgcatgtaagggacccccagcacaaatcccaaacccatggatttatgctgggggtcccttacactccgctatctaaacgcttgctttcacgctctacgctcttggccacggtgcctccatctgcggtgctagtccacgccgcgcgcgaatccaatcatcaccgtaccacatttctgtcttttgtcggccagcttcgtaatcccagaaattataccgttcaaactcaactaaccgattgtttggacccaggccaatccattcataactgccaagatcaaccgtattcgcatacttggcccacaaaattggaaatgttactgttttacctgtggcatcagtatagtgccgttcctgaccttctagaagacgtaaccgttccagtttattccgataatcaggtgctacttgttgccaaattttttcagctgtattccatgcctcttgctccgttggcagtggaccagaaagtggctcagtcagcgcgttatacgaatacaacccgccatcatcacggtagataaccgtgacgtgttctcttcctaaagcttcctctggcaaatccgctggctgataacgaagcaaatgaacctgttcgtcatctcgtggaactaattgattcacgacaacttgataatcatcgggaatttgtaaatcagggtaagttttccctgcaatcgttaatactgtcattaaaaacctgctttcgttgtgttatggcaatacgacgactttgccgaaactgtcactggcttccagtgctgcttgggcatcgccggtatgcgctaaatcaaaggtctgtgttggcttaacatcaatatgatgtgtttcaatcaaattcagcatatcgttgaaagccgaatcattggatgcaatgccagaaccaaacgtcgttaaactagcgccattaggaatcacgaacgcgctaaagtttggtaccgtccactgatcacctaacccaccagttaaacagcaataaccaaactgattaaggtgtgatagggaatcgttcaacgttgctgagccaaccaattcaataatggcatcaaagtggtcttcagtttgaactttgccatccttatccaaaactggcttatcgcagccgatagccctaagcttatcaaatttttcttcatgccgagtactgccagtgatggtgattgacggatccatagccttagctaatttgattgccgcactacccacaccacttgtggcaccacgaactaacagactcttggcggtgtcaatatgggcgtttttcagtgagccataagccgtaaagtaagtttcggggatcgccgctaattcaggccaagatagtttggtgttaacgggataaatctgttcgtttggcagcaaagcatattctgcgtaaccaccgtcgaattcacggcccatgccacccatgatgctgaccaccttttggccaacaggcaaccggtctgactctgtggtatcagcaacttcaccgacacattcaatacctaagatccggggaaatttaacggttggtgactcgccttttcgagtatagatttcggagtgattaatgccgaatcctttcacacggactaaactccagcccggttttacctttggcgttggcacttcttttaactttaaagcttctggtccgccagcttgttcaatgacgattgctttcattttgaaggcttcctttcgtttgatgttttatcggtatccccgtggagacgagcgaatgactttaaaatttgaaccaattgatccgtctcaaaatcagggaactgttttttggtaacctgcctaaatagcgcttcttctcgatctaaaatggctttaattttcgggtacatcttctgtccctcagccgttaactgcaatgcttgagcacgtttgtcagtagccgaccggtgccggctgactaacccctgatcaaccagttgtttaattgcgcgggtcacgttactgggattaatgaattcaacctcaatcagttccttttgcgttaaccctggattatcgtgaatttttaacaggtaataatattggctagcgctcacgttaatttgcgccaactgctgacccagatgctgacttacttgccggccagcaatcaccagccacttgaccagtgaatcatcgccggtatcgatcacgtcatcaaccccctttttaaagtgaacctatatttcgtctatttgctttaacgtccacattttatcaccaattagttgcgctcgcaaataaataatttgaacgttctttttaattacagcgaaaaaaagaactaataaacagtaatcgtttaccagtccttttaacatcatttctagtccaataccaccacgtgtttgccaataaactgacctgactcaaggttagtttgtgcttcaccaacagaagctaagccatgataagccttagcaatcggcacttggatctgttttgcttcaatctttttcaaaacccgattaaacacatcagcggatagatcaattgcctcacccgcgtaactagtgaagaacttaccggccggaatcatgaatggtgagaagtgttcgatttcccatccgcctgctagaccaccggtaaagcagaccttcccagctgacttaactgcgccaaaggtatcaaataaagtggttgtgcccaccaattctaaagccttatcaacgccatccggaagtttttcagcaatcttgccatcatcaataatcactttatcggcaccgaattgcttcatgatagccactttggactggcttctagtcgtcgcaatcacttctgcgcccatatctttcgcaaggaccgtggccatcaaccctactgtggaggaaccgccgcgaatcaacactttatcgcctgcaacaacgttcagccctttacttaatgaaccataggccgtttggagcatttctggcaaagcacccacgattgaccaatccagattcgtctccagcggaatcaatgattcgttgggtgctaagcagtactgcgcataactgccatcgattgcgcggccgagtcctgtcatcatcatggctactttctgacccgctttaaaattggaagcgggatcagcttctttgatcactccaacgccttcaatgcctaaaatgcgggggtacttaaaatcacttgaagattccccttttcggctggtgacttctgattcgttaacaccaaaagctttaacttcaaccaaagtgaaacctggaactaattgcggtgttggtacctcaactggttgtaattcgttagcttcacaaggttcagaaattttgattgcttgcatatccgtgtatcctcctttgaaaaattttcaattaaacttacaatgtggctaatttcctgcaccgtgtaaaaattcatgcggttgactgaaaaaagccacttgctcgaaagaatttactctgagagctgttctgctttcttaacctgttcacgcaaccgcgtccggtacttgaccaaccataattcatctggatattgtgccataatattttcagcaaatgccaccggatcatcgccaatcagttgcttcacaggtaccttttccgcagcgctctcctgaaacatgtgtaaaatttcttctaatacgtccatcatagcgccatctttagcaaagttccaaatgtaattctgtaacgcggtgagtgtctgcgcgtacggcttaggaagttcattcacatcctgtttaaattgcttataacgtttcttatccccaatgatattgttcaataaattagtcatttacctgctcctttaagtttgccatggtgtcggttagaaaatcccatttctgccaaaattggtttaaatattgctgacctgcttcattaagcgagtaaaattttcgtggtggccccacttcagactttcgccgttcgactgacagtaacccttttttttctaaacgcaataataccgtgtaaaccgtgccttcaacaatgtcttcgaaacccagatcaatcagataattggtaatctcgtaaccgtatgtttcaccctgactgattcgttgaagaacgataccttccaatgcaccctttaataactcggttaaccctttcaatcgtctcacctaccttgtaatactatatagcttgcctgaatcaacgtttgtttaccagctttcaccggctactctttaatacaatgtaccagtacataataacaacaggtagcgcatgtgtcaataaaaaataacccccacggcaaataccatgagagttatcatttaacacttatttaagtcttattttcgttttcgacgaacttctttcatgaaggccttcatctgttttttaccgccgaacatgcgatcaatcttggcgttttcccttgccttaccacggagctgattattcgactgttcagcttgcagttgccgataactggccaaccgtgcttcagagagttgaccatcagcaactgcttgctgcaccgcacaaccaggttcttgacggtgtgtgcagtcgttgaatcgacagtctttcgccaattcagtaatatccgcaaacgtcgtgtctaagtcagcgtccaataaacccagttcgcgcattccaggcgtatcgatcactaagctgccattaggtaatttaacaagttgccgcgcagtagtcgtgtgccggccatgatcatcagttttgcggaccgctgcagttgccaaactggacgtgcccatcaaatggttaatcagcgtagtttttcccacgcctgaagaacccagaaaagcatatgtcagtgcgggttgcatgaatgcagttagttccgccattcctgcagtacgcatggcatcacaaacgatcaccttcgtgtctccgctaacttccacaacagccgtcaactgttcagctagctgtgtcgttttgtcggccttagttagcacaatggctgactgcgcacctgatgctgccgcaatggctaaataacgttctaatcgccggacgttaaaattcgcgtccagtgccatacataacaagagccagtcgatattagcggccactaattgtgaagctgcccgccgaccagccgtcttccgaagaaaaacggtcttgcggtcatttagccgttcgattgtcgcagcatccgtctggttctccggtaaccgtacctgtacccaatcgcccaccgttggaaaatctgccgcgtcagtagcaaaattcaagagtcgaccagcaatctgagcctggaattggccctgatcagtcacaatcgtatattgctgatgactggtagcaaccactcgcgccaatctcaaaccagccgttaatttgtgtgtctcgttagcgccatattctgttaatttaattgttttgtcctccataaccgcggaggactaagctttgtagtcctccagtgacgtcccaacgcccattacaatgcccaacatacacgttcatcctttctgtggcgactcaatcgccttattgcagttattgtatcaaatttggcgtaaatcacaacctcattgcgcccgaacatgccaagtacacaaaagaccggatcacgccttactgcgggtatgatccggtcctttaatgatggcaggcgactctaagtcacctacagtttttgaatcagcttcaaggatgactgtagcgcttcatctggcgtctccgtcattttttgggaaatgttttcggtaatgatcatgcccatcacccgcttcacgctagcttctaccgcacttaactgggtaacgacttcagcacaatcccggccttcagtcatcatggcctgaatgccacgcaactgaccttcagcacgtttaagtcgattaattaattttggatcacatgccatgcgcgtttccccctaaaaattacttgataccactatatcatatctagtcaatgtattgggacagtcttgacttaaaggctggttccggtgtaaagcccacgattcggtcaacgatttgaccgtcttttttaacgataaaggttggaattccttgaacctgcatctgggcagccgtttgctgattttcatcgacatccaatgatttaaaggctactttgtcacccagttcatcggccattttttcaacgattggattcatcatcttacatggtggacaccacgttgcattaaagtcgatgacgacggttcctgaatcggtttcttggttaaaattttgatcattgattggttgtactgacattaaaaacacctgctctcttaatctttaaatcgattatacctacacggggtatccaagtcaagtgattagaatttactataaaataagtgataattaaatatattgacaatataccgccatagggtataatgatttcaagcttaattatgaatttcacaaggaggaacaaaacatgtctgaacgaatcattattgttggtggtgtcgctggtggtgcctctgttgcaactcggctaagacggcttaatgaggatgctgaaatcgtgatgtatgaggcgggtccctacatttcctttgcgaactgcggcttaccatattacgttggtcaaaccatccccgaccgtgatagtttgtttgtctcaactccggatgatatgcaaggcgactttaacattgacgttcacgttaatagtaaagtcaccagcattgattcagccaacaaagaaattaccattcaaacccctgaggatagcatacaggaccactacgataaattaattctttcaaccggtgctaaccccgttgtaccgaagtttccaggtctagccgatgcccacaacgtcttcaccgttcggacagttcccgatgtggatcagatcactgactacattgaaaataacgcaccaaaacacgctacggtcattggcggcggatttatcggactggaaatggtggaaaaccttcgcaaccgtggcctcgacgttaccttagttgaagccacaccacaggttatgccgaatctggacttcgaaatggcacaattcctacacgaacatttagcactaaacggtatcgatgtacatctgaataccaaattggaagcgttttctaatgctggtcatactttgacattcgctggtggcgatagcatcaacaccgatctcgtcatcttagccattggtatcagaccaaattcacagttagcaaaagatgccggtgtcaagacgaatgaccgtggctttatcacagtaaacgatcacttcgaaaccaacctccctgacatttacgccattggtgacgttatcaccgtccagaatgccatcacaaaccaaacggtatcaataccactagctggtccagcaaaccggcaaggacgttatctagctgatgacttagctggtattgaccgtcaaaatccagctgtgcttgggacgtcggtggcgaaagtattcgcactgaccactgcttctaccggtgtgaacgaacgtcagcttaaagcgctaaatatgccttacgaagtcgttcatttacacccgaattcaagtgccggctactaccctggtgctgcccctatcgaactgaaagtcctcttctcacctgaaggcgatatcctcggcgcacaagctgtgggaaccaaaggcgttgccaagcggatcgatatcatttcaacagcaattcgtttccacgcaaaagtcgctgaactggctgacgtagaagtggcctacgctccgccatatgcatccgccaaggaccccgtgaactttgccggttacatggctggcgatattcaggataagttagtgactaccattcaatggcatcaagtggacgatttactttcaaagggtgcctactttctagacgtccgtaatccggatgagcttttggcagaacccgcactggcacacgccgttaatattccacggaaccaaattcgtgaccggctgtcagaattaccaaaggatcagcccatctacgtttactgtgcagctggtctgcgaggttacaatgttgctcgggtgctcactcaacgtggtttcaacgccattaatctcgacggtggtctgaaaacttaccgtacggcgaaatatcagctttccaaacctgaaccgagtgctacgaaaccggtgaccaatcaagctgaagtatcaaaatcaacgtcgcaaaacgtcacccaggttgaactggatgcctgtggcttacagtgtcctggcccaattcttaaagtaaaaaacgccatgcaggaactagacgacggtcagcaattaaaggttaccgcttcggactttggcttttacaaggacatcgatgcgtgggctaaagccactgataacacgattttgaataatgagattcagggcgataaagtagttgctaccattcaaaaaggacaaaacactgccccttgtccaaccgacgcaccccaaacggctcccaccaacgtgactaaaacaaacgaagaaggcacgactatcgttgtctttgatggtgacttcgacaaagccattgctagtctgatcattgcacagggtgctgccgccatgggacaaccggtcaccatgttcttcaccttctggggactgaacgtgattaagaagccaggggttaaattacacaagaagggtatggcaaaaatgttcgatatggccctcccccacggcgcacaaaaattaccactatcaaaactcaacatgctgggtgctggtagaagcatgatgaagaagttaatgcacagcaacaacgtggatcaactggataccatgctcaaaaaagctcaggatgctggcgtgaaaatggtggcttgcaccatgagtatggatctcatgggtgttcagcaagaagaactcatcgacggtattgaacttggtggcgtagcagcctacttaggcgatgctcgtcagcggaatactagtctgttcatttaaagatctttgcttcaactaaaaaagcactgtcactttaatgtcgtgacagtgctttttaaattaaatcatctaattattttccaacgtagtttcgctccaaaaaactggtcatattttcagcagcgtgacccgtaatcgtcttgaaatccggcgttacttgattgaacaagcccaacgccccagcggcatacatgctggcaagttctttaccatcgccttcatccgcataaatttgaccgaattcttgtgtagtcactggctgataaccaatagtatggccagtgaccctggtcataattttacccagttcaggcatggtcaagctctgatcttgcgtcaacaaataactttgaccagcgtcccgtaagtttggctgagtcgctaaggacgcaatcgcctctgcgctatcagccgacgtgataaaactcatagcctgatcacccacaggataaatgaggttttgacgtgcaattaattcaggtagataagggactaacggatcggcatataatgaattcttgatcaccgcatagtgcaagccacttgtcgctagttttcgtggcgcgtaaccataatatggtgacatcacaaacggattgttttcctgatcagcataaaagctaacaaagatcacactggccactttggccttttgtagcgccttgattgaattttcaaattcggtgacgcgttgcagaacctcataagttttacttggaatgtaaatcaccacgtcttgacctgtgaaagccttcgtcatgcttgttacatctaagtaatcacacgggacaacgttaacaccttgctccttcagtgcggttgctttagcaggcgtatgaactgccgcggttacagaatcagcgcccacgttcctgattaaatttgcgaggactttactacctagatgcccagttgtacccgtgactaaataattcatacatgatccctccatactgaactgacttattttaacggttaaattatactgttactttaataataacacatcaataaaattggcaaccactgaccacccaaattcgagtgacagtgattgcctattcgtttgaattcaccttatttacttaacccgacagccttcatactgaagtcccagagttcctgttggacctgctcgtcatgagacaactttgatgaagcaacaggtttgtcgctacttcgatcaaaatactgggttggtccctttgcaaatttgttatcgtaaattaaatccgtgatcatcttgccagaatccttggcagtgccgataatgtcggcaaattgtttaaccacttccggcgtaaaacgtgacttgttcttggacaagccagtttcaatcatcaatccagggttcaccgtgttgaccacgatctttttaccggcattagccagttgtcgttctaactcgtagctaaacagaatcatacataatttcgagaagggatagctcatactatccacttgtgcattaccaccgtatgccaacgcctctacaccaggccaagcaacgcccttgagtggagtgtcgtgacgctcgctgctgacagtgacaattcgactatcgtcattcatcagtggcaataacagttgcgttaacagaaaatgacccaggtaattcgtctcgaaaatgtcgctaaagccgtcatccgttttgtggactgtccgaccagcaattccggcattgcagactaagccgtagagcggcacgtttagttttttaaacgcttcaacgaatgcgcggacctttgctaatgacgatgtatccaattcaaggcaaataagattggcatcaggaacctgttttagaatttcgtcctttgctgcctgtgctttttccatgttccgacaggccataatcagctgataatcggtacccttctccgcaatttgtttcgtggtttcaaaaccaagaccagaattagccccggtgataatgactgtttttgtcatgctcttttctcctttaaagctactgaaattatgatttgattgatgagtaaaagcagtttaacacaattgtatgcaattgcatagtttattctaaaccttcacgaagattcgtaaagatttagcccttaatcttaatcgaaagtatagatttgcttctattgattaggattagccgactctagccactcgcaataagccgtttcccggcggatggcatgatccagcacgagataatgcccgtaatcgttgttattttgtccatcaggaaacttgcgagtcatctgcatttttaaatgatccagtttctgctcgtgaaaccttaattgcgcggccagcatatgcgccagccttggatcatctggggttttgataaagtacatcttcaccgcaaattcgtctcgtccgccaacggtcggttcggtttcagcagaaagccaatcgtttaaagcaccgcgaccgtctgctgtaacggcataccgcttccgagccagtttttcaccactaacttcttcttcatgggtaatctggccggactgttctagtcggcgcagttgagggtaaatctgactatgattagcggaccaaaactcgccaatgtctgaatcaaaggccttagtcaattcataaccagtcaacggttgctgatccagtaggcctaaaatgatgaattgtaatacattacgcaaagccataacaatttctgctactgataacttataaaaagttatagattattcttgtttcttcctatcctgcctcgcatgagtattgctaatacagttgatatgatagtccacaagcgttaattcccggctagccaccggtacatgctttgaagcctgttttagtaggctaattcaaagttttcagtatccctgatattcagggcggcattaatatcacgatcttcagtataattacagttctgacattcatacacccgatctttgagttttaaatcaactttcttatggccacattggtgacacgctttagaagttggttcaaaacggttagttaagtgtaccggaatgcctaactgctggcatttagcgattaatttgattctaaaattgtagaagccctggtaactcacagctttagctaaatgccggtttttcatcatacctctaacattcaagtcttctaaggctacccaccgtggtttggttttcaccacagtagcgataatcttattttgataatctacctgaatattggttaatcgttgatacaagcgttgcactttccgctgagttttagctagattaaaatcagtagcagactttccttctttccgttttctagctttcagtgcttgatactgacgggacatctttctttgcagccgtctaaggcgttttctgatccgtcttacacgactgcttttattctgattatgatacaaagtgccatcatttagaatggcaaactcttttaaaccgaggtcaatgccgataggttcaccagttaatgctagttttggtatttcggcctgttctactaaacaggtcaagtaataccgaccagccttaaatttaatccggccttgtttaataacgaagtgttctgagtctgtaggaatatagcccaactctttcaagcgtacccagccaagcttgggtaacttgatccggtgacgctgacagggaatgatttgcgttttaccgttcttaacaaagtagtaactgccctgaccgcgcttaaacgagcgccaatgtgggaaaccgctcagtttcttaaagaaccgtttcatagccgtatcagcatcaatgaaggcctgtttaactgatttagcatataaatccttgatccacctgtcatcaggattggctgcaaggtactcatggttaaaccacttgctaaaagcataggcattcaaataataataaccttgttcataacgctgtcggttgatatccaaaaacaggttataggcccaacgactgccaccaatatgacaatcgatctgccaagcttgcttttcagtcggcttaatttcgactttgtaggtgagtaacatcactttttccgccttattgaatttaatcaccaaggtgaggtgtccctcatattatacgggatggatttatcccaaaaagccttttaatgaaattcatataaatcactacataaaagctatcaactaatacggaataggatagaagcaccactttacaaagatttatatccttttacagcaaaacagttactgtttatttctccttgacgtttgaatgagataagtataccataatcaagtcaactaaaacatgtaattaattacatgtatgagattacaggaggaaataataatgactaatttaaaccatatggacaaacattttgaaaccctggatgactttttgggcacccacttcatttacacttacgataacggctgggaatacgaatggtacgctaagaacgaccacaccgttgactaccggattcacggcggcatggttgccggtcgttgggtaaccgaccaagaagcccacatcaacctgttaactgccggcatttacaaaattgcctggacggaaccaaccggtactgatgtcgctttggactttgttcccaacgaacataagttgaacggcaccatcttcttcccaaagtgggttcaggatcatccagaaatcaccgtgacttaccaaaacgaacacattgatttaatggaagaatctcgtgaaaagtacgaaacttatcctaagatggtcgttccagaatttgctaacatcacttacattggcgatgctggtcaaaataacgatcaagtcattgctgcggaaccatacgaaggcatgaccgatgacatccgcaatggtaagttttatgatgaaaattaccggatgattaagcggtaatttaacttaaacatgcatgataaaaaattgtcgaaagattaatctctcggcaatttttttgtggctatatttgctttacagctcactcgaaggactacaattattgataagtaaagatgattcaatcacttgtattagaaaggagtacacaaaagataatgaaacaaactcaactaggcaatacggatatcgaaatctccaagctttgcgttggcgccatgagtttcggtcaacccggcaccatgcacgattggacattgaatgctgatcaaaccactcagatggtcaagacagcactagatttagggattaacttctttgatacagccaatgcttattctaaaggcaccagcgaaacgtatttaggacaagccttacgtcaaaatgttgcccgggacaaagtggtcatcgcatcaaaagtctacttcaatcctggccgcctcagtcgcaaagccattgaacgtgaaattgacgggagcttgaaacggttgggtacggactatctggacctgtatatcattcatcgattcgactatgacacgcccattgaagaaaccatgagtgctttaaatgacctggtcgtcagcggtaaagttcgtgcaatcggtgctagtgcgatgtacgccaaacagttcaacgccatgcagcagacggctaaagatcacggctgggcaacatttcagaccatggaaaaccactataaccttttgtatcgtgaagacgaaaaagaattaattcccgcctgcaatcaatggggcgcttcactgatgccatatagccctttggctgccggccatctcagtcatacaggctggtcaactgataccctacgtagtcgtactgatagagtggcaaaaggaaagtacgataacgtagaagatattgatttaccaatcatcgaccaagttgccaaaattgctaaaaagcacgacactaccatgagtcaagtcgctttagcttggctatgggctaaaggcgtggctgcgccaatcgtgggcgccactaaagcggaacacttgcgggaggccgttgaagcacagcaagtggtcttaactcctgatgacattaaagcattggaagcaccgtatcaaccccaccctattgtgggcgcgctgaatcagaatccacctgaaggtacggttttggttgacgagaagaagtaaagctgtaatcgcacaagtaaaggcgtatatggaacttcatgagttccacgtacgcctttattttgggtcatttaacatcccaattatttctaattttgttaaaactgccattgaaaaaatattattcaaatatacaaccatattcgacctaaattttgatatacttaaaactcacgctaacgataaacgtatttaaagataagaaactaaaatagttaatgagcatcaattaattcgccaacactattacttggatcatatttttagatttcattaattgttttcgtgtgttttaaataacgttatttaccgattacctgatttaattgataacattcgcgacggtgatctacggtgcattagaggaatggagaggataaggatattctgatttagattcacctgcttacattaccgactgtttcacttcgtttcattcttacactcatctaaccctatctacctctattaacaaggatagaagacaagatgagaatatttttgttacacgcacttattctagtacattaaggggaatatatagtggaaaagagatattgtattaactgtggtaaagaattacctaatgaagccgaattttgcttatactgcggtgctaaacaaccaccagtaaaaatcgatgcttcaaataaagatcagcaacacgaccaagcaactgaatcatctgattctcaaagtagcaatcatcaggagaaaactgatacctcttcaaataccttaacaaaagcatcattatctgctccagaaaagaaacgcaagtcaaaaaaggcaaagcggaaaactaaacggatatgggctattcttgccgcactggctgtccttttcatcgcattagcagtttatggtaatcaccattctagctccgctactggaactgcaacggcttataataacagcagttctgatagttcaagcgatgatacggatgattcttctgactacgacgattctgattatgccgatgattcttctgattctgaagactctgaagacaccggtgattttacaaatgagcctgtggcgggtattcccgctgcagattacgatgccacggaagccgctggaaataattactcatatggtgaactgcttaaatctgatgattataagggtgaatcctacaacatcacaaacgctcaagttcttcaagctaacgaaagcggcagtgctactgagttattagtatatacggatgactacgcagatgaaatattcacggtctattatcctgataccactgaagccgtcaaagacgattacgtcaccgtcaaaggtgtgctaggcggtcgtgaagagtatgatacccaatccggtggttcgaatactgtacctacaatcgttgcccaagatgtaagtgtcaccggccaaggtagttaatgattaattaattataaatacaacgaccccgaggactcgccatcctcggggttttatacgtgcctatacaacgctacaatctcgccagaattgaccgtaaccgtttctgcaactgtggtacttgttccgcgcttaaattagcgaaccccactcgcagattattttggtgtgaaccaaataaaaagtccggtctgacaagtacccgctgcttcagaaactggttgtaatcggtgatgctgagcggatgagtcgtgtttagatgtacccaaaaactattcccatttgctggcaaacggtagcttaactgattttgatcagcaaatggctttagcgcttgctgtaaaagttgccgtttttctcgcaactgggtagctttctgctgaatctgttgctgaagatccggttgggctaaaaactgactggcaataatctgtggaaagatactcatgccagattccatttgctggcgaatgtctgccaactgattgacgataaacgatggtgccaggagccagccaatccgtgcttgattgccgactaaggaagataatgagccaatgtagagcacattgtcggggtccaaggctttcaatggcggttccgactgattatccgatactgcatccgtaatgccaaagggatcatcttccacgatgggtaacttcaacgtttggcaggttctaatcagcgctcttcgcttagccagcggcatcatttgcccagttggattttgaccatttgggttaacgaacaagaaacggaaccggtgcttgtaatattcctgccgcagataagctagatcaaggctgccatccgccatcaatgggatgccatacacccgaataccggccacttgaaagagcgtgagttggtaaaaatacgacggcttttcgatggcaatggcgtcaccataggataataagccctgcgtaatcaggtaaaaggcttgttgggcaccagaagtaatcagcagttgattcgcgctaaatgaatgttgtaataatggcgataattgggaaactaactgttgcttcaaatccgcggcaccgctgatgtccacgtgattttcttgtttagccagttgcttagctgaaacatgatcaagtgagacgggtaacgccattttgttgggaatgttaaaatgccccaggttaattgcttgcggatccgactccagttctcgtaattgctgcaaataactttcaggatcaccaaaccgattagcggcaagatacgttcgccaattgacattttcagttaagattccccacttatccatgctgacccacgtgccactgccccgttttcgagtcaatagcccgttgctgaccagttcatttaacgcctgctgaatggtcgatcgattcaccgacagcatctgagctaattgccgttctgccggtaactgctgaccaggaatcagatctccattattaatggcgtccgtaatcagcgtaatcactttaatgtataacgcttgcgaaccacctgaaagttgccacttcatgctgtcaccctctttgattaaattggatggataatttaccatccaattggttgttcccattataaacgctgtgccctagtatgtaactaatttctagagaagagggcttgattatgacagaaacaggcacaactacggttaaacgaggtatggcacagatgcaaaaaggcggcgtcatcatggacgtcgctaacgtggaacaggctaaggttgcggaggctgctggtgcagttgccgtgatggcgctggagcgggtaccctcagatatccgagcagctggtggtgtggcacggatgtctgatccagcgatgattaaggctatcatggatgccgtcaccatcccagtcatggcgaaggtgcggatcggccacattgctgaagcacgaattctggaagccatcggtgttgactacatagacgagagtgaagtcttaactcccgcggatgacaactaccacattaataaaaatgactataagattcccttcgtatgtggctgccgtaaccttggcgaagcactccgccgaatcggtgaaggtgcttcaatgctgcggaccaagggtgaacccggtaccggtaacatcatcgaagccgttcgccacatggaaaaagtcaacgaacagatcagtcacgtggttggtgctaaccctgatcaattgatgactatcagccgcgacttaagagcaccttatgacctagtgaaacaagttcacgatttaggtaaattacctgttgttaatttcgcagccggtggcgttgctacacccgcagacgctgcactgatgatgaacttgggcgccgatggtatcttcgttggctccggtatttttcattctgaaaatcccgcaaaattcgccaaagctatcgtcaccgcaacagcgcaccctaccgattgggaattaatcgcaaaagtctcagaaaatttgggtaagccaatgaagggtatcgacatctcaactttgacggacgaccaaaaaatggctgaccgcgggatttagacggaggtgatgcgtgtggttatcggtgtattagcacttcaaggtgcagttagcgaacatttaaagatggtaacggcatgtggcgtcacagcacgaccggttaaaaccgaagcagagttgaaaaatctcgatggtctaatcatccctggtggtgaaagcaccacgattcggaaactgttagtacgtgaacagatgttggaaccactaaaagaactggtccaacagggattcccagtctttggtacttgtgctggactagtgttattagctcaacccgacttattgaacggcttaaacggaacagtagtacgtaacggtttcgggcgacaaagggaaagttttgaaactgaattgacggtgcagggatggtcaaagccgtaccacggtgtatttatccgtgccccttacctatctgctgttcaagaacctgctgaagccttggtaactttggatgatggtcgaattgtagctgctcagcaggatcatgtgttggtgactgcgtttcatccggagttgactggggatgagcggttccatcggtattttattgagaagatggtggcggatgagaattaatcgtataaataaataatctaaaatagtgtgggtcccattgactgatgggaacccacactatttagtcaacacttaaaaatacgtgtctacaatttctggtatttatagtgctagtgagatgaaattcagtaaaatcataagacttctacctgaaattttaatttcaaaagttccagatactcaagttataatcttattctgaataaattaaaatctaagctcattgatttgatactcttctaaatctctatttctgttaaatctaagccacgtgccggacttaagctcattgatttgatactcttctaaatcctttggcgaggtctatgcggtcaatatgtcagacttaagcttactgatttgatactcttctaaatccgggagcgggcgttaaagaacaaacgacttggacttaagctcattgatttgatactcttctaaatcccggctctttaccagcgattaaatcagtcaggacttaagctcattgatttgatactcttctaaatcaatggcctcaatcacttgctgtgcttgggtggacttaagctcattgatttgatactcttctaaatcaccacggatgcactagcaggctgggttgttggacttaagctcattgatttgatactcttctaaatcgcaatgtcagctggtgtgccacccatcacgggacttaaactcattgatttgatactcttctaaatcacgttgacactaaggacaccgaaacgacctggacttaaactcattgatttgatactcttctaaatcgcggggcttgtcgcgctcacgcggggctttggacttaaactcattgatttgatactcttctaaatcccagtgaccagatttaccttgatgataacgggacttaaactcattgatttgatactcttctaaatcatttgccgttgccgtccaatcaaacgacaaggacttaaactcattgatttgatactcttctaaatctgaatctgatacgcataatccattaaaaacggacttaaactcattgatttgatactcttctaaatccttagttacttgatacaaacctccaaaaatggacttaaactcattgatttgatactcttctaaatccggctaaacgtcatctaaaagacctcaaacggacttaaactcattgatttgatactcttctaaatcccaccgctcacgttgacgctggtgctttgcggacttaaactcattgatttgatactcttctaaatcaccgataggcgaattgatgatatgagagacggacttaaactcattgatttgatactcttctaaatcttgccaaagtgctggttcaaaatgttctggggacttaaactcattgatttgatactcttctaaatcacgtggtacgctagacacggctcttgaacgggacttaaactcattgatttgatactcttctaaatcaataccgtaatcttttcaaccaaggtgttaggacttaaactcattgatttgatactcttctaaatctagctattgagctggtgttgttgccaacctggacttaaactcattgatttgatactcttctaaatctcgtacatcagttttaattggctcttggtaggacttaaactcattgatttgatactcttctaaatcaggcgctgtcagacgttatccaagatgatgggacttaaactcattgatttgatactcttctaaatctgtcattactccaataaccatagtctaagaggacttaaactcattgatttgatactcttctaaatctatcaatgttaattatcagtataacaacatggacttaaactcattgatttgatactcttctaaatctagccatcatgcggttaacatcttcctgacggacttaaactcattgatttgatactcttctaaatcctgcacttaaatcactgccaccaaagttgtggacttaaactcattgatttgatactcttctaaatcctaaatgccgaccatctggtgctagctgaaggacttaaactcattgatttgatactcttctaaatcagttagctaccaatgtattgcttttacgtggacttaaactcattgatttgatactcttctaaatcctctcacgaggtccagtgcttgcttctcatggacttaaactcattgatttgatactcttctaaatctgatgctgtgatggttctggttctggttctggacttaaactcattgatttgatactcttctaaatccaacatcatgccactcctcggcaacgctctggacttaaactcattgatttgatactcttctaaatcgctatttctgtccagtaaccaatgtcttcgggacttaaactcattgatttgatactcttctaaatcgtaccagtgcaaacttgattgtgacttgctggacttaaactcattgatttgatactcttctaaatccgatatacgctaattaaattttaactatcaatcattacgccactcaacgtaatcctcatctaaatagtaataacggcaatctttaaatatttcagttctctgattttctgaaaatttaatgagaaggattctcaaattcaatgttttactcagtgcaaatatttcttgtaattctgaatcacttaaatagtcagtaatattcttaaatcctaaaattctagtttcatttaactcattatgggcctagaataaaaagtgtacaagttaaatagagactttgatttagtataattaaggaagtaaattggaggatcaaataatgacgaagcacagttatgacaaggaatttaaggaacaggccgttcagtattactagataacaaggatcacatgaccatgaatgaataagtaagaatctaggtattggggctatacattacataaatggattaagctgtttactgagactggggagttgggccgtggctctggtaatttgccagcgataaggacaaggagattgcacgactaaagcgtcaacttcgtacgctgaaggagcgatcgaagtgttaaaaaaatcaatcgggattctgagcagtaactaccgaaaaggtataccaagaaatggacgttcagcacgctttggaatcccacccttccatcaatggtatgtgtgattatgttggaatctcaagagtggttactatcaacgagaaaagcgtcataatcaccaatcaccgcgaaagcttcggaagaagtttattcaaggtgaaattaaagcaatttggctcaaaagcctttgtatttacggtgccggcaaaatcacccaagaacttcgctcaaaaggatataagatcgctgaacgaactgttggtaagtatatgcgtgaactggcattccgccgtttacctacccttggacgactaccactcgcaattctaagtttgtaaacagctaataaatattttagacgagcgttcaatccattgcgaccaaacgccgtttggtgcattgacaccacttatatttcagttcatgacggattcgtttatttaaccagtattatggacttgtactcccgacggatcattggttgggacttatctgaaaccttggaggtatcgaatgtcatccccttattgaaaagactaagcacagtcgccatattagcaagccattatcatgcacagtgatcggggtagtcagtttacgtctgaagcttacaatcaagttacagctaacatgacattaagctattcaaagaaagcttatccttgggataatgcctgcattgagtcgtttcatgccttgattaagcgtgaatggataaatcggtttaaaatccattcatactccgaagctaaacgactagtttttcagtacattgaaacgttttacaacacagttagaattcccagtcactgtggattcaaatcaccaaagcaacttgaagatgagtatcaaactcaaattcaaaatttagtcgtggcataggacaaaaaagtctctatttaaattgtctattttattgacaggggaccataccatcaataaaggtcacatcgtcaattaagttttgacgacgcaagtagtcaaccaactggtctaacccatcatgaatcaaagtttctaactcatcggaaatccggaagcgacaaattgtccgatacgtgggcatctgttcctgggtcagccagcgagctgttaagttctccaccgcaaaggtttcgattcggcgactactaaagaccccgcgagtgtaggcgaaaagaaccagcttcatcatggcacccaaatcatattctcgaggacgaccgaataggtagtgctccttaattgagagtgactcaaccagttcattaatatagtaagcaggattatctttttgaacgatatagtcggtagttagaggtaaaattgtttgatccatgttataatttgtcatgttggattgtcctttcgaggatgatttttgagtatcgggtgtgaccggtactctttttttctgtcattatatcaaaaaagcaggtagttaaaaatccttggatttttaactacctgcttttgaattaagggacttatgtcacagcctctttttagtgacgttattgccctataactgcaatcgattgatttacatgagtcccattttgaatctcatcaaacaccacctgcgcaaatgctgcagcgctaaccggctttactggaactggctgtccttcattaataagctggacttgcgcagacccagattgatcatcaataatcggtcgtaagacggtgtacggcatctcagcctcatccacaattttaatgccataacgttgctgtttgagaaattctttaacatcggtgattcctggataagtaagtgtaccggccacttcctgatcaatgcctgcgaccgagcgcatcacggttctaacggtttgctgctgctttcgaagtgcggtgaagacggcttctagcttccagtccacatccatcccaatgaaatcggagtagatgatgtccacccctttaactgcttccatataagtagctgctttgcgggcatccccgcaaaagtcagcagtttcgtctacttcggaaaaaccaactactgccacatcattcagttgcctagccactaattgtgcgactggttgatcaatccccaaaattaaacacttcgtcattcttctaacctcgtttcgttcatgtcgatactcactttacactatttttcgattgttttctctcttcatttccgaacattcggttttttaaataattattattcgtatattgcaaatgttataaattaatgttacgataatatctggtttttatttacgaaacacgaacattgcggctattattttagataaagggagttaattcttatgggtcaaaaaattgcgtcatactttcagttcgatgagttagggacatcgtataagaaggaattcctagcaggtttaaccacattcatttcaatggtctacattttgtttgttaaccccaacgttttaggggtttctggcatggacaagggtgctgtcttcaccgcaaccgcattggccagtgcctttggctgtttcttaatggggatcgttgctaaataccccatcgccatttcggctagtttggggatcaacgccttcttctcatacaccgttgtcttagggatgaagattccttggcaaacagctttggccggtgtgtttgtggcttccatcctatttatgattttaactgcctttaaaatccgtgaaatggtcgttgatgccatccctcgtgatttaaaaatggccatcagtgccgggattggtttattcattgccttcatcggtttaagtgatggtggtttagttaccgccaacaaatcaaccatgattggtttgggttcattacacgtcggttcaacttggttaaccattatcggcttactcctcaccattattttaatgagtgctagagtgccaggtgcgattttcatcgggatggtcattaacgtcattgttggtttatcaaccggcttaattcatgcaccatctcaatggatttccggtgttccaagtcttcactccacttttggggtggcactgatgaacgtgggccacatcaataccttacagttagccgtggttgttttgaccttcctactggtgaccttctttgatactactgggacattggttggtttgactgaacaagccggcatcgttaaggacaataagattccacgtattggccgggctttgacagctgattctactacaatggttgttggttcactcttaggaacctcaccaatgggcgccttcgttgaatcttcagctgggattgccgttggtggccgctccggatttaccgctgtggtcgtcggggtattgttcctattaggttcattcttctccccactgctgacagttattactagccaagtgaccgcccccgctttaatcatcgttgggacattaatggcgcaatctttgaaaaacattcactgggaaaagttcgaaattgcagctcctgcatttcttatcttagttggtatgccactgacttacagcatttcagatgggattgctttaggattcattacttatccactgtctatgattgctgctaaacgtggtaaggaagttagtccaattatgtacggtctagccgttgtcttcgtcatcttcctgtggatcttgcaagctggctaatgtggtacaattcaattatgcaaataaaacggcggtttcctttagtgggaacgccgttttaaattctctgagaaatgaggcaatatttgtgactattcaagaacaccaagcgtgggtcaaacaattttatgaagagcgtaactggtaccagttcaatcccctgattcgaatgaacttcttaactgaggaaatgggtgaactgacacaagtcgtccataccattgaactaggtcgtgaccaccctggggaacataaagccactgcacaggagttacgtgaccatctcaaggaagaattatgcgacgtctttgaccagacgttgattctctgcagtaaatacgatttagacccagccgaagtcttccagtacggcgaaaacaaactaaaaaagcggttcgattcagaagcctaacttgaaatttaggcttaagtacggtaatgtataccactgttgtatatctgtatgcagcactcatttaaatatctcaaaacggaggaagaatttacgatgaattctaagacaacacacttcggcatcgactcagtggcggacattgcccgggtcgccgtcatcgctgcactctatgtcgttattacgacggtcttggcagcctttagttttggacctgtccaggtaagactggcagagatgcttaatctattggccatttataacaagcgttatgtaatcgccgttccgctgggcgttgccatttccaacctggcttcaccatacgggatcgtcgacatcatctggggcagcttatcaacttttgttaccatgctggtactctattatgtggctaagcacatctcgaatttctatggcaaattggttgctggcgttttaattgtcaccttttcaatgtttaccatcgcgttggaactggcctggttaggcaacgctgccttttggccaactttctggatcaactggggtaccattgccattggtgaatttatctcactaaccataggcgccatcttgttagtcttaatgagtctgcgaatcgatttaaataaactgtttgattaatttgtaaatacccgctgatcactgctaaacgtagtggtcagcgggtatctttttgctcgttaaaaatcgtaagttccctcagttgcgactcagtgtaaattgctttatggttacgtcaataataatcgcaaccacacattaaggggagatagcctatgtttctagcgttgaaggaaattaaaaaagaaaagttcagatcgtggctaattattatcatgattgtcctcatcagctatctgatttttattctaaccagtttagcaatcggcttagcccgagaaaatactgatgccatcaattcttggggagtcgaaaagatcactctcagttccactgctaacgttgatatgcgacagtcgtttttaactaaaaagcaagctggcacactaacgaaaaatgaagcttatcttggcgaaacacccgtcgtagctgaggctaagggacataaacagcaatcagccttctttgtgggacttaaagccaatcaatttatcgccaaaaatatcaaacttgactctggtcactgggtcaaacattcccatgaagttgtggcagatgactcgttcaaattaaagggttatcaattgggggataagttcaaattagctgacgacaaaaccaagtttactatcgttggatttactaaaaacgccaaactaaacgtgacacctgtgctttacggtcaactaggaacctggcaggcgcttaggggtatcgccatgggcccgattaccagcgtggttgcctccaaaaacagccagcacaaggcgactcaatccggaaccaagacctacacccgccagcaaattatcaataaactgcccggttatcaagcacaaattttaaccttcgtgctgatgatcagcttcttgatgattatttcactgatcatcattgccgttttcctctacatccttaccatgcaaaaattacccaactacgctgttctgcgtgctcaaggtattcctagccgggtactcgtcagcgcaacgatcagccaatctctgatactggttgctagtggcttagttattgggaccatcctaaccgttatcaccggttccgtcattccggcacaagtcccaatggcgtttgatattccaatgctggcagccgttggtttaggaattttgattatggcattggttggcagtctcatacccgtcagaaccgttctcaaagtcgatcccgtttcagtgattggaggctaacacgatgagttcatttgccgtcaaaaatgtgaatcaaatctttgggactgggaccgctaaagtccatgtcttacacgatgttaactttgaggccgaatctggtactttgagtttaatcatggggccatctggctctggcaaaaccactctgctaaccattgtaggcggattgctgaccccaactagcggcacggtaactgttaatggtgtggattataatcaccaatcaaaaagacaacgtgatgccttacgcttggatgaaatcgggttcgtgttacagcaataccacttattaccttacctaactgttgctgatcaatttacgctggtagataaggtgaaaccaaaaggcaatttgtctcgggctcagctagatgaagtactgcaagcgctaggcatccaaggtctactccataaatatcctggcgaattatccagcggtcagcaacagcgggtggcgattgcgcgtgcactgtatccaaacccaaccattattctagcggatgaaccaactgcagcacttgatagtcctagagtgaaagtcgtgggcgagctgtttaaaaatctagccaccgaacacaacaaagccgtggtcattgtgacccatgactcacggctgatggcctttgcggatcagttgtatgaaattagggatggcgtattatcgaaacaggaattaaatcgtaactaacttaaaagacccacatcaaaattcagtgtgagtcttcttatttacagtaactgtttagctgatgttggtgtaatttctaacactttgcgaataaatgggtatttagctttaacatcgttgaattcttgaccctcgtcaacaaaacgaactgttcccgttaaccggaaaccggttccttgataaccatcgcggccctcaacttctcgagcacccactgtgaataagacttggttgttttgagctaaatcatcttcagcatgagtaaaacctgccgctgggattaagatacgttcatcatccgtaacggttaaatatgaattccatgtattcgtaatgtgcggttccgctggcgtccaagtgacaacggaaacgacaccttcgtggtttaatacatcgtgaaatttctcggttaacatgattattccttctttatgttatgacttattccgataatatatcagacttgtggccatgtcaattcgtatgcttctacattgttgaaacgtgttccggcaggcagacagctgcatgtaagggcccccagcacaaatcccaagcccatccttttactttgcctaaacgtgctcacgcaagcagatagctgcatgtaagccaagcccctcacaaatcccaagcccatggatttatgaggggcttggcttacactccgctatctaatcgcttgcgttcacactctgcaccaaaaaagccgccccccaacaatcgttatcagggaaacggctcctgtatctaaaccggtcgcaaacttcacgaccctttcgtacctgtagaaggttatcgaccaacaaatggtaaatcttggatcttaaccgctggggttcgcactcttgtcggctcgagggttaccatcgaataccgattccatctcctgttattcgatgcctcaattctcattttagcagcctaacaaggaaacagtctattacccatttgattctactatcaactcgattggtctagtatcactaaacgtcgaatctttgttgcttcacagcaacgatactacttacaaaaataattggtcttatctaaccttccaaggatataataacctattttgtaaccgattacaagaaatatgtttgccttttttgagtccaaaaatcaccctataaaataggcgataatagccggcaaaaactctgcttaaatcgtagatataacgactgattatcaaacgcttcagctgtcatcaaccggcttaagcgttgatctttctcaaacaattcggctaactgaaccgctagtttttcatcatacagaaaagcgttcacttcaaagttcagtttaaaactccgatagtccatattagctgaacccactgaagccaaccggtcgtccaccaccatggtcttagagtggataaagccgttttcgtaatagtaaattttcacgccatctttggccagttcatgggcataatactgcgtcgctcgataaacaaagggatgatctggcatttgcggaatcatgattctaacatcaacgcctgccatcacagcgattcgaatagcatccatcacactatcatccggaatcaggtaaggcgattgaatccacacccgctttttcgcggattgaatcaatcgaatatatcccattttaatttgctgcaaatctgaatcaggaccgctgctaacgatctgcatgttagtatcacccttcacatgcgttaacggaaaatagcgcgtctcaatatggtcagctggcaataggccttctgaggctgtggcgttccaatccagaataaatctgccctgcaaaccaaaaacggccgaacccgtaattcgtaaatgcgtatctcgccagtagccaaactttttactccgacctagatactgatcaccgatattaaaaccaccaacgtaaccaactctgccatccaccaccacaattttccggtgatcacgaaagtttaaccgaaaatccatgatggctgaacgggctagaaacggttctacgtagccgccagcgtctattagtgatttgaagaaggaacgaaaggcccctaaggatccaaatgggtcataaatcacgcgcacttcaacacccgccaaggctttgcgaactaataggtcacgaatttgcttaccgatttgatcgtttttaaaagcgtaaaattcaatgtgaacgctgcttttagcccgttcaatatcctcaatcatttcgtgaaatagctgcttgccatccgcaataatacgaacccggttcttccgagccaaaaaagcgtggtttgccgtctgaaacatcttgactagtgacgtaactgaattagatactaaatcagccggtaagttttcagttcccaactcctgacgctgctgagccaacaattcatccagttgaagctgaacatcacttttaactttaaacagtttatttttaggtaactgccgaccaagaaacgcatagatgacaaagccaatcactggcagtaaaaaaagtaccaataaccaagcccaaatagcggcaatatctcgacgttgcctaaaaataatgataattgctaaaataacattgatgagataaaccccttcaccaatcattgtcatggtaatatccatacaattctacctcttagcattctaattgtgatactatggggaaaattatagcacacgcatcatcattagctcctagaaaggaagttgaagtttcacatgctcactacaatcgttcccgcaatatatggtatccatggcgtcggtaccatccgaatctttcactggttgttccgcgaaaatccagtgattggttttggcttcttactggctattattctctatggtatctatcgttataataatagacgctaaaatctaaaagggtggcttattcgcgaaaattacgaatagtcacctttttaaattactaataaaccgtcgtcgacaacagcacttctggatcatgattgcataatagataaccatgaccagttgaatcaaaggtcaatccttctgtttcgcgcttgggcgttaatccagaccattcaaacgagctgttagttaatgatccgtgtccgtttaactgtttggctggaaaactagctactgaatcatccgcaaccaaatataaccgaccacgtttttcgttgtagcccatactttgaatatgggtacctggcagatgcttaaagacctgatccgttctcctaaagacaacgtgatgggcagaaatgtggcctttataaacgttcacgccattacccggattactccagaaataggcattcccatacttatcaaaggttaaagtatgaccgccgtgaatgaaaccatgcgaaattaaatggaaactgatggcacgatcaggtttcagcgaactggcactgatatgctgaatgtaaccgccagttgaagttggtgcgcctgacttcgtttcgttatcgcgccacatatatagtgcgtggctcttcaaattataagccaaggattgtccgtgaccggtatcaaacaacccaccaactttaatcgccttttgaacctctttttgtttgtctgagtaccgaccattatgcttaacgtaagtcgattgtaataactgcggatctttttcgacccctaattgtactaatcgtttcatatcatatcgaacaattcggccctcattatttaaattcgttggacaataaacgatatacatatagccacttttagaaatggcaattgactgaggattgccccagggctggttgtctttacccgggtatggcagtaaaaatcgggtcttaaaagtaacgcccttaccgctatacgatttcatctcattgatatgattcgttcgtttcatatgtgcaaagcttttgggtgctttaacatagttaacctttgagttattaagtacgcgcatccttgatggatggttaattaacgctgtggaacgctggttatatactttaacagaagcatttgcaacagcgaattggcccaacattaagcaagcagcaaaactgatcacccctaaaataaaacgtttcacgttatttcctccccaaaaaagattaaacaaaatctaaaacatatattttaataataagacaaaacgacttctttgctcaatacaatctcaaaaatttttccaatatcatctatgaaatcatttgcgccataacaaatcctaattactattcgatactgttgatcgtccggtcgcataatcaagcttggcgcctggttgaatattaaagatataaacattaaaccgaatcgtattgttgccaattgactgcgcctgcatttgaacacctcgtgctaacagttcattattacgaaaaaccggcgtcacacgatacctaacgtaattcgttgggctaagtttaaggtaggttgctacctcagtttcgtaattctccatgccgggtgaattcagcgatcgcgtccccgtcatgagatttttagcgttattattctgacccgtgaactgatagccaatcaaatgacttcggttataaagccaatccgttttcccctgatatgtaaaccgtttgttatgccagcctgtaggatccacgtacaacggttctcgctgggcgtgcggcatgagtgacttcgacagcagtgcatcggctccggtcacccggttatattgatccaaattgtgataagcctgccatggccccttagctgtgctcagatcctgtttagtaaacgtcggtacgttgttattgaccttgaccacttgctgaccctgatagttaagcgctgctaattgtgccgtactattagctttcgtctttccatcagtgtttggctgagacgttgtttgattagtttgatgccctttgaaagcatcaataactgaactggcttttttctgcagctctgtttggctactaaccgaacttgctgtatttgactttgactgattactgtcccccgtggccgaaatgccggcaatgattgccaccgcaatgactagccaggtaaaaaacgaattactgctgcgtttacgtcgacgtcttggcatcttttagacttccccctaaatgttcactaatattagtttaccaataaacatacgttcggtctagttcataattaaaagcgctcatcttcaaataatgcgatgagcgtttagttaattattcatttcttttactttgaaatactgctgttctgcttggcgacgcaactcaaccgcctcatcaaaggactgggtcgaacgatttaacacgtatcggccgtgatacattaaccgtgcgatgtaagtccctgttttcttatcaaatgaaaccccgatcacacccgtatgattccgtttggaacgaattaacgatgaatagccaatgccatgttcgttcactaacgccccgccttgcgcgtcaataaaccgttcattacggcgagcattctgacgtgaaacttctcgtcttaggcagccgcaacttcgggtaatgccctttctaagggcgtaaccttcaacaaccacccgtttaccgcaatcacatcgacatagccaacagacgttaccgtttcgcgcaacggtttgcgcacgtttctcaacaaccaaacggccaaatcgttgatgcgttaaatcaatacaatgactcattcaagattcctccctttaatttaaataagtccccatgacgaatgccaaaatgattaatataattaaccatctactcttactgatcaatatcccccaactcatgcccatattatataataggttggttagactgtgtctctcattttttcatgattttttaaaaaaattggtaaggttttcacgtaatatagtttgaatgctcgtttaatcgatctcagttacccacatttctttgaaaatgcttaactttaccccaaacacttgcgttactgtaactcccactgctatactcgattcacagaataatgaggtgattagtaatgaaaacatcccgaataaaggtcatgctactgagtttaattgcagttttagccatttttctaacggcttgcggcagtcagtcagcttcaaagtcacacgaacaggctagttttaaaaacgaaccggccactactaaacatacagacgttaaatcaaccgttttatcaggggacggcttctggtacttagccggtaagatcaaccataagagtaattccggtgttgaagccgttgcatttgataaaaagactggtaaagcaacgatgtacaatgttgataaattctacaagtcttatagtgcggctaaaaaagcgaaagcactcaacaaggaaggtaccgttaagtataccttcactaagaacaaacagaatcagaccgtgattaagttggctggtaaattatcaggcattgatatgacccaaaccgtaacagtcaaggatacaaccaagggaactaataaggcaactaagctgcaccttagcggttatcatgctgtacgtgatgtcgatatggacaaaactaacgtggtattcgttgaaaccaattaaatcaattaaaactcagtaattacaaaacctgcgctatggcgaatataccgtcatgacgcaggttttaacgtataatggatcataagatcttatattaaaggggggttagtcgtttgtcacacgccaatgcttatccataccaggaaacttttgaacaatatcttaatcggcgagaactcgcacagcctaccatcgctgaataccgttcagttttgactgacctattcaacttcctgagtaatttcaatgccggctatcaggctgatcaccgcgtggcaacgttactggatcgcgatgttgaacagtacctcgctatgctggtgaatcaacgtcacgtcactaatggaacttacaataaaatgctgtcgcacatcaacatttactttaaatacctctttactcacgatttgatcacacactatcccactctaacgctaaagggtaaatcacacgatgatctcaaagcaccaaccaccaaatggctgcacctcatgccaactattttagccaaccagcaacttgcagtttatactcgtctcacaatgctgctatctagccgttattacaccatctcagaatttttaacgccgggattttatcagcagttaaacaccagtgattttaacgcgaatgaacggactttttggcaaacttatcagcagttcattcgaccgctgcaggagcgtcagcatagttcggacctatttttaaaacaacgattagctggtgatccgcatctcacggctgccggccttcacaagtatttaaaacccgatgaaaaactattgggcttctcactgacccccacccgcttataccaaagcgccgttatcgattttctgttgcagcatcccagtcttagcgaccagcaacttagccaaaaactccggctagatccccagtcgctcacctattatcggcaactagcaatgcagtatcgcgggtgaatcatgattaacatcatagcgtcttaaatcttcagaccttcccactgcatttaatcaaactttacggtatgattagggcaaaaggagtgtggtttttatggcaaagaaaacggttactgttgatttcgcaaaactcgctaaccagcgagccgaatttgtaaaagaaaatccttggttgattcctgctggtctagcaattcaaatgatcccactggcactgttgattcatggtcatgttaaaactaacatttataaaaaaagactccaaatcgaacgtgaaaaaaccaaacagttagcacttcagcttcaaaatgatcatccgcacggtcatggtcaccatcgtcaccactctaagcatgatggcaattaccgtaattttgaatcaccagcaccgagacaactttgatgacttaaaatttaaatagcgactgacttccttgcatggaaatcagccgctatttactcgttatcatagatttagtaaaccgatgtcgatcgaagaacctctggattgtgattagccagtagataagcatgacccgatgcatcaaaggttaagccctccatctcacgtctgggcactagtcgcgaccattcaaaagaatgcttagtcagcgacccccgaccgtttaactgtttcactggaaaactaacgatggaatcatcggccaccaaatatagccggccgcgttttgcattataccccatactttggacgtgggttccgggtgcccgcttcagtgtttggtcggttcgccggaatttaacggaatgacccgatattctccctttataaatctcagcttctgaaccgtttaaacaccagaaataagtgttgccgtactggtcaaaagtttgggtgccaccaccgtaaaaggtttttccatgagcccgcagatggaaactaatcgctcgatctggtttcaaagactgggcgttaatatgttgcaggtatgaacgggtagtggtctgactgtcattattatctcgtttccggttatcacgccacatatacaggccattgtctctcggattaaaagccagtgtctgaccatgaccggtatcaaatagcggcccaattttaatggccttttggagctttcgttgacgcttagaatacttaccgtgatgtttaacgtacaccgtccgcaaaatttgtggctttttataaacacctaattgccctaaccgttttaaatcatactgtacaatgcgccctctgtttcgcaaagtagtgggacaataaacaatatacatcagattgctttttgacatggcaatggcttgcggatttccccagtgctcggtacctttaccagggtaaggtaacaacagtcgcgtcttgaaagccacgtgatgcccagatactgatttaacccaattgacttttttagaagctttcatatgggtatatctgcctggcgcagtgatgaaatgtacgcttgaatcatcaacgatacgcacttgagatgagtgataaattaatgctgatgaatgctggtaatgcacgattgaagcagctgccttagtagactgcccccaaaccaaacataaaataaaactcataatgaccaaaataaaccgtttcaaaatcctctaactctcccttttaaagctacttttataataggtcagcgagttaatgcatttcaatggacagtgaacgattttcaaagaatctgccttgtatggttcatttaagcccaataaataacccgatcatcgtcaataaatgatcaggctatcttgttattactgttgtgctgagtcgattagcgtgtaattagctgggactgcgatccggtcctcccgcctaatcgtaaatccttcgtgggcataaaattttagtgcagcttcattatcgatcacacattttaaggttaaattaccgatagcctcttggcgcatgcgctgaatcagcgcatgaccaactccttgatgccgaaattccggcgctacgaaaagtagatggataaaatccataactggtaagaggctggtaaaaccagcaacttgtccgtcgatctctgcgacaaagaccgcttctccccgcgaatcatggttaaaatccgtaatatcaggatgcgctacccacggaaaatacagctgacggtcacgtaaataaatttgcgccactgcttggcgatcacttggtttcattggtcttactttcacttaagtgtctgcccccttattgttcacttcaaaaaaattatagcattaattattaagacaaggtggaaaaacgttaactggaacattcgttttggtttatgtatttaattaattttaaattatatacatagtttattactgcaggaaagccaaaaatatcctcaaaacagttgaaaatccgtttatttgggattatagtagccacataccaaataacctaataatcaatctatattcttttttatagccacaataatggttaaatagaatattctcaagagacgaccgccccaatagacggtcgttttttgtgggaaattatgattaataacctatatattatagtaataatatgatatgaaaatttccaatcattttagttgttaaaaccactctcgttataatttaaccttttcttgactctttttataggtgttttctgctatactagtttcagttttgtgcaacggaggtgtaaccgttattttaaatacttacaaaaaaaagcgcgcttcaaattttctgatcgcacttgtttgtatgctactggtgtttgcaccagcaagccctagcttcgcaaaaagtaaaaaagacacccggatgtctgactatacaaaggtcaaatcagcttacgtcatggatgctaaaagcggccaaacgctatatgaaaatcatgcggatcggcaattaccgattgccagtctatcaaagatgatgactctatatctaacgactcaggccattaagcatcatcaactcaactggaacgataaagtccccgttgataatcaactgattaaaatgagtaaaagctatgccttaggctcttttaaaattaaacactcgaatcaatataccgtcaaagaactctatcaagccgcattgattgcctcttctaattcagcagccattgcgcttggcaaagccgttaccggtggcaataacaccaagtttattagcatgatgaatcatcaagccaaggcctgggggattgatgccaattttgtcagcagttctggtctagataatactgatttgaaacattatggctatcaactatcaggtacttctgacaaggcgcaaaacatggtcagcgctaaagccattagtatcgtggctcagcatttgatcaaggcttacccgcaaattaatcagtggagcaataaagccacgtataagctggatggccaaaccttggtcaacgctaactccatgttaaaaccaggttactattaccgtgccagcaaccatttaaccggtctgaaaaccggctatactgaaactgcgggcctgtgtttaacgataacgtactggcgtaacggtcgagaacttattgcaacgattattggcagccaaagtactttctctgccatgaacggcctgattacgcatttagataaaacggtacgaagcaaacctgtcaccgaagcgtctaaaacatatgatattcaaggacgcaaggtaacggttaaccccgctgaaaagcaaacacgggtgtggtaccgtatcggtcaagatccaaacaagattaacgtcactagcaaattgatgacaacaaaattacccgttaaaaaaggacagccgctaacaaccaccaactttaaccatacggggttaccaagcgttactaaccagaatggtacggctgctgaaacggtgactaaacctgtcgctaagcaaggtaatgccactggtactaactggtttagtcgccttttcgctggtatcgggaaagctttttcacaaattttctaaccttttcactaaacgaacgatctcttaactcacctaagcttatcggtttaggtgagtttttctatcttcacttttggggattatatgagaattcatctttaattttcacaaagttctcatattatttgctatactagacaaatatagaagcagacaaggagaaccccacaaatggatgaaattaaaattggccttgttggcctagggaccgttggcagcagcgtcctcaaaatgattactgaaaattcccataaggttcaaaacatcaccggtcgaaaccttagcattaaaaccgtggtggttagaaacgttgctaaacatcaacaggaagttccggaaggcgtcactgtcactgacgacctgactgccattgtggacgacccagaaatcaaaattgtggtcgaagttatggggggcgttcatccggccaaggaaattattacctcattattaaaagctaaaaagcacgtggtaacagctaacaaggatttaattgcctccgctggtgaagaactagcagtcatcgcaaaacaaaatcactgtgatttgatgtatgaggccagtgtcgctggtggaatcccaattttgagaaccattgtcaccagcttcgcagccgattacatcacggaagttaaaggtatcgtcaatggcaccactaacttcattctgacccagatgcagcgaaaacactggtcctatgatcaagcactgatgaaggctcaggaactgggttttgcagaatctgatcccaccaacgatgtggaaggaatcgatgccgcctacaagatggtaattcttagccaattctcgtatggcactcacatcaaaatgtccaatatgtccgttgaaggtatttcaaccattcagcaagaagacgttcaacaagctgatgcttttggttataccatcaaattactgggaatttcacgccggatcgatgatggcgtttttgccgaagtgggaccggttttagttcctcaggatcacccgctagcaaccatcaacaacgaaaataacgctgtcatggtcactggtaaagccgttggcgaaaccctattctatggtcctggtgccggtggcttgccaactgccaacagcgtgttaagtgacattgtttcagtcactaaaaacatcgtccttggcaccactggtaatggctttaacaattaccaaagccaggttggcaaagttgaccctaaaaacgtcatttatccttattatctatcacttaagatgcttgatgccccaggtcaaatgctgaaattcacgcaaattatgactcagattggcgctagtttcagtcagatcgttcaaactaaaaatgacgatcagaccgcccgagtggttatcattacccatgaaatgtcaaaagcgcaattaaacgatttaaagacctacttaagtaaagttaacaccatgtcgctgctggcagcttataaggtcttgtaaaatagagtgtgaaataagcgtctaaagagtggcgcataagggctcaaaacgaaaattccccaaactttgggggaatttttgttttgagcccttatttaaacacatttatcacacttatggcttaaagcgaacgtcaatatccgctaaagtattcatatgcgtcaatacggattgcatggcatcaatcaagctcagtgccaaaacagcaccactgccttcacccaccgccatttggaggtctaacatcggcgttaatcctagccaatccagcgcacatttagagccaaattctcgggaaagatgagaagcaattaagtggtctttcacgccgggatcaagcttttccgcaataacagcacctgcataggagaggaaaccatccaaaatcaacggtacaccatgttcagcagcgcaaagtatcgcaccagctttagcacctatttcaaaaccgccaaccttactcaaaacgtcaactggatcattaggatcaggctgccaatcagcgatggctttttcaaccaccttagttttgtgtgccattcgttcagtggaaatgactgaaccgcgaccaacaacgtcagcagccgggacacccagtaaaacgctgataatggcagatgctggcgttgtgttgccaacacccagttcaccaataagtaacaagtcattaccttcattaatagtatctaaggcaacgtcatagccggcttgaagacactggatagcctcatcacgggtcattgccggttcctcagcgagatttttagttccccagttgacttttttatcgatgacgcctgtgccactaagatcgtggtcaacacccacatcgatgacttttacgtcacagtgattagctatcgcaagagacgctacggttgtgtggccttcaagggtattaatggactgttcccaggtgacttttcgcggtgttgcggaaacaccagcacgttcaacaccatgatcacccgcaaagaccatcacacacctttttgctgtgcggggtttggtagtttgctggatgccagcgagggtaatcatcagtgtctcaagtctgccgagtccaccggtaggtttagcaagcccatccagtttaaccttcatagcgtgacgttttgcttcagaaataggcgatagtgttggtctaacattaaacatggcggtgcctccattcaagattttcaacttaaatttagcctactctcgactgaaaacgattacaatcaatggtcgtaaagacaacaataataatggcgcaattatcaaaaaagtcactggaatgtagtgttattttgaaaaaatggtagaaaaaacagagtttcaggaaatctagattagatttcttgagactctgttttaaatccagctacatcaacggatcccacggtgctagttcaactggctgatgatctaaaatcgcccgctgctcatccgtgaggtactttttgtgcacaacgacttcgtagacaaactgatccatccagtcatccgtcatcacgaaatagcctttttcaccgttcttttcaccccaggaattttcgactttccaacggttaggctgcccatctacaagattgacgcccgtcaaggtcatggcatgggtcacttcagcttcatggtaggcaaaccgctgtgctttgttcatggataaatcgatgccaaatagttctgcacgccgatagagcttagcgtctaagaaaccttgctcgcgactcatctgctgtagcacatcgttgccaaaccagaccgtttcgccatcctgtagctgagcaatcgcagtcttcttcaaagccgccatatccacgttcaagaattgaatctgcttgccaccagcgacattttcctgactagctaaacgataaagttcgtttaacggcttatcaggtgaattcgtcaccacgacataatcttccaaatcaacgtcaaattcctgctggaaaaaggcagttggcgttaaattagcttgtcggtgccactttttatcgttatcacggtattccagatcgaaagttgctggtggttcaccgaaggaataagccgccattcggtaaacttcacccaccatttgacgccgtttttcatccaattgatccgcgctagcaccatcacgaacgagaccacgtaaaattaccgcatcccgcttcattttaagtgctaaagttgacgcaaaagcattggtatggtcggtattgtaggtttccggcatcgcatacgcaggcatcaccccgtatttttccactaaggctgctgccattggccattgaccgccgtcaccacccgccattttcaggtaaaaggcaacttcacggtcattaggacccttaccagcagtggcgataatctgctgataaaacatatttgcccgttcaactttatcccagaaaaacaggtagttttgcgatagttcaaagtttttcacgtgatgggtctgttcaaacttgtgtcgcagcgtattcaacaacgagaattcccagcaacggccactttgtttttgattggtcacagtgcccgtttctaattcaacggaaaattcccggtgaagccgcactttagcttgcggatcagtggctgcagcgttaatgccgttagtcattacagcacgactgatgacggctgcatctggtcgttgcattaattcttcatgatactgtttaaaatcatctgttgttagttctgatggattcgatttgatcattcaattcaacctcctaataaatagactcattctactgcttttttaattcgcatgcattcggcgctgataagaaagtcctaacgctcccaaactgtagatcaacactaacccggccataggcgcgtaactggctgtaccgaatagccccactaaaggtgacgagataccgccaaacgcattttgcgataaccctaccaatgctgacgcgctaccggcattttgcggtgtttgattcatgataatggaagtggtcaaggtgagcaacattccaataaataacactaggaaccacaataataccgccaccgcaatcagtgggaactggaaccatgaaccaactagtagtgctaagctatccaccaatacgattaccatgccaactttcatttgccgcacttccgacacgtgattaatgcgactgggcaaaccactaccgatgacgattcccagaccattcatggcataaatcaggctgaaagtttgggcagacaggtggaacagctgctggtaaataaaagttgaggctgaaatataactgaataaacagccgtaaactaatccggtaatcataatatttcgcataaatcctggcatcttaactaagttaccaaaggacttaaaagtcgcaaatattggccccgttaaacgcttgcctggtgttaacgtttcaggaatcccaacaacgatgagtccggaaagtactaggccaatcgcaccaaggagaatgaaaatcgcctgccatggtacaaattgaatcatgtagccgccgataattggtgcgatgatgggaaaaacaccgttaaccgcgtttaagatagcgtaaaaattagttagcgcatggccactaaatagatcccgcgccacagctctagagaggacttgaccactggcaccggctaatccctgaatgaaccgcatcacgatcagcatggtgatcgagtgggtcaatgcaatcagaaacgatgctagtgcaaatatcaagaaaccggccaacagcggtttcttgcggccataatgatcactcaacggccccgcaatcagctgaccaaacgccaagcccaataagcaggccgttaagcttaattgaatcaacgatgctgacgtttggaactgtcgcatcatctgcggtaaagcaggtaagtataaatcaatggatagtggccccgtggcacttaaggtccccaaaattaaaacaaagcgaagtcggtgacggttttcagacatgttatcagttcatcccttctaaatggcatcatacttacaatgatacggaaatacgtgaaaaatactagcaaattcatttacaagccaattaacattgtaataaatcaccatgacatattgcgacttttaagcaaaaaagagtaatatagagtgaattaagataacagaacttggtttacaggttctggaagggatataaccactcaatgaaattcatcaaagaaatcgtcataccagtagtgatcggtctcttactggcattcggcttaaaaacgtttattttatcaccggtccgtgtcgatgggccttcaatggaacctaacttgaccaataacgaacgggtctggatgtttaaacaagccaaaatcaaacacctcagtgtcatcgtattcgatgcccatggcgctgatccagaagcgacagctggcacagactacgtgaagcgtgttatcggcttacccggtgataccgtttccttcgttaacaacaagctttacgtaaatgataaagttgtcgatcaaagctttatcagtaacagtgaagcaactactggtaccggtaaccataactggacattacaaacgctggcaaagcagtacggctggggtaaacatgtgacggttgttcctaaaggtgagtacttcgttttaggtgaccaccgaagcgtttcaaatgatggccgttactggggcttcgtgaaaaagagtaaagtggctggcgttgtcaaagtcccattttgggccgggactaaaactcagcgcgccaatgtgaatggtttaggatacgaataaccaacaaagagagtgtggcacaactcggtagattccagaatttaacgtaaaaaggcgtattccgtcgaactttgtcggaatacgcttttttgcgtcaactggccggaatctgagttgtggaacaggtttagactagcttaaagtattgaacaaaagcaaactttaaattgtctttaagtcaagaaaccaaatgaaatacttaccaatatagacttatggcacagcctcttttttaaaatcgatgataccctacgaatgacgttgctgctcttttttaatttgaccagatacccgctgtgcctgctgacgttgacgggacatatctttttgttttgttttgacgtaatttgcgtaaaattccccataatcaaattcgtgatcactgttggttcccccaaatacccgacgttttggacgtttttcactcaaccacttcgccatcgctttttcctccctgcatgataggtatacccgtatgataccagatttcattaatcttgcgtgtattacggcaaatttgtaataacagaacttaaaataatcttccccatagcgtgttgcatccatgatacaaaaatagcgcattgcaactatttcagtgcaatacgctatttataacactttaaaagctatctttcgtcgccttgagcacgcagtaattcacctaatgaaggctgcgtctttggatcaatgtggtacttctctgagtacgccttaacagtatccgcgccatagagtttttcatctaatggcataaaggccgtagcgattggatcatctggcttgatgtaagcattaatgacgattggcttcttgttaccgttagcctgcaggtccttaaccttagcgaaaacctcgtccagatcagccttattcttcaccgtgaaaccaataccgccaagtccttcggcaacctttgcccaatcagcatcggttaaatcgacaccatagaaatgctgcttagattcagcctgttcgtaataaatgaaaccaaagcggctgttggagaagacaacgttgatcactggcagttcataacgagcttcagtaataatgtcaggtgctaccatggcaaaaccaccatcacctgacagtgaccatgcctgagcgtccggaacactgagcgcaccagccatgccacctggtaggccaaagcccatggttgcaaataagccggaaatcgcaaaccgctgattcttattcatcggtaatccacgaacgccccattcagaaacgttcccggtatcaaccgcgtaggtatcattaggaccagcgagttcagcaatcttcttcgttacagcttcaggattcaagcccttactgtcatcttccgcttgttcatccagccacttgtcccagttagccttgttttcttggttagcttttagccaagtgtcagctgggcgagtttcaccagtcgcaatcatatcattcaaataagccttagcatccgcaataatcgcgtagtccacatcaacggtcttaccaatatcaaaggcgttggtattaacttgaataattttaacgtcctttggccagaagttagcgaatggaaattcggaagctaggaagaggatcaggtctgcatgctgtaaagcttcaaatcctgatttagcacctaaccggccaaaggtcccaataaagttaggatgatccgttgaaataaccccagttgcgggtaccgtattcataacaggaatgttgaattgttctgagaacttagtcagctcatcacgtgcacctaataaaccacggcctgcataaatcaacgggtgcttagcttctttgatcatcttaaggctgtcagcaattgcctttggatcaacggtttgactgtagttattagccacaacctttggtgtcttagctggttcatagtcgatttccttcgtggttaagtcttccggcaaaattaccacagcaaccccgctttgtcggtaagcttcacgaatggcttcgttgatcacgtaaggaatctgttcagccgtggttactgtccggttgtaaaccgaaacatcttcaaacattggcgtttcatccatttcctggaagaaattcgtgttcatgactggctgagcaacttgacccacgatggccaatacgggtacgtggtccattttagcgtcgtacagaccgttgaacaggtgagttgcaccaggacctgcagaaccaaaagcaaccccaattttaccagtaaatttagcatcagcagaggctgcaatggcaccaacttcttcatgacgcacctgaatatatttaattttatcttgttctaggtatagcccttcaactgtgtggttaatcgagccaccgggaatcccataaatatggtcaacatcccaatcttccaatactttaactaatgcctgtcctgccatcatctttgtcatctgaatcgcactcctccatcagtttctattagaacttttaattcttaaattgtttaacatggaagagtataagacgaacaaatttaaaagtcacgagattagcttactttttgtaagttaatttttcatattttttacacgaaaaaaattctggtattaaccgatgaaaatcggttaataccagaacaaatccgagatgattgctttttgattgaatatgattgctaaatactaatgaattgctgtttccaacgcagctgcgatgaaaccaccaaccagtggaccacacattggtacccatgcataatcccagtgagccgaacccttgttaggaactggcaggattgtgtaagcgaaccgtgggccccagtcacgggctgggttaatggcgaacccggtggtcgtccctaaaccagtaccgataacgaagatcaagaacccaacaacaagcggtttcaaaccagttgtgaagttacctaaattaagaagaacaaagacaaaaccgaatgtagcgataacttctgacaagaagttgaaaagaggtgacttaattgctggcatagtagcaaaaataccaacagtgttcccattttcttctccttttgtttccttaaagtgtgcaccgaattcaaccattactaatgctgcaccgacaaacgcacctaagaattggcctgctaaatatggtaatacttcattccatgggaacaatccaaagattgcaaatggaatcgtaactgcagggtttaaatgaccatctgagcctaaaagtcccgcaacatatacccccatggtaacagccataccccatgacaggcagacgaacaaccaactagatcccttggcgtacgtcttattcaagttgatcccagcaccagtaccagctcctaacaaaatcaggatcatagtgccgaaaaactcaccaataaaaccatccattagtgacacccacctttatataagtttgttaaacaattaacacactaatattagcatatttgaaagcgctttatttacattattttcactactttacaacataaatgtgcttaatttccgcaaaaaagtgtgatacggttcaaaattttactggtcggctacctcatcatgacacattttttgcagcatctgacgcagcacatattgcttgtttaacggctgaacaacgcgcttttcagccttactgattaacttaaacgtgctgtgaccaagtgtatagtaagtcactgatgaaaactgggaggcaagccgcgcttcaattgattgtaatcgcgtgtaacttgaaggacttgtcacaaggattctagtgatttgatgccccttcagttgagaaacgacctggtcttcctgcgtctgagaccaactatttttatagcacgttagttgcgtcaaatgtggcaaaactgctagctggttgtgtttgatgtgccggttacctgtcagccacagcagttgctgtgctggcaatgaagctaataattgcgccaaactagcctgattttcttcgactgggtacgtcacctgagtaaaccctttagcttgtaacttggccgccatcttttgactcagcacaaagaattctggctgagttgtagcgtgccagtcccgactcaaatagacctgaagcgcaaactgactcgtgatcacaatgcctgttgcagaacgaatccgtgagacttcagtcgacgttaattgagttgccaccagttcacgcaacggcagatataacggcactgtaatttttgccaactgtgactgcagttccggttcgaccttctcttttggatacgtaattaaaaatgccaccgaaaacaccttctcaatcattgattgaatgctataaccttcatcttaccttgcccatcagactgataggttgaatagtggcccgctttgaaattaagatcccaaaataccgtgtccggtacccacgactggtgcatcacacgcaacgtgccaaggtgcgcaacaactaacacgttagctgccgaagccaacaaatcctggtaaccagcgactgcatgcagtacacgttccgaaaaaaccttataactctcagcaccctttggcgtcacgtcaaagggcttttcaatccaccgtgcccacgtaactggatcctgtgcctcaatctcatcagcatccagtccttcccagtcaccaaaccctttctcattcaaatcagcattcacgtaaacggttgcgtttggatgatcatcaataataggttgggcagtctgcttcgtgcgcgttgtggcactgcgtataatgacatccagtttttgacgtcgcagtttcttcgcaagctcagcagcctgttgttgccctttatcatcaagtgccacatccatggacccataaaattttcggtgctgatttaatgtggtttcaccgtgtcgcgttacaaataaggtcatttgatcacctcaataatgccactgtataccagcaggaaaatcacctgcgataactcaccaaaagcgccaatcgtgtcaccgctaaagcccttcagcaagcgaatgttaaaacgccggtaaaaatatccaaacacaacgatggctaaatagcccaccagacccggccactgcaataccgcaccaatgaccacgatagccactaactgagacaccacgattcgccaggttttaacaccgatccagatactagccagcccattatcaccgttatagaccatcttgtaaaacaacagcccaatccctgttttagcgaccatcgtcataactgccgttaacccaatcagttgccacaatggcagctgattgcaaataacgataccgctcccgataacgatcaaataaaagtaaatcagacccaatgcgcccatcgttccaagccgactatcgtgcatgatatccttcatcttttcaggctttcgcgacgaaaacagaccgtcagcggtatctgctaaggcgtctagatgaaaaccaccagtcagcagcccatccgtgacccagtaaatgatccaggcaaaccaaagtggaaaaatactggcaaaaccccagaagattagcgcctcaagacagcccagtaacagcccaaaaagactgaagtactggatattgtttttgaacttgttcgtgacgtccttaatctcgattggaatggaaatccgcgtaaaaaattgtgtgtataaaatcattgcttttcccatggtgacccccaattatttcaactgttgtgacagaccactgatcacaaaatatacgtgatcagctgcctgtgccaagcgttggttcacctggccgtaaatatccctcaaaattcgcgtctgttttgtcgccggcacaatacctaggcccgtttcattggtcaccacaaccatagattgatgagttgcgcgcagggcatcaacaatgtgatcccaagcatcgaagatttgctgacttagtctgtcaatatcatcgctagtcatctgctcaatggcatcatccaaactaaggtgtcgatctgccgccagttgagttgcaccatcgtaaaacaaattggtaataagcatggtggcatcatccagcaaataactatcgtaatgattggccgtgataaacgcgtcaacatcttgataccgctcttcagtagcccagtttttttcagcccgccgtttctggtgcgtttgaatccgcaactgcatttccgggtctggctgagtcatcacgccggtggcaatgtaacatacacgggcaacatctgatagtgactgttcagcaaacactgacttgccgctcttcgccccaccagtcaccaacactaactgactcttcatgatttgggcctcctgagttctgccaccgcagccaattctggaaacgcttgttttaccgcttctgcctgtgtcttttttaccccgactagtacaacggttgctggaccagcagaagtatttaactctggcaaatcatggtcaaccaaatagtgcgtctccaagtgattcgtctgcgccatttggtcaagttcatacgtcacaccctttgaccccactggcagcatatccacaacatcagcgtgcccacgaatttgacgaaccttatcatagctaaaaatctgatttaaatgtgccaccacttcgttaccgacgtatggcgtgcccaatttaaaaacagttaggtccacagtcgctggtttggggatgttagccgtttgaattcggccaatcaccgtgataccaatcgacgttgtgagggtggccatgttatcttctgtactgccatttaacggtatatcggataattgcgcccgtgcaagctctgctttgacaccactgatgattcgctcaccggttggcaccatttcgttaccgaccgtatcaatcaccgtaatgggatgggcgccaaaacacattagctctaaaagtggcacccttaaagaataagcagccgtaatagctgggtcaacggctacaacgtctgcttttttctccccaattccggcactgctgtcacacgcgattaccaatgtttcctctgctgttatcggcgttaacgttaagtctcgaaactgtgtatttatcatatgcgttacccgttatttactgcatcaaaggcgttgttgaatgcttggatcgtctcatcaatgtcttgatccgtatgtttgctagacataaagttggtttcaaactgcgatggcgcggtgtagattccctgttgcagtaactgcttgaagaattttgcaaagtaggccacatcgctggcttgtacgtcatcgaagttgttcactggaccggcgttgaagaagtagctccacatggtaccaacatggtgtaccgtaattggcacgttatgagcatcgccagcagccttaattccttcaaccagacgagtcgttttagctgtcatctcctgatacagatcatcattcaactggtttaacgtgcttaaccctccggtcatggccaatgggttccctgataaggtacccgcatgatagatgctaccaactggcgtaatgtgttccataatgtcacgacgcccgccaaatacaccaacgggaagcccaccaccaacgactttaccaagggtggtaagatctggcttaatgtgataaaggctttgtgcaccatggtaggcagcccggaaaccagacatcacttcatcaaagatcagcagtgaaccagcatccgttgttagctgtcgcaaggtatccaggaattcttgcgttcctggaataacgcccatgtttccagcaatgggctcaacgataacggccgcaatttcaggcccatgcttttcaaaaacagctttaataccttcaacatcgttatacggcaccgtcaacgtatcgtaggcaagatccttgggtacacctggtgaagtattgatgttgaacgtagctagaccagagccagcatccaccagtaaggaatcactgtggccatgatagttaccgataaatttcacgatcttatcgcgttttgtaaacccacgggccaaacgaatggcgctcatcgtggcttcggtcccagatgaaaccatccgcatcatctcaacggacggaacgatttcacgaatcttcttagccaattccgtttctaattccgttggtgcgccataactggttcccttctcggttgccgcctgcaaatcgctaaccactttatcatcagcgtggcctaaaatcagtgggccccatgaaagtacgtagtcaataaacgtgttgccatcaatatcttcaatgtgtgcacccttcccctgcttaataaacagtgggtcaccaccaacattcttaaacgcccgtactggactgtttacgccaccgggcatgtagtcttgagcttctttgaacgctctttttgagttgtcaaaattcttcaatgtgtgtgttcccttctctgatgatttttattttttttgcgcgtccatccgtgcagcaacttccttagcgaagtaggtgatgattaaatcagcaccagcacgtttcaaacccacaagcacttcgttaacgatctgttcttcatcgatccagccgttagctgccgctgctttgaccatggcatattcaccagaaacgttgtaagcaaccagcggtaagttggtgttgttacgaacatcacgaatgatatcagcaaaagccattgcaggtttgaccatggtgaagtcagcaccctctttttcgtcactcttcatttcgcgaatggcttcaagccggtttgctggatccatctgatatcccttacgatcaccaaactgcggtgcgccatcagcagcgtcacggaatggaccgtagaagctggaagcaaacttaacggagtaagccatgattggtgtttctttaaacccagccttatccaatccttcacgaatggcggccacaaaaccgtccattgcgttggaaggggcaaccatatcagcaccggccttcacttggctgacagcgaccttggtgttgtattcgagcgattcatcgtttaataccttgtggtccttcacgataccgcagtgaccagtggatgtgtactcacacatgcaagtatcagcgatgacaatcagttctggataagcagccttgatcttacgaatggcttcctgcacgatgccgttgtcttcccaagcgccggtgccgacatcatctttatgatccggaattccaaaaataatgattgattggattcctaaatcaacgatctctttaatttcatccagaatggtattgaggctataccggtaaatacctggcatagatgcaatttcttccttgtcctgaatcgtagcatccacgaatactggcataattaaatccgacttctccaagtgattctcgcgcacgagatcacgcattgctgcactgcttcttaaacgacgatgacgatcaaatgtaaccataatatataatcttctttccacaaaataatttttaaaaataagtaagcgtaatcattcactaaatatccttattttaacgttgattcaatcaatttcaaagcgccttccgcaattaaagtatcagcaaccttagtcccaattttgtcattaaccgtttcctgcaccgttttgcgaaataggtgggtgccatcgggcgaagccaccagtcccttaaaggtgatctgatccccagccgactcggcaaacgcaccaatggggtagttgcaactgccacccaaggcgcgcaaaaagtcgcgttccacttgcacattttgcttagtggtcgcatcgtcaatggcgctcaataatgccaacgtatcagcatccgtcttgcgacattcaatagccaacgcgccttgcccggttgctggcaaaatatcagccttcaaactcaaccggtataaaccatcgagtgagacttgcagccggtctaacccggattctgccaaaatcacaccatccaaatgttccgttttaattttcttgattcgagtatcaacatttccacgaatcggaatcacttgaatatctgggcgtaaatgcaacagttgaccctgacgacgcagactgttggtgccgattcgcgcaccttgcggcaaatcagccagtcgcgccaactttttgggtgtaatcagacaatcataaggagattcacgcttaggaatcgctccgataatcaaatcatcgggtaacaccggcatgacatccttcagactgtgaaccgcaaagtcgatatcgccactttgcagttccgcttcaatttccttgacgaagactcctttgccaccaatcttttgaaggctatccttcaagttacggtcaccctgcgtcacaatttctttaatgcgaaaggtaatattaggaaaccgtttctgtaaggccgcaatgaccagttttgactgacacatggccaacaggctcttacgtgatcccactacaaattcatttttcataattgcgctcctgttttgctaagtctgttgggagaccaagaatttggcaaataaacgccagatccacgtcaacatcttcctgaagggccaactccttgacccctttgatgggaccgagaatcatctgattaataatgctcttcatatgcttgctgatgaccttacgctggtggacatcaagttctggcaactttcgcagcaaactgtcataagcggtcttttcaatgtccatcgcagactcccgaatctctttaatgacggggaccacgtgaagctgttgttcccatacgtaaaattcatctacggctgcgggtacttgagctgccatctggtcgatcatctcagccttagccttttgattttccgaaatgatagccgttaagtgatcaatatcaaaataggtgatctcagcaggtaaatcttcactgtgcacgttacgcggtacacctaagtccacgatgatcttcaaattagtggttccgctatcaaaaatgtggccgttcagcactggtgatttcgcagaagttgcgagaataacagcatccgccgcgttcgccgccaccgctaatttatcccagccagccgcctgcaccgtttcgccatagttctcggccatctgaaccgctttttcattcgtccgattcaaaatggtgatttcgctaaagcccatggtactagcattcttcaacacgtgactaccaacctcgccaagaccagcgatcaccaggtgcttatccgaaaggtcctgcagtaccgttttaatttggtgtaacccggtctgccccgacgttttggacaactcactcacgcgataggtcgtatgctgttttttagcaaacgtaatagcggccttggctagatgattaaggatcaccccggtggtgccaaggtcacgtgcggtgaagaaagcatccttcacctgacccaaaatctgcggttcgcctacaatcaaggattccaaaccagtcgttacccgcaacaaatgtgccacggcatcttgtttaaagccaatttctgcccatttgctgatttgatcgatggagacgtgaaaccagttggctaaaaagcgtttaatgtaataacggccagtatgaatctggtcaaccacagcgtagacttcggttcggttacacgttgacaagatcatattttcaaggatcgatttttcatcacttaacagttcgttcgcctgagtcagttcttctttgctgaaaactaactgttctcgtgtagtaattggcagatgttggtagttcagactgacgtaaatgacaaacatgtattaatcctcctcttggttaaaccagtgcttgctttcaagccactgacgaatttcttgcttgatctgcttggccttagctggtgacttccccttggttgaaacggttaccagcagattctttgattccacgcgtgcgacgttgaaaaagtcggactgctttttatcactggcatcgttaaccaactgaaaatgtgtggcatcttttgtgacctgctggttaacactgcgattattcgtacaggcaatgataatatccatctcggaaatatcaccggtctcatactcctttttgatccaagtgatcttagcagggtcaatcgcatcacacagcgtcgggctgatcacaaagatgttcgctctagcgtccagtaagccagccactttacgtgcggctaccttacccccgccaatcacggcaacgcgtttgcgactcaggtcaatattaattggatatggatagttcacttgattcacttcccgtaatccacgtcagattcagccaaaatttgatcgattttagccatatccacgttttcttcaacaattttagctaatttttcgtactgggcttccttgtattccgccatggactcattcttggcgtgtaacggctgcaaccctttagcaacccgtaaccggtctagcagctgccgcgtccaagcggtgttgtcaaaaatgccgtggagataagttccccagacactgccatcaccgttcacagcaccatctaaacggtcttcaggttcaccgttgttttcaataatggttgaaaacggcgtggcattcttcccaagagtggtctctcccatatgaatctcataaccgtgcaaggttgcatcctgatgtttcgcaatcgcttgcgtagtggttttttcacccgtaaaggtagtttgaatatcgagcagctgcaaaccatcttggtcagtaatatctgattcaacatgattagggtcatgtaactggttaccaagaatctgataaccgccgcaaataccgacgatctgcgtcttatgtgcgtgcaacgcttgaatctcaggcacaaacccatgtgttcgcagataggccatatcctcgttagtgttcttgctgccaggcaagatcagcagatctgggttacccaggtcttccggcttaaccacgtagcgaactgaaacgtctggttgaatctccaaactatgaaaatcggtaaaattggacatcttctgcaaggccattaccgccacatcaagatcctttgtggcatccttgacccgagacttccgttcaagcgcaacgctgtcttcctcgtcgagatcaacatcggtcataggaatcacgccaatgactggcacaccggtcaatttttcaatcatatcatttccggactttaacaaactggcatcgccacgaaacttattgacgatgatgcccttaaaccgcttctggtcttcttcaggcagcaacttaatcgtcccgtaaatcgacgcatacattccgcccttatcaatatctgccactaaaataacgggtgcgtgggccatttcagccatgcccatattaaccaatcctttggtatccagattgatttctgccggactgccagcaccttctagaaccatgacgtcgttttcagccgccaacgacttgtacgtttctagcacccgatccttcagcgccattttatggttctgatactcaacagcagtcatatccgtgagtaccttgcccataaacaccacctgtgattccttgtccgtcgacggtttcaatagtaagggattcatccgtacatctggggcaactccggcggcttccgcctgaaatacctgagcacgacccatttccttaccatcagcagtgatgtaggaattcaaggccatattctgtgatttaaacggggcaactttaaggccccgattcttcaatattcggcaaagaccggcagcaacccagctcttacctgaatccgaggccgttccttgaaacatgattgattttgcacacatacttgcgtacctccgcttccttatgtaatgaccaatacgcgtgactcacgcactggcacacccgttattctaacttggctaatttagcttgcagcgtcttatcggcaaaaagttctgcttcattagcataaagtggcaaatgcaatttttgatgaatttttacgagccacggctggtcaagcttattcttcaacaacgctttttcatcatcaaaaaccgtttctttttgccctgatttcacaatgtggccggcttgcaaaatataaaagtaatcacaaacttcatacataaaatcaatgtcatggctagacagaataactttttggccccgatcgattaagtgcttgatcagttcaaccattcgtcgcttaccatccgggtcgagtcccgcagtcggttcatccagtagcagccattcagaatttaaaaccaaaatacccgcaatggcaactcgctttttttgaccgccactgaggtattgaatgggtcgatccttaaggtggctaatatctaattcccttaaaatcgtatttacccgctgcttgatctcatctttcggaacatccaaattatgaagggcaaacgcaacatcatctttaacaatggaataaaagatctgctgatcagagttttgaaaaacgatgcccactttttgacgtaactgattcaaaccctttttagaataattaatgggctgattatccactaagattttaccgctggtgggctttagtatgccaaccaagttcaaaaacaaggtcgatttaccagttccattaggaccaatgatacccacgactttggaaccattctcaccaaacttagctgaaatatccttcaaaattgggtgatttttctcatatgaaaaatccacatgctctagttcaatcatcactcatcatcctccccaactttgaattcgccattatacaattttgcatccaacgcatacaccatttgctgataatcagtcatcacttgctgaaaaagcatcttaactaaaataccagctgaatgaatggataaacggaaagtccggtaacctaaccgtaatttttgagcccgataaatctgttcacacgcttcaataaaaatgaagatgaagcggtacatgagcatcgtttcctcaatcatcaaggcgggcatatggacagctttcaacattaaaataatctgctgaaacggcgtggttaaagcgaaccaatatgtgcaaaccaccgccgtcaagacttgtacgccaagccgcagtcctcttggcaacatcaccttagacaccccaaagtagctgccaaacaggtgaatcggataataaatctgactggctttaggtgacatagtgaaaacaatgccaataacacttagtaggagaaagggcaatatcgcatagagccaatgcagataaacacggacagacatctttgtcgcatataaggtatgccagataacgactgcgaggacaacgatcttgattagaatgattggttgaaaggccaagataatgccgagcagccaaagtaggccctttattttaggagaccacttaacgattcgatttgaataagcgtacttatcaatgactaacatttcatcaccctattaacgaccattgtcagaattgtttttagcttgtgcttgctgctgacgttgtcgttctttcctacgaccatgagcgttaccaataatataggcgatcacaccggtccccaaactgccttgtaccgtgaacagcaaactttcaatttcagctgaaggtggcgtccatatcggatgaatccagactttatagctaggatcatttttcttgatctgagctgtcccttcatcatcactgccggaaaatgaaccgcctttggctacgaagaatggtgtgatcacgagaattaagactaataatagtagtatccagttttgcttggtctttttcttcatcccagtgcattctccttccagagattattgctgatcaccaggttgtagacaatcacggtcaaaaacccttcggcaatagccaacggaatctgcgttaccgcgtaaatacctaagaacttgatcacagcaccaccaaccccgttattcgggtctggaaaaacaactgctaactggaatgacgtggtcacataagttgaccaatcggcaagtaccgcacacatgaacagtgatactgcacgactgagtttcaatgctcggcaaattttgtacgtcgcgtacccgacaaatggcccgacaatcgtcattgaaaagcagttagcaccaagggttgttaaaccaccatgagcaagcagtaacgcttgaaacagtaagataatcaccccaagaactgacatgactcctggcccgaacattgcggtacccaacccaaccccggttggatgcgagcatgaacccgtaacagaaggcagcttcagcgatgaaaggacgaacacaaaagcaccgcatagtgccagcatgatcttagcattttgagtggtcgagataacgatttttttcatccggtataacccgtaaatgaagaacggtgcactaaccgcaaaccagaaaatacaccactttggcggtaacatcccttccatgatgtgcatggcatatgcatcgcgaggatacagtgcaaagtacagcaaggagcacaggccaacaatcacgcttacctttggtaccaaatgatttctaaaaacttttttcatttgtttcaccctatctaatattaatcaaaattgatatttcttttttaatatcaacgttgaaaagtatggcaatttcgtttctttggtcaactcggcaaccttaaactgttgctggttagccattgaagcgtttacgattacaattgcctgattcagcaatttttttgatgccagcaactcaaagatttctgaccaatgagttgccactttcatgagaaccacattgtcattaatatcgaccgccttattgatcagcgacatatccgcggttgctggaattatttctaaaagttcatcatctaacaccagtgggattgacgtagctgccgcaatctgcgaataagcagaaataccagccaccgtctccaccgcaatctgattaccaataatatcaagcaagtaactataagtactgtatacagaggcatcacccagcgtgataaagcccacatcgtggcctgatttaacgtctgccacgatttcttcagcaatggcacgccaactggcctgtttctcgctgagatctttgaccatcgggaagcgtcgtcttttgaccgttagttcttctgaaaagtacggcgatgcgattttttccgcgacactcggctggtcattatgggccttaggggcgtataggatgtcaatttgtttaagcgtgttgactgccttcaccgtcattagttcgctgtcaccggggccaaccccgatgccataaaatgttgccatcgttacataccgcctttcgtctcagttgacgttaattgtcgttttagatgggtaatgaactgctgttgaatttcgggatattcgcccatacctttcaactgtgacatcacttgaattcctgcatcctgcaactggctctgccaagaatcaggcgcgtcagaagccatgtcattatgagcgtgattgcccgccaccagcatgaacggctgcaacctcacatgtttgacaccatccgccttaagccggctaatttcaaactgaatatcaggataactttcaaccgcgcccatgtaatgctgactgcccatcaacatgtgatccaagcaagcataagccgtaaaggcactatttgcagtgccgtgtcccataaagagtacagcctcatcagctgccagtgggttaccaatctgctttaaaaaagcaaccgtagcttggtaatccgcaaagtcgtttaataatggccgacccataacgacccgtttgaaatggtccgattcctttgccacggccgtttcaacttggtggtactcaataccaggaatcaggtgcagcgattgtacgtaaagggtgtcatatccgccggcaataatcttggcaagtgcctcttgcggtgaatcaatgctaagaccctcgtttttcttgattcgtgaaacaacgatttttgacgtaaacgcccggaaaatttcggcatcaggaaaagctgctcgaaaggcgttctccgtggcttcaatcgttttgtgacgcgtctcgggataagtggtaccaaaactcaccattaataatgctgttttactcatcgtgcaaagaccttctttaccatttgaatcacgttatcataacttggtttgacctcgataacattcttcaagcctaatttctggcactcattagctaccgtttgacccatagcgaaacaactcattttgctcattaattcacgttcctcactggtacagccggtatagagatcggtaaccgatgctgagcttggaaaaacaataccgtgaaaatcgtttagatcaatattttgattgatcgtttcactttggtatgtcaccaggtagtcggctttggcagcaacgtcgacgttatagtttgacaacgccagccgttcaccaatgaaaacaattggccgtttataatctaatttcttaggatcatacaacccgtctgccagcagaccatcttgctgtaatcggtacttcacgatgtggttgctggccactagtttccagttagccagtgctcgattatcgattcccagtgtcagcaagcgttcctgaaagtagtgaaaggctgcaaaatcagtgacgatcagcacgccgccagcgtcaaagtctggcagttcaaatgccaatggttttttgacccgccgatcaaagaagtttacggctgccccttcatcttggagggcgttaaataattttgaatcctgtttgaacggaatcaagaagtgcaacccctgtaacggccgatgcggctgcagatcacccatcaacttaacaacgccaccaaccacgatcagtgccggtgatgagatgtgcatcttctcaacggtttgaaccacgttggctaagtcagacgagattgaccgttgcttccagtgagttgcccattgaaccaccgcaaccggtgtatcgctggccattccatgcgtcactaactgtttagcaatgttaggcagctgtgccatgcccatcaagaaaacaatcgtcccttcctgatgtgcaatgttttcccaatccaattcttctccgttggctttgcggtgtccggtaatgacgtgaaaactggaggcaaaatcacggtgagtaatgggaatccctgcagccgctaaccctgcaatggcactagtcaatccggggacgacttcgaaaggaatttgatgttgactcaggtactgaccttcttcaccgccacggccaaacacgtatgggtcgcccgcctttaagcggacaactcgctttccctgtttggacagatccactagcatatcgttgatctgatactggctgattttatggtgaagtggcattttacccacatcaattttctctgccacaaacggtgacagtaacgcagggtttaccaaccggtcatacacgatgacgtcggcttcttcaaggcgacgcttgcccaacagtgtgagcagttccgggttgcctggtccggcgccaataagtgaaactaaaccgttcattgcgttccctccaatagtgcccttaattcggctaaacttgtggcccgctccggatattccagtgttggccgtttaatgaccaaacacggaattcccagtttttcacaggccgttattttttcctgaacgccgccacgacgcccagattcttttgtcaccaccgcaattgcgtgacagcgatcaaacagttcaatgttgagctgttcactaaatggtccgcgaacagcatcgatttggtcggcttcaaaaccagcatcatccagcaaaccaattgctttaacggttggtaaaacgcggacatgcaggcgattaacgccaagcttttgggcataatcaccagcagttttactgccagtagagaggtaaaccgtcccagtagttggtcttagataatcgaccacgccatccagatcatcaaacaacttcaagttgggcccttcttctaaaccgtttgctcgttccaagcgaatatacctaatctgatccgtttttgccgccaccatcacggtgcctgagatcacctttgcaaacgggtgcgtggcatcgataatcaacgtgatatcatggtcagaaaagaacgcgtgaaaagttgctggcgtcaatatctgctgactgacgtgcgcggcatgtggtcgtgcaagttctgcaccgtaatccgtagtgaccgacaaaataaacggtgcattgatcttcgtcagataatcggcgacatccaagctttcactggtaccgcctaatagcaagatcacagcgtgtaccctcgcggtgtcaccatgcgaccatctgccacgtaggtattcttgtttcccacgatcacgatggtagtcatgttgatctcctctacatctaaatctttaatggtggtcactttttcgatttccttcttgcgggcaacatccttgccaataccaacgacggtgtcttctgacttgtatttcaaaataatatctaaggcttcacgcaaattatttggacggcccttactacgtgggttgtacaagcaaatcacaaaatcagctttggcagcagcatcaacccgttccttaatgacatcccaaggggtcatcaaatcgcttagactaatgtgacaaaaatcgttcatgagcggtgcacctaatgctgcggccgcaccgatactggcagtcacacctggtacaactttcacgtcaatgtgctgatcggccttagatgccagttccagcactagtccggccataccgtaaatgccggcatccccactggagataatggcaacatccttaccagtctgggcaatctcaatggcctttttacaacgctcaatttcaccgtgcatcccagtgaccacaagttctttgcccttcagcatatcttgtaccaagcgaacgtacgtcacataaccgacgatggtatctgttttttcaatgacgtctaatgcttcttgcgtcattaattctcttgaaccggggccaagccctacgatatataacatatgttttactccttttgagttttatctagtttcatcactattcagcagtttccgactcatggtcatggtgatttcatccagtgcaaagcgatcagtcacggcaggttgcccggtcagcgtttcagcggaagcactggcaacgttgccgacacccaccgttttttcaacaaacgctgattgcgggtaatgctggctcgctggctgcaatgcttcagctgtgtaaaacgtcaccggcacgtttaacgtatcggcaaggtagtggatggcaccttcgtgctgttttttatcaatggatccaagtgcgtaaattgattgccaagctagttgatgctcaatacaaaactgggtaaatacagtttgcatcatggcgtaggtcacatccttgcggcagccgatacccaaagcgttgaccctcggtaccacttgaacgctgttggcacttttatcgaaattgaccttatcggaaacaacaactagtggtacatcgggcgtcgcatccgtcagcgtttccaattgacgaaagccgcttaaatctggaaaaactgatataaaatcagggtcgatccaaatctcaactggttcaccggcagctaataggctgttgtatttcttggtattcatcttgaaatccgggtaccagccgtcgacacgttgcgctaatgtgtccaatgcttggacgtgttccgtatctgtcgcagtggtaatcaccggatctgattccagtaattcggctaactgcgtcgtccacgcattggcaccgccaacgtgaccggataataaactgatcacatggttagcacgttcgtcaactacgagcaccgcgggatccaccgttttatcctcaatcagtggcgcaatcgtacgaaccacgatgccggtggccataacgcagatcacaccatccatttcgtgaaataatcgctgacacgtcttggtaaactgacccttgccaaacgtctgctcattagccacagcgaaccgctctggcagatacaccgtcccttgcatgaggtcggcgatgtgtcgtgccaatcggcttccctgctttgtcagcgcaatcacgccaagttgcggacgctcactttttggcatttttgatgcccttacgataagtatgggtgaatgtggcatcgtagagcttggagtagctgtactcatcacctaagaaatccccaaccatgatcaaggctgtccgacgaatacctgcttctctaactttcttggcaatgtcagccaaagttcccttcaccatcttttcatccggccaagtggctttgtaaatcacggcagctggtgttgtttccttgtaaccgcctgctaatagttcacggacaaccttgttaacaccttgaacggataagaagatcaccattgaggtgtgatgactggcaagtttttgtaatgattcgctgtctggtaccggtgtccgacctgccattcgagtgataatgacactctgtgacacttctggaaccgtgtattccacacccatagacgaggcagcaccaaggaaggagctgacacctggaatacattcatagccaatgtctaacttcttcaactcttcgatctgttcgcgaattgaaccatagattgagaagtcgcccgtctgcagccgtaccacttttttatcggcagtaacggcttcctgcattttagagatgatgtcttcaagtgtcatgctagcgctgtcatctttttcagcaccatccttgcagtaatcgagtaattcaggattaacgagggaaccggcatagatcaccacgtcagcttcggctaaacgtcgatagccttttaatgtaattaaatccttgtcaccagggcctgcacctacaaaacttacaattgtcataatttatcttacctttctgatggcactcacgatgagtgtcggattttggggtttaaagaaatggccttggccgagggcgtgccatttcgcaattcgcgtttcaaccatttccagttcagttacgtccactgactgaagatgtttaaacgcttcaaacgcattctcttgcaaaataaagttcagtactaacgcaccgccgtctgccaaatgagccactgcaaagtcaataatggcggtcaaattagagccactgccaccaacaaaaatggcatcgtattgctgatctggaatatcggctggtgcttctccttgaagcagctgaatattcttggtcttaaagtgcaccatattttcttgcatgatggcaatggcatcgtcgttcttctcaatggcagttacctgcagttctggaaattccaacgctgcttgtaaactgacactgccagtacccgaaccaatgtctaagaaactggttttaccctgcaactgaagcttatccaaactaatactgcgtacttctgatttggtcatcggaacctttgtccgtaaaaagtcttcatcacgcatttgttataatcaccacgttcatgttgtattttttattttcaacttgttcaggctgtaactggctgatccgttcttctggatagctcagttgttcgccaatatagatggtgcgctgttgatgtcgactcaacacctcttgtgcaatttggtagggaccaatttttgcatcggtgaccataccaactgttgggtgtgccaacaagaagtcaaagtcgggaattcgaccgtgactgctagtaaagtacgcgtcgttcatcggcagtcccacctggttaaacatgtactgaatggaactgatacccggaacgaccgtcacgtggtcactgccaaattctcgtagtgtccaactgccgataccgtatagcaacggatcacctgacgctagcagcactacgttttggtcgtattgttctaccaacaattttttgaggatcgccagtttgggcaataccaattgcttctcacttggaagatcaaaacccgctaattggcgtttcgatccaatcactaaatctgcctgagctaacagcttctcggttccgcgtagcatcagatctgggctacctgggccaatacctaacacagtaatcattgccaatccgcctcaatttctttcagtggcttagtagcagctagaaaaccggtgtctcgtgagaagatgaccgcgtcaatttcaacctgaggctttttatgcgccagcaacttttccgcgcgacccttgatcttatcgacgatcgtctggtacacatcctgataaccagcctcattgatcaatttgatcattgagatcgtggttaagcagccgtagacgtttttcattagatccagcggtgctcccattaaagcaaggttggcaaccataatttccgctctggcgtcagcatccttactgtgggtcgaaaagatacccccggcgaccttgatcatcttaccgaggtcccccaccatgagcaccttggtaaaacctaatcgctgaacttctttaagtacataaccgacaaagttactcatctgaacttgctttgtgaccggaatatgcatgtcgtcctttaagaaatcttcaccgtagttaccaggcgtcaggattatctcggtgtcaccccgtttgcgatgaatattcatttcaatggaaatggagtgcttccaagattcctcagacatcggtgtcacaataccactggtgccaagaatggaaataccaccaacgattcctagcttagggttataggtcaatttggcgaccctttcaccctccggtgctgagataatgatgtcagcaccccggtcaggaccaagcacatcgcgaacaccttcttgaatcagcttataaggcgttgggttaatcgctggcattcccggtttattagcgagaccatcctgcgtcacgcggccaatgccttcgccaccatcaagtgtgatggtgtgatcaggtcgtaacgtaaccgtcgaatagatcaacatgccgtcagttgcatcctgatcatcaccgccatcttttttgatggcaacgctggcgtgattgcggtcaaacgtgcaatcttgaacgtcgaactgaaccggcgtcccgttagcagcgttgactttcacaacggctggcgctttttggtcaaggatcgcctttgcagcggccactgacgctgcggttgccgtggtacctgtagtgtagcctttccgtaatttacggccattatagtaaacatagttatcttctggttctgacatagacgtcacctacttcacaagttccaagttgtataacaccgcgttgaccatagcagcggctaaattactgccgccttttctgcctagggcaacgatggctggaatatcactttcgtagagggcctgtttactttccgcggcttccacgaatccaacgggcacaccgataacggcatctggtttcaacttgccagccttagtcatctctaaaatcttgtacagcgcagttggcgcgttaccaacaacgaaaactttttccgttggcacttcagctgccacctctatagccgccatagaacgggtaatgccgcgttcctttgctcgagcgaacacctctggttcactgatgtaacagtggtaatgacagccaatcgcatccaatttacgtttgttcatcccagcgagcgccatggtggtgtcagtaaagagcgtcccgccattttgcatcacgtgcgcaattttggcgatggcgtcgtgggtaaacttcaagttcttgaggtagtcaaaatccgcggtggtatgaattgcccgtttgatcgtagcttcctcaatcgctgaattgaatgtataattgggatcaattttgtcaatttcgtcttgaatcatttcaaagcttttatccgtaatttgatttggaatcgtaatgtaatcactcatgcaataaatcctccaatgattaaaaatgcgaagcgacaggcacagaccaggagcaggccgatgaccgccaccagataaacaagtttgagcgtgtttttaatggcgctaaagtcagccgtcacagcatctggattaccaataaacggtttgtctacaatttcgccaaagtagtaatgcgggccacctaaacgtaggttcagcgcgccagccaccacggattcggaaaaaccactgttcggactgcgatgatgttcccggtcacgtcggccaaccacaaatgcgttatgtacatcaaaccgcaacagtaccgtggcaagcatcagcagacaccatgtgatacgagcgggaatgtaattaaacaaatcatctaacttggcagaaacaaaaccaatgtcaccatattgttcgttcttatagcccaccatcgaatcaagtgtgttgaccgccttgtaggccaatcccaacgccggaccgccaatcgccaggtagatcaacggggcaatcaccccgtcgctggtattttcagcatccgtttcgatggtcgctttacaaacatcctcagcggaaagctggtccgtatctcgaccaacgatcatacccacctgatagcgggccttttttaaatcaccctgttttagactgcgcatgattttgcggctctcaatcgacaaacctttgatggagagacacgtgtaacacaggtaagtcccaaggataaactgcaaccagggtaccgaccgcgtcagccacatgagcccaaagatgatgctccatgtgccgccaacgataatcacccacatcaagccgccaagcgaccttctcgtcatcggtgaaaacgtcggcttgttccaccacttggtcaagcccgcaatcgcgtggccaatcagctttaccgggtgcggccaagtcggcgggtcacctaaaatcagatcgagaataaagccaatggcaatcatactaatgactcgcatgaacacgcgcccccaaccggttcagcaatccgttgaaaacggccttgctctggtaaaaatgaacgtgcaggtaactagcaaatgtttgtcgaacctgataaccgcccgtccactcatccgcaacgacgccatctcggacctttctcatgcgaagcaccggctcaagcccggcattggctgtaaacactgaatggtgaaattcgtgaccaacaagtttagtaccagccgcaccaatgactgtatcgacagccggcgacgcctcgcagtaaccaaaccgcttcaaccgtggcgtcatttcactttcaccatccaatagtcccagcatgtcaaaggtgccactgtcagtggtcaaccggttacccaaatacattaagccgccgcattctgcgtagatggggtggttcgcttgtgaaaaggcgcggatagcctgcttcattgtggtattcgctgccaattccgccgcgaattcttcgggataaccgccacccagatacagcgcgtcgatgccgtctggtagagttttgtctgcaatcgggctaaacggtttgagcgtcacgcccgcttccctaagcgcttccaaattatcttgatagtaaaaattaaacgcatcgtcttgcgcaatacctagcgtcaggtcaacttgctgggtcacgattggagatggcagatgcgcgtctacgctagttccggctaatgtcagcaactggttcaaatcaatatgggctttcgcaagttgacctaactcactgatttttgaatccaccgctggcaattcgttgtcgggaactaaccctagttgccgtgacggcagtgataacgactttttaaatggcagatagccaagcaccgggacgttttttacgtaacgcgtaatagcacccttgatgagttcaaagtgattttgactcatcacgttattaaccacgataccaacgattgggacagccggatcaaattcgacaaagccctttacgatagctgcaatggacgttgacgctgaccggccattgaccaccagtacaacgggaatgtttagcatcttggcaatactagctgaggaatgagcatccttatccgtccccaatccgtcgtagagtcccatgacgccttcgacgagtcccaaatcaacatcgctggtatcacgttcaaagaggtactttagcgagtgcacatccggtactaaaaaactgtcaatattgcgtgattggcggcccgtgattcgcgagtgaaatttagtgtcaacgtaatccggcccaattttataaggctgaatccgtaacgtgtcgctcaaggctgataaaatacccagcgtcacactggttttgcctgaaccactcgttgctccggcaatcattacctttttcatctaaccaacccccctttgcttttattgtgtcaacgactgtaaggcagcaatcaactgttcgttttcagcatgaccacgtaccgctacccggtaatactccggacttaaggccacgtaatcagaacagtcgcgaatcataatccctcgttgccaaagtcgttcgcgtaattttggaacgtcactctttaataaatagtagtttgtaaccgatggaaaaacggtcagataacccacagtctgtaatgcctgatacaggtagggcttttcggctcttagccaatcgtaagtacgtttaatatagtccgtatcttcatacatatgctcaccgaatcgagcggccatggtgttcaccgaccacggttcctgtgtcgcagttaattgtgcttttagccgttcatttcgcgtcaatgcaaacccaagccgcaagcctggaatcgcaaaaaacttagtcgctgatcgtaaaataatcacgggatccgttggtttcatcaacgaaacataactgagggcatcatggtcgattagatccataaaggcctcatcgagaatcaaccaaacgtcgtgtcccatgcaatagccggctaactgttgtacatcagctggtttgaccacttgaccacttggattattgggattacacaaacagatcaaatcgatatctgggtgcgcctctaggtgtttcaataactgatggaccggtacctgaaaatcgtttgccggtgtcagttcaaaatgtgaaaccgttgtacccgcacgtgtcagcgagcgttcatactcaccaaacgtgggggccagcaccaatgcatgttttgaatgcaaagccgtagcagtatcaaagatcatttgaactgcaccgtttccaacaaaaacatcttcagccgataagttgaagtggctgccaatcgcctgacgcaattctgggtactgcgggtttggatagtagataacatcatccaccgcatccgtaatcacctgcttaagccgaggtgacaaccctagtggattaatattggcactaaagtccaccagcttgtctgctgaaacgccaatctgttttgcaattaattcgcggttaccgccgtgtgtgactttcatgctaattactccttaagaagctggcatgcttcatattctttggtaaaaaggcatagataatttctgcgatgacgatgttaaaaatggttgccgccgtcaatggaacgaacagtgcgaagatggcgccatgtaataacgggtacagcaacgggacttccagcggcgtattaatgatgtatcccacgatgtcggaaatcaaaataataccaaacttatctttaccgaaccgttgacggatccatccgaaaacaaacatgcagactcccatcatgcatccaatgataaggtgtatgggtaaagttaacggaaaaccagccatggcagctgaggtcaagtgaccaaagacacctaaaaacgccccaaaccacggtcctaataaaatagcaccgagaaatgctggcatagaatcaaacgcaatcgaccccatgatcttaatatttgccccaaccacacaaagggccagtagcatggctgctaaaacgattctttttaatctggctgaatcacccatatgactatataacctctctttcgtagatatcgaaataataatgttggcgcttacataatgtgacattcggttctcactaaaaatataaaagcttccctcccccatttcaacgacttgtgattcacctaacaatttatttgcggtgatttgactatctcttcaaaatagtattaatttatttgctaatagcaaaatattgcatgatatttttgtgtgctcttaaaaccagaatggcgtcatcattgtaatctacactatgctttgtttttgatagtcgttttttgagctctcatttataagaaattctcgtcgaaaccatactattttagcgttattttaaattgactatcactattttgctatcagcccttatttttcagcttactattactttagacgccgtcatatcagcctttattaagattaacaaccaagtaattcttttagagttatattatgtataatgatggaggaacgtaaattcatctgaatatttcaggaggtttaacatgaaaatttacacgaaaaaaggcgacaagggacagacccggatcatcggcaaaaagatcgtcgataaagacgatgcgcgggttgaatcctacggtaccgtcgatgagttaaattcttgggtcggctacacaatttcgatcctcacgccagaaacagccgttttaaaagatgagttggaagagatccaacaacagctgtttgatgccggtactgatttggccactctaaacgacgaccctaaacgagacttcatctttaacgcagatgccgtgaaatggcttgaaggtaaaatcgacacttataccgaagctgtgccacccgttcagaagtttattctgccaggaggcaaccagccagcttcagcattgcacgtcgcccgaaccatcacacgtcgcgctgaacgcaacattgtaacgctccaaggtgaagacgacattaataaagacgtgctggttttcattaaccgactatctgattacttcttcgctgctgcccgctacgcaaacatgcttggcaagaacgaggatattttataccgaaatagcaaacccgtctttcggtaaactatgtttgctaaaaagcgacttattaagaaatctaattagatctctcgataagtcgttttttctgtgaataattaacactttcaccttaaattgaaaagattatcccaaactgtgttcatttccagattgcacaactgactggttcacgtgcaccgtactttcagtattggcctcattcatccgttcaaagatagcctcttgatgttgctcagcctttacgactgcgtcatcctttgctttcaagttaaacactttccagataatcaaggcagctgaccaggtaatcacaaacaaaataacaaggagaataccgagaatattaaagttcagcgactgtgcgaatttaatgatgggattatgccactttaagtacccgccgattgcctgcagcacgtccacaataccaacgaaaaacgctgcggtaactgataatcccgtcagtgcgaagttgtaatagacctttcggaatggtgaggagaatacccaactgtacgcggtactcataaatagaccatcgcacgtatccataaagcacataccagaagtaaataggattggaaatgagaacaccgcgaaccacggaatccccttactagttgcaacggctgatgtagcaagaacggcaatttgggtagcagtatcaaaaccaaggccaaataaaaagccaacgcagaccacttgccagttgtgcttaataatgttgagcatcttcttaaaggttctgaagattcgcgtatcggtggacgcttgtgccgtggagaagtccccgctactgattgctttaaatgatttccagatgccaaacaagataattaaattaatcgttcccagcagcaacagcataaacccggcaaaaagtgttcctaacaccccaccaacattctgaaacttcggcagctgtttcttagaccactcaacgaaaaagatcgtcagcaaagccataatcacgaccactaatgagtgtccaaacgaaaaatagaacccgacgccatgagtgtttttaccatcgttaatcagtttacgcgtcatattatcaatagcagtaatatggtccacatcaaaggcatgctgtaaaccaaaggtaaacgatagaaacgccatcgctaataaggatggatagcggctaagatacacaaagacgagtccccacccgatcacaaatagaaaaataacgtaactgccaaatttcaataaatctggctttaatggataatgagtcattttcgattccaattgtaaaacctccgtggtggtcggcaacattaggtagtcataataaggattaacgttgtgactaacgatgtcgttaccagtagtttggctcagtttgaaatgctgtttagtaattcacaatctaatgaaaaagacagtattgatacgagcccttcgaacacactcaatataccatcggcaatcccaattatcttgtacgcttgacctttacccagttgcactagcaatgtgtgacatttttaacgcaatccaataaagcgctttcacccaccacatcaatctcaacctagccttcatgattggagatggtattattttgcgtttctatcgacaaaatcatcatgatttaaggcgaatattttgttaaaaggtgaaataaaacaatattgaccaattttcaaggccgcttgtctactcttaaaattctgtaccaaaagaattgaaaccactgatttaacagtcattaaaccgtttttgccaaacatttcaaccagtatttttctaaaagtccattgtcaaccaacatgataataatttcacgattgccgtttttatagaaatttctgtcttttttttgcaccaaaaaagcccaccacaacactaattcgatttgaattgtcgttgtgataggttttctatttaatccaatattagactgtcctaacgttcatttaattactgaaccatgtccgcataatttttatacgttttgaaaaatgattctacgtaactacatttaggaatgattttaagctgataggcctttgccatggcaatgactttgagaaccagttgctttgcgatcccttttccgcgtagttcgggctgaacagtggtactcgtgacggtcactgcgcctggcgtgtcaaagttaaatttaatttcagccacaatctcaccagcatcatttttatggtagtaatgccccttaccaagcgttagtgacagtggatcagtgctatcgtctagaaattcgccaacgctcgatgacagtgacgtcacgtaaagcaacttaacaaatgcatcgatagcggactgcaagaacccaattgtcccttcgcttttaatcatgtcatgctcatcaaacatggtatccgtgtgtgcaaggtacacttctggccgctgaactggaataatgttcaacgtagtaaaagtctgccgcagatgatggtttgcaccgtatccaccagcattaccaatggaatcagaaaccactaaagcaactcgaccgccaaagtggttcgttggtcgtgagccaatatccatggcattctttaaggctcctggaatcgaccgattgtactctggtgtgacgattaataacccgtccagcgtgtccaattgattcctgaaacgattccactccggcacgccatttggatcaagatcatcgttaaataatggcagcacacccgtgtctaaaaattctgcttcaatattgcttggtagtaacgatactaaaaccttagcaatcttttttgaatatgaccccttgcgtaaactaccaacaaatacacctatttttttcaagaaaaccacctcaaaaatatctatagattgacaatctgcgtctaacacattaattgtaagcacttacattatatgacgtgatgcgccaaaaagctcgtatctgagcaagttggatataataagattattttttcaaaatagtcttattcatcattcgccatcaccacgcctaacaccactcaatacttttcgaatagcgccttgtcgcataccccttaatattgttgattataggaccaaacgtatgattgattgctagcagtatcaacggttatcttggtcacactagtattgccaggctccggtaaagccattagattggctggctgcaagaccgccatagctgctgctttaatcgtaaagccatgggtgaccacgataatggcttggtcaggatacttgcctgcaaattccgtcataaacgacttggcacgatcagtgatcgttttaaaggattcgccatgtgcatgactagcgtacgttggcaacacatcgtgaaggctgtggtcgaacacatccggatattgtttctctaaatcccggtttttttgaccatcccagtcaccgtaagaaatttctaataaccgattgtcatagctgattggtaattgcgcgttttcattcaaaatagcagccgtttgctttgtccggttcagcgggctagccaccaactgatcagcgaagctaatatcgaaatgatcccgcaaatgagctgcctgagtcagccccacttcgtttaagtgggtaatttctgtgtccatcgtcccctgttttaacccttgaacattcgccgacgtttggccatgacgaatgaaataaaagtctgtcatactgcgccctccgttcttcttattctgccattattatgacatattattccaggcacgtctgcaaaatattaattaaaggaaacgacaaaataatcataagtaccgtacccgattgagtgtctgcttacacaccttgttttctgaaagattagtcccatccgttaggtatttgccattaccatcctcgctgtaccacaatctttcaaattttgctgatgaccaactaaacaagataagcgcttgaatatgtgcattacatcacttagaatgaaaggataaacaattaatgaaagcggatacagaggtcctataatgttagcactgattattacggggatagtgtcatttattagctcagacttagacgacattgtggttctaacactcctctttactcaagaaaaaaagtatcaaaaatatcaaattattttgggacaattattgggtatcggcagcttagttgtcttcagcttgctgattgattatggcctcagtttcttaattagcgggttgctgaaatggatgggcttcttgccgattttcttggggattaaatattggttcgactattattttcgtagtaaaaccgataacagcagtttacctcgatcaatcaagtacaaccgatctggcatgattaagattctcagtatctgcttgctgacgatttcaaatggtgccgataatattggcatttacgtcccattattttctcagtataaccaaaccgaaacggtactaaccattggtgtctatgccatgatgacgctgatttggtgctttatcggctataagctggccaatttaccagtgttaaaagaaaaaatcgaggaataccgaaaatggatcattccactcattttcattgcattaggtatctacatcctcatcaaaaataacgcgttttaaacgcctatcatctcaaataactcattaactatggaggccttttaacatgaaaagggcaatgttcatcggcccaatcggctgtggcaagaccacactgattcagcggctaaacgaaatggaaattaagtacaacaaaacgcagaccattgagtattacaacgacatcatcgatactccaggcgagtacgtggagcaccgttttatgtactcgaacttgatgacttcagccattggagctgatattattgtgttaatgcagagtgccactgatccacgggtaatcctgcctactggctttagttccatgttcagcagccccaccattggcatcgtaaccaaaaccgatgtggcaactgataaagatgtggccatcgttaaggaccgtttaaacgatgcaggtgctgacccgatcatctccatatcatcttacacggataccaatatcgatcaggtctccgcattactcaaataacacaagcaactgttactagaaaatactataacgaataataagaggtaacctatttatgaacgcacacgtcgtatacgcaagcatcactggcaataacgaagacattgccgacattgtttcagatcagctcaaaaaacacggggttgaagtcgatgaaaccgagatttcacaaacggacgctgatgaactactggacgcagatatctgtgtcgtttgcccttatacctatgatgaaggcgccctccctgaagaaggcatggacttctatgatgatttaaaggagctggacctcacaggcaaaatttacggcgttgctggctctggagatgtattctacggcgatgactttaataaagctgttgatgtctatggtgaagcatttaagactgctcacgctacccagggtgccgagaacgttaagatcgacttggaaccggtggaagaagacgttgagacactagcgaaatttacggatgcgctagttaaagctgctgagaaataagtgtggtaagggcgtttagttactccctctatcgttagttattcaccattgttttcggtcatttaacacaaacaaggcgtaatgctgccaaaattcgacggcatacgccttgtttgtgttaaattctgaaatctaccgagttatatcacatttctattgccgttcatccacaatttccacgttttgatcgatttcttcgctatcatccgctaaaatcaaagtctggtatttcggttgcagttttagagtcatttgatcactcaaaaaacgcccagaataactcttaatatacattggctgcaaattagtctcaatttcttcgtcataatccttaaacggttgactgttattgatcagtaccagctgaaaggaaacttgcaaggccactaagccatggtgagaatacgggccaacaccatcgtcatagctcaacaggagtcgggtatcatccttcaaatagggtttgatcttttcaattgcttctggtgacagagttaaatgacgtgtcattttcatcgcttctttcggttaattttggctttattatgaaagttgtcatcacaaattacaattaatctgtttcggcttcgcgtcacgttaaatgtaaccgttttattttgcttgtgaatttatggtagaatagctttaattatcgattgctggaggtcacaataatgagcacaaatcagttaacctgtcacgaaacgttaaccactacaagtcaccgcgtgtttagttccgatttaaacgaacacaacaccgtgtttggcggtcgcattttatccctcgtggatgataccagctcaattgcagcttccaaggctgtacgccaagtccaagtcactgccaccatggaccacatgaactttattgcgccctttgtcatgcaggacgccatgttgattgaatcctacgtcactggtactagtcaccgctcattggaagtcttcgttaagggactcggcgaacatttgctgacgggtgagcgtttcgtgggtttcacctgttttgtcacctttgtcacagtggctaatccagccgatccgccattgcctaaaatcattcccgaaacggatgaagaaaagtttatttgtagcgggtatgctgatcgtttagtcgagcgtaaacgagaccgagaataccaaaaagccttatttaaacatttgaatttaaaatagaaaaaagactgaatcctcgcagaatagcgaaggttcagcctttttataatctatctattaatgaattttagcaattctgccccgttcaatatacacacttaaaatcgcaatatcagctgggttgaccccactgatccgcgttgcttgtgcaatggtttctggacgaattttatctaatttctggtgagcctctgtcgctaatccatcgatagcatcaaagtcgatgtcatccggaatctttttggcttccatcttcttcatcttagccacattttcttcggctttcttgatgtaaccagcgtacttgatccgaatctcgatttcttcgataactcggcgatccagcggcttttcaggtgctggaataaaccgtagcagatctttataagtgacccgtggccggcgtaagaactcagcagccaaaacgccatctttcagtggcttttcgttatgtgatttaacgtaggcattcacttctgcagacggcttgatccggacagtatttaaccgctcaatttcatcttcaatggttttacgcttagctaaaaagttgttgtaccggtcatcagaaatgagacccagttcgtggcccttaggtgtaagacgcagatcagcattatcatgacgtaagatcaatcggtattcagcacggctcgtcagcaaacgataaggttcgttggtacccttagtgactaaatcatcgatcatgacaccaatataaccttctgaacgcttcatgacgtaaggttctttacctagtgcacgcaacccagcgttaataccagccatgataccttgtccagcagcttcttcgtaacctgacgtcccgttagtttggccagcggtatacaggtttttaacgattttggtctccagtgttggccgcagctgatatggcgaaaccacatcatattcaatggcgtaacctggtcgcatcagttcagcgttttccagacctttaatggagtggaggatcttttgctgaacttcttccggcattgaagtggacagtccttgaacgtaccattcatccgtgttgcggccttctggttccaagaacagctggtggcgactcttgtcagcaaaacgcacgatcttgtcttcaattgaagggcaatatcgtgggcccacaccttcaataacacccgtaaacattggcgcgcggtcaaggttagcacgaataatcttatgggtagtttcgttggtatatgttaaccagcatgacagttgattcttgagctccaggtagttttcatcaggagtttcgtaactgaagtggttaggttctttatcccctggctgttctagtgtttcgtcatagttgatcgtattaccgtcaactcgtggcggtgtccccgtcttaaaccgcttcagctctaaaccgtatttttcaaggttcttagtgagtttcatcgctggttgagagttgttaggaccagatgagtacatgagctcaccgatgataattttgccccgtgcggctgtgccggcagcaataactaccgtcttagaactgtaatgcgcacccgtattcgtgatgacacctttgcaaacgccatcttcaacgatcaaatcatcgacgatcccttgccgcaaggttaagttaggttctttttccaaggtatgcttcatctcagcgtggtaagcgtgcttatccgcttgggcacgtaaagcccggacagccggtcccttacccgtgttgagcatccgcatctgaacgtaggttttatcaatattcttggccatttcaccgccaagtgcgtcaatttcacgcacgacgattcccttagccggaccaccaactgatggattacatggcataaaggccaccatatccaagttgatcgtcatcaataaggttttatttcccattcgtgcagctgccagtgctgcttctactccggcatggccggcaccaacgacaatgacgtcaaagtctttgccttgataggcttgaatctcaggcatgttgtttcctcctaaataagttttctcttttacttaccaacacaaaactgactgaagagttgatccagcaattcgtcctggtaactatcaccggtaatttcacccagtttattccagcaccgcgtcatatcgatttgaaccagatccactggcattccagcagcaatcccgctcatcacatcgtctaacgcagaactagcttgattcagcagaccaatatgacgcgcattagtgaccataacgttaccgcggcccgtttcaattccttcatcgaagaacaggtgactgatttcgccttctagctggtcgactccttggttttgagtcatggaagccttaataatcttggtatcaccagctaattgtttaagttcagacatttcgagtttgagtggcaaatcagttttatttaaaataatgattcgcttttcatcggctgtgtccgccaatagctgtcggtcttcatcggttagtggctcactagcattcaataccagcaccactaaatctgcagctgcaatagcctttttagagcgttccacaccaattttttcaaccttatcatccgtatgatgaatcccggctgtatcgaccagcttcagcggtacgccaccgacgttaacgtattcttcaatcacgtcacgagtggtcccggcaacatccgttacaatggctttatcttcatgaagcagttcgttaagcaaactggattttccaacattgggccgaccgacgatggcggttgctaaaccatcacgcagaactttaccctgtttggccgttttaagtaactgctgaatcgatgctttaacttccttagccttttccagcagtaatttggtcgtcatggtttcaacatcatcgtattctggatagtcaatgttgacctcaacttgagccaaaacttccaaaatatcctgacgcagatttttaatcagccgagatagattaccatccagctggttcaaagccaccttcatggaacggtccgttttagcacgaatcaaatccatgaccgcttcagcttgactcaagtcgattcggccgttaaggaaggcacgtttggtaaactcaccaggttcagctaatcgcgcaccctgactaataacaagctgcaaaatttcattggtagccactaacccaccatgacagttgatctcaagcacatcttcacgcgtataagtctttggtgcccgcattacggaaaccatcacttcatccacttccgactgcgtctcaggatcaatgatatgaccataattgattgtgtgacttttcactttatccaacgctttacctttaaataacggcatcaccgcttcaaaagcatgatcaccactcacccgaataattgagataccaccctcaccaggtggtgttgcaacggccgcaatggtgtcaaattcacttgtcgtcgtcatgtttatccctccgttaattagttgttcatattttcacgcacaaaaaaagtgcccactccatgcccctaacagcatggataaagcactttgactactttatctatttaagataagaatgattaagtatcataatagactggaatgcggggagtgtcaagagaaaaaggtgcggaaacgagcggttagatagcggagtgtaaggtactgccggcataggtgcgccggtctttggcgtggctatgctggcagtaccttacatgcagctgtctgctcgttggagcccgattaggctagagaaaataaaagacactaaacaccaaaatttccagtcatccagctcctcttttacccagcccaaactggttccaaaaagcagggagttgcacgtaagggcctagtagtctaagcccaagcccatggcttacactactaggcccttacgctccactccctaaccgcttttttccgcaccttttttccgcacctatcttaacgtaatcaccaccgccctcttcggctccgttcctgccgaataggtcatgacatgttcattatccgctaagacactgtgaatttgtttgcgctcaaaagatggcatcggatccagataaactggtttacccgttgccactacttcccgagccatattttcggctaagcgggtcaaagtctcttcgcgccgttcacgataactagccacatcaagcgtcacttctaacttcgagaaacgcttgtgatttaaatagacctgcgccaaactctgcaaggcattgatcgtccgaccgtgcttaccgatcagcaggccctcttgttcagtttcaaaattaatcgtcacatgccgatgcttaacctcaacttgactagtagcgtcaatgcccagttgactaacaatctcacttaaatattgattgagttcagttgcaacttgccggtattcagcctgtcggtcaactgttggcccttcagtggtttcagtaactggttttgattcactatccgtggttatttctggctcgatggttgttttcgtatccatagctgatggggtttcatcaatctggtgatcagctacctcaggttggtctttaacagccggcttaacctcaacttttgctttccgggcaccaataccaaaaaaaccttttcgcggttgagttaatacggtcacctccacttgagatttatcgagctgaagttgttgaagtgcgttttggattgcaccatcaacggtctcgcttgtatataaagtcatgactgcctctcccttcaatgaacttcttaacttatagtatagcatgcgagcggtacgcatttagtagcttttgcaaatggtaatattacaatttcgcaagcgcttgcttttagttttttaaataaaaaaatctcagagcagtgaatcaccactctgagatcgttatttgctttttaaaattaggccgattaattacttacgacgactttgtttagcacgccgcatagcctttttgacttgtcgctcgtgttcgcgtttttctcggttcttttcttcacgttcacgacggatcttccaaggattttgaataaccaaggtttgacccacttggaacgcgttggtaacaacccagtaaagtgaaagtgcacttggcaagcttaacgcggtgatgaagataatcactggtgtggttaccgtcatcatagttgtcatggtattagactctggttgtcctttcatcatgagccatgaacttaaaaaggtgaagatagcagctagaattggcaaaatcaggtatggatctcttgaccctagttgcaaccataagaagtgtccagaccgtaatacatcggtccgaaaaatagcttggtacagtgcccagataattggtaattgcacaaccattggcaaacatccagcaaccggattaacgccagcttcactgtagagcttttgttgctcttcacgtagcttagccatggtttcctggtcacgagatgaatactttttctgcaatgcctttaactgtggctggatttcttgggtctttttcatgcttcgcgtttggaaaatcatcaatggtaagatgacgatccgcacaataatagtaaagacgataatccccataccatacccaccaaagacgtgggctaaccaaataatggctcgggagaagtttaataggacaacaccatcccaaaaccctgtgctatgttcggtaattggttggttaccgcaagctgttagaaaaacggatagcccaacaataccaaacatagtgataaatcgctttaattttttcactagtcttcctcgctataatcgttatcaagcaattttgcaagtttcaaaacgtgaatcaaatgcgtcttgatttctggcattggcatctctgaagttgatggtctggcaatgactagaaaatcaacatcctgtttcaaataaggtttcagctcagtgagtgattgccggatgcgccgtttgacccaattccgatgaaccgcattaccaatttttttacctactgaaataccaacccggaaatggggctgatcttttcgatccattcggtaaactacaaactgacgattagctaccgactgccgtgcttcaaaaacctcttgaaactcggcttctttttttacacggtaagattttcgcatattgcatctccaaaacgtccgcactacattatttttacgcagtataaaaataaaagaccactgattggtcagtggtctatgcagacaatacttttctacctctttgacgacgacgtgctaaaaccttacggccgttgctcgtactcatccgcttacggaaaccgtgcacgcgtgagcgatgacgtttcttaggttgatatgtgcgcttcataaaacttacacctcctgatcctcaggcatgaagccattatttacatctctaaatgcatttctaaaatataatagcatatctaacgccaacatcaaagagtaaattgaaaaaaaacgcactttttaatgaattaaaaaatttgtttcatgatttagggctgtggataacctgttaatttaagatttaaatttggcctctttcaacagagttatccactattccacaggctgtggtttctcaacgatttacccttgttgattctggggactaacttgtgaaacacctgatacatcagcatttgttttgcacaactgcctgtggataaaaatgtttcacaacacttttaaacgagttatacacagccttgtggaaaactttattcctgcctgtgaaacaattatccacaagttcaaaaggctgtggaaaacttttttatggcatgctaaactaaatttatcaatttaatacggggaggaagaaaagtgcttgatttagacacactttggggtgaaatcaaagacggtttccaacaaaagatcgcccctactgcatttaaaacgtggatctcatctgcagaacccgttaagttaacaaacaatcgtctaacaatcaagctaccatctgagctacatcgtgattattggcaacgcaacttaacccagccgttagttgaactggcctatgaatatgcccaagaggatattcagccagtttttattgtggccgatgatgacgaaagctctcaggtatccacacttgaacaccctgcaacagcatccgctccgtttagtcaaagtgctaaattgaatcccaaatacacctttgatacctttgtcattggtaaggggaatcaaatggcgcatgctgctgcattggttgtctctgaggagccgggcgtgatgtataatccactattcttctatggtggtgtaggcctgggtaaaacccacctaatgcacgctattggtaacaagatgttagctgatgatccgaatactaaggtgaagtatgtcaccagcgaggcgtttacaaacgacttcattactgccattcaatcgaagacacaggatcaattccgtgaagagtatcgaagcgttgacttactactagttgacgatattcagttctttgctgataaagaagggactcaagaagaattcttccatacttttaacgatcttcacgatgatggtaagcaaatcgtattaacttcagatcggttaccaaacgaaattccgaagctgcaagaccgactcgtttctcgattcgcttggggattgtcagtggatattacgccacctgatctggaaacgcggatcgcgattttacgcaataaggccgaagcggacaacattgcgattcccgatgaaacgttaagctacatcgctagccgaatcgactctaacgtgcgtgaacttgagggtgctttagcccgggttcatgcctactctaagatggttcatcagccaatcacgactgaactggttgccagttctcttaagagcttgaagcttgaccgtcgttccagtgaactcacgattccattgattcaagaaaaagtcgccaaatattatcacgtttcattagcggatttaaagggtaaaaaacggatgaagaccatcgtgatgccgcgtcaaatcgcaatgtacctatcacgagaactcaccgacagttcactgccaaaaattggcaacgaattcggtggtaaagatcacaccaccgttattcacgcctatgataaaattgctgatgccttgaaaactgacagtgatttacaagcagaaatcacaaatcttaaaaccgaaattgaaaggtagtccgagtcagcaaaaaaagtaatcgatttgacccaaagttcaagtcggctactttttttactcattcgaataggctatgatagataagacttcaaaaagaaagatgtggaaaactcaaaaagttatgcacaagttatccacatgtgcataacttacagtttacgagtgtttcttaaacttatccacagtatccactgccctactattactattcttttatttatattatggattataaggagtcccaaacatgaaatttacaattaatcgtgcagcgttcatcaaagaactcaataatgtgcaacgcgccatttcttcaaaaaccactattccaatcttgaccggtttaaagttagttgctgatgattctggtttaacactcactggttcagatgctgatatttcgattgaaacactgatccactcagataatcctgacaatcaacttgccattcaaagtccaggtgccattgtgttgcccgcacgttttttcagcgacattgttaaacgattaccagaagataacttaacgttagacgttactgaaggcttccaaacagagatcacttcaggatctgcatcatttactattaacggtttagatgctaataactatcctcatttgccagaaattgatgccagcgatgcgattacactaactggcgatgttttccgcgaactgatcaatcaaaccgttattgccgtttcaaatcaagaaagccgaccaattttaaccggtgtccactttacgttagttgataatcagctgttagccgttgctactgatagtcaccggctaagtcaacgtaagatcgaattgccatccgctgcctcaggtacctatgacgttattattcctggtaaaagtttaacggaactcgccagaatgcttggcgatgataatcctgacgttgaaatgcggctgtccgaaaaccaagtcctatttaccattggtgacaccatgttttattcacgtttgttggaaggcaactatccagatacttcacggctgatccctaatgaatcaaccactagtgctgaatttgatgctaaggggttgctctcggctattgaacgtgcatcgttgctgtcacatgaatcgcggaacaacgtggtgaagttgacccttgatccagccaacagccaagcaaagatttttggtaactcgcctgacgttggtaacgttgaagaagctttgacgcctagcgaaatgaccggggaagagcttgaaatttcgtttaaccctgactatatgaaagatgccttacgttcgtttggcgctgcagtgattacgatttccttcacgtcaccgttgcggccgtttacgctggtaccaactgaagacaaagagaactttattcagctgattacaccagttagaactttttaaattaaatcaataagcaaaaacgtcgactcagttcgaaactgaatcggcgtttttttgttaccaacgtttcgttagctgattttagtgacgatttttaggaaattttgggtcataaattggttcgttagttacttttttcaaaaatgagttaatttttaccaattccgttataaaacgtcatttttaagctctaagcgtttttaactagattatggcaaaataccttatgaatatcgaaaatcgcttaaatggctgtaaatgaaactgaaactatacttttacccctaaaaagcgtataattataagagaaaatgaaggtgggtgaagccgtgaaaaaggaagttttcattgaaccaccctttatcaccttgggccagttgctgaaagaagaagcaatcgttagttcaggtggtcaagcaaagtggtatttgaaggaacatgcggttgatgtgaatgatgagccggataatcggcgcggacgaaaactatatccaggagatacggtcgatgtcaaagacgttgggctgttttttattcgcttaaaacaggctgaataagcttatgagattagaagaattaaagttgcatcattttcgtaactatcaagatttaaccgtctcgtttgggccgggtgttaacgtcttgattggcgaaaacgcacagggtaagactaatttgctagaagccatctactttttggctttggcgcgaagtcatcggaccagtaacgatcgcgaattgattggttggcaggcagatacagcgcaggtatttggccgagtgcagaagaatagcggtacgacaccgctagagctcgatctttccaaacatggtaagaaggccaaagtgaatcacttggagcaagcaaaattatcgggctatgtcggccagttaaacgtgattttatttgcaccggaagatttgaatttagtcaaaggatctccgcaagttcggcgtcgttttatggacatggaatttggccaaatgagccataagtatttatacaacacttctcagtaccgcacgattctcaggcagcgtaaccgttatctcaaggaattgggcagtaagaaacagtcagatatggtgctgttagatgttctgtctgatcagctggcggcttacggctctgagattattagtgcgcgtgtcacgttattgaagcgcttagaagtctgggcagctcaggttcatcaggagatttcgcagcagcgagaacaactgtcgtttcactatgaaaccagtgttaaagatgatgatctactcgatacccagcacgtctacgatgcgctcaaattgctgtataagcaacgtcgtgataaggaactctttcagcgaacaacgctcatcggaccgcacagagatgacttaaagttcttagtaaacgataaggatgtttcgagttttggctctcagggtcagcagcggacaacggcacttagcgttaagttagctgaaatcgatttgatgcacgaacagacgggtgaatatcccgttttactgctggatgacgtgctgtccgaattggatgacagccggcagacgcatttgttaacggcaattcaggataaggttcaaacttttctaaccaccactagcttaagtggtgtggcgcaaaaattaatacaccaaccaaaagtatttcggatcagtgacggtgaaattcagactgatcattagttgttttagggatttattagtgaggaggatcacacttggctgaagaaaaagaaacgaaacaagagcgtgctcgcgagtacgatgccagtcagattcaagttctcgagggacttgaagcggttcgcaaacgacctggtatgtacattggctctaccagttcacaagggttacaccatttggtctgggaaattattgataatgggattgatgaagccttggccggttttgctgatgccattcacgtgacggttcaaaaggacaatagtgtcactgtaatggataatggtcgtgggattcccgttgacactcaaaagaaaacgggtaaatcagcacttgaaacggtcttcacgattttgcatgccggtggtaaattcggcggtggcggctataaagtttccggtggtcttcacggtgtgggtgcgtcagtcgttaatgcgctatcctctaaactggatgtcaaggttgttcgtgatggtaaacgttactacatggactttgcctatggccgagtaactaccccaatgaaggttatcgatactggtttgccagaaaacattcatggcacaacggttcactttctgccggattcagatattttccgtgaaacgactacttttgatattaaaacgctgacaacacggattcgcgaactggctttcttgaataagggattgcggattacgattcgtgacgagcgaccagagaagccaactgaagaatcctttatgtacgaaggcggcatcaagcattacgttgagtatttggataagaatactgacgtgttatttgacgaaccaatttacgttgaaggtgaggaaaacggcattacggttgaagtggcactccagtatacggatggctaccactctaacttgctgacgtttactaataacattcacacgtacgaaggcggtactcatgaggaagggttcaagcgggcccttactcgtatcgttaacgattacgcccgtaagaataatttgatgaaagataatgaacctaatctgagtggggaagatgttcgtgaagggatgactgctgttgtctccgttaaacacccggatccacaatttgaaggtcaaactaaaaccaaactgggcaactcagacgctagaacggccacggatcatatcttcagtgaacgcttcatgcagtttatgatggagaacccgacagtcgctcggaaagtggttgataaggggttactggcttctaaagcgcgagttgctgctaagcgtgcccgtgaagttacccgtaagaagagcggacttgaaatcagtaatttaccagggaaactggctgataacaccagtaaggaccctgcaatttctgaattattcattgtcgaaggtgattctgccggtggttctgctaagcagggccgttcacggttaacgcaagctattttgcccattcgtgggaaaatcttgaacgttgaaaaagccagcatggataagattttagctaacgaagaaattcgttcactgtttacagcgatggggactgggtttggcgaagactttgatgtctccaaggtcaattatcacaaactgatcatcatgaccgatgccgatgtcgacggtgcccatatccggacgttgctactgacgctgatttatcgctatatgcggccactactggacgctgggtacgtctacattgctcagccaccgctgtatcaagttcgccaagggaaaatgaaacgttatattgattctgatgaagaattagatgacattttaggccaattaccaccatctccaaagccagttattcaacggtataagggacttggtgaaatggatgctagccaattgtgggaaactacgatggatccagataagcgtcgtctattgagagttgatcctagtgatgccgctgaggccaacgaagtcttcaccacgttgatgggtgacaaagttgaaccacggcgagacttcatcgaaacgaatgcgaagtatgttgaaaacttggatgtctagtttgaattaactgaaaattcactgggggtcattgattgacgggtagttgagtgcccgtgatacgttatgggaggtactaaatttggcgaatgaagaactgccaagtcgcatcactgatgtcgatttagcgaaaaccatgcggacttcatttttggactacgccatgagtgttatcgttgctcgtgcgttaccagatgttcgggatggtctaaaaccagttcaccggcggatcctttacgggatgagtgaattaggcgttacgcctgataaaccatataagaagtctgccagaatcgttggggacgttatgggtaagtttcacccccatggggatgctgcaatttatgaagccatggtccggatggcgcaagatttcagttaccgttacatgttagttgacggccacggtaactttggttctgttgatggtgatggtgcagctgccatgcggtataccgaagctaaattgagcaaggttgccatggaaatgttgcgcgatatcaacaaagataccattgattatcagccaaactacgatggcactgaaaaagaacccgtagtattaccagcacgtttccctaacttactggttaacggtgcttctgggattgccgttgggatggcgactaatattccaccgcacaatttggcggaagtaattagtgcgctgcatatcctgatgaagaatccagatgccactactgcggatctgatggaagctttacctggtccagattttccaaccggtggtgttgtcatgggcaaatccggtattcggaaagcttatgaaactggtaagggaaccattaccttacgggcaaaagttgagattgaggaagataagagtggcaagcaaaaaatcgttgctaccgaaatcccttacatggtcaacaaagcacgcttaattgaacggattgctgatctggcacgagataagcgaatcgaagggatcacggatgttaacgatgagtctgaccgtgaagggatgcggatcgttgttgatgtgcgtcgtgatgccagcgctgaagttatcttgaataacttgtacaagatgaccatgatgcagacgtcatttggctttaatatgttagccatcgttaacggttcacctaaagttctgagcttaaaagagattttgcagtattatctggctcatcaacttgaagtcattcgtcgccggacggaatttgaacttaaaaaagctaaggcacgtgctcatattcttgaagggttacagattgcgcttgatcacattgatgaaattatttccatcattcgtaattctcaaacggctgaagttgctaaaaacgagttaattagtcggttcccactgtctgataaacaagcacaagccattttggacatgcggctcgttcgtttaactggtctagaacgtgacaaggttgaaaaagaattttctgaactgcaaaaatcaattactgaatatcaagagattttggcaagcaaggaaaagcagaaccacattatttacgaagaattactggaaatccaaaataaatttggggatcctcgtcggactgaattaatggtcggtgaagttttgagcctagaagacgaagatttgatcgaagaagaaaacgtgatgatttccctgactcacaatggttacatcaaacggttgcctacgtctgaatttaaggcgcaaaaccgtggtggccgtggaattcaaggaatgggtatccatgacgatgacttcatcgagcacttgatctccacttccacgcatgatgtgctgttattctttaccaatgctggtaaggtgtaccggatgaaggggtacgaaattcctgaatacggtcgctcagctaaggggattccagtgatcaacttgctgaatattgaagctggtgaaaagattcaagccgtcatcaacgtgtctgatgctgcgggggatcaggagaaatacctgttcttcaccacgttgcacggtacggttaagcgaacaccagtcagcgaattctctaatattcggagtaacggtctaaaggctttgagcttgaaggatgatgaccaattgatcaacgtgtccatcgttgatgatgaacaatgcatgattattgggacgcattcgggctatgctgttagctttaaggccagcgacgttcgttcaatgggtcgttcagctacaggtgttcgtggtgtccgtcttcgtgaaaacgattatgttgttggttcagctattttagagccaaatgacaacgtcttcgtcatctccgaaaagggctatggcaaacagacgccagctagcgagtatgccattaaaggtcgtggtggcaagggtatcaagaccatcaacgtcactgaaaagaatggtccacttgctggtttaacgaccgttaccggtgaagaagacattatgctgattaccgataagggtgtaatgattcggttcggtgtggaaaatgtttctcagactggtcgggcaactttaggtgttcacctgattcgcctggatcaagatgcaaaagttgctactatggcggttgttggaaaagaagcgccagcggatgaatctgatgaaacggattcagacgagtcaactgacgatggcgatacatccttagaccggttagttgatcgggcaacggatgatgatgctgattcatcagctgatagtgacagtgatgatagcgataacgaataattaaaaagcaatatttaaaagaacggcaatgatgccgttcttttttgcgtagttagaaagtataaccaccatctcttgtcaggttagtttaaaaaataatttatcgtttaagggttgcggcagctgaattgcggggtgagtagctaactgcgggcaatcggattacagaataacattgcatatttgagcgaactttggtaaaatagcattctgtgagtaatccattcggaagactctccttgctctcttaaaactcaatgaagagggcctgaagtccataaggaggtgcaaatttcatgaagtatgaaattacctacatcattcgtccagatcttgacgatgcagcaaagaccgcattggttgatcgtttcgacaagattttgactgacaatggtgcagatttaatcgattcaaaagactggaagaagcttcgtttcgcatacgaaattggcggttacagcgaaggtttataccacgttgttaacttaaacgctaatgacgataaggctttaaacgaattcgaccgtctttcaaagatcaatgacgatattcttcgtcacatgatcgtaaaacgtgaagactaatttttgacatttaatgactgagaggagcgggtcgtatgatcaaccgggcagtgcttaccggacgcttgacaagagatgttgatttgcggtataccccaagcggggcggcagttgggaactttacgttagctgttgatcggcaatttaccaatcaaaacaacgaacgtgaagctgactttatcaactgtgttatttggcggaaatcagctgagaactttgctaattttactcataagggtgcgttagtagggatcgatggccggattcaaaccagaaactacgaaaatcagcaaggtcaacggatctacgttaccgaagttgtggttgaaaactttgctttattagaaccgcgttcagcgaataataatgcagggaataccaacaacggtggtaaccataatgcacccactggcaatgctcctcagaacactaatccgtttggtgatccaaacaccaatggggcggctaacaataatcagaatactgggaacaatcaagcggacccatttgcaaataatggtgattcaattgatatttccgatgatgatttaccgttctaaacggatcgaattggagggaaaatcatggctcaacaaagaagaggtggccgtcgtcgtcgtaaagtcgacttcatcgccgcaaaccacatcgaatacatcgattacaaagatactaacttattggaacgtttcgtttcagaacgcggtaagattttgccacgtcgggttactggcactagtgccaagaaccaacgtaagttaaccatcgctatcaagcgtgcacggatcatgggcttaatgccattcgttgttgctgactaatatagtgagtgagaaggtgtcaaccagtataaactggttgatgccttttttggtgctcgttgttaagcttgtgaaacaagttttataaattggttaattggtatggtatgtgaaaacaggagtggtatagtaatctaagtatccatcagaactaatggatggtcgtaataactggataatcagacattaaacaaggagcatcacagttaaatgagaaacactaatcaatcagaagaacccaaaaaatcgcaccatcagcaaattgagtgcaatatagaaaaatgctgggtacgtatgggaatagtcaccgtcacgctgttgacagggttcaccttcagcatggcggtgactggtgtccaggcagcggctgaaggggaaggcacaacaactcaagaaaccaaagccaatgatgtttcttcgtcttctgagcagccagcagtttcgagctcagatgaaaaggatcaagcaaaaaatgatcaatcatcagcgtcaaacagtagtgatacttcaatatcaaaagcaagtagtaccacttctagcagtcagtcgagtagctcagagcaatcgtcaggaacttcagatgcatcaagtatagatagttcaagttcatctagtgtggacacttcaagccaatccaatgcaaacaaacccgctactgatgtcaatgggcattcattgaaatttgactcatcgagcaatcagaaaacagcagattcttcgtctgaaactaaaacagtcaacgataaaacagctacgcaaactgctgatgttaagaaagatgctgatggtaactattggctaccagtagctgatgaaaagaccggggttaacacttatacccaattaacggattatagttacagtcaaaatgcggatagctcaacgtatactgttacaggttatacgggtgatttacaaaattaccttgcgggtggaacaacacctgaaaacggctatgcaactgatattacgattcctgatacctataacggtaataatgttacagcaattggtgataacgcttttgataacgaagatggcgatgatccgattgctgtactaacaaaagttacgttaggcaaaaatattacaacaattggtgacaatgcttttgctggtaacgatattaaaggcgaaatagtcattcctgatgcggtaacttcaattggtgagaatgcttttgccaataatcaaatttcaggcactgttaaaatgccatttcaagttagtattggtgataatgcatttgcgaataatcaaattaccggtgttgtaatgggcaataatacttggttcacaggtaacggaacgtttgctaacaacctgattactagtcttgatttgggaacaggcgtgacattaatcggtaaaggtgcgtttgaaaacaatcgactaacgacactgacattaccagatcaagtgggcaccattaatgataatgcatttcaaaataacaaatcattaacgacaattaattttagtcagaaaggtaacttaacgcagattgggacatctgcatttgaatctgatgcattaactgcggtggcgctaccatccagtgtgattaatattggtgatcgagcatttactaataatcaaataacaacgtggtctttgggttatcataaactaagttctgattataaaaatggacaaacgattgggaccagtgcgtttgctaataaccaaattagtggttcaatcataatcccagattcagtaattgaactgggtgcttatgcttttacgaataatgaaattactggagtaagtttaagtgacaaaatcacccaaattaatgattatacttttgcaaataacaaatttacagatcagttagtcattccggatgcagtcactaatattgggaaaagtgcttttttgaataataagattactggtttaatactagataaaaatctccaaacaattgacgataatgcctttgcgaataatcgtgttagtgatacggtcacaattcccggcagtgtatatgcaattggtgaaaatgcttttttaaataatcaaattagcgagttagtgttggataaagcaaattcaaataatcagacaatagccactaatgcgtttgctcaaaataaaattagtcaggttgtcaataactctgggaatgattccgatgactatttaagcaatcagcaagctacggttactgtgaacgcccttgcaaccaccactcaaattgaagatattcgcacaataattaaaaataaggtcggtatcacactacctgaagtttcaacattcacagataaggctggtaaacaatggcagtatgattcacaagcagatacactcactattccaagcggagagacgatgccgaatcaagttacttttaaatttagctcagttggttcggccagttacggaaccaatgatttggtagtcaatctgcaacagcaaaattcaacaggtccagccgtagctgccacaaccaccacggtcaactatgaaaccccagccggtaaaatacaaggcagtgctcagttagtagggactcccggtacaccatttgatcgttataaggttcaggagtatgttccggctggctggcaactagcagactcagttagcgaactaccgctgattatcgcccaagataccaatcgaacagtggttatcccgttagttatcgcatcaagcggaccagccgtagctgccacgaccaccacggtcaactatgaaaccccagatggtacggtacagggaagtgctcagttagtagggactcccggtacaccatttgatcgttataaggttcaggagtatgttccagctggctggcaactagccgtttcagttaacgaattaccgctgattatcgcccaagatactaatcaaacggtgattatcccgctagttgcaaaaaccacagcttcaagcggaccagccgtagctgccacaaccaccacgatcgactatgaaactccagatagtaaaatacaaggcagtgctcagttagtaggcactcccggtacgccatttgaccgttatcaggttcaggagtatgttccggatggctggcaactagccgtttcagttagtgaattaccattgattatcgcccaagatactaatcaaacggtgattatcccgctagttgcaaaaaccacagcttcaagcggaccagccgtagctgccacaacaacgacagtcaactatgaaaccccagatggtaaaataaaaggcagtgctcagttagtaggcactcccggtacgccatttgaccgttatcaggttcaggagtacgttccagctggctggcaactggctattccggttagtgaattaccgctaattattgcccaagataccaatcaaacagtgattatcccgttagttgcgaagaccacagcatcaagcggaccagccgtagctgccacgaccaccacggtcaactatgaaaccccagacggtacggtacagggaagcgctcagttagtaggtactcccggtacaccattcgatcgttatcaggttcaggagtacgttccaactggttggcaactggctattccggttagtgaattaccattgattatcgctcaagataccaatcaaaccgtagtggtcccattagctgcccaaactgggactgaaactgggccagcagtagaaaccactacgacaacggtgaaatatgagacgccagatggagtgacccgaggttatattaccttaattggtgaaccaggttatgtatttggtcaggatgagattatggcacataagccagctgattggcagttagccgtaccagtagatgagctgccgaaactagtggctcagaccgggaatcaaacaatcgttatcccgttggctgcccaaaccaagactgaaatcggaccagtagtggaagccacgactaccacggtcaactatgaaactccagatggtacggtacaaggaagtgctcagttaatcggtactcctggaacgccatttgaccgttatcaggtgctagagtacgtaccagccggctggaaactggcaattccaatcagtgatttaccattgattgtgagccaagcaggcaatcaaaccgtagttatcccgttagttgcccaaagcgatgtagtaacgccaccttcacaacctgaaaacggtaatggtggtggaaccacaactactggccaatcaaatggtcaagtcccaactgatccagagcaacccaattcatcaactgataatggtggtgcagtgacaccacatacgcgaccgtctacttcaacgagtgactcgcaagcaggtcaaggttcggcaggtgaacggtcctcagtaactgtagcgactggtctacacgaagatagtaatagtggtcgggcagttgaagttgagagaacggtccaaacagcgcggttaacaccgtctaagcatcaaacagatccatctaaggcgcaactaccacaaactgatgaagcatcctcagtaagaccaacgatccttggtgtcatattgttgagcatccttggctggtttggtcttgcacgtcggaaacacgaaaaagattaatcaataacttaaatagcagcgcaaaaacgccttcgcaggtctaagcttgcgaaggcgttttatatggattaagttaataattatttttcagtcttaaatgaacgggtcgtcagcgcgataataaacgcgataacagctaaggcaagtggtaagtagatagcgacatgcacaccggctgtaaaggcaccctgagcacctaaatggctggctgcttggccaatacctagcagactagttgctaaagcagttgaaatcgcaccaacaatttgttgcatggtgttcatgatggtactaccgtcaccggatgtaggaccagctaaagcgtttaaggcatgggtttgagctggtgacattgccaaaggacagccgatcattaagacgatgtgggcagcaatgacaaacatcacagcggtatgagcaccagttgttagtaacatgatgctaccgataatagcaatcaggaagcctaaccgagttaaccacttagcaccgaagttatcaaataaacgacctgaaacggcagaaactaaggcgttaacaacaccacctggtagcatgataataccggtcatggcaacgggtagtaacaatcccttttgcatatacattggtaaaatatacatggcagaaagaataatcccgaagtctaacatcaccattaaagcgccagcccgaaaggcaggaatggcgaaaatcttcaggtttaagataggtgcatcaatatgaacctgacggtaagcgtaagcggctaatacaatgataccgaacaataataagcctaaaacgagtggtgagccccagccgtgtgaacttgcgaagctaaccgcggtaacgacgctggcaaagccaacaacactggtcaaaatagataagacatcaattttaggtttcgttaattgaccgacattttctagtgaaatcaaagcaaagatcaaagcaatgactaagaaaggtacaaatgcccagaaaatccagtgccaagaaagcttagctaagatcaaaccggtcaaagtaggtccaatggctggcgcaaacataataaccatggcgcaggcacccatagcggccccaattttagctggtgagaagacttgcatggcaaccgtaaacattaacggtaggatcaagccagtggcaattccttgaatcattcgtccgaataataaaattggaaaacttggtgctaatgctgcaataatggcacctacaagaaaatctgataaaccaaaaataacgacttgccgagtggtgaaccacttggtgattaaactgtttaacggtagtacgacaccaatcactaacatgtagccagtgactaaccattgtgcagttgcagtggtaatccctagactagccattagacttggtaatgcaatatttaacgacgtttcactaaacataccgacaaaggcaccgactagcatactaaccatggctagtgcggggtgcttgacggtaactcgtggccgagaagaggccattgttgcttgctgttccattgaataaattcctcgctttcagaaaacttttttgcacaagtgattacactaacagaaaaaaaccgtcttcgtaagtttttttttaataaatggtaaagttttttgaaattactgttagataccaagctcagatgtactaatttgtttccacaagactagtggtcacaactagctttcatttgtgctaaaatgtaactactattatcatcgacaaagcaggggagtctgaagatggacggtttattttcaagggctaatttacccgaatttttaaggaatagacggttgcgcggtctggcactattcatgattgcactatcaattgcaggaattgttctggcttttttgttctcatggattttagggatattggctttagtggcggtggttactagtttggtattttcctttaataccatgaatgagattagtgctgatatgaaccgttacattgcggatctgtcatttcgaatcaatcgtggcgaacaagaggcgttgatcgatatgcccgttggtgtcatgatttttggtgacaatgacgctatcgaatgggttaatccgtatttgcagcaatacttcggtgacgaagcggttttgagtaagcgaatgagcgacgttgatccggaactggaaaagttaattcaagatcacgtcaacgacaagcagccgcaaacagttacttggagagaccgccagttttcatttttagttcaaaaggattttcgtgcggtttatatgaccgaggttacctactatactcaaattgagcagcggtatgaaaacgaacgaattgctattggtcaggtcttcttagataattatgttgaagtgacgcagtccatgacggatcaggaaatttctaatctaagaaattacgtgaccaacgagctttccgtttgggcgcagcgttttgggatgtatctcaagcggctggacgatgaccactacctcgtgtttatgtacgcgcaagcgatgaaagcagtcgaaaatgataagttcagtattttggatatcattcgcgaaagtacctctaagcaaaacttcccgctgacgttaagtatcggtattgcttatggcggtgcggatttaaacaagttagcagatcaagcacagagtaaccttgatttggcacttggccgcggcggtgaccaagttgtggttcgtgcccaggatgaagaagcgcgtttctatggtggtaagacgaacccaatggaaaagcggacgcgggttcgtgcacggatgatctcacaggccttgcaggagttaatgaaccagtcggatgccatcttcgttcaaggccatcaacagcctgacatggactcaatcggtgcctgcatggggattcggcggattgctcagatgaaccaaaaggactgttacattatcttggatcgcagcgacatacatagcgatgtgcagcggctgcttgattccatcaaagactaccctgaaattaacgatgccattattacgcctgaagaagcgttggctaaaataacgaaacaaagtatgttagtgatggtcgatcattccaaaccatcattatcaatttctcctgagctgtatcaacaactggaaaatcgggtcatgattattgatcatcaccgtagaggcgaagaattccccgaaaatccaatgttggtttacattgaaccgtatgctagttcaacttgtgaactgattactgaaatgtttgaatatcagtctcaagaatctgaacctattaataagatcgaagcgacagccatgctgacggggatctttattgatacgaaatccttctcgttgcgtactggatcacgaacctttgacgctgctagttacttgcgttcagctggcgccgattcggttcaaatgcagcagtttatgaaggaaaacgttgatagttatctgcaacggaaccatttgattgagttggttaccttcgtccacgaagatctggcaatcattgctggtgaagaagatgaagtttacgattctgtgacggctgctcaagcagcggatgatttgctgaacatgtctggtgtggacgcctcatttgtcattactaagcgagatgatggccggattggtatttccgctcgaagtatgggcgaaatcaacgttcaagtcattatggagaagatgggtggcggcggtcacctttccagtggcgctacgcaaattgctgatagcactgtggctgaagttaaagatcagttggtagcgattttgaatagccaagaggatgaggcagcaacaccggcttcataaatagtgtttgttgaaaaggtttaaaaaatcgtactgctgcggttcaaacagttacgatttatggtaaagttattggtataagagttcccaattgggatcgataaagtcttggtatttcgatactgatcgagatgtcagataaggaggacttattgtgaaagttatttttttgcaagatgttcgcggcaaaggtaagcgcggcgaaattaagaacgttccagatggctatgcccaaaactttttaatcaagcaagggaaggcaaaggctgcaacggccaatgcaataagtcagcttaagggacagcaaaaagctgaagctaaacgcgaagaagaagaacgacaagaagctgtatccgttaaaaaagtcttggaagatgacaagaccatcgttcagttaacggctaaagcgggtactgacggccgactgtttgggtcaattccaagcaaacaaattgcgcaggcgttggaaaagcagtatggtatcaaattggataagcgaaagattgaattacgcgaaccaattaaagtgatgggcttcgtcaacgtgcctgttaaattacatcaagatgtgaccggtcggattcgggttcacatttcagaaaagtaatttgaagttcattttctaagggtcgtcggcaaattacgtttgccccgaccctttcgtttatcacagcgaggggtaattaataatgagtgaagggttgagagatcaaacaccacctcaaaatattgaggcggaaaaagcggtacttggggccatctttttaaacggcgatgccctagtcgacgcaatggaacaactgaccgcagatgatttctatcgtcgtgcgcatgggttgattttccagacaatggttaacttaaacgaccaggatgaagccattgatgtggtgacggtgtcggatgaattaaaacggctcaaccagctcgaagatatcggcggtatgccatatattgccgaattagcagcctctgtcccaacggcagctaacgttggctactatgccaaaatcgttgctcagaaggctgttttgcggcgtttgatccaaacagcaactaagatcgtcacggatagctattcagaagatgcgcccgtggatgagttgctagatcaagctgagcagtcgatcatgaacgtcaatgagtcccgaaatcaagccggctttaaagcgatcaaagatgtcttgaattctacttttgaagagattgatcgtttatcgcaacagggtgatacagtgaccggcctatctaccggataccctgatctggataaaatgacaaccggtcttcatgacgatgaactcatgattttagctgctcggccagccgttgggaaaacggcctttgcgctaaatattgcacagaatgtcgggactaaaaccgataaagcagtggctatttttagtctagaaatgagtgccgaatcactggttagccggatgctgtgtgcagaaggcagtatcaatgccaatcatctgcggaccggccagcttgaagagggcgaatggcagaacttaattgtcgcaatggggagtttgtcaaaggcgaaaatctttattgacgataccgccgggattaaaatgtcggagattcgggcgaaatgccgtcgattggataaagagcaaaacggtaatttaggcttagtcgtagttgattacctgcaactcgtcgaaagtaccggtgctgaaaaccgacagcaagaagtttccgcaatttcacggcagcttaaaaaactggctaaggaactgcatgtgccagtaattgccttgtcacaattatctcgtggcgtggaacagcgtcaggataagcggccagttttgtcagatattcgtgaatctggttctattgaacaagatgcggatattgtgtcattcttgtatcgtgacgattattatgaacgggatgatgacgacaacgatgatggtggtaatggcggtgacagcaacgacggggaacaagatgtcggtgaggtcgaagtcattattgaaaaaaaccgttcaggtccacggggaacggtcaaattgctgtttgtgaaatcgtataataaattttcgtctatagcgtatggggcggaaccaaatcagtaaggtgcggaagcagacgcttagagagcgaaagataagggcgaggaaatggaaaccctgggtttggggtttgcatttcctcgcccttatctacagctctctgtctgctgtagcccgattcagctgtgtagaagtaacgaacaatcccgaacttggatttgtgtctcggtgcccctatgtgcaagtttctgccttgttgtagcccgattaggctatgcagaaaagtaaaccagtcctgagcttgaagtgtctcagtgcccttatttacagctctctgtctgctgtagcctgatccagctacacataattaccaacgcgcttgacacacttcaccatccatgcgatactatcaaacggtgccaaaccatggcgggattccaaagatcggcgcattcgtgcgttcagaaggtcggcgggcctgccttttcttatgtctttaaatatgatccagttatcgattgtgatagctggattttttgtggttcggggaaggttatattgctgaaacgtgttcaagcgggcagacagctgcatgtagggcaactcagccataaatccaagaccaggatttacagctgagttaccctacatttcgctatctaagcgcccgctttcacactctacaaaaaagccccaccacattagggattgtggtgaggtcgaggggagtgatagcgtttcttattggtttatcctgattttggggaggaggaaaaatcgaaaaccgttatctgttttaaaagggaagtcaactaatctttcattgactatgtttaaatcataatcaacaaatgtgacagaaatatgaagttttccatgctactttctaaaggaaacgttaaagaaaagtaaagcacggatgcattcaataaacgaaaagaattactatttgtatatattatcaatataaattataaagattcaatcattagttaaacttgcgtatttaaaggcgttgagacagttagttataaaaagatggttgcaagcaaagaataagaagaagataataaaaacgttacataatctaatctaattttcatcaaggcgtttagaaaggatgtttacaatggtcaaacgatacgatagtgataaggtgaaagcattagtacataagatttataaagcctatggatttacagaggagcaaagcgcagcggttgctgaaactttgatttataccgatttacacggaatcgcgtcccacggtgttcaacgtatggtgatgtatgatcacttcattcaaaatggtaaaattcgggttaagagtaagcctgaagttgtaaaagaaacagacgtgagtgccgtggttgatgctaattttggtttagggcagttgaacgggatttatagtatggatattgccattaaaaaggctaaggagcacggtgttggtatcgtaacgaccaagcgctcaggtcactatgggattgccggttattatgccaatatggcggctgatcaaggcttaattgggctatcatcaactaattctcgaccagcaatgttaccgacgcacgcaacacaagcatttgtagggactaatccaattgccttcgccatgccagctaagccacataactttatctatgatgcggccacaactaccgttcctcaaggaaaaattgaagtctatcgtaaactggaaaaggatttaccagcactatgggtggcaaaggacggaaatcaagaaattaacgaccacactgataacgctgatttggatgctttgcgtgatccattatccaacgttggtttaacgccacttggtggcgtaagagaagaaaccgggagtcataagggatttggcttaggggtcatcgtagaagtcttcacttctattttatcgttggggaacacttccaccgaaattacgccagaggatctgcaagttggaccatgtcaaagcttcattgccattgatccatcaatttttggcgacgtagaccaaatcgttcagcgcttttctgactacctgcaacaaattcgtgaattacccgctattccaggtaagacggtttatgttgcgggtgacaaggaagctctagcatacgaagatcgaaagacaaacggaatggtgattgatgataagaccttagctgaagtcactggaattgctgatcggctaggtgttcagtatggatcactagatatggattaatacaaaataagcttagctccaagataaatcgatcgtatcgatgacatctagagctaagcttatttttttggcgaatatgtttcacgtgaaacattattggggattgttaacgccaaagatcaactgctgcgaacatcagtaacagtgtgacgatggtattaaagatgcggtaataacggtggtagaaacgactcatcatttggccaaacaccgtccaaacgaaagtacccagactgccaattaataccatgagcagccactttacgggcatatcgttccagatgcctgccagactaaaggcgcctaatccagtgatgaaatacagataacacttgatgttagttaattgcagcaacatgccagtccgaaaaccaccggtactttgatcatcttcacttggacgactgataaacatatggtaggcaagatacaagagataggtgctaccaacgattttcataaccgtaacaaacgttggtgttgattgcaaccagtgggcgaagagcacacccagtaatcccataagtcccattccaatcagcatgccaatattgagtcgcaggctcgaacgaaaacctcgctgctgaccagaaaccatcgccattattgtgttaggcccaggtgtaaatgacatgacaaaaacaaaaataaagaatgctgacattgaatctcccccttacaggtatgtatgattattcattgcatttgcaatgacttggtcaaagcttatcactatttaattgcaaatacaataaccttcctgtaaattagagtcaaaatgtaccatacggaggttaatgatgtttgaaattattcgtgatattggtgcgattacccgtaagacagaaattaaaaccaatgcagagttcagaagacttgggttagcaaataatgcttttatttatgtgattcggacctatgaaaagcctggcatgtttctgggcgaactagcagattctgttcagattgaccgaacaaccgcgtttcgaacagttcaaaaactcgtggataacggctatctgagattagaagatgatgctaaggataaacggttgcgtcgtgtttacgtcgctgaaaaggggaaggcggtatatccagaattgcacgctttcgaacaacactcatccgatacgttgctgtcacagctgaccatcgatgagcaaaatgaacttaagcgactactttccaagctagtttactaacctaatggatcatgaaccatcttgatgtgaggcgttgaattgaagataaaagattcgccaactgttttaaatccatatttctcatagaagcctttaacgggtacttgagcctcaatttcgattggtaagtgggcaaagtgcatccgaatggcggtcaaaacgttcgtcatcaactggtcgcctaaccccataccacgatgggcaggatctgtgactactcggccaaaggtgacgtgatcatcttccttgtagattctggaataagcaatgatcctgtcatcttgataaaagacgtgcagcgcattaaggtcattttcatccacttcctgataaatgcggttttgagccaccacgaaggttgctacccgcaggtgatagatttcatatagttcttttgttgataattccgaaaacgacttggttttccacatagattgacactcctgactaattgttgtgcttctgttattttagtgagaaatcgataaaaaggatttttaacccacaatttaaaaataattttgaagtcgataaatgctattatagcagtgtttaaaacgtgtttaaagcaagcaataaaaaattaatttattaaaaatgattgacattttctcatgttcggggctacactacttgcaacaaatcaaatacgacaacaagatttaacccgatggattagggtcatagccttatgaagagagtaccggtttggtgagacggtattaggactatgatttgaaagatcgtgttcgacgggttcgcttctcgaggcgaactggtggcacccattatcgtgcagcgtatcgcaactgatattagttgccgtgcgtgtgaggaattacttcaaacggtaatttgaattaaggtggtaccgcgttactaaacgccctttggtctttgaccaaagggcgttttttagttgtcgtatagctgataaaatcaaaaaaacttagaaggagtggttgtaatgaaatacggaattattggtgcaggtgcaatgggttatcggtacggtgttatgcttcaggaaaacgctggcgtagatgttgacttcatcgatacatgggaaccaaacgttgaaaaagttcgtgaacaaggcggcgtttcagttgctcgtgaccataagaatcgtcggatcattccaatcaacatgtattatcctgaagaatataccggccatccagatgtttggatcatctttaagaagcagatgcaattagctgaagaacttgaacgcgacagtaaagccggtattttccatgatgaccaatacgtcttctcagctatgaacggcatgggccacttcgaaaaaattgaaaagtactttccaaaagatcacatcgtctgtgggaccgcaatgattgctactcgtcttgatggaccagcaaacgttgactttatgggacctgttaacagcgaagtcatgcatatggcgccttataacaacaagcctgctgatgaaaccatgcaagcaatcttcaacgactttacagccgctaagatggggccagtgatggtggacgaatggaagggcatgtgcatgtcaaaggttgttttcaacgccgttaccaacacgctttgcaccatgtatgaaatgcagatgggacaatttattgaatacgagggtgttactagaatggcaaccacgctattcaacgaagcctttgacgcctgcgaacgtgccggtattcacatgattgaatcccgtcaagaagaaattgattctatcattccagttagccaagcttacaagtaccactacccatcaatgtaccaagatttctctaagggccgtcctactgaagtggattacattaacggctacattgctaagattggtcgggaacacgattatgtttgccgggttcacgaattcgttgttgaagaagtgcatatggcagaaatgatgcgtaagtaccacaaaccaacagaaaacgttgcggatactaaacaagcagaggtggaagcataatgaaatatcaatttgcaaacaacatacctgaaagtaatgaagatccagttggtaatattttaaaggtggctggcgatcctaaaatcatttcatttgccggcggattaccagcaccagagttatttcccgttgaagacttaaagaaagtcaccaacgaggtttatgacgaatctggtcgtgaagccttacaatatagtattgcagctggttatccgaaattacgcgaggaaattgccaaacgaatgaaccgttcaggtattgcttgcgatattgataacattatgattaccacgggatcacagcagtccattgatttaaccactaaactctttgttaatccaggagatacggtcatcgtggaacagccaacttacctttgtgccttagatgtgttccgtagctatggtgctcacatggtaggcgtaccaatggataatgatgggatgaagatggacgccttagagcaggcgattcaagataatccgaatacgaagtttatctacaccatcccaagttttcaaaatccaacgggtcgcacgatgcctgcagaccgtcggcaaaagatgattgaaattgctgagaaatacaatgtcatgattctggaagatgacccatatggtgctattcgttttgccggtcaggacgttgcaccagtcaagacatatgctcatgatgaccgagtcatttacatgagcaccttctcaaaaatcttagcaccggggctacggatcggctggatcgtcgctgaaaagaacctggtcaagaagtttactttaatgaagcaaacggttgatgttcattcggataatttaactcagcacatcattgcgaaatacatgtcggattacaatattgatgagcacattgccaaaattaaggatgtttatcgccgacgtgaaggcatcatgatggatgccatcaagaagtatttcccaacggatgccaaatatagtcagccagaaggtgggttattcatctgggttgaggtgccaggcgttgatacccaaacgttattcaatacctgcattgaccatgatgttgcctttgttcctggtgaaccgttctacgccgacaaggttattccaggcacgttccgcttaaattactccaatatgcaagatgatcaaatcgtcactggtattgagcgattaggcaaagccattaaagaaaccattagcaaacaagtcgaagtttaatcaccaacacatagcaccactcacatatttaatcacacataatatatagtaggaaaattaaaaatctcgctaataaaagcgaaacacatactgtagttttagcaatcacacatattaaaaaatgctgataacatccctatcaaacgggaagtatcagcattttttgttgtcagtatttcggttacaaatacttgcctttctgtgcaattcagcttatattgtccgcaaaattaaaatgctaggattttacgaaagaaggcttaaaccgatgaaagcaatcgtaattgatcgatatggcgatgcgcaagagcttcacgaggcgcaactaccaatgccgaccattaacccggatgaagtattagttaagatggtggcgaccagcgtgaatcccattgattggcgtacacgaatgggtcggtcacgagctggttggagttttcccattgttttgggctgggatgtgtccggtgtaattaccactgtgggaaccgcagttcagcgatttaaagtgggtgatacggtgattgctagaccagatacatctacagatgctactcgtggcagttacgcggagtatatggcggttaaggcagataagctggcattgaaaccggccaatatttcttttgaagaaggtgcggccattccgttatctggcacggttgcttatcaagtaatcgttaagcaattagcagtaggaaagggtgataaagttctagttcagggtggtgctggtggcgttggtctgtttgccgttcaaatcgctaaggcgcaaggggcgtatgttgcgactactgccagtgcggagaattatgacttactacgttctttgggtgccgatgaggtgattgattatcatcagatcaaatacacggatatactacatgattatgatgcagtgtttgatactacggatgatattgaaaatggactcgctattctaaaaccaactggtcatctcgttagcattgctggtcagccaacttttgcccagcaaagtggtcacccgtcagcaaaacattggtggatgcatccgaacggtcaggatttggcagccgtagctgaactagtggctgcaggtcaggtaaaagtggtgattgatagtgagtatccgctaactacagaaggtctgcgggcagcgcacttacgcagtgaatcacgccatgcccatggtaaaatcgtcatcacaattgccgatcccccgaagctaaataacaccgtgatgtgaagtggtacggaacgtgagaaaggcgtatgatattcataatcattttgaaagcgagtctaacctatgagtattacctttaaatacgctactaaatcagatttaccaactatcactgacatttataatcaaataattcccagtcgtttagctactgcggatctacagccagtttctgtggcttctaagcaggcgtggttcgacgaatttgacccacattcacggccaatttgggtcatgaaagacggagataccattgcaggatgggtgagcctagagtcgttttatggccgtccagcttacattcatacaactgaaattagtatttatattgatgagaattaccgtcatcatggactggggcaaaaggcgttaaattacgtcttctcccagttaaaggatttagatatcgatacactagtggcgtttatttttcaccataatcttccaagtatcggcttatttaagaagaatgggtttgagacttggggacatctgcctgacgttgctgacatggatggtgagctacgtagtttggatattttggggcgtcggtttaaatagatgaaaaaaataccaagtgctgcgtttgcacttggtatttctttggcaataaaaaaatcagcatccacggtgtcaagcactgcgtggaaactgattagtggtgtgttgcatatgatgggcagtcaggggtcggtaagacccacttggcaatcagtgttggtgtagcggcctgtcaacaaggtatgcgcacgctgtttattaactgccatgaattactcttgcgtctgcatgcagcttatgaaaaaggtcggttggaacaaagcattagccgttatgcccgttacgatttactgattattgatgaactaggttatttaccagtggatcacgatgaagcaaatttactttttcagttaataaacgcccgatatgagcacgcttcaaccattattactagtaataacgagttatcagcctgggtggagatttttcaaaacccaacggtaactgcagcaattctcgatcgaatagttcatcattcacacattataaaaattactggtaaatcatatcgtttaaagaatgtagattgaccgctaaaaaccgacattttctgaccgcccttgacatgctggacattaaagtggaacttttgaaaattaatggtgattatttgggattgaatagaaggactagatcctatgctgaaagtcacaatcaatcttgaattagcgttgtgcgaggattattcttaaatgcgtgacaaaaattgttgtgagagggagacaagagcatgaaaagattcatcaaggggttagccattatagggattactctggtagcatttactgataccacagtacaagcaagtgccaagcgacactatgtcaagacgccaacttcactgaggggaaactggtatagcttgaaccacgtacataacactttaagtattactaagtatacatttagtggtatggaggggattcataatcattggaaactaagtggtaagaaattttctaaacacatgagtactccagaactgtacgttggaaagggtgattctccgcgtggctattattggattggtttgagttcgacagatgccgggcaactttacagaagaacaactctaaaatttcacggtaaaaagtattcggcaattaagcagctcaacttaatatcttataatccagtaaagtatcaaacaacttactggacacatcaaaaaaatttaaaacgttaaatttgctgttatttgaagggaagtaaatgtatgagtaaattgatcaaagtattcgctgccatggcctttatccttttagcatttgctacaacatcgactaccgctagtgctaagcgctattattcgacagttcctaaggctttaagaggtacctggtacgaatataataaggatacatatagttacaccaagatggtgttttctaaacagcgtttttattataaacttagttcatttaagggtatttctttatatggaaaccagttccatcattcaaatcatagcgatttgtacgtagcctcaaagcgtacgaagaggggttattacaaaattgggccacgtcattctgacgatctgtatttaaaacctgtagttatttatgaccggggaaaaagggtacatgcacttaaagatatgagcccagatatgggtttcggaacgacttatgtttatgcgtatcactataagcataaggcataaaatatttagaataacttacggacttctcctaatcgagtagcccgtttttttatttagtactagtacatgattatgttgtattttttagtacctagcagacgtattctacgcaacaagataatcgtactgcaatcattaatcattggccctagctataagttctggtagtaatcttagggttttgttatgcttgtgtaaatatatatgaaatgaggaacacaaacttggtagaaaacgatacaaatattcatcctggatttcttttgaaatttgtagataaacaatatgtagatgattttattaataaagggcaattgcatttttcgcagttaggatattttattgatcaagaaaatgaaaatggagatgatgttattggcgataggtctgaaggtatgcgaattgctaatccagaccctgaagcaagtacaattaccattacctggaaagataagaagtacgagcttcacggtgctaaagacggtgtgttaaaaattaaatacgaatacactgatgatactgttcggcagtggggagttgtatctatttgcaatattgacttatttaaggatggggaagtagtttctgttgatcgtataaataagatttgggaagtaaagttaaaacaagctttgttagatgatttatataggttaagcggtgaaggtacacgcgttcctgttatttttaatgcacaaaccttattggagtgtatggatgaaaaattaaaaacagtaagccatccaatgttcatgagaaatgtgaaatattattctgacgaatcagaagctaatatctcacttgatgaatataatgaacatcctgaaaatatagcgtttcttaagagacaacagtataaatatcaaagagaagttagagtactttataccggagcagttccttataagcgtggtaagaatattgaaataggttcaattatagcaggagctataaaattagactcgtttgatgatttgaaaaaaataagatttcaagcaatccagaaaaaatagtattttgttaatatcgaaggtgtaactaatcctcaatattaatacaaaagcaggtagttaaaaatccaaggatttttaactacctgcttttgtattaggagacttatatcgcagtctcaaaggcgtctaattaaatatggctaatttcggtcatacagattttaaattatctaacatatactgtctttgcagatgttacggaagtaaagtgaccatgactataatgaccaacagttacctgaactgttttagctttgggcgcgtagacagtcttgctaaaggtatgtttactgcttaatttagtgtatttggtacccttatacgttttaatacgtgcatagtttgcagatttatacaatttaacagtaccgacaattttgacgtatttttttgatgaaattcgcttaactgatagtttagagatatagctgctcttactattggctgttacgggtttggcaacaccatcatgatggctactataatcggcaactgcatctcctagagttgcacctaatgattcaaaatcttctgttacatcgtatgcgttatcgatatcgtcttggacatcagaaatcatagaatctaacttgatttgataggcgtgtgataaacgtgaacggaaaattttgtatgatgcgacaaaactatttaaactttgttgttcgtctgtatcggctgctgcgtagctaccaaagtcattaaaatatccatagaatgaatcgtctggaaaagatatatctgtgtaagcagcttgtggatctgtcggaagatccttaattacatttcctctaacataagctgatgctatttttaaggcattgttcacaccatttaaatcactttgatactgtgaatatggtatttttgatgcggcttgtgcctgagtagtcgttacacttggaatttcaagtattgctgttgatgctagtgaagcacctagaatgattgctactgcccttttcaatattgttttagtcaaaaaatgacctcctataagatataataaaatcattatttaattatactgttataaattataaaaaggaatgattttttgatattaatataagtagtaagaaaagtggcgctaattttcgacatggaattgttattaaacatctgcaaagattcgcaacaaaggtcgtattaatgtggtgtaaacaggcaatttatatgttctctgccactggcaaattaaacattaataattgatcctgtctgtaaaccctaggttaaggcgcttgatttttaatatataaaaaaatcatattttggatgatatttagtagttagtgaatgaatgacgtacctatagtagttgctgaaactaacaaatttccaataagattggtgaattctggatgattttcaaaaaagtctgtaaatttgttccagttgcttggataaatggctcctttttgaatatcagatttaatttcggatgcgattttttgatcatcttcagaaagctttgaagtagcctcgctaaatttctttaaattttcagaagcttgagttttaattgaaacagaattattagatataagtgattgattttcaccattcatgacattggtgttttgggaattagtaatattcgttgtgttttgcacgatagtaccctcctgcttttgaataaattcatatcctttactagtaattcgaggttttgaagaaataaataaatagaaagtacttcgattatcccacttatcaaaaccggatatataaccgtcttctatcactgtggaaattgcattaggaatgctttcgtctgtataggcaacgctggtaatttcactgatggtgccattttcgacagcagcaaatagctgatgaatctgttctagtgtagatccgtgaagattgagaggattgagaattttttttgccgctaaagttaatgtatagtcaggatctagtagtatatttattgtgtcatccttctctttaagatgtgcaccgtgaacaagttttttgtcgataatggtgtgcatagcaatattagtgggatcgttatcatcctttttaattccccctaaaaaaaatgctgaagtaatgaggctgtgttctcttaatgttactaacatttctgaaagaattaactgaggattttgatcaggtctaataattattttcacctacttttctaaaataatatgtttaattttaccattcattaatgtggttgtgagcgtcttttatacaattaagttctctgtttatactgagagagtcacacttatccatccttttaggattataaataggatcatagtttaaatggacgacaaggacgttattattgaattcgtacggtattcaacgtatgtttggaaaatattcaagtcaaaactatgcttaggacatctatagtaatagctgcgcataagacatgttaaatccgtttaaaaataagttttgaggttcgattgatgagtcttggaaagtgaatcaattaagctgactaagttattaactaagcaatagggtacgaaatgagttattcggaatgtttttttgtaccttagattacgtaattaacagtggattggcaagctaattgcgaccacacttagcttactggtcagtgttccccatatggatgagatgtaaataactgtctatacttataggtgaaataggtaaattaaaaagcatccgctattaacagatgctcacactcgttcaagactggcgactatatttttatatgtgttgattccatgatgtacataatgatgtacattgaatgtcactttaagggtattgataaaagttgagaaaagaaaaaaatcagcaaccacggcgatttaacgctgcatggaagctgattaatggtttgtgatgggcagtcaggggatcgaaccctggacccacggattaagagtccgttgctctgccagctgagctaactgcccatatcttttttgttaaccttgcaattaagcacctgtcttaatcaacgtttactaatatatcatgttaaaaagtgattggcaactattttttgaaaaaaagttatagaatatctgaaatatgactcttagaagctgtccaagatctatgatttttgatatacttctatgtaaaaagcgagtttaagctatgaaaaattatcccagcaatattactcggcaacaatttgaattaattcgaccagctttaagaaattttcgtaagcgaactaagcctcgaaaatatgacctctacgaggtcttctgtcggtcctatatgtcttgaaaaccggttgccaatggcgtcaagtcccccggtgatttcccagaatggcggtcagtttacaactattacaaaatttggtcaactaaagctgagcctacggctgattctttattggaacagtttaaaaattgtcattgctcggcgaacttaccaaggacgttcagcttaacttcctttattatcgttgacgctcagagcgtcaaaaaacaccgctactgctgaaaacaaaggttacgacgctggtaagaaaatctcggggattaagcgccatctggcagttgatatcaatgctttccgcaggccattcacatgacgcgagcgaacgtctctgatcgagacggagccagtgcaatgatcgcttacatgccatgcatttacgccaggttcaaaatgtcttagttgatggtggttattcaggcgttaattttcagctcgatgtagccagtaatttaaacgcaaccgtgcaggttgcgaagcgcaatgagttgcatcgattcgaagtcatgccccaacgttgggtagtcgaacgatcttttagtttggctagagaattgtcggcgactttggaaaaattgtgagcgtcaattaaccaccagtctgcaaatggtcgttttagcgtttttagcactattacttaagagattttagacagcttcttagatgccactccttcctaaaaataagtgagcagatccaggcgattagtaaccggagcgtaagtcgccgcaaggaggaattcccgattttggaatttttgcttgtggtgcttacgtgcaggttgctgcctggaggagctgtcctagacactctgcctagcaataattttaaatggggtaaaagctgatttggcggcctttgtcggttgactaataatctgctgcatcccccgaacacccatctcgaagaattcctgagtgacactggttaattgcggccgcacgatgctgcaaagtttcgtcccatcaacactcatcacagctaaatcagctgggattttcaatccataatcctgtgcctgattcatcacgccgattgcggccaaatcactggatgcgatcaccgctgtcacctccggctcacggccatattgtttcatcgcattaacgccgtcttcataagcaaagtcaccgccgcaaacccaggccgaattcaattgcaacccattatcagccatggcctgatgatacccatccaatcgtaactgaccagtcacagagtctaaatccgctgccgcaaatccaattttggaatgacccttatcaatcaaatacttggtagcttgatagccgatctgaaaatcatccgaggtaatgaacggtaattttcgatttttaagggtgattgataggaactggtatggaatattggcattgactaacaggttctcattaaccgaattaaggttaacggcgaccaacaaaatacccattaccgaccgttcaatcacggtttccaaagcttttcgttccatctggggatctttttcgccggcatataaaataatcacattcaaatcatgctcaccggcctcttgctgaatcccatcaatgatctggtcggaaaagttcgtcttggttgagctcacaatgaccgcaatcaccttgctacggcgggtaaccaattcaacggcagccgtatttttttgatagccaagttttttggctattttttttaccttttttgctgtcttctctgagtaaaatgctacctgaccagacagcactcttgaaacagtggcaggagagacccctgcttgtttagcaatatctttaattgtgaccgccatgattgcgccacctctcttttatgtatatggcagattgtaaaatttaagttgaacatttaagtggacagaaaaaaccatcaaggtctttaatggtgttaccatacaatccattagaaagaagggccttgatgagcaccactattttatcattccagaaccgtgttgtcattgaaacgcttcataatgaaggacgttccttgcgatacatcgctaactacttaggctttagtaagaccaccatctttaacgaacttcaccggctaaatagtgagtatcaggctgaactagcgcaaactgactttgaacgcaaggttagtcaacgggggcggaagtcttcgctcactaaaagccttaaacacttgatcgaggaaaagattcaagtccagaagtggtcccctgaacaagttgcccatgtagttgggattgcctacaagacggtctataactggattgagcaaggctggcttgatgtgcagttgcccgatttgcctgatcatggaattcgtcgtcatcgtgctaaagaaaagcgtggtacgttcagtcacggccgctccattgaggagcgtcctcataaagtcgaaactcgccaagaattcggccactttgaagctgataccgtactttctggcaaacgtaaaggttaagctgtggctacttttgtggagcgtaagagtcgcctaacaattgttaaacggctccatggtcgcgacagtcagtctatgactcaagccgtacttgaactagctagtcaacttcaagacaagctcaagacgcttactgtagatcatggtaaagagttcgctaactaccaggcaattgagcagcgaactggtactccggtttattttgcccatgcttattcaccacatgaacgaggcagtaatgagaaccgtaaccgagttttaagacgctttattcccaaaggccaagccattgaagggttaagtgatcagaagctgattcaaattaattggtatttgaattcccggccacttaaatgtcttaactggcgaacaccaatcgagatcttcttgcttaatctacgtcactaaattcgttcaagttatttcttgcaatctgccatattgataagtttcactagaatcattaatgttaagcgctttacgatgttcatctcattttaatacagtaaacgacgcctaaatttttagtaaaacacaaacgtttgtgatgttgatgtgaaacgcttgcaaacgttttctttaagtgatattataatcgctgtaaacgtttcttgcaatatatttattggccaagttgctggggcgttcacgtaggacggctgtgtaaagcgaaatatctatctaagcatctttttcaaaaattcctgaagtaggagctttcgaaaaaagagatttagattctggtttctaagtgctttactccgctcacttttattaaaacagctccgtaaagcagaaggagacttaggctccagcttctaaccgctttactccgctcacttattttttaggaggaatcattatggacgcaaaagcaaaaactggtagtggtgacgttgagactgaacctaaaagttttgcctcccatttgccaagtttgaaagtaagcacgatttttgcaatgacgtttggctttttcggggttaacatggcgttctcacttcaacaatcacaaatggggcgaatttttcaaaccattggcgccaacccgaataacttaggctttttcttcatcttgccaccgctggccggaatggttattcagccattaattggtaagtactctgaccgcacttggacccgttttggaagacgcatgccgtatttatttattggcgcacccgtcgcagcaattgttttggtattacttcctaacgccggttcatttggatttggttatggttcggcggctgcactgtggtttgccgctatcgccaccttattcatggacctttcatccaatgtttgtatgcagccattcaagatggtcatcggcgacatggtcaatgaagatcaaaaagatatggcctggtcttggcagcagtccttctccaaccttggcggggttctcgccagcctggtgccattcttcctcgccttcatcggcctttcaaacgtcgctcaaaaaggtgaagtgccaatcaccgttaaattagcttactacctggccgcagccgttctgttgctgacctcgttctacacgattgccaaggttcacgaatacaatccagaagaatatgctttatatcataacattgacttaaccaagcaaaagaagcagcctagtctttggaaattaaccaagaaagcaccccgggtcttctgggaaatctcagttgttcaattctttacctggtttgccattctctactcttggacctacgctgccggtgccatttctttgaacgtttggcacacttccaacccatcatcagccggttatcaagccgctggtaattggtacggcgtgcttacctgcatccaagccgttgcttccgttatctttggattgttagtgcaagcccgaactaagccagaacaccgaaaagcatggtacgtctttggtttgcttgctggtgcccttggcttcatcctgatcttcttcatccacagcaaatggttgctcgttttgccattctgcctgatcgggatcacttatatcaccatgaacacccaaccattctcactcttaacagaggctttgaacggtgaaaatgaaggggcttacctgggactcttcaactgtgcaatctgcttgccccaaattgccgcatccctttgcagcttcttcatcttcccaatggttgggcactcaatgccagcaatgtttttggttggtggtgtttcattagtaatcgctgcattttcagttcgctttattcactcaaaattgagtgaaccagttaaactataataaataggacagcaacgtcaggcagaagcttccctataagcaccatgtgcaaaaattccaagcccacgaatttctgcccatggagacttatattccagtttctaaccgcctgactccgctcactaaaaaaagaggagaattcaatatgacccacaaatggtggcaaaatgccgtaatttatcagatttatccacaaagttttcaggacagtaacaatgatgggattggtgatcttcatggaatcatcaagcgcctgccttatttaaagaagctcggagttgacgtcctttggttgaacccaatttatcagtccccgctcaaagataacggctacgatattgccgattacgagaagatcttaccggaatatggcacgatgaccgatttcgacgaattattgaaggaggttcacgcccacggattgaagttactaatggacctcgtggttaaccacacttccgatcaacaccgctggttccaagaaagcaaacaatccaaggataacaagtacgccgactactacatgtggcgcgatccagttgatggtcatgaacccaacaactggcacgcagcctttggtggcagtgcctggacatacgttccggaacgaggccagtactacctacacttgtttgcccctggtcaacccgatttgaattgggaaaacccagccgttcgggaatccgtttggaacatcatgcgattctggttggataaagggattgatggctttagaatggacgtcatcaacctgatctccaaacctgaaggccttcccgatgcacctgaccccggcacctacccactcacggaaggtctggttgccgatgggcctaagttaaacgactacctccacgaaatgaacgacaaggtgctttcccactacgatgtcatgacagttggtgaaatgccgagttcaaagcccgaagatgccatcagctacactggcctcgacagccatgaactgaacatggtcttccagttccaacacgttgctttggaacccaatccagacaagcgcttgggcaaatggaacgatcagccggtcaagttaccagagttgaagaccgcgctttcccgttggcaaaaagccttagatggcaaggggtggaacagtctctactggaacaaccacgatcaaccccgggcagtttctcgcttctccaacgatgatccaaagtaccgggttcgcgccgccaaaatgctgggtactacccttcacatgatgcaaggaacgccatttgtctttgaaggtgaagaacttggcatggccaatgtgcactacaccagcattgatcaatacgaagatctcgaatcaatcaacgcctaccgcgagttggtcgaggaaaagaagctggtggatgggccaaccatgctgaagtatttagccaacatttcccgggataacgcccgcacgccaatgccatgggacgccggcaagaacgctggtttctcggacgtgaagccgtggttcgccttgaatccaacttataaggaaatcaatgccaaagctgtgttggaagataaagattccgtcttttaccactatcagaagttaatccaactccggcatgattccgacttggttaagtttggaacctatgatgaaattgatcctgacgatgcagaagtcttcgcttaccggcgtcattatcaaggcaagacgttgctggtaatcagtaacttcactgccaacacggtgacccgtgattatgatcaggggaaagctgacaaactcgtcatcagcaattacgatgatgatcaaggcacggaattgcgcccttatgaaagtaaggtctatgtatttaactaggatcataatatattcgggcataaagagtcttctcaactgatgaagaggctcttttttgctttgtttaactgcggcaatacattgatctatcggcataatattttggttagtgattatttcgatatatggtagattgtaaaattaatccgaacagcgttcggattaattttacaatctaccatttaattagacttattaagtaaagaaaatagggaccctttcagttaacatgtgctaaccaaaagggggccctattttcttttaataccgtatttcacacggtatcgaataaaggtcgtccgtttaatacctgtatttcgggacacatcaatgtcactcatgccagctcgataaagcttaaaagcatgttgcaagcggggatcgtcttgggtgtattggggtttgcgcccatgatatttaccctgctgcttagctaaggcaatcccttgctgctgccgctcaatgattcgcttacgttcactttcggcctgatacttatagagttcaataatcaagttggtcatcagttgacgtaaatttgggtcagcaatccctgtcatggacggtaaattcaacacatctagggtggcacccttattttgaatggagttcatgatcttagtcaaatcatggctgtttctgcctaagaggctgtataaaatctcttaagtaatagtactaggaacgctaaaacgatcgttctaccacccaacgttgggatattacttcgaatcgatgtaacttattgcgcttcgcaacttgcacggttgccgcatcgagccgaaaattaacgcctgaataaccaccatcaactaacacgttgcgtacccgacataaatgttcagcgtttaaagctaccatggcactggctccgtctcaatcagagtatcatgtgaatggcctatggaaagccattgatatcaactgctggatggcgcttaatctccgagattttcttgccggcgttgtaatctttgctttcagcagtagcggtgtttttgacgctcagagcgtcaaagataaagctgaatgtccttggtaagtttgccgagcaatgacaatttttttaaacttgttcccatagagaatcagcggtgagcttagctttagttgaccaaattttgtaataggtgtaaactgaccgccattctggaaaatcaactgggacttaacgtcgttggcaaccggttttcaaggcatacaagaccgcacagaagatctcttaaaggtcatattttcgaggctgggttcacttgcgaaaattttctaatgctggttgaattaattcaaattgttgccgggtaatattgattggataatttttcatggcttaaactcgcttttttacatagaagcatatcaaaaatcatagatcttggacagcttctaaggagtcactcatgattattggatatgcacgggtttcaaaagatgatcagaatctcaatcgccaaattgatcaattaatggcttatggtgccgaaaaaatcattcaagaaaagtttaccgggacaccggacccgggcaaagaagaccgggattacccagcttctccaaaccattcgggctcatgatgtcgtggtcgttgaaagtatttcccgcttgggccgcaatacgttggacattttaaatctagttcaattactgcaccaaaacaaattaagttttgtttctttaaaagcgagatggacaccagaccccaactggtcgagccatgctgcaatgatgagtgtgattgcggaactggagcggaatttattagctgatcgggttaaagaagggattgcggccagtcgtcggcgtggcgtgacagttggccgaccacgaatcgcccaagaaaattggatattgccattcggatgtatcaagtggtgactattcagttaaagaaattttggccaccaaccaaatttcctcaggaactttttacccgcgaagtgaatcggttaaaactaaaaagcttaaaagaaaagatgacccatctgcttctcacaactgacttctaatattatggattcccaaaaaagatttacgacctttagttttaacaaagttgacaaccattggagtagctctttactatacatagataatcgttctaggtaatggaaggagaaaatggattatcaaaattacgttccaatgctaaaagcaatggctgacccgaaccgcctaaaaatcattgatctgctttcatgtggatcactttgtgcttgtgatatcctccagcattttgatttttctccacccactttgtctcatcatatgaaggttttgcaaaatgcaggtattgtgtttgcgtaaaggatgggaaatggcaacactattccctacaaaaaaggtttgtccaggtttaaacagaataccgaccaactgttagccgctgatagaccactgcctttgccaacggtctgattgtgaaaaagatgttgccaattaagtttttttaagcaatacataggcgcgtgtctatgtaaggagctgaaaaatgatggaaaagtattcgccacagagattaatttaacaagtacctatttttttaccggcaagggtggggttggcaaaaccacggttgccagtgccactgccaattagcttagccgatgctggtcatcgagttatgatcgtttccactgatccagctagtaacttgcaggacgttttttaaagttagtttaaccaatcagccaaagccgattccaaacatttccggtttgtttgctgccaacttgatccggtcattgctgcgaacgagtatcgcgagcaggttattcaaccttatcgaggcgtgttgcccaaagaagccattcagaattggctgaacaattatcagcctcgtgtacggttgaaattgctgctttataatttgccaactttctactaacctagcaccacgatacattcttatccatgtaattactttactccaagcaagagattgcaagcattcttaaggtatggccggtcggcgcggtatcaaaaataatatagtcaaattgctgatttaaatcttggaactagtt

SEQ ID NO: 708 - DNA, 168844 bp, Unknown
  Metagenome-assembled genome
taaaatcaggggataaaatcccgattttattcagaaaaaaaggtttatcgagaaatcaaattttgatttcttcgataaaccttttttgaaagctatgatttacgacttaagtcacagcctcttttaatttaatttttctaaaacgcgctcaccgcggcagatagctatgtgtaagacaaggaccacccaatcccaagttcggggatttaggtgggctgatttccttttatctagctgaaacgcgctcaccgcggcagatagctatgtgtaagacaaggaccacccaaatcccaagttcggggatttaggtgggctgatttccttttatctagctgaaacgcgctcaccgcggcagacagctatgtgtaagacaaggaccacccaaatcccaagttcggggatttaggtggtccttgtcttacacgccgctatctaaacgccgcggttcacgctctagctgttccacaattcatccaacagctctttagcactttcattcaagctatccttactcttatcagttccaaggtgggtgtaaatttcacctacatacactccttgatcaaacaagcgcttgaataccttatcaataattggccgcgtctttgcttcttcttggactggtccaaatgggttcgcgaagaaggtcgtactcatcccaacttcatccgttgtccccaacgcaaaccgcttaccttcgatgaaggttgccttagcttcctcttcattatcgaaacggtgaataccaatatctttatcgtagttgtttgcatagacccacatatcaacgccatgatggcccacaactcggttatacgaatcagcgggaataataacccgcgcattcttacggtctgggttcaagtacacaccacgatccatgttattgaaggccacggctgaacttaaatcatccagtcgaacaaaggccccaatttcggttccttgcgcatacaaatcatcatccgttaaggtgaaactgcccatatcatcaaaaatcgtttcaaggctcaaaatcttatcgtccgcaatttcctgcagggcttccaaagattctgactttccggcaccggaatcaccgaagaagaccacgttcttattcttaccgttagcgaacttgatccgaaccattgaaccgtgaattggcaaacggttttcgtagatcatgtgtaagttatgcaacgttaagcacatcttcttcatgtagccaaagtacgtggtcttatcgttgtatggcacttcgccgacccagatgtcgttttcttcatcgtggtgataatggcaaacatcgccctcagtctttggtaaaccaaatagtaaaatttcatctggtttatgaccggcaacatccttagcactggcaacttcgaataggttagccagcgaaataccgctaacaaagtaatcccggtggaagtaaatataagctaaactttcgccaatcttagctgggaagcaataccattcgctacgtgagccatggaatttgtcaattgggttatcaggaacggctgtaaacgttccctcacgtctgtttgaaggtgtcttcatcatcattggtggccgtaacatcaaagtctctaagaagcgaattggcttcaatgcttcataaccatgtggaatcggccagtctaacgattgcgtcagaacacatgcagaagtcccagcacttacctgacgataagttttattacggaatccctgcagcttttcttcaattgtccggtaagcttcaatcacaacatcgttgaatttattatccatttgcatgaagttctttgcggtagcttcactcccatgcaagttaacaacaccaattctaagatatgaccggtaatatgaatacaggtcttcaacgctaaaaagaatttcctcacgcttatacgtatcaaaagcgtcagaacgatcaagcaaaactgccttcagtgtatcgatgtaagttttgggatctgtatcctcaaaatcgcttcgctgactctcggcggtatgacgccgatcatctaaaaataagcggacaacttcctcgagctctttactattgattaaggtaaagatatcggaaacatacttgttcgtgtaattaagtacggcaatttctcgatctggattcatatataacgcagatgtttctacttttcctgactcagtcatgtggacaattccccttccaatgcaactcatttgcataactccattgtagcctaaaatgacccgaacgaaaatagaaaaatgagaatttaataaaagcgacaaattccgtcatgacgggctataattgactttcaaaattacaaaaatgagagaattttttgaaaaatttagactaaaatttaaacgtcattatcagaatttcaaccattttaattttgaactttcttttctttcaaagtgagtgctaaaagtagaccgattatttcaagaataaagaaggtgatgaaaacaatgtggaaattacctaaggttgcggtggcaactcctcctagcgacaacaagatagttgcaacggcaacaccagtcgatcccagtaattgacgcatggtagtgattacggcggtcccatgagaaaccttctcgttaggcaacgcatccgcacctaaagtcgttgcaggcatcatgacaaaagcattaccgccttcaatcagcatggcaatcggcatcattccccaaagtgagaatttaacgggaaccagtgctaggactccccagcccaccagaatcatcgtcatcccaatcaataaaacctttttaaagccgattttatcagccaaacgaccggtcagtgggttcaaaatacttaagaatagcgcaccgggaactaacgccatacctgaaatgaacgggctaactcccaagataatttgatagtacagtggaaaaacaatcgtaacaacaattagcgcgatataggaaagacctgtcagccatactgatgcgttaaactgacgaaccttgaagacccgtaaatcgagcagcggttccggcaagcgtaattgtctgataccgaagaacagcagtaacacgatactgacaatcagaatcacgctggcaatcccccagttaacacctggcgtacccaccaaattgatcacgtaaagcacaccaatgaaaccgactaggctgactactgaaagccagtcaaggtgtgacggtacttgcggcatcacgttgacaatcgtctttagcgatagcacaatgaccagactaatgatgatcataaaaacgataaatagaccttgccaagtcgtaaaccgcagcacaatcccagaaataatcggtcctactgctaatgctgaccccatgaccaaccctgcaacgcccattgcgctgccgcgttcgtcacgtggtgtgatcgtcagaagtaccgtttgatatgacgggaacaaaataccgacaccaatcgcttccattgcacgtcccagcaggactaacggaaagttgggtgctaatatgattaagagcgtccccacgtcaaacatcgttaaaacagataaaaataatggcttaaacccaatattgctcaatagccagggactcaccggcatcatgatacacataatgagcatgaatcccgttgttaaccattgaaccgttgaagcagaaattgaaaagtaccgcattaacgtcgggtaggcagtagacaatgctgattgactgatcgacatggtaaaagttcccatcagcaaagtcgccacgaaccataaccgcgcgcggcctgatagcgtagttgattgatccatcttcagattcccccttatgaccataatgataagcgtaattagggttaaaatcaattgcgtcaaaggtagattaaatgattatggagttttaagttctggtagcctaacaaaagagtgtgacacaactcggtggattccagaattgcatcacactctcagacagtattatttatctaaccgactgcgaatccgggaaagtgacactggtgtaatacctagatatgaggccagctcatactttggaacgcggttgaccaattcgggatcagacgccaacaaactctggtaacgcaattctggtgaatcctcgattcgattgaggaagtattgcgtgtaatcaataaaacggtgacaaacataatcggtaaacgcggccatcaatttgggctctgcttcgatagtctgtcgcaataatttcccatcaacaaccgtcaccgtcgttttttccatggcagtaatagcaaacaaactcggcttaatcaagtaaaaactttcaaaggacgacaccgcttggccctcaaagaaaaattgcacggtgatatcgcgtccatcatcgttatgccacaatctcactgcaccctgatcaacaaaatacaattgcttggcgacgtcaccctcacgcaataaatcttcgcctgcttcgaagtttctttggtgtcccatttgtttaatctgctcataatagtcgctaagtgccattttcagtcctcctcataaaacaaaaaaacacgaccagattggccgtgctaaatactaacttaaactattaatcgtaccgtcatcaatcgcttgtttgatcttctttgcttcatccaagcgagactcagtaatgtacttcatagtgacgtctttgtccgtttctgcttcgttaaattgctcagttaaaaactcgatttgatcctttaaatatgagattaagtccatcattaccaccaaccttttcatcctattcttattataagtcaaacacgcttaattgtcgtcacgatttccaccaaaaaggatgattaatcgtaacaattgtaaaaatgtcgccagtgcagctgcaacgtaagtgagggctgccgccgtcaggacgcgtcttaccattggcacctcatcagctgtcaataaaccaccgtcactaagaattcgaagtgcgcgatgtgacgcgttgaattccacgggtaaagtcaccaattgaaacagcagtgcaaaagaaaacaagaagataccaatatgaatcaaagtctgattcattcccatcagtacacccactaaaatcagcggaaatgaaattgaggaaccaaagttagcaatcggtacaatggcagtccgcaatcgcattggtgcataattagtagcgtcctgcaccgcatgcccgcattcatgggctgccacaccaaccgctgctaccgacgatgaattagccgttgattctgacaaattcaacgttttattcccgccgttgtagttatcagtcaggttccctgcaattggatgaactgaaacattattaatccccgactgctgtaaaatatactccgcagcagtcgttccagttaccccactttgtgcacgatatcggtcgtatttagcgtaggttgaattaacgtagcctgaagctgccattgacagtaacaagccaacaataactaagatatacgttggatcgaaaaaggcgaatatcggtgatgtcattgaatccctcctgtttagtgtagtcatatcgttgcagaacattgtagcaagttattggggcgggggcaagatatttaaggaaggtttaaggttatgagactttcgaggtggttttgggtgttttggacaggcgtcatagcctattggagtttagcgtttctaggtatcatagcctattcgggttccagcggactgagagctacatgtaggcgagtaacgttataagccccaacccaggcttacaacgttactcgcttacacaccgctctcaaaacgtccgcttccacaccatgttctatttgggttccagcaagcagagacttgcacctaagctacttttggcgtaaatcccaagcccatggattcacgccaaaagtagcttaggctccagtctctaaacgcttgcttccacaccatggctttttggtgtaccattataactgttgaatttattaaagaacaaaggagctcaaattcttgattactttaaaatcagaacgtgaaattgaaatgatgcgtaaatccggtgccattttggccggtgttcacttgggtctacgcgacatcatcaaacccggcatttctagctgggacatcgaaaaatttgctaacgcctacattgaagaacaccacgccaaggccgaagaaaaaggctttgaaggctacaagtacgccacctgcgtcagtgttaacgatgaagttgcccacgccacccctcgtaaagatctcctacttaaaaacggtgacattgttgccgttgacatggtggttaatctggatggcttcatgagcgattcttgctggacctatgccgttggcgagatcagcgaagaaaagcagcacctcatggacgtgaccaaaaaggccctttacttaggtatcgaccaagccgttattggcaaccgaatcggtgatattggttacgctatccaacactacgttgaagacgaaaaccacatgggcgacgttcgcgaactgattggccacggtattggaccgactatgcacgaagagccaaacgtgcctcactatggtgaacctggtaagggtctacgtttgcgtgaaggtatgaccatcaccatcgaaccaatggttaaccttggtacctgggagattgcttcaaagcaagtacctggcgacacttgggaatactacgtttcagctgatggtaccccttcagcgcaatacgaacacactttggtcatcaccaaagatgggcctaagatcttaacctctcaagatccagttgaagacgctaagtatctttaacatttaaatcaacaaatcaaaacgtcccgcagctggaaacagacttgcgggacgttttttgttaaaattaaactactaaatttactcaggagggactaacatgacactcactaatcacacaccagaaccacaagtacagtcactctttcaacgggtggccggaaattacgaccgtatgaataatctcatttctctcggcacccacaaacactggcgtaaagttgctatggctaagatggtcattaaacctggcagctttgtgttagacctctgttgtgggactggtgactggacgatagcactcgcaaaagctgtcggtccctctggtcaggtaatcggtctggatttcagtgaagaaatgttggcaatcgctaaaaagaaagtcacggcagccggcatgaacgaccgcgtcactttagttcaaggtgatgcaatggcgttaccttacgataaaaatcattttgacgtggtcaccatcggctttggcctgcgtaacgtaccggatgccaaccaagttttacgggaaatgcatcgcgtggtacgccccggtgggaaagcagcttcactagaaacgtcacaaccaacccaaccactcgttaagttaggatggcaagcctattttaaactggttccgctgatgactaaattagccgtccgcaactaccaagactatgcctacctagaaaaaaccgccgccgaatttgttgatgccaaacaattagccaaaatgttcgttaatgcaggatttaaaagcatcgactaccagacattcgacatgggagctgcggcattccacagtgcacgcaaatcgcacactgaaaattaagttattttacccagccatgtgtttctaaatccatatctcgtttgcgcattccagaaacataggggttccccgccacaaaatagcggtatggtgcatccgtttgaccgccacgtttgctgacgccaatgcgggctgatgtggcaatccgcaacggctcgcggctatcctgtaaatcaattttaaagggactttgatcaagcatggtgttgttccagtgaaggtcattgacaccaaatgcctgcatcagtttgcccgggccgttcgtaagttctgatccggattttggccggttagccatcatgatatctagaccatccttgggttcaatcccacgcaccaagattccttgtggctcacctttctcctggaccgcaatatcaaaagcatagtacccacgagacgtgtagatgtagatattcccaggtgcgctatacaacgcatcgttagccttagtccgacgaccttcatacgcgtgggctgccgagtcagcaacgccaagatatgcttcagcttcaacaatgtagccactaactaatcctttaggtgattcatagctgagtaatttacctaaaagttcacggctaatggtttcggttgaacggccactaaaaaattctgccatagttgtcattatttctacccctaacatcaatatgtgatattgtcattatagaagaggtgattcgaaatggcactcaaaattgaacgaatttatactaaacctgctgatacggatggctatcgaatcttagttgaccgtctgtggccacggggaatttcaaaggaaaaggctgctctcgatgagtggtttaaaaccattgcaccaaccaaagagctgcgtcagtggttcggccatgatccagaaaaatacgctgagtttaaaacccgttatatcgctgaactggacgccaatcctgaccgcgacaagtttctggaactaatcaagtcacatcttgctgaaggcaatgtcatcatgctttatggcgcaaaagatgaaacgcataatcaagctgtggtgttaaaagaatatttagaaaaactgctttaactaaaaaagatcactttagtcagtgacctttttttgttgtgcctcaacttgctcctggataccagctaaactcaattctgtagaacggctaaatttaacgtcagcggctgcaatctcttctggctgaccaacgccaatggatagggcacccgaaccgtttagagcactcaaacccgtcttcgagtcttcaacacccatgcactcacccggctgtaaattcagtagggccgctgcccgaacgtaaatctcaggatctggcttgttatgcgtcagtgttgcaggatcgacaatcagcgggaaataatctgtcagctgcatctttttaatttctaatggtgcgttcatggacgccgaagccagcacgatgccataatgctgagcccttaattcatctaggaaacgtatcacgccgggcaatacatccgctggcgacatatgagaaatcaactctaaatacatctggtttttatgattgcccaacttctgccgttcttcagccgtatagcgttccagctgatggccagcctctaaaatcgttgtcactgcttcctgccggttcattccaagcactgtttcggttaaggctgatgtccacgtaattccaagctcatcagctaactggcgccaagcttgaagatgatactgagatgaatccgcaatcaccccgtgaagatcaaagagcaccccggaatattgctcgaatttaatcatttaactcactcctattggggaaataccccttttattttcaatatactcccgtataattagaaacgttatggagggatcaacacgtgtatcaagacaacggcaagccaactattttgggagattgtatattacttattatttccattataatcaactcactgggaaacgcactgacagtttctttaaatttaggcagcgcattatggaccgcatccgctgtcaacatgtcacacctatttcacatgaacttaggtaacattttgttgctggaaggtatcgcagttatcttagccaacgctgtgttgctacgagaaattgactggcaccgaatgcttggcaatatactcttcatggtaccctttagctatttagtcagtggcattgcacaactgttgactgttttccatattcaacatttatcactcgttccgtcagtgatactcgatatcgtcggcgttatgatgattggctgcggtatctctatttatcagcgaattaacctgattctgcatccaaacgatgatttgatgcagatcctacgctttaaatttctgcacggcaatgcggtaaccgcttctctaaccgcttttatcacacccattacaattatcgctatctgttttttgattcaacgtcacatttgggcagtgaatatcggcacagtggtggcactgttattccaaggcaccttcattgctttaagtgaccgctacgtttttcgaaagttaaaacatcaacgcctataattaaaaagttcgtctgcatatgcgggcgaacttttttaattcattttggtttaaaacgcaaattcatcaacgacttcaaaggacacattagcgttttgcttgatcatcttagccactgggcaatagttttttgcttcatcgactagtgcttgcgcttgcgcatgatcaacacctgtcatcagtacttgaacgcgaaccacgaacttataacccgtgtcatccttaagttgatccacaccggtgtgtacaacactcgtatgcggtaacttatgcaactgctcaatgatttcaatagtagcgttaaaacacgtactgattgccagaccaactaattgttccggattggtaccagagcccttcactaacgagctgctgaccccaagtgccaacccttcgttaccgcgaataaagctcacaccacttaaacctttttcatttactgcctcagtatgatataacgatccatcaattgccattgtcaggatcccccttttattttttgtgcctgtagtgtagcacgcaagaaaacgattccaaaacgtttagcttgtacaaaactaacaagaaaacggtatttaaaataaccgggagaaatccaagcaaactaatgaatggagtaatcgatgactaatatatcaatttgctattaatactgtggattattaaccgcccactctggcttttgtccagatagcgcagcatcgatcatcttagcagcaccaaaggccatattctgaccggcttctaccgtatttgatgccgtatgtggtgttaaaaagacgttatccattttataaaacggactgtctgctggtaaaggttcctcatcaaaaacgtctaaagccgcactggcaatctgatgcgtgttgagggcagtaattagtgcctgttcatcaaccactgaaccacgcgctaaattaaccaatgaagcgctcgttttcatcatggctaattctttctcgccaatcaaatgctcagtctgcttcgtagcggcaatatgcagcgtaacataatctgattgtttcaataatgtttctaaatcaacgtactctccatattctgttggccgtttagttcggttataaatcaaggttttaacaccaaacccacttagcatcttagcaacggcttggccaatgtgaccataaccaacaatacctaccgtcgaacccagtaattcatgtccaaagagttgcttagcagtcctaattttcccttgatgcatcaaagttgacatttcatatgagcgtttcgacaacaacataatatcagtcacagcattttccgctacactaatggcattggctcccggcgtattggtcacccaaacacccttagttgcagcatactcagcatcaatactgtcatagcccacaccgtaacgtgctaaaacttttaaattgggtaatttatcatacaaatcattgggaaagggagaaacaaacatcataataccagcaacatcaggtgctgtcgccaaaatagttgccgcatcagggctggtaacggtaagaacttcatagcccttcttagacaaataatggtcggtttgtttgtccgcaatctccggaataattactttctgcatactgagaattcccttctgaattaactggttttaatacctaaattttaccatgaatctaccatatcagactaatttaacaatttaccagaagtggttacccgattacgaccggcttcttttgaacgatacagtcgctgatcagcacacttataaatatctaagtagttttgatcctcagcgtcgatttgtgcctgtcccaacgaaatcgtgatttggaattggtcaccttgcttagttttaaaaacgagtttgccaatcgcctcacggacttggttggcgacttcattgggagatccgtgctgcgtttgatcgtcaaaaaccataaaagaaaattcctcaccgccgacccgataagcctttgcgttactgctaattttcggcaacaaacggttcaattcagtggccacgcccttaagtactgcgttgccttccaaatgaccataccgatcattgacccgtttaaagaaatcaatatcaaacgtataaagcgaatattgggtccctttttcatgatactgatcaaaggcccgctgtagatcgtcattaaaaattctgaaattattcagctttgtcaggttatccttactggcttcacaaagaagaattgcctgacgctcatcacgtcttttcaactggtaatagatcaaccaaatcaaataatacaccacgaaacattctgctaactctacccaccagctaacctctatgccacgcaacgaaatccaatttgcccacagaaaaggggccgaaaagagtaaacaaaacggataaaacactagtggccgatcgatgatccgccacccaaaccgatcagcttcagctaacaataaaacactcacaacataaaaataaccccaccatgacacgttaggcagccaccaataccagaataacaggacgacagatagacttagaaaaagccatgagctcctttttaaaatcatcgcaaagagaagcacccctatttgaaacgctaaataactccacccaaggcccttacgatcatgagcctccatgattctgagttctgacgacaagtgataaagcaataaaaagccaatcgtcagagcaatctgactcgcctcacgtaatcgtcgccaaattggcaggtgaaattcggcgtgctgcaaccaagtgtataatagtgaaaaccccgttaataaaagcatgttgatgacaaagttaactcctcgaacttcccagatcaacattgtttttcccccgttttcaattggattttgaaaacatttgtctcaaattattgcacttttccatttctgtttatttcatttatttattctatgataacttccctaacagcgcaactatgaataattgaaacaaatttgccattaaatataatgttagtttcaacttcaatcaaaaaagcgctagtaacattgcttttcacaatgttactagcgcttttatcatttataacttaattagccatttgcttaggtgataaaatcagcttaccacgaatagcagatttgcgttccacggtaacaggacgtctttgtgccacttccgcaacttctggagatggcgtaaagaccaattcgtgatcccgtttgaccaaccggtgaattgacaccagtatgaccgcgcagaccgcaatcaatgggaatccagccattacggaaatcgtctgaataacttggaagccacccactaagaccagtgaaaaagcgaaaatcatgaagacaacaacccagctcatccggttaaagcgagttggttcgcggtgcttcaatggcacactggtaaacgatgacagaatgtaggctgaacccgaaatcgtcgttgccaagaaaatgaaacatgacagacagtaaagcaatgtcataacctgcttcattggcaacgtcccaataacggtcgcaataacagcagcttgaccttgagtgtttagcatgtggaccaaattaatgaccccgttttgctgtaaccaaagcgcgtagccacccattacggcgtagaacaatgcacagcctgtaaagccgtacaataacatacccatcaacatttgacgaatggttttaccacgtgagatcttcgcaatgaataatcccatcactggcatgtatgataaccaccagccccagtagaaaatcgtatcctgctgagtggcgcttggacgcgtattagtcgccattggcacgaacttttgaacgagcatgcctaagctttgcgcctcgttagaaataatgtaacgggttggaccaaagaacaaaattaagaccagaaaaccgatggctaaccaaatgtgcgccatacttaatcgatcaataccaccatttaagcccttaaagactgtgacagcaaataaaacgaataagacagcgaacaatgctaattccaatggtaaaccgtacttaataccggttgcacttgagaatgctttagccgtaattggaacttccatcccaattgatgaaccaacaccaccgatgatgccgacaacgacaaggacgttgatcaagccagcaaagaactttttagttgattgatgcttatcaccatctagcatgccgataccgtcgctaagtttttgaacgggttgccccttacgatacatcaggtaaccaatcaaaaccgcagcgggtgcgaacatcatccaagccattggcccccagttaaactgccccatcatagtggcagaaatataggcggcgtgagaataggctttaatgtgaaaaggtggattttgaatcaccgttagcggatcagtgatggacagcatcataatgctggcatcaatcgcagtggcgaacaccatagcgccccacttgaatccactataaaccggcttgtcatcaggttttccaattttaattttcccatatcggctaaatgccaatccgattaagaagacaaagttgatgatataaataccaaggtacatccaccctaactttaggttcatccaactcaataggctagataaaggtgcttgaagaccctttccacctatcattaacactaaagttgccagtaagaataatcccacagttggtacaaagacccacttgttgattaacttgcttcttaaaataatattcctcctctaataattgtacataccggggacagagtgtggcgcaagtcaaagtgtccggcaaggctgtaaaagatcgcccttactcattcctgatgagaatcccgttatcgaattcggaccattcctgaatcagttaaaatctctaccttgcgtagcatgctttaattcgtgaagtacaccatgactttttattagctaagatatacttgaaaccacagatgaaattgttacctttcaactctgcaaacacccgacgtattttcataagggtcagcaaagtacaaaacacaaaaaagctgtcgagatcggtctaagaccatctgcaacagctttatctgcaacaaattgccacttccaaatgaaacccgaatgaatttacattttcattatacacgtttgaaagaataagtaaaatatgcagcatagataagaaaatgaatctattttattgttttaatgactcgcgccggattacccgctataacaacgttgtcgccgaatgatttcgtgactactgagccagcacccacgaccacattgttgcccagagtcacaccaggcaaaatcgtgacccgaccacctaaccaagcattatcgccaatggtgattggcgcgcccaattcaacatccgcatttcgctgtacgggatccaatgggtgaactggcgtataaaggccgatgttaggaccaaagtaacagtgctcaccgatagtaattgggcaggtatccaaaaaggtcatatcatagttaccataaaaatgatcaccgatatgaatgttgaacccatagtcaaatttgaaagatgattccacgaagaaatcgtcgccaacgtccgccagcagtgctttaaagcggttatttcgattatcattatccgtaatatgattaatctcttctagttgctgtctcatatagacacgacggttaatcaactctggatcaaactgattatagggttcccccaccgtcattttttcacgttctgtcgtcataaattgaacactcctttgctaataagcatatcacacgtcacaaactcgagttaaattgctttcatcattcgctatttgcactaaactgtagtcgtaacaataatgaaagaagaggcgatttacttgaaacttgcactaactattttccttctaaatgcttgttatattacattaaatacatttcgaacaatgctggttgtccggcgccagcgtttatgggcaccgttgctggccgttcttgaggaattcgtatacgtgattgcgctggcgattgcgttgaaaaacatcaattcacccgttaacgtcatcgcttataccgttggttttggactgggtatttaccttggtattatcatcgaagatcacgtggcactgggttacgttaatttccaagtgaccgttaaaatcgataatgacgatcccaagtatcagcaaaataaaaagcttccggaagacctacgtaacaatggttatggggtcacggaaacttgggggtacggtcgcgatggatcacgtctaattttaaacatcttagcacccagaaaagccgatcgccggttaatggaactcattcatgagctggcacccgaggcctttgtgatggtcaatgaaccaacgcaaatgtcaggtggtttctggagtaaagaagtggaacgccgattcaggaaagtcacccataaggaaaaaccaaatagctaatttaactcggcactggactatggatttttaaataaatccaattgttccagtgctttttgaatgtcagaaacagattggtcaacctgcttttgctgttcgggtgtttgcttggtatgtgtctgtttggcaggcgtttgtttcctaggagcaggtttgctaactgctttagccttacctgttgccatccgagtcggtcgaccagctttaaccattgcgtccatggttttattcaataaagaatccacaaaaatattcccctgattatcggcatgccctttagtccagactaatgagagctgtgggaactgaggtaaaaggcgactgacttgctgccacagctcaacgttcattaattcaccgccggaacgtcgccaaccccgtcgctgccagccctttaaccagcccttgttgattgcgtccaaaacgtattttgaatctagaaccagcgtgatgtcggtcttttgctgatgttcttcaatcaacgtttctagtgctttaataaacgccatgatctccattcggttatttgtggcgccccactcacctgcagaatcacttagcactttatcagacaattctaatcggtacgcccacgctgccggatctgttgttttaacgtgaccgcccttaacgttgccggagttgcgggtaccgccatccgtgtaaccaatgatcatgtcaccgttggcagaatgcgtaaccgatttttcacccataaactgtcttgcttctgattcagtattaaagcccttaaattcggcacctgagaaaccagacacttctttttgcgcttccggccaactggtataaataccgggatgctgaccctttctgactgcgtaatacttacccaaaatagtcacctcttattaatttaaatgttgttaaagtttagtaaattcttattacaagctcaattttacagtagtgaatcatactaattctgtgaaaattatgctaaagttattactgtaagtaatttattcagtaattaacgttcatacatgaactttaacatatacccagttgttcaagaggaggaactccgatgtccgaaattcacgcgcagctcatcaacatcgatcaagcacacgccttgttgaaagagcaacacagtcaagccaacgaattttttcccaagctgacactaactggccaatatatcctaccagattatcggctaacacgtaaacgggaagcgttcaaaattcgcaaacacacttttttaaagagacattacaagtcctacgttgcctttgattctgaaaatggtcaaacgctttggatgcgtaatttttcaagtttaactcaagctttgttctggcttcaaactggtcttaaacccggtgatactgatagtcaattttcctttaaagaatggcacgaaaaccacgcagaggaaattgaaagttataaagatcagctacgttccctacataaggaagctgtggctaaaaagaaagcttcagaatctcgcgctcacaagcccaaaaagcacgcctaactgattaattttgactattattagcattccgacatgattaatcagttactaaaatcccttaagacagtgaccaaatcgtcactgtcttaagggatttttgtgtctcatctaatttcgttcaaaaacagaatttaattacttagtaatgtcgctttgaccaaagtaagttttaacttcttgaggccgtgtcttaacggtcacaacaccatgatgaatcgcatacagtacttctgctcgttcattcagagcatcatagaagttatctctgttcaaaataatgcagttcgcttgtttgccaacttcaataccatagtgatctaaaacgtgcatcgcacgagcaccattttgagtcacataccgatatgagttcataatttgatcataacccatggtctgcgccacatgaagaccaagatgtaacggatccatcatgttaccgtcgcccattggataccacggatctttaatgtcatcctcgccaaaggcaacgttaatgccatcttccgtcaactctttgacccgggtcataccccgacgctttggataagtatcaaaccgtccaccaaggaaagtgttaaccagtggattagcaatcatgttaatccctgacattttcagcaaacggaataacttataagcgtaagcatcgttatacgaacccattgcggtagtatgactggccgttacttgatcacgcataccagtctcataagccaaagtagccaaggtttcaagtcctctggctgctggatcatcgatttcatcacagtgaacatcgattagcttgtcgtacttttcagctaaatcactgacaaagtgcaaggactgtacgccatattcacggttaaattcaaagtgtggaataccaccgatggcatcaacgcccatctccgcagccttggtcatcagctccttaccgtgtgggaaagaaagaatgccttcttgaggaaacgcaaccagttgcagttcgatgaaatctttcacttcatcacgaacctcaagcagcgcttttaaagccgtcaaattaggatccgtcacgtcaacgtgtgaacgaacgaactgtgtcccatgacttgcctgtttctttaacgtctggatggcacgcgtcttgacatcttcaatcgtcaatttttgtttccgagccgaccagatacgaatgccatcaaacagtgttcctgattgattccattcaggatcccccgctgttaaagtcgaatccaaatgaacgtgaggatcaacgaacggtggtaatagtaacttaccgcgaccatcaatcaggccttcactatcttttggtgcaatgtgatcagcaatttcaacaaacttgccatcttcaattcgaacatcttttaaggtatcgctattttcaattgacacttgctgtatcagcatcttttcacaacctccaacgatttagttaatgcttttcactaaattataccactggatttaccaattatttaatgcgtcgttcaattcatcgcaatctatttatttccgccgtatactggcaatgaattcagtaccatattacttttaaactgctgtcattttcgctatagttgaattataaaacttaaaggagggagggcaatgtcaattcctaaacatcagcacctttcgctcccaaaagcactgacacttggttttctaatcatcattctaattggcactgttctcctcagtttgccgattgcaactcgtgacgctcacagcacctccgtactggatgctttttttaccgctaccagtgccacctgtgttacgggactaaccttggtcagcactgcttttcactggacgatttttggtcaaacggttattttatttctcatggagattggcggccttggttttatgacgttcaccgtcatgctgttcttattcatgcgccgacaaatgagactgtcgacccgactcctagcccaggaatcacttaacctagataacttatctcaactcaatgtcatcaaattaattttactgctatcgttcatcatccaactggcaggcgccggattattaatggtcgatttttacccgcggtacggtttagccaaagggctgtggttcagtgtgttccacgctgtttcagctttctgtaacgctgggtttgacctattcggcaatagtttggaaggctttgctaacgatccttatgtattaagcgtcatgtctattttaattattgctggttcttttggtttcctagtttggcaagatctgctgctttttcctaaacggcatcacttgtcactgcataccaaattagccttgggaactggtaccgtgctggtcttactctcaatcgttgtttatctactcagcgaaaataatttagcagttcttagcccgcacgtttcttttggtaatcggctagttaacaccgtattcatggcaatcacacctcggactgctgggttagtgacattgccatatcagcaattatccattgccagtattgcgttcaccatgttattgatgtttattggtgggacacctggatcaactgccggtggggtgaaaaccacaacgattggactgctcaccctgcaaagtatcgccactctaaggggaaaacgtgatgctacttttggtcaccgtcgttttactcaagaaaatgtcttccgcgccctgaccttaatattcgttgcactgaccattttaacagtagcaactttggttctatgcgcgactcagccgattcctaaaaatgatggtctgcaaaccgtcacctttgaagttctggcagcgtttggaacaacgggaatctcactagggctaacccctcacttaaacgtgcttggtaaactgattatcatgtttttaatgttcattggccgtgttggcatttacaccgtgatgttctcaatcttaaacgcaaaccgtaagcaacctaactaccgttatcccgaggagagtgttctaattggttaaacaaaagcgtgaaaactatgccgtgattggcctgggtcagtttggcagtgccatttgccagtctctagtagacgccaatcaagaagtcctagccatcgatattgatgaagaaaaagtcaacgaatttacaaacatcgtcacgcgagctgtgattgctgatgcccaagacgaagatacgatgaaggaactcgaaattggcagtttcgatcacgtttttatttcaatcggtcaaaatattcaggccagtatcatggctacgctattgactaaagaactgggtgccaaagacgtcatttgcaaagccgaaaacgaaagccacgctagagtactggaaaaaattggtgccgaccaaattgtgcgaccagagcgcgacatggcccgccgaatcgttttccatcatttgcagccgaacattgtcaactacctgatgctgagcgaccaagtcaccatggctgaagtgaaagtcgataatccaaacttcgtgggtaaatccttgaacgaattagccgtccgaaacacgtatcacattaacgtaattgccatcaagacagagggtaaagttaacctctcgcccgacgctaatgacaagttaagactcaacgatttaatctcggtcgtcggctatacaactgacgtcaaccggtttaatgaagacgcgcagtcatcttcaaaatgagtacgtaacgtaacacaaaaacgccagtccaacatgggaatggcgtttttgtgttatattctggaatctaccgagttgtgtcacactcaatccttaatattcatcctatcttccacttgcaatgactcgtaatcgatttcttcttctgcttctccagaccagtttaacgacacgatgcccaccacaatcagaactaaacccaagatctcaccgattgaaaatgaaacgtgaaacatggtgacatccagtgctgcggttaataccgtgccagcgcctgaccaaagtccgtacgccacactcaacggtaccacccgcatggcatacgataaactgtagagcataattaaaaagacgacaatgctcaacaaagtccaagagacttgggtgaactcctttgatagctttaacgaaatcgtcccaataatctccgtcacaatcgaaagacctaacgctacataatatttaaacatccgccttcacctacctcacaatatattcaacatcaccgtgccaataataatgcacgcaacaccgaccaccttagagcggttgagccgttctttgaagaaaatgatgccgataatcgttgtaaatagtgtaccaatcgcgccccacagcgcataggctaccccgagatccatccagcgaagcgacttggaaaaaagaaacagtgtaatcgtatacccaatcactaggcaaatggtgggtatcagacgatgaaaaccatctgactccttcaataacgagctgctgataatttcaaatataatcgctgcaaataaaaacccatatcccaatagcaaagtgaccatcccgtttctaaaaactatattaagtctcattctaaacctaattaattaaacaagtaaatccctcgaatcaccaacgtgaaggattccaggttcgtccgtcgatttcaccttgtgccagcttaatgcggcgctgctgttcttcgttcaattcagcaagcgctaagtacagtgcgcgttctttaaattgcggcgtttgtgctgctaatttcaagagctgttgtgtcgcccatgtctgttctgccatcagctattcctccgtatcttgaatcatcttcagattcatctgcagatcttctagtgtcgattgatcatttttgatttgatctaaaattaacgttaattgctgctttttgtcttctggaaccgtagcaatgagttcggtcaattgattcaccagccaattggtttgatcatcaaagtgccccaaccgtggctgcgtgagatagcgttgataatcaattaataatttggccttcatctcgtctgactgatagccaaactgatcaattacaaatgtaggtaaataagtcatttgcaacttatgcgctaacgcttgaaacgggatcatgatttgagaaagactaaagttctccccagcaccggcaacgaaatttctggctggtgaccctaaactgactgcaattcctaactctttgccaactagacttcccatagcatccggatacgcaaagtgtcgtgtcagcacttgatctaaccagttttttaaaacggctggcgctgagtaccaataaagcggaaactgcaacactaatcggtccgcttgttgaattagtgcttggtcttttgccacctcgacattaaaagtatttacaggatgccaagtgacctctgacaaatctgcagctttctttaagaactgctgcgtactggaatcttcaatttgtggatgtcccacaatcactaaagttttgataaaaccgcccccactcacatcatcatgatgtttctaattaagctcatcttatcacaccaattatttgtctggtggtctcaaagcttatcatcattgttttcctaacgtgagtgactacaaaacggttttgagagtaggctttctcaaaaccgttttgtgcaatgttttatagggagagcacagtagtgaccgaactactgggaatagcaacgggatttataagcaccaatgtgactatacccttactattcgccttaagtttactgtttgtctgtaatgaacatatgtcgtttatgtatcggttgcgtaaagattgaaaaatcatctattgattagttggaccaactgaactccaccctcgctgcctcaaactgtacgatattttgaagtaacgatacgatgtaaaaccggttcgagaacacaaaaaaaccaccaatcaaaatgattggtggtttcgttgggcttaattaagaattaagcaacagtaacgttagcagcttgtgggccgcggtcgccgtcttcaacgtccaaagttaccttttggccttcttcaagagtcttgaagccgtcagcattgatagctgagaaatgtacgaatacatctgagccgttttcaagagtgataaaaccgtaacctttgtcagcgttgaaccatttaacagtaccttgttccattagaatgaaacctccatgcgctatgcgcaaataaattttgcatttgaaacttttgaataaggagccattctaaaaagaacgttgtaccttaattccgaagcataaatacattaacaatacaataacaggtaattcggaaaagtgcaacaataaactcctaaaaaaatgaactttattttggttaatcgaatcaccgactgcagtataacacgtttaacaccatacgtttcaagtacttttaaaaaattaaataaaacctcaaatgatatcaatttaattattttaaatttagtttttaattatcaaattaccgaatcaataactcaatggtatccttttgaggagcaaaatttagccccgccacacgttctttaagaatctttgagtattcatccagtacatcatcaggaaggggtgttgtggcccctaattcagctaacacatcatctggagagtcaactttctccatatcaatgaataggcgcatattacccactgtatctcgtagtagatcggtcagcagactattgggtttgccttccaaatcggtaacaacaagttgtgcgccatcaactccttgatgattgatcgtaatcatttttaagacatcgaaaacgttatacatagcagctcccccaattaataagtgacattgtgctcattatacacgatgtttctaggctgtaaaagcgattcagtttaactcatccgtaccaggtgccagccaggtttcagactaaagtgccattgggtgccggcatagtcgtgattctttacgccaacgctgaataacagtcgcagttcctcatttcggtagacccgatacgttctggtgactttcagttgattgtgcttagcattttgagtaatttcaactggtccctgggtaggatctgtgtgttctaatttgtgttccagcggattgttcttatacaaatacacccgttcgttctttgtcccaatctggtgataaagcaacacccgttttttggtagttaaactagaggtaagcggatattcatgactaaccgtcacctttttcatacctaaatactgattaagatttaggatcatcagcaaaatactgcccacggttaaaatcaggccaataatcacccaaaccgttttcttagtaccgccagtcataaaaatcatactgccagcaaaaagcaacacaccggcaaataatagtattgcaatcatttaggccgcctccttatttcgtttcaagaagaaggtcatgacgagaccaatcagtgcaaacgtagtggctatcccaaaagcataccgaaaaccgacaacgttagcgtgcaaagctaattttttaaataaaattggtgtggccgtggctacggcatggtttggcatgtggttcatggtcacattcgacattaccgaaaccagtacagcagttcccatggaagcaaaaacttgtcgtgcagtgttgttcacaacggttccgtcactgatcaagttcaacggtaaagcgttcatcccagtagtggtaacgggcatcatgaccatggaaattcccatcatccgaacggtatacagacacacgatatcaattacgggtgttgttgcggtaattggaataaaggaaccggttgccaacgtcagcaataacatcccagcaatggccatgttacgtgcacctaaccgatcaaaaattcgaccagtaatcgggttcatcaacccgataacaatcgcacctggcaataacgttagccctgaagctaacggtgactcccctcgaatggtttgcaaatacattggcagaatcagcgtaaacccgttcatcgccataaacgatacggctaccaacgctgctgaaagtgaaaattcacggtgggcaaatactttaagttgcagcagcggattcttaatcttaactgaccgccaaataaacagcccaaccacgatcaaaccaactatcaacgtgacgtaaaccactggacttgtccattgatagtttccaacagatgaaaaagcaaacagcatggagccaaaccccactacagaaagtaaaactgatagccagtcaatgggtgctttcttggttggtaataccttgcgcagtgtaaaccagcccatgatgaggaccagtactaaaatcggtagaataaatagaaacagcatccgccaagaatagtgcatcaggatccagcctgaaagcgttggcccaattgcaggtgctaaaccaactaccatcccggcagtccccatagcagcaccacgtttcgagggcggaaaaatggaggtcataatggtttggtaaactggcgcagtaatccccacaccagccccctgaatcaaacgaccagctaaaatcatccaaaagttagtagcggaaagacacagcagtgtaccgataccaaaaatcaaaatagcggataagtataacttccgcgaatcaaatcgctgaaggaaaaaaccggtaatgggaataataatccccatcatcagcatgaatccagtcgtcagccattgaacagtatttgctgaaatactaaacgacttcatcaacgtcggtaaagcagtggtcagcatcgttgacgtcaaaaaggtgctaaaggttcccacaagcattgtaaaaactaatatgagtcggttatacggtcgccccatttgatcaactggctgatctgatttatgtaacttctcatccaagagcatcactttctttctgtttaaatctcaaattgaaactatttattgaatctgatgtacccgcgttagtaatttttcctgaactttcggcaacgccattcgcgtcagttcgtcgctggacagccatttacccggaaagaaactgaggtcagcatctggtttaacttcagcacttaacaaggtgatgagccactgacggtgagtaaacgtatgtttaactggcttaccacccatgggtatcacgcgaacggttaggccaaactcctgctgcactaatttctcaagcaagcttaatcgttcttcttccgttaccagttcaggtgtctcactcattgctaaaacatcgtcttctgcaatcaagggaaacgtccagaaattagccaatagcccatcactgggccgcttttgcatcaaaaactgatcatcatggcgaatgactagcccataataagccactttaactggcttgggcttcttcgatttcaccggatactgcatctcaacgccatctaaataagcctgattaaaggccttcactggtgaatgcgccgaatcaggattcttggcagacatataactggcaccaaggtccatcaccgcctgattgaaatcaccgggacggtcgggtgacataatgcgaccaatcacccgttcaaaaactgggcgtgtttgcggcttagcgatatccaggtcaatctccagtaaacgagcaaacacccggaaagcattgccgtccacggcgggaacgggttcattaaacgcaatgctggcgatggcaccagcagtatatggtccaataccagctaattcttgcaggccctcagcggtttggggccactgaccgccacgttcactgacgatttgcttggccgccttttgtaagttacgcgccctagagtagtaaccaagaccctcccacgccttcatcagcttagcttcaggtgcattagctagatccattacggtgggaaattccgccataaaatgttcgtagtatggtatcaccgtattcacttgggtctgctgaagcataatttccgaaacccaaacatgatatggatcatggtcccaacgccaaggtaaatcgcgaccataggtgtcataccaatctaacaacgtttttcgaaaggagcgaatcgtactttctgaccattcaatcactttaatcactccttcacttcagctaacaggcgcaccacctgcttagacggatcatccgtctgccagttgcctacgactggttcttcatagtaattagttcctaaaatcaggtgatgttgcgctgcatactcacgtaaatggttaaagccatcaatcaatggcgtatctaaatggtggtaagcaagcactgcacgaccacctaactgggtggtatcagccttaactttgctgctgggagctaatggcgtatatagtgccgtcaccaacttggattgccccgactcaatcgcgtgctgcgaatgtatccgtccaactactaaattaaccggtgccgtgtccatcacggaaagcacatgcttgatttgcgcttgaatttggttccccgtgacctgtatgtcctccggaaacgtcgtcgttagtaaattaactggtgaacgatcgaccaccgtcgccgcttctggcatggcctgacgtgcggtttcctgattcgtgatttcctgagaaatctgctgatgcgccatgctcaactgatttaattgtttttcaaccagttgctgctgatacttcaacatggcaatgtgatcattaccatttgtgtgcagtgttgctttcgtcttattcaaatcattttccagcttaaccgtggcttgcagtgacagccattgattgacctggttgagatcatatgcccgccgtccgttcttatcccggcttgctggctggaataaacccagctcatcaaagcgattaagaacgtgacgatcaattctcatgagctgggcaaactgacctgcagaaagttgttgcccttctatcaatatggttcacctcgtaaagtatttatgtaacttgacgttatgaaactgcttcattattatcaaaatagagctattgggattgagagggtactgccatgaaaacaacattcaaactaatcagcgttatgctggcaacgctttttttaagcggctgtcagcaaagtctgtctaattcaaagcagacttctgacaataaaggggtcatgtcacgtaatcaaaacgttaccgtcgttgaacaaacacgtttaaacaccgtggatatttcaaaagttaacagttttaacaaattacgcagttcaacggaaggcctatttcgattgggcaacaatggccgggtcaataacggcttagctcagagctaccacatcagtaaagatgccaaaacgtacacctttaaacttcgaaataacgcgcgctggagcaatggtcagcccattaccgccactgattttgtttattcatggcagcgaagtgttaacccgcaaactaagtccgtaaacgctaatttatttgacgggattaaaaacgccgacaaaattagaaaaggtgagctgccagcaagccgtttaggcgtcaaagccctttcaacacacaaccttcaagtgaagttaaatcacccaatggtctactttgaaagtctattagcctacccactgtttgcacctcagcatcgtgccacggtgcaacgttatgggtcccaatacggtgccagtgcagatcagcagatttacagtggcccctttaaactggttaaatggcacgccaatagtgcttctcgaacgctggtacctaacccgtattactgggacaaatcccacgtttatctcaaacgtttaaccattgtgacttctaagtcgccctctcaagatttaagggattaccgcagtggtaaagttgctgaaattcagttaattggtaaacagatccctgagaacaaaaataacccagactacattgtccggcccttctcattaatgcgcataattgcttataattttagcacaagtaacactgctaataaaaaactcattaataatcgtaacgcacgactggcaatttcgcacgcaattagtcgtcgccgtttgatcgatcaagcactgcaaaatgcctctctaccgccaaaaggatttgtcactgccggcctcagtaaaaataatcttaatcattccgactttgctaatcagcagaaagcatcttcatacgtcaaaggaaacaacaagacagcagcacacgaatgggcaacagccaaacgacaactgcatgtcagtacagccaagctaactctcattaccgcaaacgatgcggtcagtgttcgggttgcgaacaatctcaaaacccaactggaaaatcatttgccaggcctcaccattcatacagtttctctagattcaaatcacttaaacaaccgtgtaactaacgggcaatttgacctgctgctcaccgggtggggtgccgattatcccgatccgctttcatttttacaagtaatgacgagcaatagtcggcataattacgggcactggcacgacgctacgtatgaccgactagtaaatactcttaataacaatcagagtacggacaatcaattacggtggcagcaaatgctaaatgctgaaaaaaggctaactgaacagcagggcgtcacacctttgtatcagcaggctgacagctttttaactaacccaaagttaaatggagtcgtgcataatatcagcggggttgtggaagattataagagtgcgtattgggtaaaatagagtgtgaggggaagcgcttagagactggagcgtaagcaactcatggtggaaatcccgaacttggatttgtaccgtgagttgcttacgtgcaagtctctgcttcccggagcacgtttcagaaaatagagtgtgaaaacaagtgcttagagagtggagaataaggcaccgtcaatggaaatcccgaacttggatttctgttggcggtgccttatttgcaactctctgcttgtttgaatacgtttaagctagattagagtggtgatcaaaagtaaattttcaattgtacttcagtcaaaaactagataacatttttatcaatacaaatttacgataactctctttttagttaatccacctttaactcattatcggcctttaattccttcaaaaaagcagcaccatatttggccagtttactttcaccaacaccactgaccgtcagcatctcttcttcgttttgcggcatcactgcacacatatcacgaagcgttttatccgaaaaaatcacgaatggcggtacgccctgcttcttagcaaattctcttcgaatagctcgcagacgttcaaataaatcatcgttttgtggtaagacgtgcgttgcttgcacggcaactttccggtaaactttctgctttccctgcagcacagctaccccactatcactcacacgcagtactggatactgaccgccttccgctaccaaataaccggcagccgtcagaaaatcgattagctctgctaccgacttctgtgacaaacccttcatgatgccatacgtggtcaactggtcaaagtgaaactctttgatccgcgccacgctggaacccgttagcacttgtgccacaaggattttcccgaaccgttcgttcattcgcttaacgcaagacagtactttttgagtatcaacggtaatgtcttgttcttcacgatcatccagacaattcgaacattgcccgcaatcagtgccctcttcaccaaagtaatttaagataaatcgttgcaggcattcttgcgtattagcatactgcgtcatgtcctgtaacttttcgtattcccgcttcttacccgcatcgtctcgctcagactgatcgatcaagaaatgctgaatcgacacgtctgattgacgaaagagtaaaattgcttcactaggcaagccgtctcgacccgcccggccagcttcctgatagtatgattcaaggctgcctggaacctgcgcgtgaatcacgaaccgaacgttacttttatcgattcccataccaaacgcgttggtggcaaccatgacaggtactcgatcataaagaaagtcttcttgattttggcgacgaacttccttagaaagaccaccatgatacatcgttgcgtcgatgtgttttttatttaataacttagttaaccgttcaacttctttacgggtacttgcgtaaacaataccggattgaccggcattttgctttaaatagtccaccagatatttgtcgttatcctggtgcttgatcactttaaaagctagattgggccgtgaaaaaccggttttgacctcttccgctaaacctaatcgctgacaaatgtcctttgccacaattggcgtcgcggtagccgttaacgcaataatcgtcggttgactgggcaactgctgaatcgtttgcgccagattcaagtaactcggccgaaaatcatgcccccactgagaaatacaatgggcctcatcaatagctaccaaatcaattgggagctctgctagccggttcaagtaacccgaatccagccgttctggggaaacgtatagtagtttaacgtcaccgtttgcggcatcattgaaacgctgattgatctggtcatagtccagtgaactattgatgaaggttgccgcaatcccattttcatttaacgcatcaacctgatctttcattagtgagattagtggtgacaccaccagcgtaaccccatctaacatgagtgccggaatctggtaacaaagtgatttgccaccaccagtcggcataattgccagcacgtttcgatgtcccaacacatcgttaatgacctcttcttggccggtacgaaagctgtcatatccgaactgggattttaatatggtctgcggcttcatgaatttcagttcctttcgaaatagtcttcttccagtttaacagaatactggcgctaatgttaattacggtaattagggaaattaaattttaataaaacgaaaggggactgtgatataagcctatattgattaaagctttatctggtttcttaactgaaataccattaaaatttacctttattcaatgctttaatctagcctaaactggcttcacactctgtttttttgaaacgtgctctgaggagcagagacttgcacgtaagcagctcatggtacaaatccaagttcgggattttcaccataagctacttacgctccagtctctaagcgttcctcctcacactctgtttttgaaacgtgctcaaacaagcagaaagttgcaaataaggcgcagccaacagaaatccaaaaccgggatttccattggctgcgccttattctccactctctaaacgcttgttttcacactctgtttatttagctgtaatgtaaccttgtgccttcaatagttcagcacattcaacggcaccgccagctgccccacgagctgtgttatgagacagaccaacgaacttccaatcaaagattttatcttcgcgaagccgaccaatagaaattcccataccgtgttcgtagttcacatccaagcgaacttgcggacggtcatcttcagtcatgtagcggataaactgctttggcgcgcttggcagacccaaacgttgcggttcaccagtatagctttccagtgcatcgattagatcctgcttagttgggttcttacggaagttaacgaatgctgcggcagtatgcccatataatactggcactcggatacattgagaagtgatcacagtatcatcagcgggcacaatggccttctttttatcatcaacgtggccccaaattttcaagggttcgccctctgatttagcttcttcaccagcaatgtaaggaatcacattgccttccatttctggccaatccttgaaggttttaccggcaccagagatggcctggtaagtcgtagcaatcacttgagtaggttcaaactgacgccaagctgatagtgctggcgtataactttgaatcgaacagttaggcttaacggcgacaaaaccgcgactagtccctaagcgttcccgttgatacttgatgacatccgtatgatccggattaatttctggaatcaccattggcacatcaggtgtccaacgatgcgcgctgttgtttgaaacaactggcgtttcagccttagcataagcctcttccaacttacgggtgtcagctttatctaatttgatcgcactaaaaatgaaatcgacttgaggtgcaatttcgtcaacattggctgcatcatgaagcaccatgtccttcacttgttcaggaacatcgccttccatcttccaacggcccttaacagcttcagcgtaagttttgcccgcactgtgcgcactagccgcaactaaagcaatctcaaaccagggatggtcagccaaaatcttgataaatcgctgaccaaccatacccgttgcaccaataatccctactcgtagtttctcactcatcagatatccctcgttttcatcacgcatattttcaaattagtttttaataattgcattaaactgtattttgcacaattagtcaagtgctaggctttatcagctaaaaatgcttttagtcgtttcattgcttccgtcaaatcttcatcagaggccgcatatgaaaaacgaatatagccttcaccgccggcaccaaaggcactgcccggtacaccaccgactttgccctgctcagccaaatcgtacgcaaacttcacatcatctttgccgtagctagctggaattttaacaaaggcgtagaacgcaccagatggggtcgccattgatagtcccatgtcatccatcgcattttgaacgaagtcacggcgtttttgataaactttccgcatttcaacgggatcttgcagaccgttatgcagtgcttcagccgcggcagcctgtgctgggttcgatggtgaagtcaccataaaagcgtgcatcttggttgcattggcgattagttcagccggaccagccatgtagcccatgcgataaccggtcatggcgtgggacttcgaaagaccgttgatcaaaattgtccgctctggaataacgttagcgatcgagtagtgatcaacaccataagtcaattcactgtaaatttcatcagcaatcacaaacaaatgatgatcagcaatgactttagctaagccttcaatcattgatttaggatattcaaccccagttggattacccggatagttcagtaaaacagccttcactgaatcaccttcttgatccagcactttttccaaccgctctggtgtcaaaacaaagtcactgtccgaggtatcaacttgaaccgtggttgctccagcaatcgtcactagcgggaagtacagagcaaatgctggtgtcgggatcaccactttgtcaccaggatttaaaatggtaaacagtgaggcacaaacggcttcagtggcccctacagttgcaataatttcagtattgggatcgtaatccaaaccctgacttgccatcagataatgatgaataccttcccgcagatacatggtccccttctgtggcgagtaatgtgaatcattgtcttgaatgctcttaatggctgcttgcttaacgtgttccggaacgttcatgtctggttctcccagggtgagttgaatgagtcctggaatggttgagaatttttgggcaacttcccgaatgccggaaggtccaacttggtttaatctttgattgacttgctgacttaaatcactagctaattgaggcataatgtcactccattttttaaattaattaaagtacgttttcaagtccaacaactaactgtttcaagtcgaggacgtgatccatggcgaccttaacgccggtcatgaaggattgacggtcaaaggaatcttggcgaatggttaatgcttcacctgggccgccaaacagaacttgttcatgagcaacgtaaccgggtaagcgaaccgcatgaatatggataccatgataatcaccaccacggacacctgacaaactctctgtttcgttaggatttccctgttcatgttctgggcgaacttcatcgatcagtttagctgtgcttagagccgttcctgatggtgcatccgctttgttgtcatggtgcatttcaatgatttcaacgtctgggaagtacttagccgcttccttagcaaacttcatcaataatacagctgacataccaaagttaggtgcaatcaaaccgcctaaatgcttagtattagctaactcctgcaattcacttacttggtcatccgttaatccggttgtcccgataacgggatgaatcccgtgttcaatcgcaaatttggtattggcgtataccgcgcttggtaacgtaaagtcgatccagatgtcagcatcggtttgaatctcgttcaagtcaccatagatggcaaccccagctggcaaatcatagtccttaggatccttggaagtcacatcagcagcgaaaccagcgactaattcataaccgtcactttcttgaactaagcgaaccgctttttgacccatggcaccggtaaaaccggcaattaacacttttgtcattttaaaaaactccttgttctaccacacttattattttactaatgcgtcttcatccatacctaacgcaactgctaattgacgagattcttcctcattcaatgattggattggtaagcggcaatcgccaacgccatagccttgtgcattcaaaactgccttaacgggtgatggtgatgggaacatgaacagtgcggccatctttggcgttaattgacgctttagaccaccagccttagtcaaatcaccagcgtagagtgcatcgtacatcgtccgaatctggtcaccgtagatgtgtgacgcaacggagatcacaccagcaccgccaaccacgcgagcagacagtgcctgagcatcttcaccactgtaaacatagaaatcatcgggggtgtgttcaactaaaaattcgatatcttcaattgatgtgcattgcttaacgccagcaatcttagggttctgagacaatgtcacaaccgtctcgtttgccatggtcacaccagtacggccaggaatgttgtaaatgatgattggcttttcagctgcatctgcaactgctgtaaagtgagcaatcatcccacgttgacttggcttgttgtaataaggtaccacaacgagttcgtaatcaacaccttggatttcgctaacttctttagttaaggctgcggtttcacgggtattgttgctaccagtgccggcaataacgggaacgcgaccaccgataatttggccgaaacgggtgtataattcaatcttttcatcatgggttaacgttggcgtttcaccagtcgtcccaccgataacaaagcccttgctgccagtatcaatcaagtgattagtcaacttttccaacgcatcatagttaatgttgtcgttttcatcaaatggggtaataatcgcggtcatcaaatctacgttatctagtgttgtcataatagttctcctttttattgagcaattcagattacagtctaattattcagccattctagcggtcataaagccggtaatagcgttaacacctgcttcaatagatgattctttaggactcagtgttgctgaatgcaactgtgagtcgtcttcaacccccagccagaacatcgtgccaggaatcttggaaagcaagtaaccaaaatcctcacccgtcatggcaggttcggtttcgacaaagttaacatcgggattccccttcatatatttaatgaagcgtttggtcagttccggattattttcaaccggtagataaccgccctgattcaaacccacggtcaccttagcgttaaaacttctggcaatcccttcaccaacgtcttgcaaacgctggtcaatgcgcttgatcatgacttgcgtcaaaccacgaatcgtcccttcgatgtgggcgtgaccggcaatcacgttacgaatcgtaccagcttccagtttacccagtgtaatcacaccgccctcgatggggtcaatgctgcgggaaatgatggtttgaacttggctgatcaaagccgctgctgccaccaccatgtcattagcatcttgcggataagcagcatgaccgcccttaccttcaaggtcaatattcacttccgtggtaccggcaaataaagttcccattcggcagccaatcgcgccagacggtaagtccggattgtcatgcaacccataaaattcatcgggtcgccactgatctttgaacacgcctagttcataggctagcttgccgccattttcactttcttcagctggctggaagaagaaaatcatgttgtcagtcggctgatgttcagcaaagtaactcaaaacgcctaacgccaccgtcatgtgaatatcgtgcccacaagcgtgcatgacaccgggatgcttggaagcaaatgggagacccgtttcttcagtaaccggcaacgcgtcaatgtcagttcggtaaccaagggtccgccttggtgcgctaccttcaattcgtactaacagtgccgttggcaaatcagaaatcttttgaatttccaaatgggtctgattaaaactggcaatcaccttttccagataagctgacgtctgcacttcgtttaacgccaattcaggaatctgatgcaagtcgcgacgaattttgattaacgcatcttctgttaaaactgccatctcatcacaactttcttaaatcgtcttcaagaccggtcttcgattcggtcttctgatcaacgttcttgataaacttagctggtacaccagccaccatggtatgcggtgcaacgtctttagtcaccacagcaccagctgcaaccacagcaccttcaccaacgtgcacgccttcaatcaccacggcgttggcaccgatcagaacgttatcgtcaacacggaccggttcagcagatgcgggttcaacaacgcctgccaaaacggtaccggcaccaatgtgagaatgttttccaacaatcgctcggccaccaagaaccgcccccatatcaatcatggactcatcaccaatttcagcaccaatattgatagttgcacccatcatgatcacggcattattaccaatcagaacttgatcgcggataatggcacctggttcaattcgagcgttaatttctttcatgtctaacaacggtacagcggaattacgggtttggttttcaatttccgtatccgtaatttcagcttgatgctggtcaagaaaagttttgacatctgaccagtcaccgaacagcacgccagtcttagtttcaatgaaggctttaatgctatccggaacgtttaagtcagccagattacccttaatataaaccttaaccggggtcttctttggtgcattaccaatgtaatcaataatttcttgtgcgtctaattgtgccatgtgataacctcatctctcttaaattaattataataggaagtttttctttaaaatgattcaggtaatggttgatctaaccgcgtcaaatcagcgtacgtttcgcgtttaactaccagcgttgattcaccattttccacgaagacaacggctggtcttggattacggttatagttggaagccatggagtatccgtatgccccagtatccaagatagcgagaacgtcacctggcttgctggctggtaacggctgctggtcaatcaagatatcgcctgattcgcaatacttaccagcaatgtgcaccgtttcagttggctttgcagttggctgatcaaccaaaagcgcttcatactctgcttgataaagtgctggtcgaatgttatcacccataccaccatctacagtgacatacgaagttaagccaggcacatctttacgagagccgatggtatataagttataaccggctgggccagcaattgaacgaccaggttcaatccaaacagctggcatctcaaggttttgatccgctgcgctctgtttgatggtcttgacgatagcatccacgaaatcttcaggggctaatggatgatcatccttggtatattgaataccaaaaccaccaccaacgttgatgacttctggttgatattggtattgatcatgccagttagctgcaatttcaactaacttcttcgctgccatttggaagccattgagttcaaaaatttgagaaccgatatgggcgtgaatgcctaacatattcatccgctcgttcgctaaaacttcttgaagtgcttcatcagcttgacctgactttaaatcaaaaccgaacttactatcttcttgaccagtggaaatgtattcgtgggtatgtgctgaaatccccggtgtaattctgagcatcactgctgaactggcgtcctgttctttaaggacttgagccagtaattcaatttcatggaagttatctaaaacaatgacacccacgtggtttttaacggccatttccaactcgtcgcgtgatttgttgttgccatggaaacttactcgcgccattgggaaaccagcctgaagggccgtgtaaagctcaccgccggaaactacatcgatgtgtccctgttcttggtcaatcacttggaacatcgcaatcgcggcaaaagctttgctggcgtagctaactgcgtagtccacaccatttgcttcaaaaactgatttgaaacgtcgaatctgatcacgaatcttagaaacatcgtaaactgctagcggtgtttggtacttcgttgctaattcatccgcatcgacaccaccgatggttaaatgccctgcttcgttgatctgttcgtttgtcaattgctcactcatgttatgtcctccggtagataatagattatacgaaaagggtccttttgtttacgctaaacaaaaggaccccacagttaatgacttattcattatggactcaatttcgatagcgctccgcagacgttatatctgcgacagtccgtgatttattgaatcacgtcccagcgaactgaatgctgtaacattcagcgcttcggcaacgtccccttttggttcacctcttagtcataacagtgactgagtgaactgactaatgtcggttgcaacctcttcgatttaatcaaagtttataattgttttctaagatagtcaaggggttattaaaaaaaggtgtggaaacgagcgtttagagactggagcctaagggcactcgggcaaaaatcccgggtttggatttgtgtctgagtgcccttaggtgcaagtctctgctcggtgtagcccaattaggcaatgtaagagtaaacagcctttccagccacttccacccccaaaaaaacttaatccaaaaaaattcacatcctactattgccccacaaaagcatccccatttccatcaaaaaaaatttgccaaagaaaaataaactgttagaattcaatgtaattattaaccgtttctgataaaagcagaacggacaaggagtgttagatgtgaaagtcgttaagtttggtggcagttcgttagccgacggaccccaatttgaaaaagtaatttcgattatgaaagctgatcctgaacgtcaggtcattattacctcagcaccaggaaaacgtcatgatggtgacattaaggtcacggatctgcttattaaatatgcacaattaacgattaaacatgcagacaccagtgaaatttttaaccaaatttttagccgttatcaatcaattggcgactacttcggtttaactgaagatgcacttgcgcctatttggcacgccttaagtgagttacccacgaccgattatcctgatgacgactacttgatggccgcgtttaaagctcatggtgaacgattgaatgcccgtttaatggcaaccgttatgactcatttaggcctcaaagcccgctttgtcgaccctaaagaagctggcatcattgttagtgatgaacccaataacgccacggtactaccagaaacctacacacatttagctcacattgacgtggatgatactatcttggtcttcccaggctttttcggttttacccctaatggtcagattgccactttttcacggggcggatccgacatcactggtgccattgtcgcccgtggtttaaaggctgatttgtacgaaaacttcaccgatgtggatgctatctacgctgctaatcctaagctggtcgatcatccactggcgattcaccgaatgacctatcgggaaatgcgagaactgtcatacgctggtttttccgtattccacgatgaagccattattccagctattcaaggtgagattcccattaacgtgaaaaatacgaatcgtccagacctacccggtacactgatcgtaccagaaaaggacttcaagccagctcaaaccattactggtgtcgctagttctactcgcttcgctgcactatatttgcaccgttacctgttgaacaaagaagttggtttcactctgaaattacttcaagtattcaaaaaatataacgtctcatacgaacatatgccttctgggatcgatgacttgaccgttattttcgataaaacccagtttgatgaagataccatccacaacatgtgccacgatatccgcgaagttctccaacccgatacattagagtggatcgacgattatgctatcatcatggtggtcggcgaaggaatgcgtaataaagtgggtgtcattgaacaaatcattcagccacttgctcagcatgatatcggtgtccatatgatcaaccaaggtgcttctcgcatctcaattatgttaggtacccgtcgcgcagacgcggaagaagctgttaagtcgatctataatgcttttttcagtagtgaacctgttaaaaattgatttaatcaagagactttttgactgaagactgatacaataaccacacgattatctgcaaaaataaggagtaaaaaactatggtgcaattacgaaaagttcacggttctgaaaatcactttttcttactggatcaaacgaccctggaccaacagctcaatgatgctgaattaaccgcattagctcagcagattaccaatcccaaaacgggtattttagacggtgctgacggcgtactagtggtcaactcatcgtcacacgaaaacgttttgggtcaaatgcgtgtgatcaacgccgatggcagcgaagcttcaatgtgcggtaatggtttacgaactgtttcacgttacctggctgaaaagaaccatgccaaccagtttaaagttgaaacactaacagctgatctacaagttagccgtcaaaacgacttagcgccagaagtacctgcttttagcgtggaaatttctcctgtacggttcaaaccagcggattttccattcaccaacttgggtaacgatgccttaatcgaccaaccagtaccagcacttgcgccaggattaaacttcactgccatcgctgttcctaatccacatctgatcagttttgtggatgaagccaccatgaatagtgacgttttaggtgaattaggcgctcgtttaaacggcgtcaacgactatttccctgatggcgtaaatgttagtttcgctcaaatcttagggaagaaccagttatttgttcgcacctatgagcgtggcgttggctttactaatgcctgtggaaccggtatgtcagctactagtctagcgtttgccatggttcatcctaatctaggagaatttgaccatacaatcaccgtctacaatccaggtggtttagttaagactcaggttcaccaagccgatgaccgctactggatcgatttaacgggtaacgccaccgagacccaccttatcgacgttgatgaagcagaacttcataacgctaacgtgacaacggaaaccgcctcgattcagcaaaccacagaagaggcagcttaccttcagtttgttgatcagttacccaaggtttcagcaattgccgttaaaaagtaaagtaaatcaaacatgaatatatatacaaaaaggacttcagccatttttgagttgaagtcctttttgtactatttaagtttggtttttgccagccgaattaactcatcgctaacaaactcactggtgaagcgttgcatcggtgtaatggcatgcctgtccttatacgccacaggtttggtggcaaccaccgctaccgttaaatgattctcggtcaaaaagacctggccgattcctttcagtttacccttggtatgcctaccagttcgccaagaatgcagttgaaaatctgattcatcacggataacgtactgaccgctatcatcctgttcaactggcacaccgatatattcttcaactggatactttgcttttgccatgattcacctactgcttttcaattaataattcatcaactaatgtttcaatatccgcgtcactcagtactttacgcaaccagcgcttactgagccgttttcgtaattcatctttatctagactggcatccgtcagctgactttctaacttgcgggccaatttatcatcaagtaaatcaccgtatacagcgaccttgataatttgccgctggtcaaccatcagattaagggcaacggtgcctgcatcaaattgcttaaaccgatagcggttaaaaccgggattagcaccaaaattccagtcattcgttcgatattgttcggctaaccgttcatcaatgatttgccaatcatgatcagttaaatgataagtttcaatatcttctaaatgctctacgtggaataacttcagtaataactgagtcttgaaggcttcactcgttaactgctgatattctggtgccaagtgagctttaatattttcaatgttacttcgatttgatttgacccatttaccgttaatccgcgtttcaaccgggtgtaaggcctgactagctgcctccaaatccatgtcatacatcagtgttccaccagcagcataggcatcgcctgacttaaccatggtcataccggtaaacttatgatcatttaccacgaggtcggaattgccacgtaaaacggcatccgttgctcctaattcgtgcaacgcatcaagaattggctgagcgaagacactatagttaccccactcagcatcatcatcggtttcccctaccacgatattttcgaacactaagttccccatatcatgataaacggcaccaccacctgatgtacgtcggactaacgcaatgttattctcacgcaaatatggtacgttgacctccgcaaacacattttgattcaccccgacaatcacggaaggttcgttaatgtacatgatgaggccatgccccggtaacttaagatcattgatcaaataattatcaagggattgattgacgattggatcatagactggtttgccatcacgactggtatcgattaagaacataaggtttgcccctttttcactgatatttgatacttctattttacggtttttctggtgccgataccagtccaacgtgaatcgctttctttctttcacaaacctcggtatactaactatatgaacgaaatgtgagggagcgaatagtcatgtcattttggacgaaattaatcactagtattaagcacttgtttggcggaaagccagccaagtttgaaccgaaagaaaaagatggtgtttggtaccaagaaatcaaaccgggtgtcgtcagaattgggatgacggaccaagtttatgaagatctaggtgacatcaccttcatggacttttcgtcaccagatgaccaattggaacccgatgatgacctacttgaaatggaaggcgcaaaagcggtggaaactttaaagtcacccgttaaaggcaccattattacaagaaataatgacttgcttaaacaaagtgatcaactagctaaccattcaactcaggataactggctagtcgatgttaaaactgcctaaaaacacaaaaaaagaacgtgatcacagccaactggttgccatcacgtttttttactgttcttttgaaaacagccaaagccgtttttgattagttttggttttctagcttttcagcagcttcgtcaattgtagcgaaacctgacttgccactcttagcctttgggtgcttagcacggtcttcctctgccttttcgatcaatgccttacgctgttctttacttaacttgttagccatttaaatcgcgctccctttattgtcttaaaatcatacgttaggataccctaacaattttatgttagcactaatagtcggctttgttaaatattatgattgattgtagcccgatttaatcatcttctaaacgcttccagtagatgatttaatgtggctaatctcattcataagggcaaattacaagtttaatccgaacaagcccggaatctttcaatggcagtctgttgatgatgtatttttaatggtcgttgattaattagttcaagtgctgctaggatctcatcagtcgttactggctaaaattggtctttttcgggaagaaacagcgtaaccgtctattaaaatattcattggaacctcgctcccatggtgaatatggatggcacaaaaataaactttgatctgataatcctgttctaaggcctgataattggcaaactctttaccatgatcaacagtaatgattttacttggggaccgaaggccccataaactgccaaaggcggtgtttagagttagccgttctattaggctttgaaggcccatgaagtcgggtcttacgttctacgaatgtaaccagacatgatgtgactcacttcgactagaaagcaccgtatctacttcccaatgaccaaaagctaaccgttgattaacagttgttggccgttgttcgatggaagtcccacttgaaatttcccacgattttgcctcactcggtgctggcggacattccgattgggtagatcagtcaatttgaaggggagccagccacgattaagccaattataaattgacgcagtgctcaagttataagcggccgcaatggtttctggtgaccaggttaatcgtaagtgattggtaattaaagtcgctaatgctgccgtcagcatcgaacgacgaccgcaatccgccttttgcgatctgcatctgctgagctaattctggatcataaggtttaacccggtccaactcatagctaatcgtagcttggcgaagcctaaggcgtcagccattacttggtaagatttattccctcattgaccagttgtgctaggcgccacgttgaaaacgtgataaagtagatgtacccaaagtaatcactccctatattggttggaattagctactaccattgtaagtgattgctttgggctttttaatttctgttcggattaattatagaatttgcctaagcaaaaaatttaacactcagaaataaaggactacaatgtagtttgtaaggaggaattcaatatggctgaatcagtagataagactttattcttggattacaatatgaatgacgcttttgactggagcgatgaagaaatgccagttcgcgacgccatttgggattacctcatggagcacaacggtcacgataccatgaagaccgaggaacaaatgaaaccattcatgaccgaatctgaagctgacattcgtaagtttgttgaaggtaacttgaagactgcggatgctaagtaatttattattagtaaaatcgttttaaaacaagggtcgtttaccaattagtggtgaacgacccttgttttgtgattagtttgtctttttatgttttgcagacaatataattgagaacatagctgatatattcaattaaaaacgaatatcagaactgattttgactagatttattcgtagatttagtttaaaatcaattcaaatctaaaaaaatcaatagcaacaactgacaaatattcagaaaaaacttttgtatattcagttttctgcataacactgttctattggcgttttctagatttttccacagtttgttgtaaacctttttgtatcagggttttattgagtaatgtcagacagctatctttcgggaatgtataaaataaagttgcgttttatatctataagtattcatataaagccaaaataacttatatttaactgaaaatagctgtttttatgtataaatcagcttgacaatactcgataaaaatcttatcttatacaaaaagcaattaactccgtccggcgaggcggtcattgaggaggctatcaaacatgaagaaatatttaacactggaaaacggagaacaatttgtaggcaccgctgttggtgacctcactaaagaaattaagggtgaattagttttcactaccagcatggtaggttatcaagaaagcatcactgatccctcatacacgaaccaaatcatcacctttacttatccattaattggtaactatggcatttcacttcacactaatcagtcgccaacgattgctgcatcagccgttgtcatgcaagaaattgcaacgacggtttttcattatcaaagtgtcatgacgttagatgaattcttaaaaaagtctggcgtcccaggcatcactggtgttgacactcgtaaattaacaaaaatcatcaggaaacacggtaccatgaaagccagtttgactaatcagccactgtctaaaagcagttttaaccagactaaagccgtggatatggtggttaaatcagcgaccttctcacaccctgaaaacgagcatccggatcacgttgtcttagttgatttcggggtcaaagcaaacattgttaaatcactgagaaacttcggtgctaacgtgactgtggtcacaccagaagctaacttcgagtcaatcgaagctttgcatccagatggcatcctgttatcgaatggccctggagaccccgaagaattcacggatttcctgcccgttattagagaactgcaggagcattacccactatttggtatctgcctgggtcaccagcttttggcgctggcaaatggcgcccgcacttataaaatggtcttcggacaccgtggtattaaccaccccgttaagaacctactgacaggtgaagtcattatcacctcacaaaatcacggtttcgccgttgatattgattccgtcgatgaaacaccccttgaagttactgccattgaaatcaatgatcaaacctgcgaaggattgcgctaccctggtaaaccggtcttttctgttcagtatcacccagaagctgcaccgggaccacatgaagcaacgcggttattcagtaaattcattggttcaatgcatacgaatgggggagtacaacatgcctaaaagaacagatctaaataaaatcgtcattatcggctcaggcccaatcgttattggccaagctgcagaatttgattatgctggcagtcaagcctgcttaagcttaaaagaagagggttatgacaccgttctgatcaattccaacccagccacgattatgaccgacgacgaaatcgccgataaagtctatttggaacccttaacgttggacagcgtcactgccattttgaagaaggaaaaacccgatgctatcctaccaactttaggtggtcaaactgggcttaacctggcagtagaactagctaaaaagggtattcttgctgacctaggaattgagcttttaggaactaacctgcatacgatcaaccaagctgaagaccgtgaagccttcaaagacttgatgaaagatctcaaccaaccaattccaccttcgaagacggtttacgaccttaaaacagggttagattttgcccacgaaattggttatccagtcattatccggccagcgtacaccctcggcggtaccggtggcggttttgctcataacgatacggaaatggaaacggtactcaatcgtggtttaaccatgtcaccagaaaccgaatgcttggttgaaaagagcatcgctggttacaaagaaattgagtttgaagtcatgcgtgatcacaagggttcatcgattattgtggctgggatggaaaacttcgatcccgttggtgttcataccggtgattcaatcgtctttaccccaacacaaacactaacggataaagagtatcaacgcttgcgtgacgcatcgctgacgattgttaacgcccttaaaatcgaaggtggctgcaacgttcaattagctcaggatccttatagcgaacactactacgtgattgaagttaatcctcgggtcagccgttcatcagccttagcctcaaaagcaacgggttatccgattgctaaaattgcggctaaaattgcggtgggccttaatctggacgaaatcattaatccaatcacacaaacgacctacgccatgtttgaaccagcgttagattacgttgttgccaaaattccgcgctttgctttcgacaagttctaccatgccgaccgtaaactaggcacccaaatgaaggccactggcgaggttatggcaattggcagtaatattgaagaatccctcttaaaagcagttcaatcattagagctggactcccagatgcaaaccacgcttttaccggatgatgctaaaaataaatcacttgacgatttactcgaaactattaaaacaccaactgatattcgtttatttgaattatttgcagccatttgcaaaggtgcaacgatcgaacaactgcacgattcaaccaaaattgatgaattcttcttgtccaaattaatcaacatcattaacatgcaaaaagagttaatgactggtatgttaacctctagcttggttctaaaagcccaaaagctgggctttgatgacgacatgatcaaagccgtcaccaacgttactgatgatgaattaactaaacttcatagtatgaccgatcaacatttagtctacaaaatggttgatacctgtgctgctgaatttgaaagttttaccccctacttttacagtacgattggtaacgaaaacgaaagtaagccgctaggtaacagtgtgattgtactaggcgctggccctatccggatcggtcaaggtgtggaatttgactacaccaccgttcactcggtcaaagcgcttcaggctgccggttataatgccattattattaataacaatccggaaaccgtttcaaccgacttttcaatttcagacaagctctactttgaacccctcaccattgactcagtcatgaacatcgttaacttagaaaagcctatcggtgttatcgttcaatttggtggccaaacagcgattaatttgactcaacagctcactgatcgtggcgttaaaatccttggaactaacatggccggcattgaacaaactgaaaatcggcacgattttgaagatctgctgattgaccaaaacattgctcatcctgctggtgacactgcaactgatattccgggtgcccatgaaattgcaaccaagctaggctaccccgttttagtacggccaagcttcgtccttggcggcaaaggtatggcaatcgttcatgatcaagacgagcttaacgattacctcgttccagcattgaagcacagccatggcgaacccattttaattgataaatacattaagggtaccgaatgtgaagttgacattctcagtgatggtaaacaagtcttcattccgggcatcatggaacatttggaaggtgctggtgtccactcaggtgattcaatcgccatgtatccaccacagacgttaacgacttctcaaaaagccgaaatcgttcaaatcgcaacaaaaattggtaagtccgtccactgcatcggtatgatgaacatccaatttatcgtcgctgatcaagtttacgtgattgaagtgaatccacgggcttcaaggaccgtgccattcatgagtaaaattactcatatgcatttggctcagctcgcaacccaattgatcattggcaaatcactggacgaaatcgacctgcagccaggaatgtatccagaaccagatagtgtttatgtgaaagcacccgtcttctcatttgctaagttaccgggtgcaccaactgcacttagtccagaaatgaaatcaaccggtgaggatcttggtcacggcaagaccttagctgaagcacttcataaagcattctttgacagctaccatttcgatagtgaccaagtggggccaatcctggttacgccacacgatgctaaaaatactgaactaatggcagcacttgatgcgggtggctatccgcaccaggtttatcaaatgggacaaaagtggcctgaaaacttagcttttgttctcgcaactgaagatgaaagcagtctggccaagcaattaacgacccgggctttaagccacgaagtcactttgtttaccgcttctgacactgtcgcagctttagtgaaaaatgctcagtctgctagtgctaaacagtagagtgtgaaggtaggcgtctagagactggagcgtaagctaagaaaccggggatcaggtgattttgtcctgatcgtcgttttcttagcttacgtgcaagtctctgcctacctgaacacgttttgaatgtgagcaataaggcgtattccgtcgaacggaatacgccttatttgatttaaattttggtatttaccaatttgaatcacgtctttagtgaaaccgtttactttctaattgacacccggcttttaacctgcgatgattaagttgtaatcattgagattagaagtgaaactaacgtcattaaggaggcttaaaaatgattaaaaatcaagatccacaaaccactgaacgacttacccgtttaacccttttactcgttattcacgccccaaaacacgttcctcttgaagaactcactcaagcgttaaacgctgacgcagacacaattcgtcacgacctgaactgggtttccgactttttggcgcgttatggcctggttgtcgacccttccgttgatcagcaagtagctgtttacgggcaggaaaattacctgtttcgggcagctttagacctcttaaaatcactttccaaaccccatcaactggttactgacttaccaatttcggatccagcattagaaacgcagttggaacaacgattagatgcgttgcttaaaaccattccgttagatactaccgcacaacaatcaatttacgattacctgtggacattagccatgcgttaccgctatggcagagtaaagcgactgggactggcagaattattcacgcctggacagttggcactgatttcaaatgaaaaggacatccatccctggtcccaaaagaccatcgaagttttagaggattctttaccaggaaaacaagatttccctctagtcgaagcttatttattaacgttaagagtttggctgtatgctaactgattggattatcaagcgagcgtgacacaactcggtagtttccagagcttaacacaaacaaagcgtatttcggcaaaattgccgaaatacgctttgtttgtgttaaatggccagaacctgagttgtgaaacattttagactagattagaatattgagtaaaagcgaactttaagttgtctttcagccaaaaaacagatgaaatttttaccaatatacccttacgtcacagccttttcttttgtcctaagattcacttataatgagagcgttgttttcaattctaatattacccggaggatgtctatgtttaaatttcaacccgccaagccagatcagcttgatgccattatgaccattgaaaatcaggggttcactcctgatgaagccgccagcagaaccagcatggcgcaacgtatcaagcgaatcagcgacacttttattgttgcctcacagggatcacaagtcttaggctacgcggttggtcctgcttcaaacgaacgctaccttagcgacgacctctatgatcacttaacagccaataactcaacggatcgttaccaaaccgtgttgagtcttgcggtagccaaagatgcacgtggaaagggtctcggcagtaaattattaactaaattagcagatgtagcccgcactcaaaaccgcgaagcaatcacgctgacctgcctggcaaagttagtgcctttttatgaacagaatggttatgttaacgagggtgtttcagcttctacgcatgctggtgaaacctggtataacatgataaagtccctttaacgctcataacaatcggttataaaaccaaacgtaatagtgcccatcaattaaactaattttagtgacgctggtattatcgggctctggcagtgtcatcgcatcccgtggctgcaaagcggctaacacggctgctttaacagtaaatccatgggtgaccacgatgtattttccatccgctgaacgattcgcataggccgtcataaagtcggtgatgcgcgctatcacgtgatcaaatgtttcaccatcagtggcatactccgtataactgggtaaaacgtcacgtagaaccggatcaaatacagctggatattgtgcttgtaacgcctggttttttaaaccgtcccactgaccataggagatttcaagtaaccgttcatccgtttccgtaggcaatttcgccgttgcattgagaatggccgccgtctcttgcgtgcggtgcaatgggctggcaatcagttgatcagcaaaaccaatgtcaaacacatcgtgcaaatgctgtgcttgcttttttcctttatcatttaacaaagtaatttgagaattaatcgtgccctgttttaagccaagagcattagcctcagtctgcccatggcggataaaataaaattcagtcatgcagttgtccctcatttctagatggttagtggtttaaaattcatgaatgttttcataatagcaattatcctcatgtaattccaatctttaaagcatccgtgtaactataaaaaaattcgatcagcagattaaaacgcttccattacgtgtttatcgcttattagttataaaattttcgttgacaagtattctatcgtctgttaaattttaattaaagaaagggaggctaacaatttgaataacttaaataacacacaaacagtatcatcctcctggtctacagtcacatctgtgtagacccatcttgacgtgtcttaattggtctcacacagatgaatttacgaatttaaattcaactgtgaggccgctataactgtaaacaatcaccctcacagccaatactgtgagggtttttaattttttaaatcatttggaggaaatctcatgacagtttataattttgccgctggtccagcaacgttaccagaccaagttatcaaccagattcaaagcgaacttccctcgttacgaggaacgggaatgagcattatggaaatctcccacagatcagcactttttgacgatatcatcaatactgcacaacaggatctgcgcgacctcatgagtattcctgacgattatgaagtgctcttctttcagggtggcggaaccggtcagttcgcagccgtgccgatgaacttagcaactaagcaccaccgtattgcattactagatagtggtcactgggcagctaaggctggtgaagaagccgctaacttaggttatcaagtggacacactggcttctactaagggcacccattacgatagactccctgctcgaacgtcaacgttacctgctgatacctatgactacttgcatatttgcaccaacaacaccattgaaggtaccgcctatcatgatctgcctcaaactaacggtacgcccctagtagctgacatgtcttccaacattatggcacagcattatcaagtgactgattttgacttaatttttgctggtgtgcaaaagaaccttggcccagcaggtgtcacgttggtcatcgtgaaaaaagcgctgatcaaacacgtggatcacattccaagtgtctttaactatgaactgttcgcaaaaaagaactccatgccaaacaccccacccgtttttaacatctatgccgtgggattaaccctcaaatggttgaaagaaattggcggtattgaagctatggaagctctcaatcagaaaaaagccagtctgctttacgatttcttggatcagtcaaaactatttaataatcccgttaaacacgaagaccgttccctcaccaacgtgccattcatgacggcagacccaaaaattgaccaggcagctattgatgatttgactgctcatggtttgttgaatctaaagggtcaccgcagtgtcggcggtttacgtgccagtctttacaatgccatgccatttgaaggtgttcaggcattggttaatgaactttatcattttgaaaagaacttataggaggccatttcatgtatcagattaaaacgtacaacgcaattgcaaaagccggtctggaccgatttactgaccactatcagatcaatcaaactgatgatgctgatgcctacctgattcgatcggtaaacctacatgaacaagaattacctaatagcctaaaagtcatcgttagagcaggagccggcttcaataacgttcctattgaccgggcaaccgcaaccggtacggcggtcttcaccactccaggcagcaacgccaacgcggtgaaagaactcatgattgctatgctgattgcggcctctcgaaacctctttgcagctgctgattacgctgcgcataacagtggcgccgatatttcaaaacgaacagaacacgataaaacgaaattcagcggtcaagaactattagggaaaaccttggctgtgattggtgttggtcacgtcggatcgttagttgccaatgcggccagtcagctcggcatgaaagttattgcttatgacccctatctgtcatccgatgccgcatggcggatttccactgacatccaccgggctaaaacattaccagcagcactgaagaatgctgattacgttaccattcacgtccctaaaaatgaggaaacgacaggcatgattggtgctgcagaatttgcggcaatgaaacctggtgtgacagtcttcaactttgctcgtggcggtatcgtgaacaatactgaaatgctcaaagcgttggacagcggtcaggcaagaggctacttcactgattttggcagtgacgaaattttaaaccggaaagacgttgtagtgaccccgcacattggtggctcaactggcgaagcagaaaccaacggtgccgtacaaggtgctgaaaccatcatgaacttcctggaaaccggtaacgtgcaaagcagtgttaacctgcccaatttacaagttccatttggcacaccttaccgaatcaccgtcatgcaccaaaatattcctaacatggttggtcaaattgcaacgatcctagccaatgccaacatcaacattgaaaacatgagtaacgcggctaaagataaagtggcttacaccatcattgacgtcaaccatttacaaaagcaagacgccgtgattattgaccagttaagtgctattgaggccgtttaccgggtcagactaattaagaaataatcgtaaatagaggatgctgtgacaaacctcggtagattcaaaacttaacgcaattaatgcctattccgcgatttttggaataggcattatttaggccggaacctgtgtttatactcatgactgaaccatatgcaaaaacgggtatcagcgccctacacgctgatacccgtttttaattaaaaccttaccgttgttagggaacgcgaagtaaagtttgtgtgttgcgatatctaaaaatcgttatcgcaagtgtttaaatgattcgtcgtcaccaaacacttttatctagtcgctgcagcttgccatcgcgcccccacgctccggcaattacaactccattaccaatccataaattgcgctgataaacagttagctcagcagtagtagtcggctcaatattctctccaatattaaacttcgctgttgaaacactcccagaactatccatttgtctaccacaagatacatcatgtaatgtaattaacccttgtattaaattccctagctaatttccaggtagttagccatgtagaaacgttaagcaagagctcctttaatacaagactaattatggcttgaaatagccgtaaattcaacacttcgagtctcccagtttttttaatttttttaaaaaaactgacaaagtcaatttggcagaataactgattaatggacacaaatgaactataataaagtataatttagggtgaaaagattaatcgaacactatgattggactggctgccatggattatacgtttctattgtcgaaaaacgataaaatttgttttgaaattttatcactcttcacccaacaaactgaccaaactttgaataaagcggagttaagtcagtcactgtcattgacgaactatcagttaaataagtattttgaaacgatgaacgcagatctagccgtcgtttcagaagatacgccctgttacctggatgaacccaataagggggtctggcaagcatttggactgaactcttacgtcttacaaagggttactctgctctatttaaatcgagcaccgttttttacggctttagagtatcagttcttctacaatcacttatataccaaaagcggctacgttaccgcgaattacatgagtgtttcggtattctaccgttcattggattcacttgaagcaatcctggaaaagcaccattttttccaagccagtagtttgtatgctagtaaagaattcaccattcggctccacttattccagctttattacacactgtataacggtgtctctgaaccctttgagcctctgaatccgttggttgaagacctcgtttcagccattcaagctggattgcctgccgccttaaaaccaacccaagaaaccaagttatcaacctttttacgggtatggttactcagaatgcttaattccgatccgattggttcgtctcaattgcttaaaataaaacccacaaagtctagcaaaacaatgcagcaacagcttcaaacactattagcagatcagttgacactaaccgacgacgaatttaactatttgtacagctttttagttgcacaaggttacttagactttgatcagatgcatgaattggctgctaacattcccgctgttgatgacttaaccaaccagtttttggatgagttgcaagatactaatgtgctactcaagactcacttggttgataatcgtcagctaaaagatagtttgctgagtattcatttccaattcacgacgttttacattgagcccacaacgtttattgatcccgaccaggttcaattcttttcggaactttatcctgccttcgacgttgctgtttcccataacatcactaagttacagcgtcgcgaggatcttcacttaacgcagaagatggctgtcaatttatacttcagctacatgtttgcgttaatcaatgcggttccaactgaattaatgcgagatcaagttcatatttgcgtggacttttcacagggtgttttatataccaattacgttattcaatccctggacgcttttaatcacgcccacattattattgatactgaattgacgcctgacaccgacatttatatctcagattttcattctaagaaaattagtcaaacgcaagtcatttggcaagacccaccgacccctgtcgattggtcaaacttagccgatttgattctagacgttaagcgccaaaaattaccagatttatttccaaaccaagatacgcaagaaccagaatagaaaggaagtggcgttcatgagactcagtaagtcagcgagaaataagtggctagcagcatgtctattttcagcgaccgttttaactggtttccacttgcagcaaatggctgtacacgcctcagagacgcaaaatacgactgctgttacctcaacaacggacgcaacaacgacaacaagctctacccatagtgtgtctctaaaatcatcttcaagtgtaacgacgaccacttcctctaatttgcaaagtaacagttcatctagttctcaaagtagtagtaacagtagttcatcttcttcaacatctattagcagcactagtgattcaaagacaagcagtgtcatttcaaattcagtcggcgaatcatcttctagtacgccagcaaatggttctaatcagaataaagaaactgataatactgctactgatcaattaggtcatttagtcgttaacgcttttaatgcggtaaccaatgaaaagatcaacggtgatgcctttaccagtaattatcagggctacgttggttcagctattaaggataagtcggctttcgtcactcatattcctggctattcattcgtcggtaatgctgacactgctgttcccgataactttattgggggcactcaaattgccaatttatactataagccgctctcaacgattgttgtccgctacgttgcagaacctaaccgattattgtggacctactcgattccaactacctatgcaactcaggggcagctcttctcgaccactgataatttaatcccatttgctgggtataagctcaatcatgtcagtggtgatgcgaatggtattattaaccagaccgtcaactcgcttagcgatgctaacccggttgtgattacgtactattacgaaccagaaccaggttcaataagtacgctggatacaagtaattggattgtaacgtctaaaacaacgccaattggggcaacgggtaagtacagctttagcatgtaccttcaacgtgaccaattaccgtctattgaaattggtcattatggtatccaaccaactggatctaatcaaatccgcactaatggtggtactacaggtactggtagtgttatcgaaaaggtgccaactgggccaactgggtcagctactacaactgatatcaatactcagacaccgacaaaaccagtttccttaccaacagcgccatcagtacctactgcaacggtaaatgttgttacggaaacgggcaagccaatcaatcagctaacagttagcggtcaaccaggcactaacgttcgcactcagattcaacctgaactgaacaacctgcgacgccagggctttgcaatcttaagtaacggtgttaagggtgacaccaagttagagcgtgataacagcgtcttaaccgttaaagtaagtcagactgaccaacagactgatcctttccaacacagtacaatgccaattgttacccaattaggtcaagcttcacaacccgctcggcaagcagctcaaactgtaaataaagatcaaacaaacaatagcaataacaatcaacgttccgaaaacacgactcaaacgactcagcaaaacaaccaaaagcgtcagcagatgattcgtacacacactactgaagcgactgcaaaagatacggaacgaaataaccaggttcaccgcgacaccattgctaatctcggccaatcacatcaacatagcgccgcagctactggtagcggtggtaatcaaatttctggtttggctgcttacttcatcagcctttccggcaaaatcaatctgggcacaagagtataagatttaaagcactcatttttgaagggtacaaaaatgaatgctttttggtgactctaaatttgttgtcacaagctaaattcaaaaaagattaccagcaacatcattggtaatctttttttgatacggcaaattctataattaatccgaacagaaattaaaaagcccaaagcaatcacttacaatggtagtagctaattccaaccaatatagggagtgattactttgggtacatctactttatacactttatcacgttttcaacgtggcgcactagcacaactggtcaatgaggggaataaatcttaccaagtaatggctgacgccttaggcgtcgccaaagctacgatagctatgagttggaccgggttaaaccttatgatccagaattagctcagcaagatgcagatcgcaaaaggcgaattgcggtcgtcgtcgatgctgacggcagcattagcgactttaattaccaatcacttacgattaacctggtcaccagaaccattgcggccgcttatacttgagccctgcgtcatttataattggcttaatcgtggctggctccccttcaaattgactgatctacccaatcggaatgtccgccagcaccgtgagcgaaaatcgtgggaatttacaagtgggacttccatcgaacaacggccaacaactgttaatcaacggttagcttttggtcattgggaagtagatacggtgctttctagtcgaagtgagtcacgatcatgtctggttacattcgtagaacgtaagacccgacttctatgggccatcaaagcccctaatagaacggctaaggctctaaacaccgcctttggcaagtttatgggggccttcggtccccaagtaaaatccattagtgttgatcatggtaaagagtttgccaattatcaggccttagaacaggattatcagatcaaagtttatttttgccatccatattcaccatgggagcgaggttccaatgaatattttaatagacggttacgctggttcttcccgaaaaagaccaattttagcccatgtaacgactgatgagatcctagcagcacttgaactaattaatcaacgaccattaaaaatacatcatcaacagactgccattgaaagattccgggcttgttcggattaaacttgtaatttgccatacgaatttttaagtgcatgcaatcatattggtgcttgaactttgtcattaaaacgatgcgacttccttaacgtgctttaagttgctaacgttcccacgattagcaattaaactgatatttgttttcatcgcttcacgcccccgttcacgacgaaggcaaccgcaacttttagtatttcccttacgtaataaatagccgtcagcaacaacttctttaccgcaatcacaccgacaattccacaaggcattgccatttttcgccatcccagcaaaactagtcacggtcagacggccaaaccgtcgattggttaaatcaattcttttcattgtaatcccccattagtgctgcgttgatgcagattcggttatctcattttccatgttggcgtctgtctttttaggacgtgggtgccgagcacgaaaccgatctaaaccaaacagtccaattaagcataccaacaaccccatgcctataaagactgcttccgttaaatcttcacgatcggcttttgccaataactgtgacgtagcagcattaactagtttaggaaactgagtaaccccgtaaaccaccgctgctgtaagactcccccaaaaataatatgttttacgtaataaatgttgcttttccattttgctcggcccccttctgacttagcatatgtctatactataatagtacgctgaaagcgcttaaaatcaacgtttcttggcagcttttccttcccagttttttaaaaaaaattaaaaaaaatgataaacgttgctgtaaaggttttacagaccaactaaaaaagccgactaatcaagtgatcagccgacttttattctgattaataaggtcaattcgggtgattaaccggcatgacagcctctagaaattcaccaatatctttggttaattgacgcccctggggactaaaggtcatcacgtgaggcgcttctggatagtgccgatacgttaccggtgcgctgggcgataaataatctgccaagcgctgaccaatatcacgatcaatcagttcatccgcatccgcttgcgcaataaagactggcttggttaggccgcggatctcatcatgtaccggccctgtaaacgtctcaatagtcgttaacatctcatcaatatgctgtgataaatactgcattcttttcgttacttcgtccgttggcagtttcattttctggtaccagccacgacattccaacaagaaacgtgccgctacccgactggtgtctaccttaaaaagcggtgtatcaattgtgccgcctgcaaccacttcatcaaattgtgctaaagctttcatagcaaataagccacccagagattccccgaaaactgcaatttcactgtgaccgtcattgataagctgctgaatagctgttcttgtatcctgccaccaacaatcaggagcgccagtcttaaaaatctgccgcgggtcagcggtgccatgacctgcaaacataggtcctaagactgtatatccacgtttctgcaatcctcgtcccatgatgcggacatcattgggtgtcccggaaaatgtgtgtaacagcaacacagccggttcacccgctttaaaataaaacgcctgtggcaaatccatctcaagcacttcctttactctctttttagaatattttacactattaccactaaaaaatcgcacctccaatctggtagtgcgatttaaaagacaatcaaattattcagttacttgatggcgactagtgccgcctttgacaatggttaaaacgtcatccaaggcaatttccaccatattagctacagcagcgtccgtatagaagccaacgtgtggactgacactcacgttgggcatggtcagcaatttttccagcggtggattatttagatccttattagaccagttctgactgaaaatctgactatcgccttcaatggtatcaatcccggcaccggcaatttcaccggtttccagtgcgtccaccagatcatccgcaacgacaactggtccccgagaggcattgatgaagaaggcggatggcttcatcattttaaatacgtgcttatcaatcatgtggtgtgtttcatcagttaagggcgtgtgcatggtgacgatatccgccgttttatagaccgtttcatgatccgtataggttaaggtatctccaagttctggccggtgaatcgggtcagccgcaatcaccgttgaacctaacgccttgaatatccgggcaacggcactaccaattttcccagcaccaataatgccaatggttaaattatgaatctcgttagcttccaatccgccccaagtaaaatcatggtgagcttcacgggcttgagtaatccctaagtgacgaactaacttcatcacgtgtgccaacaccagctcactaactgaacgaggtgaatatgctggtacgttggtaaccactagatgattttcagcagccaatttcaaatcaataatttcgtaacccgtaattcgtaacgtgagctgtttaattccaaacgcatgcagccgctggtaaatcttcggcgagtctactggaatatgctgctgaatcacaatcccatcatacccattagccagttcaacggtttcttcggtcaacggcacatcgttggtatccacctgaacatcgggatgatccttcatccattccttaacggcaactaactcatcttcacgtgcatgatataacaaaaacttcactgcgacttccctcttcctcaacgatttccttttaatgctgatcaacaaacttttgaatccgctcgattgctttcttcaaatcttcggtgctagcagcataactgatacgaacatagccttcgccaccaggtccaaatgatgctccaggaataaccgctaccttggcttctttagccagttcatagcagaatgccacactgtcctgattgaggttggctggaatcttagcgaagaggtagaacgcccccttaggattggcacattcaaaaccggcttttttaagccccgctaacaacaaatctctgcgttgctgatagatcttacgcatggcaaccccatcgtcgggtccgtttttaaaggcttcctcagcggcagcttgcgcgtttgcggtggcagaagtaatagcaaattgatgcaccttaccgatttctgaaatgacatcaactggtccgcatactaaaccgattctccaaccggtcatagcgtgagactttgacacaccatttaacaaaacagtctgtgctggcaataattcgcccatggaaacgtgacgctcaccataggttaattctgaataaatttcatcacttaacacaaaaatatcgtactgtttcaagacatctgcgagtgcttgcagttcttcgcgattataagtcaccccagttggattagacgggaagttcatgacaaccgcttttacagtatccttattggcttcaatggtcgcttgcagcttttctggtgagagaataaagccgttatcagacgtatcaagaaagattggcttagcaccatttaaaatagcaactggaatatattgtggaaaaattggtgtcggaataatgacggtatcaccaggatttagcatcgctgttaatgaagagaaaatcccttccgtagcgccagtggtcactaaaatttgagtttcgggatcatagttgacgttatatttatcattcaagaattttgaagccgctttgcggaggccttcagttccgcgagaattcgtgtagtggctttcgttattctcaatactgcgaatggcggcctgcttcacgtgatctggcgtattgaaatcgggttcacctaaggtcagcttaaccatatctggtacctgagaaatttcttggttaaactttaaaattgatgatggctgaatctgttttaactcttttttcatgctgtctgacaatcgactcatttcacacactccttataatataaaacacccatacagccaatgactgtacgggtgtcgaagtttacccacacagtcagaatctgatctgtgtggtccgtttgcattaatgacaaaatgctcttggctcttcacagatcaggactggaaaaaccaaaagtaaaatcgactattcaactgagtaactgtagttgtctgcatcatgacgatcctctcagaatagtggttacttttatcatagcattttaatggaagaaagcaaggtaaggtgcgcaaacaagcgcttagagagcggagtgtaagtggacaaggacggaaatcctgggcttggatttatgtgcttatctgcttacatgcagctctctgctggttggagcccgattaagccaaggtgcggaacccggtgcttagagactggagtcctaacgtattagtactgtaaatcccgggcttggatttatagtgctgatgcgttaggcgcaagtctctgccgggtggaacctgattaaggcaaggtgcggaaacaagcgcttagagagcggagtgtaagtggacaagggcggaaatcctgggcttggatttatgtgcttgtctgcttacatgcagctctctgcttgttggagcccgattaagccaaactgcaacaaaaaagccaccacccccaaacaggatgatgacccctaacatctaaagtttattgaacctgaacataactctgattagcagtgatgtaactgccatcgctcaattggatacggtaagtaccaccgtgtgaacgagcaattgccttagccgtcacaatggtattgtattttaaactaccttttttaccagtcaagttagcggtttggtatctgccaatattacgtgttacccgtaatttttgaccgtttttaatactgctaaagtaactgtcctttggcgtattagtataccactttgttacggttgaattatccacagtccggcttagatcaacgtgaccgctgatacctgaaagcgaacctgtactactatattgccataagtccgttgcgacatttggcttttgtgaatagtttgcgatccatgagccattaaacttggaatagttgatgctatgttctctgacaaagctttggtatgaataatagaccaaaggcttctttgttaaagtccgcattgtgttataccaagcgttgacataggtctgttcatgtcctttgacaccagaaactcggtgttcgttatccagagcatagaatttagcgttcttatttgatagcgcatagaattggcgcgcatcgttcacagcatcagcagtgctattgaactctgtataatcatattgaccaaatggtgtgccatatttgtgagcaccatttgcgttcacgtcacgcttaggatcgatccggtaatcagagtcaccagggttcccatgtttaacacgaataatcgtcatccgtaaatctttagaagccttagaccagttaatgtttccctgatattgcgaaacatcggcaatcttagtcttagcagcaaaggcggtggttccaacagttagggcgctaacaagtgctaatgatccggcaaaaattctcttcaataattgattagttttcatgtaaatccccttagtctaatttattaattattactagtgtaacgcaagaatgaaacagagggaaaacatgtgaattacagttcatttactgttgtgtgacaagaaggtgcggaaacaagcgtttaggaaacggagtgtaaggtggttatgacaaaaatcctgggcttggatttatgtcataaccaccttacatgcagtttcctgcttgttggagcctgattagtctacataacagtgagccaacatcattgtccccaacccaataatctgtcataatacgttcaaaattaagcgttgtattggaggcgtcaacatggaaaaaactgatttgattggtttacaccacatcactgcaattacttcaagcgcaccaaaaatatttcattttatgacaacgattttaggcctgcatttaatcaaaaagacggttaatcaagacgatgtcgccacgtatcacctttatttcaccgatgatatgggaactgctggcactgacctgaccttcttcgattttcccggaattgctagcggacactacggtaaaaatagcatttccagaattggctttcgggtaccaaacgatgtggcattgaattactggcaaaaccgcttcgaacagtatcacatcaaaactgattcaatacaggagcagttcggcgctaaagtctttccgttttacgattttgatcaacaacgctatcagttagtttctgatgaacataactcaggcttaccaggtggcacgccatatcgtcacagtcctgttcctaatgatgtagcaatcagtgggcttggaccaaccattatcaccgtttcccagccggaccacctaggcaacatcttaaccagcgtcatgggttttactaaacttgaaagccagggttctcagactctctatgaacttcacgatggcggtcacggcgctcaggtcattattgaaagcagcctcatcttacccgatagcattcaaggctacggttcggttcaccacatggcatttcgaacgcccgacactgatagtttaaaggagtggatccagcgaattcagcgcgccgggcttcatgactccggctttgtagaacgtttttattttcaatcagaatattttcgagctgccccgggcgtgttatttgaaattgccactgacggtcctggcttcctagttgacgaaacgtatgaagaagccggcatccacctagaattaccgccctttttagagagccaaagaacggccattgaagctaatttgatcccgtttaattcggaggaggagtgaactaatgacaaatgaaattcacactgcttttttccctggcagaatcgacctagctccggtgttaatgttgcacggtaccggtggcgatgagagtgatctgttgccaatcgcgacctttttatttccagaacaccccaaactgggtatccgtggccgaatcaatgaacacggcagtaaccgatacttcattcgccacgaggatggcacgtttgacttggataatttaagccaggaaactgattggttactaagtgctatcgaacaggaaactgcgcgttaccagttggatgccaaccgactcatcgtccttggcttttccaatggtgccaacatcgctgcttatgcttggttaaataaaccgacaccgtttaaaattgcagtgttattgcatcccatgatgattacgccaccacaccaaatcgtgaatttaaccgggtatcggacattcgccacttacggagacgtagatcccatcgtttccgaagataactttgatcagttgatccagcaactaacggatgcccacgtaaccgttgaggccttcaaaaaccatcagtcccaccatttaactcaaacagaattaatggccgcacaatcttggattaaagaactataggattcaacttgaacactaaaaatagcgcaattccataaaacatcggaattgcgctatttggtattcaataacaaaatatctacaattagttttcttcatccatcagttgctgaacgccacgagccatcgctaactcttcgttggtcggaatcagtaatattttggcacggctatcctgggcatctagtggtccggtttgtccagcttcattaagtgcgatatcaagcttaatccctaaaacgcgcagaccttcaataactgcctgacgaatttccggatctttttcaccgataccacccgcaaataccagcgcatccgcaccgccaatttccgtatagtaaccgcccaccagctttaccacttggttaacaaacatgtccaatgccagcttagcacgttgatttttctcagcggcaacgtgtaaatcacgcatatctgaggacacccctgaaacgccaagcaatcccgaagaagcattcaattcttgaatcacaacttcaggtgtttccaaatctaaccgtttcatcaaataagggaccaaagttgggtcaacgtccccacttcgcgtgcccatcatcacgccggtaactggtgttagacccatggaagtgtcatatggccgaccattcttcactgctgtgattgacgcgccactgcctaaatgcatggtaatcagatttagctcatctagtggtcgattaagcatcaccgctgcttgttgcgctaaatattgatgtgaaattccatgctcaccataacgtctgatttggtactttttagtccattcatacggaatgccataaatcgccgtcttctctggtaaaccgtgaaaataggcgctatcaaacacggcgtattgtggcacaccggataatcgttgtgctaacagttcaatacacttaacctccagcggattgtgcagcggtgccagttcactcaagccctttaactgattgattcgacttggaatcaacttcaccggtcctttaaagagcgtaccgccagccactactcggtgtcctaccgcttcgacttcatctaaagtttcaacgccaccaactgtgatcaaacgtttcaaaacgcggtcgatggctgtgatttcgtctaaagtctccaccacttctttagttttcttgccacctacttcgaccttgacgatggtacctggtaaattgagccgctctacttgacctgaagcaatcacatgttcagccggcatcttcaccaactgccattttaaagaggagcttccagcattgatcagcaatattttagtcataggtcaatacctccgtttacctctattttacaggatactgaggtcatttaaggtaagttcatagaaagatcatacacctttcgaaaaaagcgcatattcgttgaacaagtaaaacctatcacatacaatacaatcatatacaactcacattgtcacaatgaatagggattcttttagagggggaatcattttgaaacgaggacgtttttttgctgtggccgcgaccttgatgacagcagttgcgctaccactttctgctcaggaaactacggcacacgcgacaacgcttacgcctagttcatctatgcttaggcaaagtaaaaactactaccgatttaacgctagaacgcttgctaaccgctatggactaaactacgctgcacaaactgccttaactcgtcaggaagtcgtcaaggtttacgttgctagcagcaatacacaagttcaaaaaagtgccaaattggccatgtcatattggaaccaaaagctaggccatacggtttttgccaaggggacgaaaaccaatcgtacgatgactatcagtatgactgctaagaacaccagtgccgacgcctggtggaagcctgtccagcaccagattttactggagcaggcagattacaatcagcaactttcattgatccggaataaaatgatcaatcaatcgacttcaaccgccgtcactaagaccaataaccgaattttagcttacggccataaaattgctcgccaagctaactttgctcatcgatataatacctaccgggccgcacagatcaatcaggctcaaaaacagatcaacactcaaaaacggaacattaccacccaaaagattgacgtcaaagccagaacttttaaatacgcgaacatcattgcgcacgaaatgggacattcattgggtctacagcactctgcaaattcaaaagacgcgatggccgctaatagcacaacaccaaacatttacaactacagcaaagtaaaggccagtaaaaacgggtttaacacactggacaaaaccgatgttaaccgtgcaaaattagcgctttccgtccatgatgcattgcactaatacaaaagaccctctgcaaatgggttgtgccataagattgcctaatcgtgcgtcaaaactcagatcctgccatttaacgcaaataaaacccatcctggcaaagttcgccggaatgggttttattcacgttaaattctggaatctaccgagtttggtcacacactccaggggtgtctttatttcaaactgattacaatcctttactatctcaatctactattgaattgaagcattctctcatggtactataaccagtggaaaacaaacgtacatatcaccaatttttctttattcactttttggtgaatgcacatagagccattattcaagctgattgcttaggcagtcagcttttttgttgttctaaattaaaagacttctttgtccgtatagtgctgttctagatcattaaagtcataagcctttaacgcttgaatcgcttctttgccgttataaaaggcagtatatgactgtgccagcattaaattaagcttcttactttcatcatactgaacgaggaccactggaataccggcttgccatgccgcaccaatttcaaaaatcgttcctgaatctggttcattttccttagtctcttcgtattgataatctaaaatagcgactaccgcgtcagctttacgaatctgcctaacatcactattaaacgttgccacttgccacttgaaagtaccaaatttcaaatcttcctgctgatgctcagaaggaataaaaataccattatcagcgaccgttgggttggcacgcaataaactcactacctcgttaacacggtcattttgaccatcactaaagaatggggctgctaaataaatattattcataaaaagttgctcctttattatattatccattagcataccatagatacgctacgtttcatcattaaaaatcagcttatttaacttgctgtcggtgtttaaaaatccactgtgaaaaggtcctttggttgtcgtcattacggactagccaatcacggataactaaactattatcatccgtttgttcgttcagcaaattaagcagtccaatctcatcaccctccgctatcgtcagtatctttgtcagatggtccggtaaccagtctagaagtgcaacgggaatgtcacttggcgtaccgtcagtatcttccacggcaatgatcagatgtggcggtaaaacataatccgcctcctctggcacgtgatcaagtgtaataaggtttggtgctaagcgggctagcagccgggcacttaactcaatgagcgtattgggtaacgattcgatatcagccgttatcataacagcaaagacaccaatcacatcgtaattagctaacgccaacacgttcattaacggtagtaacaaatcatttcgctgactctgttgcagtaaataactgcctaaatattgctcagccactggttcaacttcactggtgttaaagctacccagaacttcagtggccgtcactgtccgattcataaaccggttcaaattatggtggttcaaagtggcattatcgataaagtgatagagtgcaacttcatcggtaccagcgggagaaattaaactggtaaaaggccgttcaccctttacatctagccaagcataaccgttgtgtaactgctccgccaactgctgagaaatggtgattgtctctagctctgctggtaacggtcgatgccggtactcttcagataacattgtcatccacccccttattaattgccgttatcatattgaaaattcactaaaaatgcaaagattgtgcgttaaagaaaagggccacaataacggattggttattgcggtcctctattctgcacacgacggcaaaatcgtatgccaacaagtatttagcaaatttatcttagcagatttgatgaccctttttgattaaaatttcatgagatttgtttagtgtattccctattagccactatttgacggtaattgacacttctctccaaatacttatctctaaaatcaatcttctaccttgtgctttaatgacgtattattcagcaaaacatttaggataactgctgtaaaactccctacaaccatcccattgctgagaatggtttgggcttctgctggcaagaactggaagagttgcggctgcgtggtaacacctagacccaaaccaactgagacagcaataatcagtagattacgattgttgagctcaactttcatcagcatcttaatcccttgagcacccaccataccgaacatgatcagcatcgcgccacccaaaacagcggatggaatcagagttgcaatagcgccaaacttgggaattagtcccaagaaaatcagcagaaaagctgagtagtaaactggacgaagggtcttgatgccagataattgaacgatcccaacgttttgtgagaaagtcgaatatgggaaggtattaaagatgccacccagaatcgcggctaacccttcagaacggtaaccatgttttaagtctttggtatctaagtcacgtccggtaatttccgccaaggcgaagtagaccccagtcgattcaatcatacaagtcacagccgccaaaatcattgtggcaattgatgaccactcaaaccgtggtaccccaaagtaaaatgggcgtggtaattgtaaccagtgagccgcactaacgggagcaaagccaacttttcccagcgcaatcgccagtaacgttcccactaagataccgattagaatcgcaatctgtttaagaaacccgcgaccccagatattgatcacaataatcactaacgcggtagtgaaccctaaagttaaattaatgggtgagccaaaacttttagccgtcgcatctcccccacctaaattttggaacgccactggaatcaacgtgaacccaatcagcgtaatcagcgaacccgtgactactggtgggaaaaaacgccgcaaactagcgaatggaccagcgactaaaatgataaagataccagctgcaatgatgccaccatacatataagtccatccaaaatgattaccaatactttgaagtggtgccacgtattcaacggcacaccccagcacaactggtaatccgatcccagtaattgcagttcgcttcaactgcagcaaagtcgcaatgccacacataaaaatatccattgaaactaagtaagtcatctgagcggtactaaaatgcagcgcaccgccaaccagtaacggaactaaaatatcaccagaatacatcgctaataaatgctgaaaccctaagattaaattttttacaactgaacgatcgtttttaacagtctccacgttccattacccctcattcggttttatattatcagtatcttcatactatcatctatccatcagtcattcaaactaattctgaacattattcgtaaatagcttaaaatagttcgtattcagtgctgttctatttgattcaatcgttcataaacagttaccagttcgcgtcccatctcaatcgtggtcattgccatgctcaaatgatcctgagcgtgaaccatgagtaaagatggcccctcattcgagtcaacgtgatcactaatataatggctttgaaattgatgtccctcacctaaccgtttttcagcattgtctaatttcgtacgtgcatcttgaatcaaccccttcttagccaattcaatccccttaaaaacctgcttcttgacgtctccagcaactagaattaattgcattgccacgtgctgttcctcatcggccatgttatacgccctccgaaaagttttttaactataaccgtagcgccaattagtatgagatgcaatcacttcttgagtaaattgcgccttatatgcaaaaaaagaaccctattatcagagttcttcaatcaatcatctctacttcacatgtttagccacaaattcttcgattggtaatctaaaatcagcgtagttcgcttcaagttcttcgcgcgaccaatcccaccaagcaattttctccagatcggttttaatttcatccggaaaacggtccttgatcttctttccgggaataccaccgataatcgtatagggttcaacgtccttagtgaccactgcaccagcaccgatgacagcaccatcaccaaccgtcacgccagcttgaacgaccacgtcatggcctagccaaacatcgttgccaatcaccgtttttaattctcgacgtttctgtaaaaatgcggtatcaggatcaccgaaaccataacccgcaccgttgtatgcaaaaatatgctgacttggtctattataagggtggttagttggcccaattctgaccattgcggccatactgataaattttttgagttcactgttctggataaagcataattgacccgtatacgtatagtcatcaatcgtactgttatcgataaaattctgactgccaatttccacgtactggccaaaggtggtgtcctttgtttgcccaccttcaccaattgtgggatgatccttggaaagtttcacgaaatcaatgtgcattaacctcactcctgacttaaaatttgtattaattatactcgagaatctattttggaggaaaaattatgtatcaagtaaaagcaatcgacgaatttaacgttagtgaatttgcgggtaacgtttttcagcttaaagatactagtgcccctgacgcaattcttgtgcgtagctcaaaagtaccagatgaactgatcaccccgcatttattgttggtatcccgttctggaatcggaaccaataccatcaacattgaagcctgtacgcaaaacggaaccgccgtttttaataccccaggcgccaacgctaacgcggtgaaagaactagtcattcaggcactttttgccagcgcacgaccattgcaatcagccattgaacacacagcctcactaactggtgaccatctccagcaacaagcagaagcgacgagataccagttcatcggtaacgaactatatggtaaaacgattggcattttaggtctaggcgccattggtcagcgactagcagatagttgctaccacttaggtatgcaagttgtcggctataatcgcagccctaaaaatctccagtccgttcaacaattggaaaccatcgatgaagttttgtctatcgccgactttgtggttcttctcctgccattgaccgaaacgactgaaggcatcatgaacgccgaacggttccgacttatgcgtaaaaacgcagtcttattaaattttggccgtggcgaactggttaataaccaagccgtcattgccgcactggatcaaggccaatttagtcgctatatcactgatttcccagcagaggaacttcaacatcacgaccacattgtcatgttaccgcatctcggtggtaacactgtagaagcactatccaaaagtgctaacttgaccctgcaaaatacccgtgatttccttgaaactggtattattcgctcttcggtgaactttccaactgctgatttaccctttaccagtcctaatcgattaacctttttctttacttctcgtgctgcattttggaacgatatttccgccgttctccgtcaatatcacgtcccagttttagaaatgatgagtaacctccgcgatgactacggctacatgatcgttaacgttgatttaaccgctacagaccagacccagcagttggttgatgatctccaagcggtgtctggtaccttacgcgttcgcatcttaaataatccgtcagaactcgcaagtgggtcaaattcttaagaatctctatgctcagtaacggataattgactgaagtatccgaacttcgataaactgatatcataagtatcctctactacgtcataaggagacgcctaaatgaatacccaaactatcatgacactcattaatcaatacggttacctcgcaattgttttcttgattgccttagaaaacgtctttccgccaattccttctgaggttattctaacctttactggttttttgacactgaccactcatctgactgtctgggggtcgattatagccgccacggtaggctcgattatcggcgccatcgtcttatacggcgttggccgactagtttcggttgaacgactcagcaggttcgttgaaacacgggcaggacgcctacttcgtttaaaacaaactgatattgaacgcgcagggaacttctttaatcgcagaggtggtatcgccatcttctacggccgttttgtgccagtagtgcgcagtctgatctctgttcctgctggaatggccgagtatcctttttggtcgtttgttggtttatctacgttaggtaccctaatatggaacaccgtgctaatcaatgccggcagcctagccggatcccattggcaatctgtattgggctggtttgaagaagcgtcaatgtttgtactgataggtgtcatcgttttagcagtcccgcttggggccttctactaccatagaaaaaagcgtcacggttaaaatacaaaagcagtgccataagtctatattgataaaaatttcagctggtttcttgactgaaatacaactataaatttgcttttgatcactattttatctagcctaaaatggctccacaactcagattccggccatataacacaaacaaatgcgtataccgcccaagatcgacggcacacgcatttgtttgtgttatattctggaatctaccgagttgtgtcacactctcgattaaacgatttccaaatgaagctgttcgtctttaacccaatcaattgcggcgagcaagtgataaacaaccagtgagattacggctggtgccaaaactgccattaccatgtaggcgatgaacattggcatactgcttgaagccaagttgattggtgcaatcaatgagtttaatcccaaaccaccaagggtgtaagaaactttgaaaccgaagaagacggtcgcaagcggtgcacaaaccccagcagcaacaaacgatggaattgccaaacgtggattcttcaatagattagggaactgaactttaggagtgatgataccttgagcgatgttagcaccgatcttgttttgacgccatgagatagcggtaaaaccaacgaattgagcagtggtaccaaccaaagcagcaccagcagctaaaggtgacagcataacggcaactgacaaagcagctgacgaagcaggtgtcatcaagaacaatgaccaagcaagggaaacacagattgaaccgataactgggttaacttgcattgattgtgcaatgaaagcactcatccagttcaaagcaggtgtagtaacacttgctaatccaagaccggcaattgaaccaactaacgtggcagccagtggaaccaacatcatatctagtggtgtcttaccagtaagatacttaccaactaatacggcaactaaaccagctgcaacggcactgataggttgaccagtggtgaagatccctgattgggctgcttcaaccatcttgttaccagtagcggttgctgcatgcattgccgttcctgtgaagtaaacggcattggcaccaacagtggatgaaatcatggcactgaagagaaccagcgtgttaactttcatttgtgatgcaatcgcggcaccaaacgctggtgccagtaaccattgggcaattgaaccaacttggaatagagcttgccaatgaacgaaattagcgattgactgtgttaatagcccaatccccagcataaccaaaacggcgttagaaacaccggctgaaaccttataaacataatccattactgacattttctcggtgtcagttgttgctgcttgtgtactttccatatgtaagacctctcttttgccccttaaataagagctatgttataaaatgagaaaatgattaaaatgtttatgctgttattaaagcattatcgcaaaaacttgtcaatagtttttcacatagaaatctcattttattctaattatttattgagcatgtttggcccaattaaaccaactaacagaaataagcgttaccccgataaagaatcggaataacgcttatttctgttagatcataaaatctacaactcaaattattttgcttttgcattctggcggtacttggtcggtgaaacaccggtgtacttcttaaatgacgttgaaaaatagtagatattttgaaaaccgacgttcaaagcaatgtcttccaccgtggtatccgtatttaataaccactgcgttgcctcttccatccggtactgcatcaaaaactccgctggcgacatgccgatcgtctgacgtaagacacgcacaatatagttcggccgtgcgtcaaaatgctcgcttaacgtagcagcagtaatttttttattaaagttctttttgaggtacctctgaatcgacagcgacatctgagttaactcgtttttcgcattatcttgtgtctgcaaacaggatagtaatttaatgaaaatagattgcgcttcaaaaaactgctttgaattacagttcagctctttggaaactaattggtctaccattgaataaacctgttcaggctgttcaactgaacgatgctgcattaaaaaaagcgtttgtactggtactggtggatgaagcattaacgttttcattgaattttttgcgggtgtcaacgacgattgaacatgccaatcaccaccaacataggcgtagatccagtctagtttcaccgcttctttatctgcccaccacacatatttatggtaacccggggtcatgatgaagatttccccttcactaatctgctgttcaacgtcctcttgaatcacgtttaggcgccctttgcgcacgaaaacgaacacaaaatactccaagtgaacttggttcatcttactaccatccggtttaagttccacccggcgaccctcgataaaagtcggtaatggcagacaagacagcgaaatatatgcagcctgtgccatttttcgttcctcctaacagcatctgctatcctttaaaattatctaaaaagtaaatccatagatttataaaaactccacgttaattgtaacaatatcagatacgttataacaacaaaaaagtgttactaaattcgttatttcacagaacttggtaacacttttttataattattgtttgtcggcaaacttccaaattaattgctgcacaatttgattatccgttggttgaccaactgtgattcgtaaccaatcaggtcctaatcccgtccgaacaagatacccttggtgcaatagttcttggctgagtgcgtcagcattattaattttgaaaaacacaaagtttgcttgtgacggatagtacaaaacacctagctttttgaaaaaggctaaccatttttgccgttcatccgcaacggtttcaactaccgtttgaacgaattgctgatcggagtaagccgcctctgccgcaatctccgcaaacgtactcaaattatacggtaaacgcacggtttgcagaatctttgccagttgcggggcaactaccgcgaagcccacccgaaagttagctaagccatacgccttcgaaaaggtacgtaaaaccaccaagttattaaacttaggcaacagatcaataactgaagcctgtttttcagccgtaacaaagtcgatataagcttcatcaacgacaacagtcacactttgcggcactttagccatgaattcagcaatcgcctgatgggtaacgtatgtcccagtcggattattggggttgcaaagccacaccatacttgttgctggtgtaattgctgccagcattccgtccagattggtaaccccgttattatccacgggaacgtccaccatcttagcaccctcaatttcagcatgaagggcatattccgaaaatgtcggctgggttaaaatcacctcgtcgtcaggagaaagcagtgtccgagacaatagctgaataatttcatccagcccatcaccgaaaactaatgcttctggtgaaacgtttaagccagtggcaatggtttgtcgcaaacctgtcacttcactgtccggatagcggttagcacccttaacaccccaatccagaattgcttgagccacttttggtgaagtcccccaggcattttcgttagcggacaagcgaactagtttggtcaaaccttgttcctgcttgatttcagcaatcgttttttctgggatatacggttttagttttttaatcgcttctttgaccattgacgttcattcctcctacagatctttaatatcccggcgttccttggttttgctcatcaaaccttcgcgttcagccaactcttttttgacttgatcaacgctgatgccacgatctgccatgagaaccagcacgtggtaggctaagtcagcaacttcatatacgaattcgtcatcgctgtcgttcttagctgcaacgacaacttccgtggattcttcaccgaccttcttcaagattttatctaatcctttggtaaagagataatccgtgtatgatccttccttagggttgtttttacggtctaaaattaattggtaaagttcatctaagtcttgcatactattttcctcctgctgaattaagttcaatgtcccggtaaaaacaactggtgtgcccagtatggcatgccggtccggctggattaacgcgaacgagtaacgtgtcctcgtcacaatcgatttggatggcaacaatgtcttgggtattcccgctggtcgcacccttgtgccaaagctcttttcggctacgggaccaaaaccaggtctgtttgctttctaagctaagctgataacttttcgcgttcatataagccatcatcaacacctgattcgtctgatcatccacgacaatggttggcacaaggccatccgggtatttatcaaaatttggcttcaacgtcatcgtactgtcactccattctgcttcaatgctgtcttaacatccggaatcgtgaactcgccaaagtgaaataccgacgcagccaaagctgcatccacatccgtttgcttaaaaacgtcattgaaatcgctgatcttaccgcaaccgcccgaagcaataatcggtactctaaccgctgctgtcagggcttggtatagcggaatatcaaaaccgctcttagtcccatccttatccatgctggtgaccatgagttcgccagcaccggcagcgacaccctgttttgcccattcgataacgtctaaatcagtggcctcacgaccgccatttacgtaaacggtgtaacgctgtttttcaggatcccatttactatcaattgctaacacaatgcactgggcaccaaacttttcggcaccttctgaaatcagtgagggatcacgtaccgctgctgaattcaccgcaactttatccgcgccagctttcagcaatcgctgcatatcatcaacgctgtgaatcccaccaccaaccgtcaggggcataaacacctgcccagccaccttttcaatggtatccacaatggcgggccgcttttcgttagttgctgtgatgtccaagaagaccagttcgtcggcgccctgtttttcataggcggcagcaatcgccactggatcgccaacgtcggttaaatgaacaaaattaacgccctttttaacccggccgtgatcaacgtccagacaaggaataattcgcttagctaacattgctggacacctccgctaaggttcttaaaggaaggtcgccagttgccatcgcccggccgacaatggccgatttgatgcctgcatcagctaatttttctaaatcagcgacagtggtgacaccgccggaagcaatcacctcagtggttggaaaggccttttgcagttttcctaacaaatccacgtttggtccgcttaatgtaccatccttcgtgatatcggttaccacaaagttgactacgcccactgccaccattgatgtcatcaaggtgttcatggacacatcgctttcttcaagccagccagaaatggctaccttgccgtctttaccatcaatacccacaacgacttgatcgttgccaaactggttgacagcctcctgaacaagtttcggatcagtcagcgctgcagagcctaagatgactcgtgaaacaccactagtgagatacccattgatttgggataacgtccgaatgccgccgccaacttcaacttttaaactggtttcggcacagatctgcttgataagttcccggttcactggccggccacttttagcaccgtctaaatcaactaggtgaagtcgctttaagccggctgcctcaatttgcttagcctgcttcagcggatcttgggcaatcagcgtggtttgatcaaaatcaccttggtacaggcgaacagattgctgatttcttaaatcaattgcgggaataatttccattagataccaactccttaaacgcagccagaccatttaagccgatccgaccactcttttctgggtgaaattgcatgccaattacgttttgattacgcacgatgctgggaatcttaacgccataatcactttcagctaaaacgtattgcggttgtgttttgacatagtaagaatgcacaaagtacgttgattgctgatcaaagccattggcgattgggtctggttgtgtcacttgattctggttccaacccatgtgaggcactttaacacctaaatcttccgggatagccacaacttcgcctggaattaaacctaatccagccgtttcaccgaattcaaaactgcggtcaaataataattgcattccaaggcagattcctagaatgggagtccctttttcggctgcttgcttaataaccggaattaattcacgctccttcagcgcctccactgcttttccaaatgcaccgactcctggaaggatcagcccatcagcatttgaaataacctctgaatcagctgacagcgtattaggaattgcgagaaaatccatcgcttttttaacgtttctggtgttacccgtatcgtaatcaataatcgcaatcattaaatcactcctttagtcgatggcacccctttgatttcaggattaatggtcactgccgcacgtagcgcacgacccaatgccttgaataacgtttcaattttgtggtgcgtatttctgccatacagcacttctgcgtgcaagtttaattcagcgttaaaagcaaaggcctggaaaaagtcttccgtaacttcggtatcgtaatcgcctaatttgggattggtcagttcggcgttgaataccaggtaactccggccagacaggtcaatgactactcgactcaacgtttcgtctaacggaatcaacgctgatccgaaccgttcgataccaaccttgtcacccagcgcctgcttgagcgccattcctaaagcaattcccacgtcttcggtggtgtggtgaggatcaacgtttaaatcaccattggctttgacaacgaggccaaaccggccgtgccgggcaaaggcgtctaacatgtgatccaaaaagccgataccagtatcaattttgatcgtatcgtaattatccaaatttaagctcagttcaatttgcgtttcgttcgtattgcgtttaaccgttgcttctctcatgacaagcctccttagttaaaccgtgattcaacagcgcgggcgtgggcttcaagaccttcaacacgtgctaaggtggtaatcgccttttcttcgttcttcagcgcatcccgtgaataagtgacaaattggattcgtttaacaaagtctgataccccaagtggtgagaagaagcgggctgtcccaccagtaggcaaaatgtggttaggaccggcaacgtaatcaccaactggttctgacgcgttaaagcctaagaagacggaaccggcattcttaatctggttaagatactgcatagcatcttccagctcaatttccaagtgttctggggcaatagcgttcattacggtaaaggcttcatcaaggtcatcaactacggcaataaagcccttgttggcaactgaagcactggcgatttcttgccgtggtaaagtttgtacttggcggtcgatctcatcgctaacagcttcagcaaatttttcactaggcgttaccatcattggacgcgccaatttgtcgtgttctgcttgtgacagcaaatcagcagcaacttctttagggttagctgagtcatccgcaatcacaccaatttctgatgggccagcaatcatatcgatatcaacttggccgaaaacttgtttcttagcaacggcaacgaaaatgttaccaggaccggtaatcttatcaacacgaggaacactttcagtcccgtatgccaaagcagcaatggcttgggcaccaccgacttgataaatttcatcaatgccagcaatcttagcggcagctaaaacggcttggccaataccatctttttgtggaggtgtgaccatcacaattttgccaacaccagccaacttagctgggataacgttcatcaaaatagatgaaggataagcagcagtaccaccgggaacatacagaccaacggcagctaatggggtaatcttttcgccacggacaacacccttttgttcagcgtccacgaaaccgttttgaatctctttttggtgatagctaacaatgttgttcttagctaagttcaaggcatcaattaaatcttgatctgcatttttataggcagcatcaatatcagcttgtggcactcgaaggtcatctaactcaaccttgtcgaacttttggctgtattcctttaaagccttatcaccgttcttaatcacgttggcaataatttctgaaacagttgcttcaacttctggttggttagcctgttggtcagtttgacggtcgacttgttcgagtaattggtctaaagtttggttttttaaaattttcattattcattcactcctaaattatttttggcttgttgtaagttttcaactaaggttctaatttctgaatgatactgtttcaaagctaaccgattgacgactaactgtgtgctaactggctgcagttcagcgtaaacatggagattattttctcgcaacgtagtccccgtttccgtaatatcaacgatggcatcagctaagccaatcaacggtgccagctccactgagccctcgatccgaatgatttcaacgtcctcaccaatactttgaaaataacgtttcgtgatattcgggtacttggtagcaatgattttccgccgaacttgctggggattaaaatcactggtagaggcaaggacgaatcggcaacgccccacgcccaagtccagcatggcgtactgggtattgttctgctcagctaagatgtcgctgccgacaattcccagatgaaccgaaccgctgttgaggtaagtcagaacgtcggggcccttgactaagatggtttcgtaaaccggatcttcgtcaaaaatcagtcgccgccctttattgcgaataccgctgcaatcaatcccactggcttcaagcagtggcaccacttgctgttccacacggcccttggttaaggcaattttgattggcatttactcaccttccttcgttaaatctaatagcttcttattattgctaacggcaattcggttggcttcttctcgactgtccgccagacacaaggtactgtttggtgtctctttcaaaacctgttcagcttgttgccactgatcaggttcaaaataaatcaacgtctgctgtggtgcttccggtaacggtacccgatcagccagggcatcaacgtcgaatgctagcccaacagcgggttctttgatctgctgaaagctggttaacaagtcatcgtaacgaccaccgctgaacaaataatctgaagcattttgggtgtaaccccggaaagccatgcccgtgtaataggtctgcggtgaaggaatactgaggtcgagaaccactcgctgatctggcgccagccgcttaataaattggttaaccgcatttaagttctcaatgactgtctgaaccttggcaatctttggcaggcgtttaaccaccttcatgacggtatcaaaatcaccgaacagccaaggccactcgcttagaaaatcaccaaattcagtctcattaagcaactctgaaatctggttataagtagtcagattctttgtaaacaaagcttgtttcaacgccaccttagttggttctggcactggtaatgcttctaaaacgccttccacaaaacgggcatcgctcaattccaaggtcattttcttaacaccagttgcgaaacatcctgctaaagcaatcgttaggcattccagttcacccttaatgctacttgaaccaactaattcaataccggcctgagtcacttggttgtaacttccagaaagttgcttctttactcggaaaacgtccccgccgtaataccatttggctggtaactcaacgcccgtggtactcatcatccgagcaactggtaaggttaaatctggtcgaagtaccaacgcttcgccctgctcatccaggagttggtacggccggtaattatcaagatttaagggcttaaaaacatccgcgtattcgagaattggcgtggttaacttggtaaaaccgcgctgtttgaaaatggaaaaaagctgtgctgatatcgtttccttaaccgcggctcgcggaccaaattcgtcgcgcgtcccacttggtaaatttcgatttttaatcatgcttgctctcctttctgataaacaaaaaatcctcgcaaactaaacaagttagtttacgaggacgatttaatcgcggttccacctcaatttgtcgccacctctcgatgacggccttacgttgccaataactagtcgttgaagaaacttcaagaacagttaagggtaaccctgataacgctaaacatgcggagcagcttacttaattcagctgatcagttcatagaggtgtttcgttgtcccaatcactcggtttccagcattccaagttctctgcgcattggcgttcaactactttttctaatcacaacttattttgtcattcagttttaatggttgtatataatttaacaccaaattctaatttgtcaacgtattctttaataattggcaccaatatttcttgatgttaacgctttattccgcgatttaatagtactctcaattattaaaattatttttaatttatcatagccatcaacgtatgataaccgtgacccacctctttaatactgtgtgcgtcactaccataaactaagggaatttgcatttgctgagcctgctttaaaataaccgcatccggataagtttcgttacagaattccttataaagtccagcagcattataatcgagctcgtcaccatgctgtttaaccgcttgtagtagggtcgtaatcacttgcttcgtctcagcatcataagtgcgtggcaaaccaaaataatcctgaaactttttaatcagcgtgatgtgcccaatgcgcttgggtgcgtacgatcctaggtctgcattcactgcttcggttaccgcttcaaaatactgacgatataatgattgaccgttgtttgcagattttaacagtcccttttcaaaatcatcaagggtatcgtcaacgcaccaaaaatgatcatccgttccctgcataaagtgaacggataaaacattatcagtcgtttgcgggccatattcatttagaaaatcccgcgtccactgtacctgattgggtaaaaagtccacttcaaatccaacgttgatttgaatttgtgcaccatatttatcctgcatccgctgcacttttttgaaataagccggcaaatcactcatggccattgaagcctcggtataaccggtttctagccccgcatactccgctgcaaaggctggcggtaacggtgcgtgttccgtaatactgtagctttcaaaaccaagccgaattgctttttgaatcatcagctccacatcttccccgctaccatgcggacaaaattctgtgtgcgaatgaccatcttgctttaacataaaaatcctcctaaccttgaattgctatagttgtatcctatactgaagtaaatattgttattaattggttgattgacagaaaataatctagacactgttgttggctaatcccaccggcatatggtgacattttcttagaataattgctataatgaactaaattatctcaccgttttatcattatttaaagttctcacttgtcattcattaagaggaggaacaatcttgggactctcaaaaccttttttagatgcaattagtactgattcagttcgtggtccattaaacctgatcactgatgtgccgggcgtttcagttggtcaaaccaccttcaatagtggtacccatcatacaggcgtcacagtggttaaaccgactgccgacaacatctttcttaacaaattaccagctgctgcccacgtcatcaacggctttggtaaaagtaccggcctagttcagatcaatgaactgggaacgctagaaacccccattgtgctgaccaatacgtttgcagtggggacagctgaaactgcactggcagaagacatgatggctgagaacccagatattggcgacaccaccagtacggttaatcccgtcattatggaatgcaacgatggtgatatcaacgatattcgcgacgttttcattaccaaaaaagatgtcttaaacacgttacaccatactggcgagtcatttgatgaaggaacggttggtgccggtgtcggtatgagctgctacgatttaaagggtggcattggttccgccagccgagtaatcaaaatcgatggcaagtcctttacaatgggtgcactggtcctatcaaattacggtttcctacgagatttaaatatctataacgtcccagtcggcgaaaagctggctacctttaaagctgaacagaagcaaaaagaaaagggtagtatcgtcactattttagcaactgatattccctttaattcccgtcaattaacccgaatcgctaagcgtgccagtgttggaatcacccggactggcgccttcattggtaacggtagcggtgaaatcgtcttagccttttcaacggctaaccggattacccactatcctaagactgaactgtcctcacaggctgcaatcacagatgataagattgaccgttacttccgcatgaccgtttcagtggttgaagaagccatcttaagcgtattgactcacgcaacgacggtcaccgaccgaaagggtaacccccgcctgagcctccacgacgctttaaaagattatcaggctgaacatcaagatcctgacattgcccgactacaggatcagctaggtatttaaccaatttcaacggcccaccgacgggcatcaaaagcctttttaaaacgatccatgctgagccaataacgaccatcaattggatctgaaacatgtaataactcaccaaaataaccatcaactaataccgcgtgattattgcccattgcccgtccaaatgagtattctccccattcaggagtttcaaagttcaccgtcacgtatgcgacgatgggctttttttgttgcagtaaagtcggtatcttttcagcagttaccccattgacgtcactgactggcgcatattttttcgcccacgcaactaacggttccggataaatcgcttcaaagtgccccggcatatcctgatcgggttcaccgccaaatccgtggtttggattaaaatcagctgctctgggcatgtcctttaagaaggtcaaataatctatttcagtggcatacccctttacgtgcaagccttctaacaaggcagctggttcacagccgctttgcatcccccaccaaatttgattgatgttttctgctttaaggctaaatggctgttgacctttttcaagagctgcttgccataaatcaggatccagcgtaacggcattttttaaaacataacggtcacccggcaactgatagagatgttcaccgtgctcatccgttacttcttgagttacggtaacagcggtcaaagcactcatttggccaactgcttttccgttggcatccacggttatcgtaccatcttccgttacacaaccactagtttgttcaggctgatgcaatgctaatgctaatccgtttgccatgagtctacctcgtcaataaccgcttgggccattttctttgattgatcattaaacaaagttggtaaatggtttaaatcaaaatacttcacctgcttggtctcgttggtgacgtgatccaatggtttaccacccgtttgtcgaactaaatatagtgctgtaatcaactgtgtctgatcaccattcggataggtataaaaatctttatcgaacaactgaatcaacttcactggttccacttcaattcctgcatcttcaaggtattcccgctggcaggtttcgacaaaactagcaccaaattccatgtagccacctggaaaactccagtcacccgtatctgcacgttcttgtaataacaaacggttattatcgtctagcaaagcaccagctgcagtattcaaaatcattggccggtgtccaaccaacgctctcatttcatgaatatagtctgccataaaaccaccctttcagtttaggtattcggttttattatagcagttaccctgtcagctgtattcttctccgcaacgcttttaaaaatgtagccgaacccccgaacagtctttaaacactgcggattcttagcatcaacctcgatcaatttacgtaatttactgatatgcgaatcaatcgaacgcaatgtcgcatcacgaccattgcgccaaaccccttctgcaagttgtgcgcgggtcagcacaacgttttcgtgttgcataaagtaaacgagtaaccgaaaatcaacggggcccatcgtgagtttgcggccattcacggtaatcatgtagtgctgaaaatccaccttgagttgtcccgtatttaagaactcacgattttcctcctgtggctgataataccgccaaatcttctgttgaattctcgcctgtaattcacagttagccatttctaacgacagtaattcatcaaaatgaaatcggttaaaaatatcgcaaacggtcgtgacagctaatttttggcgatgaatggctaataacggcccatgaaattgctgtcgcattaaaactaaagtatcgattcgctgagttaaagcaaaaaaatggtctaaatccaaaataataacagtttgattatcacggtttaataagaagtcgggtaaataagtgggactgctaatgatttgccaatcaatcataatctgtttgagtcgtttcaaaagattcgcattatcactaatcagcaaaatacttctatccatggggcttcctcttttcatttcaattgataccatagttatcccacgtttcactgcccaacaaaacccgttttacataatctttacatgacctatacattaactttacgcagaccttttatactaaccttgtgcttaggaattacctttctacaacacaatacttttaaaggggaatatgttcatgcataaaaaaacattgctttccacgttagttgcttttagtctcgccggcctgctattaggaggttgcagttcgaaatcaagtcacaaatcttcttctgaagacaccaaggcggcaaaggtcaccaagattacagccgttggttcaaccgcactccaaccattagttgaacaagctgcacaggattatcaggctgcaaataaaaacgtcaaccttaccgttcaaggcggtggctcaggaactggtttaagtcaggttcaacaaggtgctgttcaaatcggaaactccgatatttttgcagaacaatcatcagggattaaagctgataaactggtcgaccacaaagtcgctgttgtgggtatgaccccagtggttaaccctgaagtcggtgtggctaacgtctcaatggcacaattacgtgacattttcacgggtaagatcactaactggaagcaagttggtggcaaggatcaaaaaatctcagtaatcaaccgtgcgcaaggctccggaactcgagcaacctttgaaggtgctgtactggaagggaaaaaggccgtaacctctcaagaacaagattctaacggtaccgttcaaaaactagtttcatcaacacccggtgccatcagttacctcgctttctcctacgtaaacgacaaggtcaaagccctctccatcgataatgtcaaaccaactgataaaaacgtgaccactaacaaatggaccatctggtcatatgaacatatgtacaccaagggtcaaccagttaaagcagctgcaggtttcttaaagtacatgaattctgacaaagtccaaggtagtctggtcaacaaacttggctacattagtattcacgatatgaaagtaaccaaaaacgctaaaaacgttgtcaccaaataactaaacttaaacaaccaataagcggaaaatcgggcaattaccaactatcctgattttccgcttgtctatggcataccagcacgaatttcgtcgttcctgctggcattgaaacaaatacattgtgatattggaggcttttatatggatgatattcaacacaaattaactgcaccttctaaggcatcccgtgaagatgtcatgggtcgaatcattagctacacctgcatcgctgcaatcatcatcctggtgatcagtattctctacttcattacttcccggggagtcgccacatttacagctaatcacgttaatctctggcaatttttgtctggaaaagaatggaatcccgggaccttgaacgcaaacggccagccgcaagttggcgcgctaccgatgatcgtcacttcattcagtgtcacgattttagctgccttagtagccacaccatttgcgattgctgtagctctatttatgactgatatcgcaccaaaaaatggtgccaaatttctgcagccggtgattgaactgttggtgggaattccatccgtcgtttatgggtttatcggtttaacggtagttgtcccctttattcgtcaccttttcggaggaactgggtccggtattttagctggtactatcgtgctgtttgtgatggtactgccaacgattacttcactggcagttgacgcactcaaagcagtcccaacttactttcgttccgcttcattagcgctaggtgcaactcgttttcaaactatctataaagtccttttacgcgcagccatgccccgtttacttaccgcagtcatcttcgggatggctcgcgcattcggtgaagcactagccgttcagatggtcattggtaacgccgccttaatgccccataatctagtaacaccaacttcaacgttgaccagtcagttaacaactaatatcggtaataccatcatggggacgttaccaaataatgcactgtggtcattagccttgattctgctattaatgtccctagtgttcaacttactcatccgttacattggaaagcgaggcgaaatcaaatcatgacaccaaatcaaacagatcgaatagctactcaagtgattaattttttggttctcatcgtcgtgctaatcttatttttcctattaggcgacatcattttgagtggctttccccacatcagttggcactttttaacttccccatccagttcgttcagtgccggtgggggcattcgagaccaactgtttaactctctttacctactagtgttaacactcattatttcgtttcctctcgccctcggatcagccatctatttgtctgaatatgcgggtaataactggcgtaccgggctaattcgaactgcgattgaagttcttagttcacttccttccgtcgtagttggtttatttggctacctgctattcgtcattgaatttcacatgggattttcaattctctcaggtgcgattgcgctcaccttttttaacctgccactattagtccgtagtattgaaggctcactgcacgcagtcccagatagccagcgtgaagctggaatttcacttggcctttctaactggcgtacgattcgtgggattatcttgccagcagccttgcccggaattttgacgggtatcattctcagcgctggccgcgtatttggtgaagctgccgctctaatttacacggctggacaaagtgcaccgattctaaattattcaaattggaatcccactgatagcagcagctttcttaatccgatgcgtccagccgaaacattggccgttcatatctggaaggtcaatactgagggggttacgccagatgccgttagcatctctgctggtgcatcagccgtgctgatcattgtcatcctactttttaattttggtgcccgtgcaattggtaaccatatgtataaaaaaatgactggaggaaagtaagacacccatggaaacttatgatttaagccaaaatcacattgtcacaccaccagaagaaattgccctatcgaccaatcagttacaggtctattacggtagtggttctcgcgcttccatgactgatgctagtctgagcttcccccgctttcagattactgccttgattggtgcctccggttcaggaaaatcaacttatttgcgttcactcaaccgcatgaatgaccgaattgcccggatcgagggtgaaattatgtatcgtggtaccaatattaacagtcctaaagttaacgtctatgaggttcgcaaacatatcggcatggtttttcaaaaacctaatcccttcgcaaaatcaatctccgaaaacattacctttgcacttaaagctgccggaatcacgaatcggcaggagttaaacgaacgtgttgaaaccagcctgaaagaggctgctctatggaacgaagttaaagatgatcttaataagagcgcactcgccttgtctggtggtcaacagcaacgattgtgcattgctcgcgcactcgctatgaaaccagatattttattactcgatgagcccgctagtgctttagatcctatttctaccactaaattagaagtcaccctgaaagaactaacccaaaattacaccatcattatcgtgactcataatatgcagcaagcctcacgaatcagtacttacactgcatttttccatttgggacatgttatcgaatatgatcagaccgaaaaaatcttccaaaccccagaaatacaggccacacacgattatgtcactggcaattttggctgagaaaggatccccatttatgactgcacttctatcaacaaaagatgttcatcttgcatatggtaaaaaagaagcgcttcacggcatcgatttagactttgccgatcacagcatcaccgctctaatcgggccatctggttgcggtaaatcaacctttttacgttgcttaaatcgcatgaacgacttaattccacacacgaccattactggcagttttcagtttcacgaacaagatatctatgcgcctaccactaatttagttgaactacgcaagcaaattggtatggtctttcagcaacccaacccctttccgttctccgtttacgaaaacgtcacttatggactaaagttagctggccacaatgaccgaaaatttttggatgaacaagtcgaacgtgcgttgaagcaagccgctatttgggatgaagtcaaagataatctgaataaaaacgccatgtcattttcaggtggccagcagcaacgaatctgtattgccagactacttgctgtccagccagacattatcttgttagacgaacccaccagtgctttagaccccatttctagtgcccagattgaaaccactttgatggcacttaaaaatgaatactgcatcattattgtcacccataacctgcagcaggcttcacgcatcgctgatcgaacagctttcatgttaaacggcaacctgattgaatatgatcttaccagcaaaatgttcaccaagcccgttatgcaagacaccagtgactacctcaacggcaaatttggttaggagcgattacgcaatgaataatattttttcaactgaacttaaaaagttatactcagttttcactcagatgggtgatgctgttagcaaacagattgaacaagccaccgaatcttatattaatcatgataaggttgccgctcaaaatcttgtgcaacaagataattcgatcaacggaaacgaagtggatctcgaaaaacaagcactcactttaatgacgttgcaacagcctgtagccgatgattttcgcaatgtgatcactattttaaaagccagttcagatttagagcgcattggtgatcatgcaactggcatcgcactagaaactattcgggtcaaaggctcacaccgcaataaagaaatagaaactaacattgcgtcattgaccaatatgattcgggatatgcttaaagtagctctaactgcttttcaagacattgatcttaaacaagcacaggccgtagctaaccaggatcaagacgtggacgctaaatttgatgagatcagaaataatatcactgatgcaattcgtaaggaccctgctgtggcggaagctggtgcaagttatctcatggtgactaaattattggaacggattggtgatcgaatcgttaacttggctgaagaaatggtttataaccaaactggggaaattgtcgagcttaatcaaggacgtttacaccccaatgattaggttaagaaaacggcaaattagctgattctcatattttaaaaaaataatttaattaatttcttttttgctataactgacgggggagtaaaggttaggcgtccaaattccaactaaatactagacaatttcaaataattagagctttagcacttgctattacgaacaatagctggtaagcttacaactaatgtatttaatacttcgaaattttggtacgacgttcgtaagaatgacttccccgatttctaaagtttcagatacacaaatatattgcgctatgcgctcggaggtttcactcttatggaacaaggtactgtaaaatggtttaacggcgacaaaggttttggctttattactttggaaaacggctcagacgttttcgttcacttctcagctatcaatgctgatggttacaagactcttgaagaaggtcaacatgtaaccttagacgtagaacaaggcgaccgcggcccacaagcagccaacgttactgttgcttaattcgtttaaatcataatgaaagaacccatcgattatgtcggtgggttctttttttgttcaagctgtgacaaaacttgatagattccagatagtgcgagataggatattcattcccctcacttcgcctaaacgtgtaaaataactcagattccggccatatagtgtcataaaaacgggtacccgcccaagaacagcggatacccgtttttatgacactatattctggaatctaaacgagttgttttacactctctaaataacatttctctcaaacggatcatcactaatacccttttcaaggatatcacgagaccactgctttgcagagaataacgagtgatcacggtagttaccgcaacttgtaatatcagttccaggaacatcttcccacttaatatcgttagcaatttgttccagtgaactcttcaatgccttagcaacttcagtcgttgttggttcgccccacataataagatgaaaacctgtacggcacccaaatggagaacagtcaataaccccatccatccggtcacgcaataaaccagctaataaatgttcgatagtgtgaagtccagcagttggaatcgcattttcgttgggttgaactaaccgtaaatcaaagttggtaatcgcatcgcccttaggtcccttttccactgtaatcaaacgaacatatggtgccttaaccttagtatgatctaattgaaagctttctacttttgccataaaaatcctccttgagattaatctctgtacgaatactattataccgctgattgagcctcagtgtcattcgtataaatcaggacgccgatcagcaaacaccggcataaacccacggaccttatccgtcgcactggtgtcaatcgtaacggtcttcaactcttcatcgtcaccaagggtcaaaacctcgttaccaaggggatcgattacggttgaatggccaccaaaatggttatctggatccgcaccgacccggttaacggccacaacaaaactctgattttcaattgctcgtgcagctaatagtgttcgccactgcggtatccgcggtgttggccactcagctgggacgaaaataatccggctgcctgatagcgacaatgttcgcaaccattcaggaaaacgaatgtcgtaacaaatcacactggttgcaggtgtcccctttacctcgaaatgatcctgagcattaccgggagtcaaaaattcatcttcacgcattaaaccaaataaatgaactttatcgtacgtagtcagtaactcaccatcttcattaaaaacatacgtggtattaaagaattgctgatcccgcttggtagcaaccgatccagcatgaatcataatatggtacttttgcgcaagtgcctgacaaacatgcagtgcctggctaccgtttgcatcagcaatatcatcaaaacgactcagatcatagccggtattccacatttctggaaaaaccacaatatccgcgtgttcactagcggcttgtgccacaaacgattcaatcttcgaaaaattttcggctggtttaccgaaactaatatccatctgtgctaaagcaattgtaattttcattccaacgcctccatgttttgtttttagtataatactgatattttcgctatcaagtccatattaatctttaaattgaatttcttaacaaccatagttgcacatccatcaattatccggcacaattaaagaaattacgttcgaaagaggtaatcactatgaactcattcaccgtttatctggttcgccatggcagtacgatgttaaatagcttcaatcgcatgcaaggttggattgattctgacctgtcagatgaaggcatccagcaagctggacaagccgctgaaaaattacaaggtgttactcttgaccgcgctttttcttcagacttaggtcgagccattagtacccgtaacatcattttaaatcagctccaccagacaccgcgtgaagtaactcaattacccgcctttcgtgaagtgaactttggcttcttcgagggtttagattctgatgacatttgggccggcattgccgcaccatatggcaaacacagtcaagacgatttgatggcgattggtggcctccaagagacgcgtgatgccatgaagcaaagtgacccatcacataccgccgaagactatgacgccgtaatttcacgcgttaaaacaggttttatcgccttgcgtgaccactgtcaaaacggcgagtcaattctactagtcagccacggcaccttaattcgcacaatcattgattatttaggtgtcgacacaacgggcaattaccctcaaaatggcagtgtcagtgaattaaccattttcccagatcacgttaacgttgagacctataaccaatgatgaaaattgctttcagtcactaaacgcaccagataaagggatttcgcctagctagcgggatcttttttactgccacttgaaaacggtttcattctccgttagactagacttatatttaggttatagaaaacaacgaggtgggaatatatcatgacaaaaattttagcagtcaacgcaggtagttcaactttaaagtggaaactattttcgatgccggatgaaacggtaatcgcttcaggtttggtcgatcgcttgaacttgcccggttcagtctttacggttaagcgccctgacgccgacaagtacgtggtcactcaagataacatcgattatcgcttggcagctgcaatggtcctttctcacctaaaggaagcgggcatcgttaagcatttgcacgaaattgctggcatcggtcaccgtgttgtagctggtggcgaagttttctcagattccgccgttgttgatgatatcgtattgaagcaaattcatgagctttctcaatatgcgccactgcacaatccgattgaagcaacgtacattgaaattttccaacaattgctgccaaacgtgccgcaagtagctgtcttcgatactgcactgtacacggatatgccaaagatcaacgcgctttaccccattccttatgaatattacaagaaatacggtgcgcgtaaatacggtgcacatggtaccagtcaccgctacgtttcaaaacgggcagccgaactattaggtaaacccctctcagatttaaaattaatcactctgcaccttggctctggctcatccatcaccgcttttgaccacggcaaagttgttgatacttccatgggctttacgccgttagctggtgtcatgatggccactcgttctggtgacatcgatccttcgctggtaacattcctggctgaaaaaatgcacgttaagatgagtgatatgatcgatattttaaaccagaaatctggtctactaggcatttctcaactgtcacccgatcagcgtgatttggaagcggctcaggataccaatccacaagctaagttggcattggacatgtatgctaaccgaatcatccgctatattggctcatatgtcgcagaactaaacggtttagacgccctgatattcaccgctggctctggcgaaaacggcatcgatatgcgtgccaaaattgctgatcagttaagctactttggtattcagatcgatcatgaccgcaaccaagttcgtggtaaggaacaggtgatcagcccagatggtgcaccagtaaccgtcatggtggtgccaactaacgaagagttgatgattgttcgcgatgtggaaagattaacacagaactaaactaatacagccattaataatgatgacgttagattgccgataatcgggaacctaacgtcatcgttattttacagtgcttctggcactttaacaccaacttcttctccaagtgtcgccaattcagcggccgtcttgtcatcaattaatacgccttgcttttggttttcagcatagcgccgatattcacggtcaccaggaatcttgatttccgtacctggtaaatgcttcaaatttctgatgcggtcaaacatcgttgaaacattggcttttaaggtatccagatccccaaacagcgacggatccatggtcatgaagaactgactgaaatcgtgtttgcctttgttggtatcagcagagattgagccttgggcaagaatacccgtcagcatctcaacaactaatgagttaccgaagcccttgtagttcgaattattctccaggttaccgcctaaggtcagaacaccaccatctggccggtcatcactgaaagcaatggtcgataaattatcttcaacccgctgagcatcctgatcaacttgacgatcttcacccacggcccattcgccgggaatgttttcaccctttttagctaaaacttgaatcttaccgcttgaaaccactgaggtcgcaccgtcaaaaacaaatgggtgtggctctgctgggaaagtaaacgcaaaggcattggaacccaagaaggcttctaaggcgtttgtggggagcactaacggccgcgtattggtcgttgcaatgccaattaagccctctttaaccgccatccgagcgtagtaaccggcagttccaaagtggttagagttgcgaatgaccgcaatggaaacacctaacttcttcgttttttcaatcaaacgtttcatggtaaaaccagaagcaatctgccccatatttttgttagcgtcaactaacaagctagtaggtgtttctcgtaaaatctctggcttgttagtgggatcaatcgtgccgtccttaatcatattggtgtaccaagtgatccgctgaattccgtgtgatgaaatgccacgtaggtcagcatcaaccaaggtgtcagcaagaaattctccatcctcctcggaaaaatgaaaggctgctaataccttcttcaaaaagaccttttcttctttagcatcaatacgcattgtgaatactccccttcttaagtaaatgattttaagccataaaaaaagtccctgttataacaacaaggacgatttgcaatcgtggtaccacctaaatttacagttccatagaactgcctcagttcgctcaaacaagcgatgcaaggataacggtatgcttgccgtaaacgtcgcgtgaacgcgtttagcactccgagctcatcttcaccaacctttaattatgcctttgcagctatcggcactctctaaaaattaaaaattgattactcttctcatcaatgcacaatatttatggataaattcatgttagaactcgtggaaacaattgtcaagattgagcgtgtgacacaactcggtagattccagaatttaacacaaaaaatctcaggaacacgtcctgagatttctgacattaaaaattagctatttattaccatccggagcttcagcttcaccagcagccacacgattttccttagttaagaataatgcagcaatgattgttgcgacaataacaatcgcaccaaggacgaagtaagtgtgttggaaaccaattgaatcgtataagttaccagcaacagtagagaagatgaagacggatatttgcttagcaaagttagaagctaacgcataaaccgtcgcgtaaacccggatatcgaaggctccggcaatgtacttcatgattgaagttaataccaaaggcatttcgaaaccagctaacaaacgaaggatgacaacccaaacaacactaggtgaaagggcactaccaataatccggatagccaagatgcaaccataagcaatcaaaccattacgtgacccaatcttgttaattaaccatggcattgggaacatgagtaagaattccaaagcgatttgtgcagtagtcatataactgtatgcagtggtaccagcagacgcactgttaaagtatgtcttgaagaagatgatgaattgttgatcaaaaacatcatacaaagctgaagtaccaatgtagaagattgatagaatccagaagttacggattttgaagatctgaccgattaagccccagttaagtgaatcagaggtgtcaccagcagcagcagcattttccatgtgaattttatcactgaaaatgatggtgaaggttaaaatggcacccataacagtacatgcccagaaaattgagttagggctccataggaagagcttaccacctaagaatgaggcgcaggcaccggctaatgaaccacccatacgtgagtgagcatattcgaaaccgttggcaagactggcacgttggacatattgttcaacaacagaaacaccaccgttgaatacgaaactcaagaagataccagttacgacggcaactaatgcagcgttcatgtgcactagtggcaagaataaccattggaaataaggtccaattaaaatagcagcaatcgcaattgtaactaataagttctttttgaagactaatttatcggaaataaccccgaaaattggttggaatactaaggacataccagccatcattgagaatacgaatccggctgtggtcccgtttagatggccaacttgttccatccaaagtgttaaataaccattgataatttgccacatgaagaagtaagtaaagtgggtgactgggaaaccccagaaatccttctttttacttgttttagctgtgttttccaagatatttcactcctattctattcgtaattataaggaactggcttaccgaagtttggtgtgccatcgtcattccatgtaaatggttgtaccttagtatgacggttaggatcgtaaagcggatcacccttgatttcggtatagtcgcgacagtgataaaccatgatgtcagtttcgccatcttcagcaactgtaaatgagttatgtccaggaccatattgatgagtttctagatcgctttggaaaactggttcctttgattttgaccagttagaagcatctagtaaatcaacgtcatctttaacggtgagcatacccattgcatagttttcatcagtagcactagcagaataggtcaagaaataacgaccatttctgtggataatagctggtccttcgttaacccagaatcctttgatttcccaatcgaattcaggctttgataacatgactggatcagttttcagagtccaaggattttccatttcggcgatatataaattagaattaccgcgaatggctttatccttttgtgcccaaacatagtacagcttgccatttgcttcgaaacaagtggcatccaatgaaaacgtatccatgttagtcttcacttgaccgcgttcaatccagttatcttcactggtcattggattttcttcatcacattcaatgcagaacatccgatgctggaacatcccgttttcatctaacgccgttgtctctgcagcagcgaagtaaatgaaccacttaccatcgatatagtgaatttcaggtgcccaaattaactgactcatgggaccgttttcatgtttgcgccaaatcgtccgtggagctgcatgtgctaaaccagctaatgttttagcccgacggatttcaatcaaattgtatgcaggcactgaagcagtgaagtaataataaccatcagtgtgtttgtagatatagggatccgcacgttggataatcagcggattaatatattgatttgtattcgccatttagatactctccttaaactttttactacgtagtttgttgacctcttgtgcacgtgattatcatatgatgaaccgaaagcgattacaacatggtttttaatgttttttcgaactttttgcattttaaccaataaaaatattgttcaaaatgcttttgtgaagaaattgtatccttacaaaaagtaaatttgatatttttatactgataaattcaaaattttaaaaaatatttattgaatgacttttccgattatttcagttatttttattaaaaataaccatttatattaccctaatattcttatatattaaattaacatcctaaactaatagctagctaacagctgtttagggataatacgttcttatttaaactcaggaaaaagccagtcatcctaattaatcacacaattatttggaattttttcaaatcaatttattggcatgatttaaaaacaataaaaacattgctataatgagtgaggatacaaatttattcttaaagatgaacaatttgataatttaatcacaatctttcaaaacattggaggttacgtttatggaatctgatatctcagaaagttcactccccgtctataaagctttggcaagcccggtccgtctaaaaattattcaaaaactctcgattcgtaagatgagtgtacgggagctggcatccgcacttgatctcagtggcaccatcgtgttgcagcatctgaacaagttggcagatgccggcattattaagtttgagcgagtaggtcataataaggtctctcgcttaacggttgataagatcaacgttcatttcccccaaactatttatcccgaatttgaatcctacaacactcaagttccagttggtcacttcactaatttttccgtcgagccttcctgtggcctagctggtaaaacggattacattggtaaagtagataacccagcgtattttatggacccagacagaatttctgctggtatgatttggtggtgtaacggctttgtcgagtaccaatttcctgactacctcactgaagacaataaattagagatgctagacctttccatggagttaggttcggaattcccattctctaataacgtttggccctctgacattaccttttatatcaatggtactgaaatcggcacctggacagctcccggtgacttctccgatactcgtggtaaatacacccctgaatgggtgcctgataacgttaaccagtacggtatcatgaagacactgcgtttaactcacgatggcagctttctagatggtcagccattcaccgatgtttcgttggaggatattgatactcataaacaaacctttgcagttcgttacggtattaaaaagaacgctaaaaataatggtggttgcacgatttttggtaaggggtttggcaactataatcaagatattgaaatgaaactgttttacagttaatccttcacgtatcaatgaacaaaaagcgccgataaactttctcaactcgaaagcttatcagcgcttttttgatacttactttaaacatttattaaccaatttgtcgtgaaaatttcttgaaaccaaacaacttatcaatccgtggataaaactcagcaggaatctctaaatcaatcgcttttaaattatttttcagctgctcgggtttgctagcaccagtaatcaagctggaaatccgtggatcccgaagcgcccaagctaaagcaaaggtggctagatcagtatcgagttcatcggccatcttaattaagccttcaaccttatccaagttatcatccgtcagcaatgccttaatctggtcttgatacgttgcacgagagcctgcaggaatcggctgaccctttcgatacttacctgtaagcaagccctgagaaagcggtgaaaacggcactacgcctaacccaagtttgccgcaaacgtccaataattcatgttcaatataccgatcaaacatgttgtattgaggttgaaccactgccattgggtgtaagccacgttcctgaataattaactgagcttccataatttggactggacgccattcactgacaccgtagtacagtattttaccttgatccactaagtcgcttaaagcctgcaacgtttctgctaatggcgtttctggatcaaatcggtggcagaagtagagatctaagtagtcagtttgcatgttggttaaggacgtcccaattgattccatgatatgtttccgtgataaaccgcgatcatttacacccttgtcagtagggaaaaagactttgctggatattacgagttctttacgtgggaattgctttagcgtcttgccaagaaatttctctgccgcaccgccactataagcatcagcgcaatcaaaataattgatgccactctcatacgctaattgaatgctttgagcagccagctcctgtttatcaggtgcactgacatcggtcatccaacttcccaatgctaattcgctgactcgtaatccctgcttgcctaaatgtcgatatttcatgtgattaatttctcccattcctgaatttgaatgactgtacagtaaaagcacagatagtctccaaaacgggggccatgctgtgcttctactgtttgttttcaaataatatgctagatttctttaaacgattacttgatgttaattaaatgtaagttaaccatcttagcgaagtcttccatttgttgagcagtaacaccgaatgagaagacagtgtggtgaccaccaccattttcgatccattgagtggcaccgttcttcaggccagccttaggggtccacatctgcttagcaactggcattttaggcattgactctgccttgtgaccatctacttcgtacatgatcatccgatattcgtcaccaaagtcagccaaggtaacgtcaacagcgtcgccttcaccaccggcaaagaccaaacgagctgggtcttccttaccaccgatgtccaatgggtgaacttcaatcttaggcttatcagtagctaaggttgggtcaacttccaacatatgtgaaccaaggattgcttcgtgacccttacgtaaatcaagggtgtagtcttccatgaaggcagtccgcttgttgtggctgatgatcttcatcaaacggtcaagagcggcagtcttccagtcaccttcaccagcgaagccataaccttcagccatcaataattgagtagccaagccaggtaattccttcatgccgtataagtcttcaaagttatctgagaaggccgtgtaaccatgagcatccataaagcgcttcaagccgaagtattcacggatttggtacttaacgtggtcttcgaagaaagcctcgtcgttatcgccagggttcatggtgtaagtcttagctaattcatcgtacttttggtcgatgtcagcatcagtaaccttatccatttcagcaactaaatcaccaacagcatagtagtcagcagtccagccaagttggatttgggcttcaatcttatcaccatcagttacggcaacgttacgcatcttgtcaccaaagagcacaactttaagcttaaagctttcgttgtaagcaacggcaacgtcttgccagtcagcgatttctttttgaacatcttcatcgccccaccagccgtaaacaactttattgtttaaacggagacgtgcattaatgaagccgtattcacggtcaccatgggcactttggttcaagttcatgtagtccatgtcaatggtctcgtatggaatatggttcaagtattgggtagccaagtgtaataatggcttctgcaataattgtgttccacggatccacatcttagcaggactgaaagtatgcatccaagtgatcacaccggcaacggagtcatcatggttggcatccttcattaactgggtgatgttatcagctgtagtggcagttaacttaaattcgattgggtaaggtaagttgccagacttgtttaacttatcaacaatgtccttggcatctttttcaacggactttaactgttcgtcaccgtataagaattgactaccagtaacaaaccaaaacttgtaatctggggtacttaacataataaaaaatctcctcttttaatttagtaaccttagtttatgaacgagctgcatggtcttttgaatgcgcgttgttttgaccatagtaggcgttagaaccatgcttacggtaatagtgcttatccaaaaggtattgtggtaatgcagagctctgatgagtcagctgcatggtatggaaatcttcttcagcaactacttctagaaccttagagttataaaccgccttgtctggtgttggaccccaggcaaatgggccatgttgactaactaaggcagcaggtacggcttcgtaatctaacccgcgttccttgaaggtcttaacgattgtcttaccggtgttgccttcgtaatcttcttcgatttcttccttcgtcagtgcatcagcggctggcacgtcaccgaagaacgtatcggcatgagtggtgttcatcgctggaatgtccatcttagctgcagcaaaggaaacagcccaaggtgaatgggtatgaacgattccgccaatctttgggaaatgattgtacagatacgtatgggttggtgtatcactagatgggttcatgtcaccttcaacaacttcacccttcaagttcacaacaactaagtcttctggctttaacttgtcgtattcaacaccggatggcttaatcacgaacaggcccttttcccggtcaataccggaaacgttgccccaggtaaaagtaactaatcctagtttaggaagctgcatattagcttcgtaaacttcttgcttaagatcttctaacatttaaatatctcctttttaaagctcgattgcgtcaactgctgctttttcgacttcaaggcccttcttataagaatcgatgaactcattgtagcctttaacaccatcagcattaggtgtcactgtttcactttctgaatttgcgaaaacgtgattatctaggtaatcagctaagttttctgtatttgaagcagttgatttagccaaagtgtataagcccaaaatagccatgccccatgggccaccctcaccagcattactcataacagtgatcggtgtatccagtgcatctgctaagacttgttgcccaatctttggtgttttgaacaagccgccttgagcaatgaagacatccgctttgatgtgttcgtcgttagtcaaaatatcattaccaattttcagtggtgcaaaggctgaataaagatgtgccttcataaagttggctaagttaaagtgactgtttggcgtccgaacaaacattggacgtccttctggcatcttagtgatattttcacctgacagataagcgtaactcaataagtcaccagcgttatcatcagcgcgttcagtgctgttaaacaaggcaccgtataagtcatcgggtttcaaatcaatcccgatttcctgggcgaattcaccaaatagtcccacccaagcattaatatctgacgagcagttattggtgtgaaccatggcaactggtgcaccatctggcgtggtaaccatatcgatatctttatgaacactatccattggttgatccagcacaatcattgaaaaggctgaagttccggctgaaatgttcccagtacgttcacgaaccgcgttagtggataccattcctgtcccggcgtccccttctggcggtgccatcaatgaaccagcttgaagcgtaccatttggatcaagcaagttagcaccttcagcagttaagtttccggctgcttcacccgctactttaatctcaggtagaatgtcctttaagttccagaaatattgttgaacattactttgtgcttcaaatttatcaatcattgctgctgaataagtcttagtagtggcatcaattgggaaaatgcctgatgcatcaccaatccccactaccttttcgcctgatagcttccagtgaacgtaaccagctaaagtggtcatgaaatcaacgtttttaacgtgagtttcttgattcaaaatggcttgatataagtgagcaatactccaacgttgtggaatattaaaatcaaatagcttggtcaattcatccgcagcttgttcggtaatgttgttgcgccaagttctgaaaggcaccaataatttaccgtctttatcaaaggccatgtaaccgtgcatcatggcactgacaccaatcacaccgatcttagtcagttcaacaccgtaatcagctttgactttttgaaccatcttttgataactggactgaatacccttccagatgtttgaaacagaataggtccaaatgttattaaccagttcgttttcccaggtaaaatcgccgctagcgatcgttgtaaaatcgtctgtaacaagtacagctttaattcgtgtcgatcctagttcaattcccaatgagacttgcccattagaaatcttttctttgatctggctcgtttccatatctgattcctccagatagtttttaatttgtttaaattcattaacatactaaatcgcttacaatttgaattttaatatatttatgctaataaatcaatatgtttattatttatacgtacataaaatctcaaaaagttagcttaaaagccgtttaatcagcttttaaaccactaaattatttttagtgtttttcaattttagctccttgtttatcccttaaaacatttcgtggactgattcttaaaataactcggaaacctaggtatttacttgatcaaagcgtggtttcccatgttgttcatatcataatggcgattgacatttatacggatgattactattgttttattagtgcatatatcattgcttctcatgccaaaaaggagtgtttaattttgaaagcttataaaacggattttgacagctacaaggaccaaaaagtgaccgcttttcacctggaaaacgacaacggtgttagggttacagtgcttagccaaggtggcatcattgctgaaatgagtgtcccaacaaaagatggtcagcataaaaacatgctactggaatacccacacactgctgattattatgcgaacccattctacgtaaacatgatgattgggaccgcagcaggccgtatcaaaaaaggtgaatttaccatcgacggcaaaactactaaggtcacaccaaacgaaggtcaaaatacccttcacggtggtcctaatggcttccactcagttaactgggatggcgagcttgaatcaaacactagtgatgccagacttactctgaatcaccactttgattcaaatcctggtgatttccctgccatttctgtaaccgttacctatactttgaagaacgataatacactcggcgttcaatttaccggtgaatcagacgaaaccactattttcaacccaacttatcatacgtactttaacgttagtgatgaaacaaccatcaaaaaccaaacattgcaactcaatagccatcgtcacatggacgttgataccgaaaagattccaactggtaaaatgcttgataacattaatactgcgtttgattttacgacaccacagaaactgggtaccgcaattgataaaatgcaggatactaccgaaaagggctttgacgatatctttgaagttgaaccttcttcaacgaatcaaaccattgctaagttatccgatgacgcttcaaaacgtgccgttacattacattcaagccgtaatggattagtcgtctttaccgctaactcatttacacctgacatgaacttaactcttggcaagggtgcaccatacatgggtgttgcattggaagcccaaaacctttctgatgcaacacgctttgaaaacttaggtgacgtcacgttacaacctggtgtgccaaagtcttacgaaattacgtatcagttaagcttctaaaacaacgattttaaccaaataaaaaagttttgatattaatggctattgccaattagtatcaaaactttttttctttgggactgtaattcacaatctatatggataaatattttatttttgatttatcgctttttaatatagactaaacctgcgacacaactcagattccagaatctaccgagctgtgtcgcactctcgtttaattaatctttttaactgagtcacgcacgaccatttccggctcatataaaatcgatttaactggtttcttggcaattaaattaaccagtaactgtgcggcatcatgccccattcgttccttttcatgaaccatcgtggtaattgccggattaatataacgcaccacattatagtcatcgaacccggtaattgagatatcgtctggaattgacaggttcatggactttaccatatcaatcacccggatagctaattgatcgttataacatacaattgccgttggccgatttttcgattgaatctcatgctcaactttagttaacacttgcttagtggaatccatcgactgatacataataatattacttttaagcgcaatgctggcatgctcttgataagctttaatatagccattcatccggttaacaccttgcatatcatcaacttggaaaacacccaagatgcgctcgtgtccttgttcaatcagataattcgttagccgttccaacgcacccttatcatcggtagttaccgagggtgcatgaagatctggcatatcatacgttgcattaataaagaccactggtaagcccatttcaccaatcttttcgtataaatcacgattagttgtgggtaacgtactttgagtcggctcaataatcagtccagccacatcgctttgtaacatcgtggtgagtgaccgacgttctaatttgggatcattgtgcgtattagccaatagtatggagtagccattatcagaaataatctgatcagcaccactgacgatgctagggaaaatataattggcaatatgcgtggcaatcacaccaatcatccgattggaatttttccctttagcgtgtgcggtttgccagtcgttcacgtacataccgccaccttgaatccggtaaacgaagtcttcgttttccaaatcgccaatcgctcgacgaattgtatatcggctcacgttaaatgctttcattaattcagtttcggtcggtaatttttcgccaattggatagacacctgacaggattttttccttaaccccattttccacaatttcatattttgccgacatactaaaaactcccattttatctcgctaatcatcacttacattaacaagtctttaattattaattactaaaaacaatgaaactttggtatgaattacctgcacacatgatgtagtataacaatttttcggtaaaaacactgatttatcaggttctttatcgaaaataagtaaagaaacccagacaaaatttctgtccaagtttctttacgatactatccactgttagtcactgatctttctacggtgcagaatcaaagaatccactaacgtcacaattcctagtatgatcatcgcaatgtctaaccagaaataaatgttcgtcatcgtttcatgaatgagtgttgatgcagcaaataccatcacaacaagtgcgatccaaaattgaaaatctttatagaaagtcgtattaaacttcagttgtttattattcatggtgtagtaaccccttatttaagctcattgaatgcgttaccactattgtgcttcattttttatacggacgcaagtaatttatctactgaattgtcactgattgattctataaaaactattagatcagtgattgtagcgttaaaatttatttgataaattttaattcaaaggttttacactcagtaacttatctataatcaataatttaaaaggtatcaaaaaagcataaccataaaaactgctgtgctatcaattccactagttcgataaaaattagcgacaattttacacttctaatcatagagaaccatgatgattgttctaacagtgaataagatatctgataagtaactaatactaagctttatcactgataataaacctacgctttgtgatacccttgctttatatccttagaagattaagaatcatggaaggcgcccaaccaccaggtccagaacctattttgattacaaaggaactgccaattgcagtcaagaaacttcatgttgaacaacaaaagcttatacgtcataaatggtattatatattaaacaaaaatggacttaccaatcgactgctggtaaatccatttagttgcatttatttaattatttgtcacaacgtcagtagcgtctgctgctctccgttctgctaattcctcagtaaccactggttcatgtttttcccacttacgataaaatatcatgcaaatgatactcaaagcataaatgataactggaacccagataaaggtgaaactaatagctgataaactaccagccgtttgagttgccttagcggcggtaaagccgaaactagctaaaattcttgcagcaataaaggaaccgaatcccgaacccatttggatacagaacgaagcacccatcgcagttaagaagccgttagcccgaataccgttcttccattcaccaaaatcaactgtatcaccaaccatcgagaaaaacatggtcattgctgatccggaaccaatgcaggccaagcaccagccaattaatccggaagtaacattactaccagccataccgatccaaacttgaccaatcatggtcattgctagcatcaggattgttgtcccccatttgtgcagatacttaacaatgaacggaacggaagccatcccgataatttgaataattgagaaaccgttaaagactgaaataagtcctttatcattcagattatactggaaataatatggcaaggctgcattccgcgcggaataagcggtccacaatgctaggttagctaaaacaatcaatacccatggccaattactcctagtagctttaaggctctcgcgaatcgtaatgattttttcttccccaatattcttttcacgcatatctaagaaagcaatcatcaaaataatgaatgcgataatcgcatataaaccaacagccagtgaccatcctcgacgatcattgccatgacctaacactgacgccaacggcattacgaaagtaacagcaaagaagttacctacgtttccaaggaccatccggattgagttagctgatgtccgttcatcagagttagccgaaaggtttggtagaactgaagtgattggcgttgataaagctgtatacgtcaattcggcaatgatatacatggcgccagcgtaaattattttagctgtactgctgagtgttggagtagtaaataatagccaaactgaaatagtaaatggtaaggccatccagaggaaccatggtcggttcttcccgtatttactgtgggtatggtcaaccaaaacccccatgacaggtgcacctaatgcatcaataaaccggccaagaagtaacagtgcaccagcggtaccaacatccaatccaaagacattagtaaagaagtacagcatgtaagaaccaatcaatgtatacaacaggttccctgccatatcagtaaacccataagttaattttcggtgaaatggtaatttatcagcggccaacatcgcctgtgctgccgcaacgttatgatctgtattcgaactcatttgttaaaacctccattcacattaactgttattgataaaaattaaattacgcaattgtgtacttttaaattagtgtttagaaattctttttttactatctcgagctaaactgacatacgtgataagcatcaagacagtcccaccaataatcgtccacagattattcggtatcgtatgatccgccactttccaagcgagtgtaataaaagcaatctgcagtatccaagtgaaaaccgactgacttgcaaaaagttttccaaatagtcgcataggcaaatctccttcagagttcaatttattttaaggcttgaaatgccggctttaattcttcagcatcctcctggcgaatgaaaatcggtaactcatcaattggcgtttcaacagatactgtctgcccacccgtgacaaactcaccagtattagcatttatccaatccgttccatttggcaaatagactttgcgttgtttcatcttttcatacaaaacaggcgcgattaaaattgaatctccaaagagaaactcatcttcaatattccaagcctgactgtcttggctgaagttatagaataacggccgaataacaggtgttcctttttcatgtgcatccttcatttgaactttaatgtaattcttaagattagttctcagattcatgtactttttcatgatcgaatatgtggcctcaccataagcccatggctcagtagcaccaccggacggcattttgccaccaccttcgttactgagtggttcagtatgaggttcccgatcaccgtgcatccgcataacagggcaaaaagttgcaaactcaaaccaccgcgttaccagttcacgaaaatcttcgttatcatccacaccgccatggaagccaccgatatcagtagtccaccatggaatgccggcaattcccatattcaatccaatcgctaattgatttcttaacgactggaagctggagtcaatatctcctgaccataccaaggcgccatatttttggcttccagcccatgcacaacgaactaaattaataatgttctttttaccacttgccttttgcccatcataaattgctttagagtaccctaaaggataagtgtttccaacctgtaagtttgagccattatgataccggtaattatcaaaatcatagaccgtatattctggttcagcctcatcgagccagaatagatcaacacctttatcttgatagtttttcttcaacagctgccataaataatcttgcgcatcaggattagtaaaatcaacaaacccgttattgcccaaaaagttcatggtgattgggaccccgcgctccgtttgaaccaaatagcctttttcttccatatctttatagtgcgaactagtttcatcgatggttggccaaacggagaccattaacttaattcccatctcatgtaattccttaatcatcttctctggattaggccagtatttttcgtcaaacgtgtactcacctgattttggccagtgaaaataatcaatcacaataacactaataggtaaattacgcttcttaaattcgtgggctgcggctagcaactcctcttgtgtgcgatacctaagtttacattgccaataacccatcgcaaagtccggcatcattggtaccttcccagtcacatcagcgtactgttcttcaatatcactaggtttatcaccacaggtaatccagtaatccatttccttggtggctaacgaatgccattctgtaacgttctttgcaaagtcaacatcaccgatagctggattattccataaaaagccataccccttgcttgagagtaaaaacggtacgctagcttgagaattacgatgcgctagctctaatttagcattttttaaatttagaaaatcctgttgatattgccccatgccaaacagtttttcattcggatcagattcaaaacggactttaagttcaaaatcaccacccaaaatcggtttaaactcccgtgaatcaatatttaatgcgctattaaaatggttcactttttctgcatcgattcctgccgacatatcatcaattcggtttcgttgaaatccttttaacaggagatcaccgttttgtttgtaaaaactaatatttttgaaagcatctaatttggctgttaatttcccattagtgatttccccacttttctgggtttcattaacgctcacagttgctttattttcaggaatagattcggttagcgcatgattttcaccagtatatgttgaaaattttgtactccgaacgcgaaaactattgttaccccatggccgtatttccaataattcatttccgtttcttagatataaacaaccactatcttcataaatcattttaataaccccttaacaataaaattttatgattctcaacttcatctaaaattattttagcaagcgcttacatgttttatactatagctttacaagcaatctaaaaactaataaaattagcacaaaggtatacatatcaaaattggaggtatctattttgaacgaaaaagtatacaaattttccttgtacaaacccgttcaattttttaaagcaggtgagtactttgctaatcgtggatggcaacacaaagatatcattaacgatggtgactacgaattatttattatgctctcagggactgcatacattcagattggtgccacacggtatactctcaacaaaagagattgcttgttgattcctccacacattcgccattttggttacagggattcaccagataataccaattattattggatgcactttttccctagtggaactgtaacctcctcctttgattcgaaactacccattaaaaaaacggaagccgagatacctcaattatttacaatcactgactttgaaagattaattatcttaataagacaacttttggacagcgctaatgacgaaaaagcgtctaaaattgctgccaattattttatttcaagtatattgattgagctatctcatcaatatatttctgcaatacaaaacactcacaggtcctctagtcgctttgaattaataaaaaattggattcgaatccacagtcacgaaaagttgagtgtgactcaaatcgctacggagttccaaatgactcccgtttatttaactcgtctttttaaaacttacgaaaatacaacaactatccatttcattaattcagtaaaggttaaacaggccgaagaactattgcttacaaccaacaagtctataaaagagattgcatatgatttaaacttcagcaatgaaaaatattttttacgcatctttaaacaaattacatctttaacaccttcaaattttaaaaattcctattctaaaacctatctgaataatattgaagttgatccaaccatacctaagccttgattattcaataacaaaaaaaagcccatactgggcttttttcgttattctttactcaaccaaactctcattgcaccatcttcacgattggcccaagcatagtaaggaactaacttgattttggtatcttcaagcttttcatccgttgcttcagtatagaggtcagcaccatcttcatccatcgtaggtaatttggcatctacggtaatagtgcccacaccttcaagtaaatcaggtccaaattcgtagctggtctcactctttgcagaaacttcatactgccacaatggtgcttcgttatcagcactttctgcacaaaagacgattgggccacgttgaactgctaatttaccaaaatcggtacttacgcgattacttgctcgcataaatttagtggccatatccagtgataaatcagcaacaacttgatcttgagtaatcggaatgtaaaggtaaccgtcagttgctttaatgtcctgtacgtcaccattcactttcaattcataatttgcctttgaccaatttggtaagcgaatgccgaacaaagtctcaacttgattagggttagaaatctcaaaatgaatttctccgctccatgggaagttgctagtttgctcaatctttaaaccatttttaaactcagattgattagcaataaactgattgcttaaaattctgtccggtttgacatcatagacatattgatcaagtgatgtaatcaaccgagctaaattagcaggacaacatgcacagccaaaccagtcagcacgatgagtcaggacatgtgacttcccaggattcagtgctgacgcctgtggatcggcttcaagcggattaacatagaagaagtgttttccgtctaatgccatgccagaaagtgcgccgttaaacaattccttttcaatgacatcggcatattcactattagtatctagcaaagacatctgccgagcgaagaaggttaatcctactgaagcgcaagtttcgccatacatcgtgtcgttaggcagatcgtaatcatacgtgaacgcttcaccagtggtggttgaacccacgttaccagtgacgtacatccgccgtttaacaatatctttccagaatcggtgacaagcttctagcagcgttttatcattggtcaaacgtgcaacgtaggccattcctgtacatagataaacgacacgaaccgcatgaccatcagcggtcttctgatcagcaattggttctgcatcaagatagtaacgctctcccgcgtcacgcatacctggaataatatcgttttctagcccatcggctttattttgcttttcgaagaaatctggttcagttccccgaaccctcaaaaagtaaagtgccttattcaagtaatcctcgttatgtgtcacttcatataaacgagataaagccaactcaatctcagggtgaccatcataaccattaatttggccgtctccggtaccaaaacttctgacaatacaatccgccattcgctttgctatttccagcgctttttcactgccagttgcctgataataagccacaccagcttcgatataatgccccatcgtataaagttcatgcgattgttgcagtcgcttaaattttctttctggcgcatcaatttggaagtatgtggacaagtagccgtcatcttcttgagcatcggcaattaaatcaatcaaatcatcagtaatcgtttttaatgctggattagggtgatatgaaaatgaataggccgcagcttcaagccacttatatacatctgtatcttggaatgggaatccatagtgatgccccttcattttgccagccgcaatttttaagttagcaactgcatggctatttttatcggctccttgaattttttgaggatctttagacatattaatgttggcctcatcattcatgacagcccattgatacggtaaaacttcagaaacaactaattcctggtacctctcccaaaacggagaggtaacggtcacgtgttgtaaactgttacttgttaatttcgtttcagacatttaattgttcccctttcaataaatagaataacgttgcttacttatcggcaacaacatctgctccatttgctgcacgacgttctgctaattcttcagtaacaactggttcatggttctcccacttacgatagaagatcatgcatacgatactcaaagcgtaaatgatgactggtacccagatgaaagtaaaactaatagctgacaaactaccagctgtttgagttgctttagctgcagtaaatccgaaggtagctaagattctggaagcaatgaaagaaccaaagccagaacccatttggatacagaacgaagcacccatggctgtcaagaaaccgttagcccgaataccgttcttccattcaccaaaatcaacggtgtcaccaaccatagagaaaaacatggtcatagctgaacctgaaccaatgcaggccaagcaccagccgattaaaccagaagtaacattgctaccagccataccgatccaaacttgaccaatcatggttagcgccaacatgagaatcgttgtcccccatttgtgcaaatacttaacaacaaatggaactgaagccatccctaaaatctgaatgattgaaaaaccgttaaagactgagatcagacccttatcattcaaattatattggaaataatatggcaacgcagcgttacgtgctgaataagcagtccacagtgctaagttagccaaaacaatcaatacccatggccagttactcttagttgctttaagactctcacgaatcgtaatgatcttttctttcccaatattcttttcacgcatatctaagaaagcaattatcaaaaggcaaattctataattaatccgaacagaaattaaaaagcccaaagcaatcacttacaatggtagtagctaattccaaccaatatagggagtgattactttgggtacatctactttatcacgtttttcaacgtggcgcactagcacaactggtcaatgaggggataaatcttaccaagtatggctgacgccttaggcgtcgccaactacgattagctatgagttggaccgggttaaaccttatgatccaaattagctcgcagaagcagatcgcaaaaggcggaattgcggtcgtcgttcgatgctgacggcagcattagcgactttaattaccaatcacttacgattaacctggtcaccacgtaacacttgctgggccgcttataacttgagcactgcgtaatttataattggcttaatcgtggctggctccccttcaaattgactgatctacccaatcggaatgtccgccagcaccgagtgagcgaaaatcgtgggaaatttacaagtgggacttccatcgacaacggccaacaactgttaatcaacggttagcttttggtcattggaagtagatacggtgctttctagtcgaagtgagtcacgatcatgtctggttacattcgtagaacgtaagacccgacttctatgggccatcaaacccctaatagaacggctaaggcctaaacaccgcctttggcaagtttatgggggccttcggtccccaagtaaaatccattactgttgatcatggtaaagagttttgccaattacaggccttaaacaggattatcagatcaaagtttatttttgccatccatattcaccatgggagcgaggttcaatgaatattttaatagacggttacgctggttcttcccgaaaaagaccaatttttagtccaagccaagtaacgactgatgagatcctagcagcacttgaactaattaatcaacgaccattaaaaatacatcatcaacagactgccattgaaagattccgggcttgttcagattaaacttgtaatttgccaaaataataaaggcaatgattgcgtatagcccaacagccagtgaccagcctcgacgatcattgccatgaccaagagctgatgctaatggcataacgaacgtaacagcaaagaagttacctacgttccctaaaaccatccgaattgagttagctgaagttcgttcatctgaattagccgataagttaggtaaaacggaggtgattggggttgatagggcagtataagttaattcagcaacgatatacatagccccagcataaataatcttcgtggttccgctcagtgatggtgtcgtgaacaacagccaaactgaaatggtaaatggcaatgccatccaaaggaaccatggtcggtttttaccgtacttactgtgggtatggtcaactaaaacccccattactggcgcacctattgcatcaatgaaacggcctaaaagaagtaatgcaccggcagtacctacatccaaaccaaagacattggtgaaaaaataaagcatgtaggacccgattaaagtatataacaggttcccagccatatcagtaaaaccataagtgacctttctatgaaacggtaacttatcatttgcgagcatggcttgcgcagctgcaacattatgatctgtatttgaactcattgtgtaaccctccatccatagatttaaaaataattgctaaaagccaaaataaacaaaaccttttctgctacttgtcggaaattcgtttcttactgtcaaaagcaagactgacatacgtgaccagcatcaaaaccgtaccaccaataatcgtccacaaattattcggtatgctatgatctgcgaccttccaagccagcgtgataaaagcaatctgtagtagccaagaaaaaatcgactggcttgcgaagagtttcccaagcaatcgcatgataaggcctcctttacagttttattttgaatacgctttcataataactgtttccatataccctagtaaggtctataattacaaaaaaggtaactatttccgactttttaaaatttaatttagcgacatatcgcaatttttatatattaggtgactattttcgacttttagcttcggtattttcttattaattactacgattcttgtttaagattggaggtttacacgatgaatttttattgctttaaattaaacaaaactgtcttatattataaaggtggtgaatttatgagcaagtcaaaatggattcataaacccatgtatcataagggagactacgaaatcattctgggattaaagggcaaaattcatcttcaaattgaagatgaacccgtcactgttggccctaatgatgtcttattaattccaccatatacgcattttcaaggttctaaaccaagtaaccaggtcgacttttactggcttcacttttttcctcaggactcactatctaggtttacagctgatgaaaatgcgactgttagctctatcattacaaattccgataacgagaaaaaagtgatcctgcccagtctatttcatttacatgactatgaacatatcaccgtcctcatgcaccaaattttatcccttcacacagagctttcgtacgttgaagaacgggattttttaacgtctgcgttactaattgaactattcaaatcatacatcgcacaacataatccatcagacgccaacagtcgtatcaactatttgaaagagtggatccgagctaatatgtctagtgaattgactgtagcagagattgctagacaagttcacctcaatgtagactacttaacgcgtttatttaaaaaatacgaaggcatcaccactctgcaatatattaatcatctaaaaattgaagttgcaacgctcttacttattcggactgaaatgccaattaatgaagtcgctgaaaattcatacttcagtgatcctaaacttttcatgagacactttaaaaccgaaatggggctatcacctactcagtatcgaaatacgtttaacatcattcatcacaataatccgcacattgacccgcagattcccttaccaaaacaattatctgactcaatcgataaaattcccgttaatggcaatgaataaactgaaaattagaaacccatttccttaatgatgtcaacatgataaattagttactggcaacttttttagatgatttaaataattttgtaaagcgaggaataagatgctattaggaagtatcgaagcaggcggtaccaaatttgtctgcgcagtaggtaatgaagattaccaagttaaaaaacagattcaatatccaacaactacgccagaagaaaccattcaaagatcaattgatttctttaagaagtacccggatttacgcgccatttcggtggcttcgtttggtcccattgaaattcgtaaaaacaccgaaaaatacggctacatcactgacacaccgaaagtaggctggtcacagactaatttcttgggcatgctacaaaaagcctttgatctgccaatctattggacgactgatgttaatggttcagcatatggtgagtacacgttggcactggcatcaggtaaccagattgatgcattaacttattacaccattggcacgggtgtcggtgctggaacagtcctaaatgggcagttcatcggcactttgggtcatccagaagttggtcacgtccggttaaagcgccatctcgacgacttagattttaaaggcatctgcccttatcatggtgattgcttagagggcttggtagctggtccaacgtttgaagctaggactggtaaaaaaggccaggatattcctctatctgatcacgtttgggatattatggcctattatgtggcacaggccgctctgcaaacaacgctgcacattcgtccacagaaaatcgtttttggtggtggcgtcgtcagtgaaaccttcctcaagaaagttcgtcacgaatttgcgacactaatgaacgattaccaagacgttggcgacttagaagattatattacaatgcccatcgctgaaaataacgggtctgcgaccattggtaactttgctttagcctatcgtgaaattaaatcagcagataattaatccatcacaccataaaaacagcacgttgatttttcttttctggaaaaattaacgtgctgtttttaaattaactaccttcaactacttaacataagtcgtcttaaagttgtagtttgcaccagccgagttgtaaatcgcgttcttcacgtcccgactaaagacccatggcgctgaagattgatacagtggtgtaatgccttgatccttcaacaggatattttgggctttcaccatgtcatcccaacgttgctcaggcttgttagcatccgttgttgaggaagccttaaccaactgatcgtaagtagtgttcgaccaatcagaaatgttacttgggttatgcgtggtgtaaatatttaagaaggtgattggatcagagaagtctgcgaaccagttagccattgtgacttgatacttccgcgtagcctgacgtgccaataccgtccgagctggaatactggaaattgaaacctttagtcctggtaaattcttctctaaagcactttggagatattcgctaacttgcttagtcgactcactgtcaccacacatgatggtgaacttagggttagaaatgccagtttctttgagtccttgttgccataaagttttggccttagctggatcatagttcatagaggatggtgcagtggtgtctgcagtaaagtccttgccagtcttagggttagtcgctagacctttagaaacgaaattattggtcacgactgaaccatcaccaaggactttcttagtgatttgctgccgatccactgccatagagattgcttcccgaatcttcaggttctggaataatttcatgtgttggttcaacgccaggtaataggcacttgactgtggccgtgcaatcaaatctttattgttctttaggttcttcgcttggttacccgttaacggcgcaccaactaatttctttgaattatactgattcaaagccgtctgactatctttaacaacttggtacttgattgaactcatcttaacggctttcttatcccaataatcgttgttcttagccagcgtccaggtcgtaccagtcccgttccacttggttaacttgtatggcccgttgtataccatccgatcgcttcgagtaccgtagttgctgccatacttttcaactactttttgatcttgtggataaaagactgggaagccgagcaatagtttgaagtacggaatttggtgatccaaatcaatggtcaactgatacttaccagtggctttgattcccaatgtacttggtgctttcttacccttggtgatcgcatccgcgttcttgatgccactaaacagatatgaatactgagaagccgttttaggattgaccgtccgctgccaagaataaacgaagtctttggcagtcaatgtatcaccattactccatttcgtattgtgacgaacatcaataacatagtggcggccttggtttgattcagttaacttggtggctaaccccacttccggtttactgttcttgcccaagcggtataacccttcattggtgttattcaacgtatcaaaagtacccaaagcagtggatttcgaaagatccatggttgataattcactgtcggcaggcatcgtgaacgtttgctttttactcgaactgctacttgaaccacaagcactgagcagtaacgctaaacttgctaagccagcggtaaccgcccattttggattgattttcatatgcttttcctcctacacaactcaactaaagcacaacaacgattactcatattctatcacaattatgagtaaatacacatatcattttaatattattttaatgtttcctttttcaatttagttagtaatccttcagcagagctcctataaagtgcaataacttacctttagtataagatttatgacgtatcttacatcaaattgtgagaattaaaaacaaatgagagattctaatgagcacaaatccggttaatgcttattcattttaaaatacgatcaaaaaagtgcttcctaacagttagaaatctaactgttaggaagcactttggttgctattttgactgacttaaactacttaatataagtcgtcttgtagttatagttagcacccgctgagttataaacaacgttcttcacgtttggactaaagagccatggtgctgaagattgataaagtggtgtaatcccttgatccttcaacaggatgttctgggcttgaaccatatcctgccaacgctgctctggcttattggcatccgtggttgaagaagccttgatcaacttatcgtaggtactgtttgaccaatcggaaatgttgcttgagttacctgaagtgtaaatgttcaggaacgtgattgggtctgagaagtccgcgaaccagttagcaaaggtcacttggtaattccgtgaagcttgacgtgctaagacggtccggaatggaatgttagaaacagaaactttcaatcctggcaggttcttttccagtgagttttgcagatactcagtcactttcttaccggaatcgctatcggcacctaaaatcgtaaatttagggttactgatacccgtttctttaaggccttgttgccataactgtttagccttggctggatcatacttcatcgaagcaggcgcagtggtgtccgctgtaaagtctttaccagtctttggattagtagctaaacctttagaaacaaagctattattaacgattgaaccatcgcccaacactttcttagtcaattgctgacggtcgacggccatggaaatagcttcacgaatcttcaagttcttaaataacttcatgtgctggttcaaagctaggtagtagctgcttgactgtggccgtgaaattaagtctttgttattctggaggttctttgcttggttacccgttaatggtgcaccaattagtttctttgaattatattggttcaacgccgtctggttatccttgacaacctgatacttgatagaactcatcttaacggctttcttgtcccaataactattgttcttagtaagtgtccaggttgtaccagtcccattccacttagatagcttatatgggccgttgtaaaccattcggtcacttctagtcccgtaaccattgccatatttatcgacaactttttcattttgcggataaaagactgggaaacctaacagtaatttgaagtaaggaatttgatgatcaagatcgatggtcagctgatacttacccgtggctgtagcaccaagcgtacttggcgacttcttaccattggcaatggcatcagcattcttcatgccgctaaacagataggcatattgtgacgctgtttttggattcagagttcgttgccaggaataaacaaagtctttagcagtcaccgtatcaccattgctccacttagtatcgtggcgaatatcgatcacgtaatgccgcccattattggtttgggtcatctttgtagctaaagccgtttcgggtttactatttttacccaaacggtataacccttcattcgtgttattcaacatatcaaaagtacctaaggcagtggatttcgacagatcaactgttgttaactcactatcagttggcattgtaaacgtctgcttctggctggaactgctgccagaaccacaagcactgagtattaacgctaaacctgctaggctagcgctaactgcccattttggattgaacttcatattcttttcctgctactgataacttataaaaagttatagattattcttgcttctccctatcctgcctcgcatgaagctcgctaatacagttgatatgatagtccacaagcgttaatttccggctagccaccggtacatgctttgaagcctgttttagtaggctaattcaaagttttcagtatccctgatattcagggccgcattaatatctcgatccgcggtatagttgcagttttgacatccatacacccggtctttgagttgcaaatcaacttttttatggccacattggtgacacactttagaagtcggttcaaaacggttggtcaagtgtactggaatacctaactgctggcatttagcgattaatttgattctaaagttgtagaatccttggtaactaactactttagctaaatgccgatttttcatcatacctttaacattcaagtcttctaaggcaacccactgcggtttggttctcaccacagcagcaataatcttattttgataatccgactgaatgttggttaatcgttgatacaagcgttgcactttcagctgagttttagctagattcaaatcagtagcagatttcccttctttctgtcttctagctttcagtgcaagatactgacgggacagcttcctttgcaggcgtctaaggcgttttctgatgcgtcttatccgactgcttttattttgattaggatacaaagtaccatcatttaaaatggcaaactcttttaaaccaagatcaatgccgatgggctcaccggttaacgctagttttggtaattcagcctgttccactaaacaagtcaagtaataacgaccagctttgaatttgattcggccttgtttgacaacgaagtgttctgagtctgtaggaaggtagccaaactctttcaaccgtacccagccaagcttcggcaacttgattcggtgacgctgacaggcaatgatttgcgttttaccgttcttaacaaagtagtaactgccttgaccgcgcttaaacgagcgccaatgtgggaaaccagtttgttttttgaaaaatcgcttcatagctgtatcagcatcgataaaggcctgtttaaccgatttggcatataattccttgacccacctgtcatcaggattggcttcaagatattcatggttaaaccacttactgaactcataagcgcccatgtagtgataaccgcattcataacgctgccggttgatatccaaaaacaggttgtaggcccaacgactgccgccaatatgacaatcaagctgccaggcttgtttttcagtcggcttaatttcgactttataggtgagtaacatcaactgttccgccttattgaatttaatcaccatggtgaggtgtccctcataattatacgggatggccttatcccaaaaagccttttaatgaaattcatataaataactacatataagctatcaactgatatggaaattttaacgcctaactttaaccttgtgatatcttttaccaggttaagaatacgcaataggatcgaaacaccactttacaaagattgatatccttttacagcaaaatagttactgttcatccctcctagacaactcatctaaaaatacaacaacgattactcatattttatcacatttatgagtaaatacacatatatatttaaggcttatttaatattaatgattattcgttcattaataaagtgtctagaagtccccaatatcgattgcttgcccataacaacggctttctgttatgctttataaaaagagaaaggttgcaaaaacatgagaaaactaagtgttcccctcatcgcccaacgacctgagttacctactggctgtgagatcaccgccgtaaccatgctactacaatatactggcgctcgagttgataaagtacagttagctaaagagatgccttatgatgccaccgattgcaataaagggtttgtgggcgatccctttatggaaaacggtaatagcatttatcccccagcgttaatcaatttaatctctaagtacgccggtcacgcaacggacttaactggggctgatctagccactttaaagacccaaattgaccagaaccgtcccgttgttgtctgggtcggtgaatttgacgggtttcatacccacgccttagttttaattggctatgacgatgataccgtcatcgtgaacgattgctggactaaccaggctgaaaaattgtccaaccagcaattcgctgaaattcgagcaaatttgggcaatcgtgcaatcaccatttaaaacagtgactaaaaagaaccattgatcagccgtcttattttgacgtgaccaatggttctttatttaaactttaaaatcgtctgatcgtcctcatccgccaaataagctcggccggtatttttgacaaccacgtagtctggtaaatgccgatcgagctgctgcttgaacgtatttaatagctcatcaaatgaaatctcagtttcaccctgctgatacaggttctgtacgaaaccgtcatattcatcttcaatgaattcgctgatactgcgcacgtttgaataacttggcgggttattcccttttttatagaaatccttagtacttgcaatttctttatccaaaatgtctctggataaccccatgacctcgatcatcttttcagatgagggcaagtcgaatttctcaataatttcttcgggttccacgttaggttgaggcatttatcaatcacttccaggtccttatttgaattcatcaggtagttatactaacgagttgttagaaagtcacggtttaagcaattcgaatcgcaagcctcgtattttgaacgccaaacacggttcgttgacaaaaacggttcatcactgttttcagaaaaacagctacaatctcagctaactggcgggagtcatgaccactaatagctggctgatgatattgaatcgtcaagattgcccgatgatgttggtgatcagcgcgcactgccgccaacttcgctgttcccttctgatttccagtagtgtaaggcacatccgtatgccactcatccgtccatggactctgcgacagcaatagctcgtggatggcgaattccaactgttggccactagtggggtgtcgttgattataacgatccagccagtcaatataaacgggtaaatgaaaaacaaatgttgtattgatatggctcccctactttccttaaactcattaatgcacaaagtatactaccagaagctaaaatagccataagaaattcgccatctttaatttaaattaaaactctaggaagctgtgacaaaactcggtagattccagaatttaacgtgaataatgcctattccgcgatttttgcggagtaggcattatttcggaatctgagttttggcacgtaattaggctatcttacgtatagagccaacgtacagtgataactatttatggctcaaaatcaattgaaatacttgccaatatagacctatgtcacagctttcttatttggcatttaccgagatggcactcttttacgttaatgacgctactcagcatctgacaacccaggatattcactcagaaactgggcaacggcaccaattaaattagacgcgttgcagaacttgcaacggtcaatttccgtcgtcacggtggcgcctttttgctgcaaaagccggttcgtttgatcacgaatcattgccaagaagtcatcccggacggatatgccgccaccaattaataaccgatccggattgaaaccagtgattaaattataggcttcaatgctcaaccaatgcaccatttcttcaatacacttttgagctaattcatcacccgttttagcgcgttcaaaaatttcacgtgcgtccaccggttctggagactgactcagtcgcgtatattttctcgccattttaaccggcgcccctagttcacttaatgtttcgttttgctcgttcatgatgctgtagccgaattcgcccatgaaataatcgcgcccggttagcagatgaccatcctgaactatactaccgccgatgccggtcccgataatgagcaatgcaactgaggaaacatcctttgcgttaccaagccaggcctccgctaagccggcacagttagcgtcattttgaatggttaccggtagtttaaactgcttgcttaattcttgacgaataggaaagccgttcagatagggaaccgcgctgagcccagatatttcaccgattttggtattcacgcctccaggtaaactaacggctacaccctgaattggctgattaatttttgctggcagacttaacagcgctgctaacatttccggccaagtttctggcgttttaaagctaccggaatcagttagtttctggtaccaatagccatacttaactgatgtaccgccaatatcgatggccaataagcgactatcatctcgttgtgtcatcactatcatcacctaaatcttcaccatgagttgaaatgaccttttgataccagtagaacgaatctttgcggtaacgtttcaaagaaccgctgccgtcatcattcctgtcaacgtaaataaacccgtagcgcttagataactgaccggtacttgctgaaacaatatcgatggcactccatggcgtgtaacccatcacgtcgacaccgtcatcattaatagccagttccatttgcttaatgtgatcccgcaaatacttgatgcgatagtcatcgtgaacttggtgattagcttccatctgatcaatggcaccaatcccgttttcaacgatgaacagtggcaaatgataccgatcattcatccagtttaaagcgtaacgcaagcctttaggatcgacctgccagccccaatcagattgcggtacaaacttgtttgtcactaaatctttggtttcgttgtaagaataatagtcgtcttcatcaggcttcgctgccgtcgcaaaggacatgtaataactaaaaccaaggtagtcaactcgccctttcttcaaactagcgaggtcctcatccgtaatatctaagtcaaattttttcgcagcttggtatttgcgcagccaacttggataacgaccctcgacctgtacatcagagaaccagaatctagcctgcatcgcccgttgcgccttcaagacgtcatccggtttatccgttgccgggtagactggtgaaaaagcaaccatggcccccactaataaatcagggtttaattggtgcgcgaaggcaaccacttgggcactggccacaacttcatagtgcgcagcttgatacatcacggcttccgcgttttcaccttcatgaacctgaacgccagaattagtgaatagcgtaaacgcccggtcataattcgtctggttattgatttcgttaaaggtcagccagtacttaaccttatgttgataccggttgattactaccttcgcaaatttaacaaaggcgtccaagacttttcggctacgaaaaccaccgtattccgtcaccaagtgataaggcatctcaaagtgtgatagtgtcacaacgggttcaatattgtatttatggcattcgtcaaataaccggtcataaaactttaaaccagcttcattaggttcatcctcgtcaccttgggggaaaattctggaccacgcgatggacgtccgaaaacatttaaagcccatttccgcgaataacttaacgtcgccaggatattgatgataaaaatcaacaccttcatgattggggtaaaactcacccgctttaacaccgtccgtaatgcgccgttcatcaaaattaccggctgcagtcatcacgtccgcaacactcaatcctttgccgtcaacgttataagcgccctcggcttggtgagcagcaatcgcgccaccccataaaaagttttctggtacttgcatgtcattttcctcctaatcaacaaaagaagcccaaatacctatctcttgtgggtatctgaacttcttagaaaaacgttataaactacctgatgaatcatactaatgatggaagatcaatctcataccattcatgtgaagcaccgtatgaatggccattgaagcaccacctagcagcgtcgcataatgcacatccttagacatgactagtggcggaacaagtggtaaaaaggttaacttcatttgaatgttcttcaagatttctggcaaactatcgatcaacggtgagttatagaaaatcatttgaggatcataagcggaaatcaaatgactagtcacaatcgctaaataataacagaagtcatcaatcaaccttgtaatttggtcatcatggtccttgtaatcctcaattaacatcgacagactataagtcttgtctttcttaatcacccgagctttgtggataatcgcatttagggaccattctgaatcaaaagtcggtaatttcgtcagttgctgatgtgttcctgacgtatctgaaatcagcattctgccaatctcaccggcctgcccgtagttacccgtatacagatgggcattaatgatcacgccagcgccaacgccttcgtgaatattaaaggagactaagttttgcagttcctgcttactaaaatcttcttcaaaaatggccgataaattggcttcattttcaacgatcaccggtacgtgataattgtcctgaaaataatcaaccaggtcaacatcatcgtaatcgacaaaatccgagttaacgatttggtttttatagacgacgccaaagactgcaatcgatattgcctgcaaaccgttaacaaagtgaaagtctggcagttgttcgatgagttcatccatctttttcaaaataaccgaaattggctgatgattaatttgttcaacattatactccagaactcgcccatcaaacctagtcgccagcatctcaatctgagaccctgaaatactaaagttaacggtatagccaaattcagcgttatactccactagctctggttttcgaccactactgccactcatcgatttcccctcacccaggctcttagccagtcgctgttccaataattgacccacaatatcggaaaccgtaaccttgttcagcccaacttttttagaaatctcattgcgtgacattggcccattattgataatttcggccaatactgaatgctcgttatggtcgcgcataatgtctttgttaataatcatccgaatcgctcatttctcatcattattatgcttcagcattttccttagcatgctttgcagctaaatcactttgcatcttcttttcaatcccatctacatgatagaacaataatgcaatggcggatagtgcaaatccaagaagtggtacccagatgtagttcatttcaataccgtgtaaagctgatgcgctttgggcgtggttagcaacgtaaccagttgatgaaaggatagcaccagtgatggcaccaccaatacccatacctaacttagctgagaaacttgagaatgaagtcacgataccttctgcacgaataccgttcttccattcaccataatcaacggcatcggccaacataacggcgatcaaacctgaaacataaccagtacctaagtaaccaacgatggtagcaaagacgatcataccaacactcagatgtgatgcacccaagtccaacagaagttgaccaacacaagctaacagcatcccaccaagcatggtgttacgcttaccgattagtttagaggtcaatggtgtcaaaacaacggcaactaacgcaactaattgtaaactcagtaccaatgaagctaaacctgcattgtgcatgttgtacttaaagaagtaaacagtaacttgtgaacgagtttgcatccccaaccagtaaatgaagttaatgaagatgatgattgcccatggccagttcttcttaagcgctttcaaagattccttaattggaattgactgacgtgaactcttagtttgaacacgttcttgagtgtttttgaagacaattgcgaacaagataacaacaatgataccaacgatcaatgcccaaatgaaccagccacgtttgctggtagtagaaccaccaccgagccatgcaaccattcctaaggtgataccagtgatgatagttgcaccagcagtacccatgaattgacgaatggttgacaaggtgacacgttcttgaggattacttgttaatgatggcaaaatcgaagtaattggaatgttaactgatgaatagagaatatcaacaccaatataagtaacgtatgcccaaataagtttaccggtaaggctcaaatttggtgtggtaaagaccaagacacagaagacggcaaatggtattgagaaccataaccagtacggccgactcttcccatatttagtatgggtatgatcgatcataatcccccagaatggaccatcaaaggcatccacgatccgggcaactaaaaacagtgtcccaactgcagcggcactaataccgaaagtatcagtgtagaaaatcattaaataagttcccaccatttggaatgacaagttgcaggcgaagtcactcaaactgtatgagaaacgctctttccatggcacctgatttttttgctcgggtgctacgtcagtaacattttgactcataattaacacctcgttgaattttattattgattattaataagttcaactttcaaaccaaatgttactgtaaccggtttcaaatgtcaatagttttttaaggttcaactttgccatggtgttttttcattacctatatataagcctctgcgtcataaaaattattcggtttcagttcatgaaagcgttgacaaaacttcaaaatgccattacactgaacttgattattaataagttcaatttctaaactaactcaatagaggtgctttttccatgaagtttacgaatggttattggctagaccgacctcaatatgagattcagtcgccaaaagaagttttcgacgtcaaacaagacggcgataaattaacgctttacgctccgttcaagtacataaatgaacgtggtgatgaattaaacctagggatgtcgactattgaactcacttccccaatggaaggcgttatcggtgttaaattaattcactttgatcaacctgataagaccccttcatttgaattggcaaatgaacatccaaatgtcaagatcacaactaatgataaagaaattagctatcaatctggtgatttggctgttaaagcaccatttaagggtcacttcgaacttgatttccaacgtaatggtaagacgattaccaaatcgatggaaaaggctgaaggcgttatcttagataagtcaactggcaaacactacatgagagaacaactttccatgggtgttgacgaactggtttacggacttggcgaacgtttcggctcccttgttaagaacggtcaatctgttgacatcgttaacaaagatggtggtaccggttctgaacaagcttacaagaacattcctttctacttaactagtgaaggctatggggtctttgtcgaccaacctgaaaccgtttcctttgaaattgcttcagaaaacgttgaccggactcaattcagtattgaaggccaatcaatgcagtactacgtcattgacggtcctactccaaagggcgttttggacaagtacactcgcctaactggtaagatttcactcccaccagcatggacatttggtctttggttatcaacttcatttacgaccgattacagtgaaaaaaccgtccttaagtttatcgatggcatggctgaacggaagattccgttggatgtctttcactttgattgcttctggcaaaaagggtttgaatggtcaacacttctgtgggaccgcgatcaattcccagatccagaaggtttgatcaagaaggttcatgatcgtggcgtcaaagtctgtgtatggcttaacccttacattgctcaaaagtcacctctgtttaaagaaggcagagatcatggctacttgatcaaacgtcaagatggcaatgtctggcaatgggatctctggcaagctggtaacggcttcgttgacttcactaacccagatgctgttaagtggtaccaaagcaagctaaaagacctgttggatatgggtgttgattgcttcaagaccgactttggtgaacgaatcccagttgaagatgctgtcttcttcgatggttcagatcctaagcgcgaacataactactacacttatcagtataaccaaactgtttacaacatcgttgcacaagaaaagggtaaagacgaagccgttgtctttgcacgttcagcaacagttggttctcaaaagtacccagttcactggggcggcgattgcttgagccgttacaagtcaatgtctgactctctgcgtggcggactttccttcttactttcaggatttggcttctgggctcatgatattagtggatttgaagaacaagctactccagacctttacaagcgctggacacaatttggcctcttgagttctcattcacgttatcatggttcaggtcagtacaaggttccgtggatcttcgatgacgaagctgtggaaaacactcgtaaattcgttaacttgaagctttcactcatgccttacatttacgacgaatccgttaacactcatgaaactggtacaccattgatgcgaccactcttcctcgaatacacaaacgatcgcaacacctaccatcttgaacaacaatacatgttaggtagcaaattaatcgttgcacctatcttcaacgctgaaggcgatgttaagtactacttgccagctggtaactggactaacatcttgaccgaaaagagctatcacgttgaaagtggtaagtggttctcagaaaactacgatatgctcaatctcccattattagctagagataacagcattatccttcgtcaccctggtgcaaagcatgcgcaatacgactacacagatgctcctgacatcaacatctacgaattagctgacggtaagaccgctactactcgcgttgttgatcaaaagggtaaggctgtcggtagtgttaaggcacagcgccaaggcaacaccttaacagtcacctcagatggtttgaagggtacctcaacggtaaacttccatgctgatggtgaagttaagagcttcaagttaaacggtggttcaggtaacttcaccctttaatttgaaaccatagcaattcaactcacacaaaatcaagctgaggcaaaactcggtagattccagaatttaacgtgaataaagcctattccgatgcacttttcggaataggctttattttgcgttaaatggccggaatctgagtttggacgcgcgattcggctatattaacatattcactatgcctaatcatagcaaaaaaatggattgaaatacttaccaatatagactttatagtacaacatcgccttttgtggaccatatatctgttttagaactgatttttaatctgtatctgagcctgctgatgccactctgataaagaataacctccaaccccccattaaccgtaaacaacaaagcaccagcacagtcgctcacagacgactatgctggtgccattagttttgaattaaatggatcctttagttattctcgcgccggtatgcaagcaactgttggctaatgcctttagtctgctcataaacctgtgcgtaaatcttgtgcagctgatcatacttcttggcattatcagggtttggcaggtaagtcttaccaaagtgaacgaacttctcagcacattcgtggaagtccttgaaccaaccaagaccaacagcggcaatcattgcggcacccataccaggtccctgctcgttggttaagctgacaactttcttgttgaagatatcagcttgaatttgcagccatagtggactcttagcaccaccgccgatagcaacaaccgtatcaaattgcttatcgttctcatcgtaaatatccatgatgtccttgaacgagaagatgatgccttccagaacggcccgaacgaagtcattcttcttgtgggtaccatcaacaccggtaaagctaccacgaatgtcagcatccgcgtgtggtgcccgttcaccgacaatgtaaggtgtatacaggagtccgttggccccaacagttgaatcagcagcactagccaccatgtcgtcgaaggattcatcactagcaaaggtccgcttgaaccagttcaatgaatagccggcagccaaggtaacacccattgagtaataagaatcaggaatggcatgatcttcaaattgaagcacaccgtgataatcaacagttgggtcttcctcatacttcagcacaacgccagaagtcccaatgcttgaaagtaccatgttaggtgacaggataccggcaccaacagcgccagcagcgttgtcagcagcaccgccgaagacttgcgtgtgggtatctagtccagagaagatggcataactgcttgaaatcgtacctgctgaatcaatcgacttcatcaaaggtgggcacatagacattggaatatcgaaggcgtcacagattgtttggctccacttgccgtccttaacgtctaagagaacagtccctgtagcgtctgagtagtccataccaagcttaccggtcatccgataccgaacgtaatcctttggcagtaagaaggtcttagcttgtgaccagatatctggttcattttccttaacccacaacatcttaggtaaagtaaagccttcaagtggtttattcttagtaatatcggtaaattctgagcccagtttggcctcaatttcgcgacactgtttagttgtccgggtatcgttccagagaatagcaggccgcaaaacttggttatttgcatccagtaaaactaagccgtgcatttgaccagaaaaactgattcctgaaatttcctcaggcttaatgtgatcatctaaaatcaaccgtacaatggctaccgtagtccctgatacccagtcttctgggttttgttcactgtagcctgggcgtgattgaatcaaaggatagtcgaaactttgctgggcaacaatttcgccgtcacggttcattgctgaaaccttaacagcactagtgcccaagtcgacccctaatacgtattcgttcataattttctcctttataactgttataccaacaaaaaagcagtcagcagacaatcggtccactggctgcttcttttaaatcacattatttgcctaaaacgttaacaatgtaatggttgatggtatctttgatttgttccaagtgatctgaagaagttgcggcacgtaattcagcttgggtcttgtcaagtgagtaatcttcaagggtcttgaaggttgccttgccactttcgatgtcggcaccaatacctgaatcgtatgagctgtaacgttccttaacgatgttgtcaagaacgccgtcttccttcatcttcatagcaacacgtaagccggcagcaaagctatccatacctacaatgtgaccatagaataagtcatttgcttcgaatgatgaacgacgaggcttagcatcgaagttcaaaccaccgcgagggccgataccgccgttttcaacgacttcgtacattgcagcagtagtctcgtaaaggtttgaaggatattcatcaatatcccagccaatcaacttgtcaccttggttggcatccaatgaaccaagtaagccagcttcacgggcaacacgaatttcgtgttggtaagtatggccagctaagttagcatggttaccttccaagttcagcttgaagtctttatccaagtcgtattccttcatgaatgcgatagtggttgcggcatcaaagtcatattggtgagtcgttggttcctttggctttggttcgagcaacatttgtgcatcgaagccaatttcgttagcgtaatccttagccatgtggaacatcttagcagcatgttcttgttcaagcttcatgttagtgttccagagtgattcgtaaccttcacggccgccccagaagacatagttttcagaaccgacacgcttaccaatttccaaactgtgcttcaattgagcagcagagtaagcaaagatgtcagcgtatggtgaagtaccagcaccagcaacgaagcgagggttagtgaacaggtttgaagtgttccataataccttcataccagtggtcttttggtattcaacgatacggtcaacaactttgtccaagttcttgttggtttcacgtaaagtgtcgccttcaggagctaagtcacgatcatggaagcaaaggaagtcgttacctaatttgtcgtaaaattcaaatgcgtaatcaacttttgctaatgcgttgtccattggatcagtgtacttgtcgtatggacgcattgcagttccatcaccgaatggatctaccaaacgttgatcaaatgtgtgccagtatgcaacggcgaaccgtaaccagtcacgcattttcttaccgccgataacttcgtctgggttgtaatagtgaaattcagcaccagaacttaaatttgagttaccaacatacttaatcttatccatgtcccatagttgttcagccatgaagaagcctcctaaattttttaaaatcaaatcatcaattaattagtttgttcaaacaaccaactcacaagatatagtatagcgcttacatacaaaaatacaagccctttcattttttaaatgtgcttaaattcatcaaaaagcgatagtgtcgggcttaaaacaataaaaaaaattcaggtctctcttcaagagagcctgaatttcaaattacaatacggttgtttgtgcttcaaagttcaaattagcatcttccattcccaacgcttcacgtgtgactaaggcacagccacctagtaatgtagcgtaatgagaattatgggttaatttgacgggtatcaatatagttggcgccattttagcataaacggactcaattcgcggttccagttccggcaatgcttctaatagtggtgagttcaagaaaaccacgtctggatcgaaattgttggcagcgttgtaaataatttgagcaacgcttgtaacgaagccctttaaagctgcctcggctgcttcatcaccctgcttaaataactgtaccacgtcttcacgggacatgttctcagcgtgcttggcatcctgaatttgattaataatggcgtcttctgaacagaaatcttctacttttctaggttcactcgaccagttaccatcaattaagactgaccgaccaatttcacctgcttcaccgtgcgtaccacgatgcagtttttgattgatgatcaatcccgcaccaatcccacggtgaatactgatggttaccatgttttgcaactgttcattagccttattaaaatcacgttcatacaccgctgatacgttcgcttcgttttccagtaaaactggcacctgaaactttttcgtataataatcagctaaatcaatgtgttccatatccaagaatggcgagtaagtcaccgcattttgatcaacggttccgtgaatcgcgaaactgattcccagcaagccgtgactagtgttatcctgacttgccacactttctaattcatggttaatcaacggtaaaatttgttttaatgtcagtcctttaacattaacttgcttatatgacagaacatccccagataaattgttctgcatcacatgtaagtgacggtaaccaaaatcaaagttcatggtatacccataccgcctgttaattgcaagtaaaacgggtttacggccaccaacgtttgacgcgtcaccttcaccaagttcttcaacgtaaccctgctcttttaaatccctgtaaagagaggacactgtggacttgttgagtgctaaattccgggaaatttcaattctcgagattggctgatggttaaaaacttcggcaagaaccgactgaatattttgttgatgtaactgcattctgttacggattgcacccgacaatgtgttcccctcctttggctataagtccattctattgtacactattgttaaataggtcaacaacattcgttattacatttttccaaaatacctgaaaacgagtacttcaacaatcaaaataattttaatacaggaaaaggaagttcaccatgaaaattgcagaattcggcgttgaaaactggcttaaccagtgggaaaaaagcgccaagtacgatatctctcaaagcaccatcgattcaatgactatcgcagaactacttaaaatgaccggtgatgatgaaagtgttctttacgaccaattatcgcataccaaaatgaactatggttggattgaaggctcaccagagtttaaaaccttaattagcaatctttacgatcacgtccagccaagtcaggtgctccaaactaacggtgcaaccggtgcgaactacttagcgctctattccctgattgaaccaggtgatcacgttatcagtgaatactcttcctatcaacagctatacgatattccccgctcgttgggagctgaggtggacttttggcatattcatgaagccgataactggtatccagatatcaatgaactaaaaaagctcattcgacccaacactaaaatgatttgtttgaacaacgctaataatccaacgggtaccttactgaataaggccttcttacagcaagttgtcgaattagccaaaacagttggcgcgtatattctaattgatgaagtttatcagccattgaacgatctcgaaaactttacttctatcgtagacctttacgatcgcggtatcgccactaactccctatcaaaaacttactcatttcccggcgtccgcattggctggactgtcgctagcgatgaagtcactgatttatttagaaaataccgtgactacaccatgatctgtggtggggtctggaacgatattttagccgtttatattttgcagcatcgagaccagatactggcacgtaaccgcaagttggttctacacaacttggagattttaaaaaactgggtggcgtctgagccccatgtcagcgctgtgttgcctcaagccgtttctacttcctgcatcaaaattgacattccggaatctaccgagagcttctgtttacgattattgaaagaaaccggtgttttattagtgccaggagagcgttttgacttgccagggcacgtccgattagggtattgtactgatgaagctactttgaaaaaagggcttagcaagttatcagaatttctgcgtcaatttgactaaacattcggaggcgtaatatggcagcaaacgaagcgttactcattattgattatacgaacgattttgtacatgacgatggcgccctgacctgtggtaaaccaggacaggtcttggaaccagcaattatcaaattagccgatcagtttgaagcggacggcagctgggtgatcctacctacggacgttcataaacccaacgacccatatcatcctgaaaccaagttatttccaccacacaatgttcgtggcacttggggccgtgaattttatggtcaactcaagccgtggtttgaagaacatcaaaacgatgaaaaagtctatatgtatgacaagacccgttatagtgcctttgcgggaactgacttagatatccgtttgcgtgagcgccacgttgatacggttcatctagtgggtgtctgcaccgatatctgcgtgcttcacactgcagtagacgcctataatctaggctataacatcattattcataaggacggcgtagcagccttaacaccagccggtcaagactgggcattaggccatttcgaacacgtccttggcgcaaaaattgagtagaaaagagtttgggtatgcaaccgtactttaacaaagtcactcaagctgggtatgacaagattgccgctgaaatcgaggcggtaaagaaagagcgccctggccgaatcaaggcactttcggctgcccgtgcgttgggcgatttatctgaaaacgctgaatacagcgcggctaaacgtgatttacgacacttggaaagccggctacgttatttggagaaacaactccgctatgcgcaggtatatgaacctgctgataacgccgtgattgaaattggcaaaagcgtcacgctgcagttcgaagatgaccaatcagaggaaacctttgaattagtgggcaatcctgaagccgacattgagcacaacaaaatctcactatcatcaccgattgggcaggctttgctgaatcatactgttaatgatgttgtgacgattagctcgcctaatggaagttatcaggtgaagattttgaatgttgagaagggttaatggttataaaaataaggtatttgagcgatttgtttcatcgttcaaataccttatttattttcttcttaatcgggcttctccgagcagagagctgcatgtaagtcagttccggcataaatccagacccgggatttttaccggaactgacttacactccgctctcttaacgctcggctccacaccttgctttaatcgggctccagcgggcagagagctgcatgtaagggacttcagccataaatccaagttcgggatttttggctgaagtcccttacactccgctctcttaacgcccgcttccgcaccttgcttttatgccgttggatccactttcttctccacccagcccaaaactaggtcaagaataatcgccattaaggccgttggtagtgcacccgctaggataatggccgtcccattcgtggcatttgttccccgaatgatgatgtcccctaaaccaccggcacccacgaaggtcccgatagcggtaatcccaatggccagcactaacgcatttctcaaaccagccatgatcaccgacatggacagtggaatttccaccaaccgcagcaactgcatccgggtcatccccataccagtccctgcgtctagtagcgccggatcaacatttcgcataccagcatccgtattcttgatgattggcagcagtgaatacaggaacaccgtcacaataacggtgttaacccctaagcctaaaccaatcatgatgattgacagcatcgccagtgatggaatcgtttgaatcacgttagcaatcccaatcacaatcccattcagttttgtatggtgagcgatgaaaatcccaatgggtatgccaacgatggccgccagcagtacaccataaatcgaaatcaagaagtgacggctaaactgggaaagtacgtaagcgccattatgactgtaatagtagactagctgttcccacaaattcatcttcgccattagttgccactcccttcaaagtaatgatgttgttcaagatattgcttagcaaccacttcaggctccatcaagtcattatcaactttatagttgagctgttgcatggtcttcaaatcaattttaccgctaagtttattaatgactggcttcagttctgggtgttctttcaggactttgttggttgccacggcactagccgtatacggcgggaagaagtgcttatcatctttgagcatcttcaagttatagctaccaacacgaccatcagttgaatatcctaaaatcgcatccattttatcgttggcaaccgcatcataaaccagcccaatttgcatcgggtgaactgcaccaaacttatagccgtacgtcttctggaaaccatcatagccatcgccttttcggttaagccagatttggtcaataccaacgttcatcttaccggcaactggtttaaggtcgctaacgttatttaagtgataacgcttggcggtcttttgggtcaccatccaaacgtaggtatccgcaaagccgtatgatttgaagtaagtcatatggtacttattgttaaagtaggtttcaaccgttttcgtagcccgttctgggttacgatcaacttttcttttcataatggtggttaaatcagtaccgacatatcgaatggccgaaatatcagcctgattattttttaaagcattaaaggaaacacttcctgaaccaagattattaataattgtcgtgtgtaatttggtatcatgctgaatcatgtcttgtaacatataggacatgatttgctgttcagttgtattttgcgaagcaatccgaaccgtgtcgttaccgctcccagctaatccaggaaacccgcagccggctaatccaatagcgcaaagtaaggagaagcccaacatgatcagccatcttttgatgtttttcacgttttcccctcctatccttctgatgttcttggtgttaacgctgtttcgactttgcctaacagccagtcaaccaccagcgccaaaataatcaccggaattgaaccgccaagaatcaagtcactacggtacaggttcaagccgttaaagataaaatcaccaagtccgccagcaccaatataggaagctagcgctgcccaggcaatgacgtaagtggctgataatctaatacccgacataatcaccggcgcggctaatggcacttccaccttgatgatggattgccaactggtcattcccatacccttcgcggcatccttcaaagttggatccacatcattcataccaatataggtgttccgtaagattggtagtaacgagtaaatgaacagcgcaacgatagccggtttagccccaatcccaaaaatgggaatcataaaggctaatagtgctagtgcaggtatggtttgaagcatactagcaatggaaaccacgatgtttgccgtacgtttggttcgagtcaaagcaatccccactggtaccgctacaatgatacctaagcctaacgaaatacccgaaatgtaaatatgctgccaggttttacccagcaaagacaagccatagacggctaaaaaatgcatcatttggcgtcaccaccttgatctgcaactgctgcatcagtcttggcgtcctcgctatcgtcctttttatcttcatcaccccaaagcgcgtcgtaaacaatatcaaccaacgccgcacgggtaacgatgccgactaaatgattatgattatcaacgacgggcacgttcttaaaaccacgtttcaaaatccgctcaaccgtatctcgaactagggaatctgatttaacgtagaacacatcgctgtgcataacgtcaccaacgctagtggccgttttaaagttatagtcaatatcttcaatatcgagataaccttttagggtaccaccatcgtccgtcaccagcagcgaatcaactcgccggtcatgcattaactttaaagcttcctttagcaggcgatcgggtgtgatcgatgccacgttagtcagcatgacttgaccaacagtggtaatgcttggacgtgcctgaatcagacggtccttcccaatcaggttttcaacaaattcgtttgcagggtggcgtaaaatctcgtctggcgaggccacctgcataattttaccgctatccatcaccacaatcttggtggctaacgttaaggcttcatccatatcatgggtcacaaaaataaccgtcttgcccagccgagtctgcaggtctttaatcaagtcttgtagtgattcacgggtaatcggatccaaagccccgtaaggttcatccattaaaataatatcttgatcagccgctaacgcccggacaacgccgatccgttgctgctgaccaccagaaagttcagagggataacgatccaaaaactcctctggcaaatcaaccagcttaatcatttccttagcgcgttcatccatcttagcttgtggccacttcaataaacgtggtactaaggtaatattttgacgaatggtcatgtgcggcattaagccaatattttgaatcacgtagccaatctttcggcgtaatttcaccggatccatttgactaatatcttgaccatcgattttgatcgtaccagatgtctgctgcaacatccggttgatcatccgcatcgttgtcgttttaccagatcctgacgtcccaatgaagcatacgaattcgcccttttcaacttctaagttaaaatcctccacggcaactttaccgccactgtatgtcttgttgagatgttccattgataaatacatcggttttatcccatcctctctgtcgcaattttgaacaactgtcttaaaacatctaggtcaattgtaacacttacgtattatgacatacattttccagtaccccctctacttaatcattatcgcggtaaatagccgatttgggcccaattgttaaattaaagtaagcgcttttattgtctttttgaatgaatcagttataattagattgtacacaactcaattccccgaaatgaggtaattttaatgacaaaaaaactctataccacaacgatgacgaacaaaggcggccgttccggtgaagtatggtcaaacgatcgtaaatgggattttaaaattggcactcctggcgtagataaggacacgaccaatcctgaacagctttttgcggcggggtttgcctcctgttttaacggtgccttagacatcgccttacagcaggctggtgttaccggtgaatccaccgttcgcgcaaaagtctccctatatcaagaaggcgatgaacccgacttccatattggtgtcgaattattcggtcacatcgaaggcttagatgaagctgacactaagaagtatatggaaattgcagaaaccatctgcccgtacgcaaaagcaactcgcggcaacattgaagtgacggttaacgctgaatagttttgaaatttaccgaagagccacctggtagtcgttatttgactgctggttggctttttttactgcatcaaaattttttagattgtgcaaaattacattgataaaattaattaagttatttaatacttgaaagtatcacgtttttagctacttaacaaagataactggttttcacatgacgagtaagtatgactatcacataatgaaagggcttgcattttatagttaaggtagttatactatcttttggttagttgcttctgtaaaccaacttatcaaataccaactcacattggttctatattattttttatcattgtcgttttgtaagcggttactgcaattattagttacacaacgtaaccatcattgatttgataggaggatctgtctatgtcaaatggaggtactaaaacccttcaccacatgcctgtctgggtcatttatttctttggtgccctaggtggcttgctgttcgggtatgataccggtgttatttccggtgccatgttatttattggtcacgagttaaacattgctaatggttcattccaatacggtttcttaaccgcatctacttcaatcggtgccgtgtttggtgccgcctttatcgggccgttgtccgataggtttggtcgtcgtcacttgctgatcaccgccgcaatcatcttcttctttgcagccttaggttcagccttttcaccagaatacatcgctttggtttccttccgattctgtttaggtatcgctgttggtgccgcatcatcattgattccaacgtacttagctgaactggctcccgcagaacaacgtgggactgtcgggtcgctgttccaattaatggttatgaccggtatcttctttgcctacgtctttaacgaatggttctcaccacagggtggtttaaacctttctgaaagtatcagttggcgttggatgttggggttggccgcagtacctgctgccattctctggattggtgccatcttcttaccagaatcaccacggttccttgttcggaagaatgatgaaacacaagccctttcagttctccgtcaatttaacccagacgaaaaagtggctcaaaaagaacttagcgctattaaagtgcaagctgctattccttctggtggttggaaggaactcttcggaccagttgctcgtccagttctagttatggccgttgggttagctattttacaacaagtcatgggttgtaacactgttctctactatgcaccaaccatcttcatttcagccgggttcagtacccactttgcccttcaatcacatatcgttatcggtatctttaacgtgattgtgactgccgttgccgtaagtatcatggataagattgaccgtaaaaagatgctgaccggtggggctattggtatggcagcttcactgttcgcaatgtcaatcgctatgttagccttacatgccggcgatggtaacttaggttcatggatctgtgttattgccttaaccctttacatcgccttcttctctgcaacttggggccctgtaatgtggttaatgattggtgaagccttcccattgaacatccgtgggttaggtaactcattcggtgccgcggtaaactggttcgctaacttctgtgtttccgaaacctttactgttttgctggttgccttcgaacccaagggtgttgcaaacccagaaggtcaaggtatcgcccgtctgttcctgatttacgccctcttctgtgtattcgccatctggttcgtacacaagaaggccattgaaactcgtaaccgttcacttgaagatattgaaacaagtcttcgtgaacgtgctgcagaaaagggttttgatccagaaactggccagcccaaataatcaattttaaattctaatataagaggttccagactgttatcattgatcagtctggaaccttttttgcgacaaataagtggtaaacgctggtttcaaaagcagccaatggccaaattttgtcatataacttaatctactggtaattgttagttaacataaatgaaacattccccgtgtatgctgttcattagtaatcaacaaataaggggatttttaaatatatgtcaaaagcgaatataaaaataaaattagcagcattcttcttgattttcggattcgcctttggaatgggcaccgacgttacatcaagtatcactgcacaaccacaaaccacgacagcacaagcctcaactaaggttactgctagccaagcaaagcaaattgctaaaatcaacgctaacttatctaaaactcaaaaaaaggccaagaactggattgcctatcgcgaatctcgttacaactactctgctcgcaacggaaactgttatggtcgttatcaattactgaagtcttaccttcatggtaactatagcccagtcaaccaagaaaaagttgctaaccagtatgctagcagccgttacggttcatggacaaaagccaagaaattctggcaagcgcatcactggtactaattcactaccagattacatataaaagactcaggcacttcaaggtgctctgagtctttttttacgcaaacttatttttttaactgatcaactttcttagacaaccgtgatacttctcgagtcagctgctggatttgtttcgtcaattcttcgttttgctgctgttgcgcatcagcctgccccgttcgatccgtgaagaaatcggtaatcgtactggtcagcaaaccaataaacccaaccccgccaagcattaagacggtggcaattaatttcccccaagccgtatgcggcgaatcgtctccatagccaacagtcgtcgctgtggtaatcgcccaccatagtgactccgaaagcgtctggtgttccacgatggaaaaaagcagcgcactcaggcaaataattaccacactaatcgtaaagaggtaaataaacccggtatcatacgtaaacctatgaaactcgcgagtccatttaccggaaatacctaaccgccaaaagacgtggtgggtgcgaatcatccgaaagattcttgctagccgaaaaagtgaaaacgcaggatgcatgggcagaatacctaacaaatcaaaagcgttattgatcaagaaccacttgcggtttttggtaaaaattaatctgaccacgtaatcaacaacgaagaaggccaacaatccttgatatacgacacgcccagccaagccgactttaacgttcaacatcatcgaaacggctaagatactagatataaccgccaaaatagcaacaaaaatatgataaatgacaagccatcttgcttgctgttgctttgttgtgtaacgcatgactaattaccctccgtaccgtaaatcgtctttagcgcactaatatcaccggttgaaagactagtattgccttgatccactggatacatcactgaattacgataacgactatgatctagccctaacgcgtgtcctagttcgtgaattgccaccgattttctcaacgaagccgctggataataagcgttcagaccagcacgggcgtggttggcggtataggcattccaaccggtctgctgaataatctgcggaccaccatgacccgattcaatcatagtcgtgttgccactatctggcatttgcttagagtactcgaaaaaagtcactgagttttgccgatcggtaccgtcacctggtacgagtttcacgatacccgtttgattataaacggcaactgcattctcaaaaaccgttttcgcactggcagaaacgttagcgtcaaaatgatagtagtaagtccgggataacttacggttctgaacaatcgattcaattggcgtatttcccgccgacacttcctgcttttgtgtctgctgagtcgttgttttaaaattggggtcaacccgttcaatcagtcttgtcatctgactgccaaaattaatgggtgccggtttggaatccactgccattggcacgaacgccacggcaagtcccagtgtgacccatgttaaccaaccttgatagcgcacagcagccactccttactttattagttaaacatagattactgattctggatgaaaaggtcaattaatctcactgaatgacactaaattttaaacgtttcgtacgaaatccccttttcagcctgtatttaacgtggcaacgagatgcctttctcacaatatcattacaatttagccaaaacgattgacctagtccctttagaatacatagtatgaactattatagtttaagcggacagggagggtcactatgactaaaagtttgaaaatcttaatcgttgaagacgatgacgcattagccaaaaatttagaacgttttttatcagatatcgctgaaattacggtgagcaatgatggccttgagggacaaatgctgggacaagatggtatctacgaccttgctgtattggatctcatgctgccccaagtcagtggttacgacatcttgaagtattggcgccatgaatgccagttagaaatgccagtcctcatcttaagcgcaaaggataccctggatgacaaagttcgtggtttccaactaggcgccgacgactatctcacaaagcctttccaccgtgaggaactcatcatgcgagtgagagccctgttacgacgaaccggtagtatgggtactgataaccagctcaccgtggcggacttcaacgctaatctaaatagtcgcacagtttctctaaagggggaaaacctgtcactgaatggtaaagaatatgatttactaatctactttctgcagaatcccgataccattattacgaaggagcaaatcttcgaccggctttggggctttgactcagaaaccgcgctgtcagtcgtggaagtctacatgagtaacctgcgtaaaaaaattaaaaatgtgactaatagtcaaccgatccggacactgaggaacgtaggttacatgctggaaacggaggcttaaaatgaaaggtaaaactgccgagaagcaccagcaatggcagctcttcattaaagaactggtcaccttcgccctcctttttgctgctttaggcctagtcgtttattttctcttctatcaatcaatttatcacgaaatgaaccatggcctgcaatggcaaaaaaatcaaatcatgcaaaattcccctgtccctagagtcaaccatctaatgggtagcgaagcgcaaaaagctcagaaagccaagaatcaggtgccacctaaagatggctcttttcgggctaacctagtggtcttcaataagaacggcagggttatcaatgatcctatgctgggtgaacgtgactatgatctgctgaaaaatacgcagttaattaaacggcatttaaatcgcattagtaacttgacgctaacggccgatggcatcaccggccactttaaaacgttattgatcaaggtgcctaagtcaaatcctaatcccgtttacgcagggcgctacgtgttaatcatgaaaaacattgacgctgatctgcaagcattaaccaacttcagaactgccttagcgacaaccctgattattttctggatattagcaatcgcaattgcctacttcctatctcgttcaagtatgaagcccatcattctcgcctggcgcaaacagcgtgacttctctggtaacgctgctcacgaactgcggacaccactaacagtgattcaaaatcagttggaatatttactgactaagcctaaatcacgaatcatggacgaggctgaggaagtttccaccgctctggatgaagtgcgacacatgcagacattaaccaaccagctactaatgctggcaagatcagattctaacgtgattcaacttaaccaaaccgatgtcgatctccagccatggctggaaaaatccgtcaagctatacagtgacattgccaccagtcagcaaaaagagcttaaagccaatattaaagtctctggtcacggttcgtttgatcctgatctcatccgtcaggtactcaccatcctgctagacaacgctattaaatacaccccaatcaatggcaccgtcaccgtgaacgccaaacggattcacgacccgcttcagcatgaagccctgcacctacaagttgcagatacaggccccggtatcgcggattcggagaaaacgaagatttttgaacggttttaccgcactgataaatcgcgtaattctaaaaccggtggtaacggtcttggcttagcaatcgctaagtggattgtcacccggcatcacggtaagattaacgttaaggataatgaaccttgtggatcggttttcaatgtaacgattccactgaagagtgcgaaaacaagcgtttaaaaagtggagaataagggctcaaaacggaaatcctctgaactttggggatttccgttttgagtccttatttgcaactctttgcttgtttgagccattttaggctacattgaagtattgaataaaagtaaactcttaaacatatttcagttaagaaatcagatgaaataccgcccaatgtagccctaatgccacttcccgctattcacctaaatgattcgccgtacacttagccaaatgatcatctaaaatgcccagcgcctccagccacgattgaacaatcgttggccccacaaacttgaacccagcttgtttcagcgctttactgacttgctgcgacaatggcgtttgtgctggcacatccgccattgttggataccggtttacaactggctgattaccaacaaacgaccataaataagcgttcatggtcttacctgcgtgatgccattcaactaactgtcttgcgttatgaatagtatccttgatcttcaacttattacggataattccagcatcgttgataagtctagccacatcatcatcgtcaaattgggcaaccctgtccacgtcaaaattagcgaatgctgcccgaaagttctcccgcttgtttaaaacggtttgccagctcaaccctgcctgcatcatttccaacgtcatcagctcaaaggtttcgcgctcatctttagtgggtacgccccattcgtagtcgtggtaatgcgtcatgaggtcatcggcattctctgcccaatcgcatcgtgtcatagtttcctcctagtgaatctgctgagttgacagcaggttagtcaagtactcatggctagcgcgcatctctcgactatcgttttgatcagctaagtcaatttcgtaaatactggtggctttaggattaaccactttcatgacccgctgccagtcaatcttacctttgcctaattgtagactgtcgtgatgttgtcccatagagtccaccagatgatagtgaaccgtttgcggcgccaaccgagcaatactgttaactaatttatcgttatcgccgtgcagcacaataaagccgtggctaatatcgtagcacaaccggtaatggtgcgccatgacagtttcttcaatctcctcatcaccataatcaaaggctggcgaaattgaattttcaaacatcacgtggtcgccacccatcttctggaaataatccaatcgggcaaaaatcacttttcgtgcggttttaaaatcaccgaaggaattaaccactgcttctttgtctgagtaaccgccgtgaataagcacctgaacgtttaatttaatagccaattcaatcaaggcatccgcgctactcatcataaactgatagccagccggatctttaagtgccgaaacagcaacttcattatgatggtgatcataagccatcgggtgatgaatcacaatctggcgcacacctgccgactgaacgtacttaaccatttcttccaaatgcgtcagtccgttcttagtcatgtcgtgagcatccgtgtaaaattcaaacactgacggttgatattgtaaccgctcatcgatttgttccagcgatgtacttgcttttaagcctaaacttggcatcatttaatcaccccatctcgttcttatttatagcaccattaactgaagataacgactatttcgcacttcacttcgctaatcgtaaacaaatgttaaccgttaaaataattggtcaattcaaaaagcacatttgccagaaaaatcggcaaacgtgctttttaattttacagtcttctcaatgaattatcgatctgatctgcgtttcttaaagcctaataatcccaataagctcatcaacatcgcacccaatatagcaaaccatgatgactgtgtttcattagtttgcggtaattggctcgccacagccgccttgtccgtaccagtcttcggcgattggctagacgacagttgtgtcaaggactgagcactctgtttaccagcagtaatcgccgacgttctgtaaggcgaattacctgcgtgattgacttgctgcgtgccgttctgcgtagtctgttcggatgccggactaacggtgcgcttattgtgtttattggtacgtcggttagaattcgaaccattctggtttgatacaactaactctccgtgttcaggagcagattcaacaatgtgctttgcctcatcaagttcgtgagcaggtggaacaattgcaaccgtctgatgcgtacttgggtcagttttatcaactaaatagttgacgattaactgcttcactggcaatgttgatttctcaatcacagtttgtggttgcctcatcttagctggtacaaacggtgtcactacaactgattgtggctgtttcgtctcaactggaacaggtagcgtcacaacgaccggttgcggcaaaatctgatagctgttcgaaacagttgtgatgtcataatttggattcagctttgggttcgcgataacgttgatcaaatgagtaccaacgctgccgttattgccataatccaactgataaacaaccgacgtgccatttgctggctgaccggtcactttaccagtagctgagcctgaatatggctgaccatcgtcagtcttcgaaataccactaggtgcagtaatcgtgaccggggccttagtaatcattaattgaccaggagtaatatcttccgcgctaatgacatagtttggattagcagcttgaagcgccgtcaagccagaatcactcaacgttacagcgtagttaccggtagtttcactggcatcttgacgttcaaaatcaccggctgtccaaactggcgctatcagcttatctggtaacgtcaccacatagttagttggatcatcagtttcaccgtcataaaccttcgtctggctgccaatttgaatttgacctaaatcagctttttccacatcgattggctcaatgactagctcacctggtattacccttgctggatctacattgatgacatcattcggattagcctgctgtaatttcttccagccggtactgctcaatgttactggataggatccaaccgcatcgggagtgcctgaaaccacaaagtcctctggtgtccactgtggttgaaccaaatcagcgcccgttattgtaactttataaacgtgctgatcatccgctgacgtgccagtatacagttgatatgttgcgtcaatcatgaagcggaattgtggcgtcatcgggttgatggttaattgtcctggagtcgttgaaatcgtgtaatttggattatcattagccgaaatatcaaccaaaattggataatctcctgcatcaacatcattcaatgatggcagcgtataaaccggagcaacaccctgtgcaggtacaccggtgatcactggcgtcaatgcccccgcataaggataaccatcatattgtttagtcaggttgggtgtagtaatcgaaattggtgctggtgtgatcactaataacccattttgaatcgactgcgcgttaaaggtgtagttcttgtttgctgtctgcaattttgcaagaccagcagcattcaaggaaattgcgtgattaccggcattttggccgtcattgaccgttgtaaagtcatcagcagtgaacgtcggcacattaaagtcggcataatcacttggtgcaaacacctggtacgtgatgggatccgtgctgacatcgccatcatagaccttggtagcacccttaacgactacaaacttgtcactctgggagttatcagccggagcgttggtgttggctggtgaatcgactgaattaccagttgcctgacccaatgcttgcggtgtaatcgtcaatgtgccaccaatataggtaatggcgtaattggcagtatcatccttagcgattgcttggataccgtacgtaccagcattgatatcttggctaatatcagtcaagacaaaacttggcgcagttgcttttactggtgtaccagccactgcagcttgatactcacctgcataagctgaaccatcataggtcttactcatggtaggtgctgtcacggtgattggtgccgatgtaatcgtcaaccgtccagccttcacgttgtcagtcgtaaagctgtagttagtgttagcagcatttaatttttgaatcccactatcacttaatgtaacagcatacgaaccaacgttttgactgttaccagaaacttcaaaatcatcagccgaccagtttgaaggcgcgttaacaccagctggtaacgtcactacatattgtttaggattcgtattctcatcgttatcgtaagtcttgcttgccgatccgatttgaacaggcgcctcagtattcttagttacgctaaacgtacttggaaccactgtaatgtcgtagtttggattgtcagttgtatcagtaacattcactgagtacgtacctgcattaatagctgtctcaagtgatgacaaatgatagttaacagtcgcaccgttatcaggcttgcctgtcactgtagcactgtcgtcattcaaaacataaccactaccgtcatagactttggttaaaccttgtggcgctgtaatggtaacgggagccttattgatagttaatttacccgtagcagtttgaatgtcatagttttgatttactgcagcagtaggatcaacgatgacatcaatctcgtaaccatcagcattcacatcttgacttaagtcagtcagacgataaacgggttgttgattgccaatctgatcagtcactgttcccgacaaatcattaccagaataagcatgaccatcgtagatctttgatagtgttggtgcgctgattgaaatggtctttcgtgtaatgttcaacgaaccattgccaatactcttcgtggaaatgacgtagttcggattagcgtccttgagcttctggataccactatctgtcaagttgacatcatagtcgccaacgttctgactagccgctgaagtcgtattaaaatcagcggtagtaagattcgttggcatcacgaagtttggatcgtccgttgcatctggtgcacttaaagtaaatgttggaacgttattggcatcatcatcataagtcttagtagcatgactgatggtgattgcgttatctgctaataccttaggtgaaatagttaatttcccatcaactgttgtcagcgcgtagttcgagttaacagctgcatcagctgttatcgtgattggtgcatcagtaatgacattaatattctttggtacgttcactgtataaattattggtgtaccagaaatgtcattggcaactttagctgtacctggttcatcataagaactgccatcataaaccttttgcacatcatctgcggtaatggttacaggccgcttggtaatgtgaagttgaccgctgctgatactatcagcattaatcaggtaattggtgttggcttggctaaacttatcaataccagattgagttaattttacgttatagttaccaacattttgactatcaatgccagtagtatcaaagtccgcagctgtcaaattgtcgggaataacgacttctggatattgatttgaaacggtcaatccataggtcttaggatccgtattggcatcgccatcgtaaactttgctggctgagtcaattgaaatggcaccagcagtaacctgttcaggtgtgatgttgaaatgacctgttggtacgtttgaagctgctaacgtgtagtttggcatttgtgcattaactgctgcaatgccatcactgttcaaactaacagtgtaattaccaacgttttgactaaaactaccaccattattagcagcgagattaaagtctgaactaggtaacgttaactggtcgccagttgataattgtaccgtgtaattttctggatcattggcagcattattatcataaacttttgtctgatcgttgattgtggctgttaagtcagccttgttgattattaacgaaccagccttataagtgacggcataatttccaatgtcttcaccagaagcggtcagtgtgtaagtaccagcgttgacgtcaccgctaatatccgttaagtcaaagctaggtttaacgccatttaccggtaaaccatcaactgaaacctgatactgatctgcgtaggctttgccatcataggtcttagttaattgcggaccaataatggtaatcgtctttgttgtgatattgagtaaaccactgctaatactattggctgaaacaacatagttcgggttaacatcttgcagtttctgaacgccatcagcggtcaaagtaaccggataatgaccaacattttgactagcagcctttgaagtatcaaaatcagttgccgtcaaatttgtaggcattacaaagttggtataagttgcagtatctggtgtgcttaacgtaaatgctggcacagtgttggcattattatcgtaaactttagatgcttggctaatcacaattgcgttggcagccaattgcttagagttgatcgttaaatgtccagaaacggttttaacatcatagtttggattctcaccaagctgtatttcgatgccatagccattagcttgcacattcgtatcctgactcagatcagtcagactgtaattcaatttagttgcttgcggattggctggcagaccgacaatttttgcttcattatcgctaccagtataactctggccgtcatagctcttcgtcaaagttggcgcaataatcgttactggtgccgctgtaatgtggaactgaccaccggtcacgttggcactttcaagcgtgtaattcgggttagcttgctgtagcttctgcagcccttgttgacttaaaccgattgaataactgccgacattggcactcgtgatcccactcagatcaaagtcttcagcttgccactttggtgccactaagccagtggaaagcttaacgttgaactgcgtcgtatctgcttgcgtggtcccatcgtagaatttagtactgtcctgaacctgaactgttgcctgcgtattcggtgtaatggttaacttaccggcaaccgtcttcacattatagttgggattgtcacccaactgcactgtgatggcataaccgtcggtttgtacgtttgtatcctgactcagatcagtcagactgtaattcaatttagccgcttgctgaccgacaacttttgcttgattatcgttgccagtataactctgaccgtcataactcttcgtcaaagttggcgcgatgatcgttactggcgctgctgtgatgtggaactgaccatcggtcacgttggcactttcaagcgtgtaattcgggttagcttgcttctgcagcctggttttgacttaaaccgattgataactgccgaacattgcactgtgaatcccactcagataagtcttcagcttcaccttcgtgcactaagacaatggaaagtttaacgtacgaactgcggtcgtatctgcgtgctggtcccatcgtagaatattacatgtcctgaacctgaatgttgcctgcgtatcggtgtaatggttaacttaccgcaaccgtctttcacactatagtgggattgtcaccaactgcactgtggtgcataacgtcggtttgttacgtttgtatactcgactcgatcaaaaaaagtgcagactgtaagttcaatttagccgcttgctgacgacaatttttgctggattatcgtttgcctagtataactctgaccaagtacataaacactcttcgttcaaagttggcgcgatgatcgtactatcctactgggcgctgcctgtgatgtggaaactgaccatcggtcacgttggcactttcaagcgtgtaacttcgggttagcttgctgtagcttcttgcagcccttgttgacttaaaccgatgaataaactgccaacattggcactcgtgatcccactcagttgaagtcttcacttgctcacttcgtgtgccactaagccattggaaagtttaaacgttgaactgcgtcgtatctgcttgcgtggtcccatcgtatgaatttagcactgtccctgaactgaactgttctcgtattcggtgtaactggttaacttaccggcaacctcccttcacatttagttggattgtcaacccactgaactgtgatgcataaccgtcccggtttgtacgttgtatcctgaatcagatcttcagatgtaattcaatttagtccgcttgctggaccgacaatgtgtgcttgattctcg

SEQ ID NO: 709 - DNA, 6103 bp, Unknown
  Metagenome-assembled genome
cacaatctaccataagcactttatatcccatatttgataattcccaactgattaaggctgtagtagatgttttaccagtaccacccttttcattggcgcaactaattatcattttttataaatcctccattcgtacacggtacacggtgtactgtgttatgtgtacagtgtaccgtactcagtacacaatgtacagaaaaaaatccttaacaattgaatgcggaatgacggctttttaatgaaattatttaagtgtacagtacacagtattcaatacacagtgtacagtgtacaagatacagtgtacagtgtacggtgtactgtacacaagaaaagttgaccaaaaatttgataactgatataatgataaccgtagtaaaaatagaacataaaaaaacacccaccgacgggaatcggtgagcgccaaacaatcttctaatttatagattattatatcatggccggtgcgatttttaaagccctaggggacaagctggggtctaaatccaaggggacacgtttgccagtgcgacttcaataagtctggctataccacaacaaggtcatctgtacggctgggtggtgaatggtgagcgcgaccattaacggcgcgggtggtaaaacgaagcttcggcttggtgccattgattagttggtgatcgaacaaatataaatacgcatcatcaacgcctgctagggcgttttttagtaggttaaaccgaaaacgtaggtttataatgagtggtggtagcaataccgcaattgtacagacaagcgacgggcgttaacgaccgacgaactagggggaaaccttagcgtagaattgcactctggttcagttatttcaaatagctgatttcagggaacaattctgcgctcaaaacgtcactccctctaaactgaatggaaaaccgtaacccgtcaagtcaaattccaaagaaaaaaagaaagttggtggaattgttggaatgtaaggattacattgttccattgaatccagatgtgatcattaagaagacaatctatcggagttctggaagaattacaaatcagcagagagatcaagtgaagagagttttgcgtagtcaagggtatcagggaagaattagtagtattcgatacactcgagtaaattacaagtattcatttaaagtatcagtgaagtatcggggaagtgttggcaaatttttggttaatacaaagaatgagacagtttaatttaagggaatggtctaggagtaataccagtaaatttcacaaaatttctttccccaattaaagccaatctgcgacctataccacttcttttttggacaagttcacaatcaaaaaataacggaatgtggaagtaccgcggtgaatgtgggttacttgggataagccgccttatgttaactaaaaagtggtatagttagtttaataagatcacaaggggtgttgtaattgtctaggtggattaagggattaattgtagggttaagtatgtgtgtgggattggtagtatttggattaccttcaacagcacacgcaaattatggttatggcactaatgtaacctatggttataaagtgcctaaacctcttcatggaatatggtattttggaagtcaaaaagctttatttactggtcaatataagaagtataagactggtaaaatggtaattactagacatctagttaagggttactgttatgttaatggtaaacaaaatcgtgtaaagctttactgcgatgaaatgtattataaataccactctttacagcctggttgtcagtatgtacctctaatttttagataccatgggcataactataagggattagatgtgtctggtcatgacgcagatgttatatactctagaaaaaattttcataaaacgttatcgcttaataaatatggaagttatcataaggtaaagttggttcattttggattttagataactaaaaaagccactccaatacctttacgggtacagggtggctttatgttattaagcgtgtgttatagttagtttaatatgataaggggtgttgtacattgttcaagtggattaagggattaattgtagggttaagtgtatgtgtgggcctgttaatattcgggataccttcaacggcacatgcttataaggcagttgcgcctggatattcttcaaatatgaagagtaaaatacccaaggcacttcatggaacatggtacatgggaaaggaaaaggttaaatttactgggcatgataagatgcctaatgaatcatacatcattacacaacacctagtaaacgaatactgttatgttggccataaaaatttaaaggcaaaagcctattttgatggtgtatatatcaaaaaagatggttttgattttggatttcagtatgttccattagtatttagttatcatggtcatcatcataagggactagatgtaactggtcatgattcagatgtgttgtacactaggattaagacacataatctgctttcattgaatggatatatgaatactcataaagttaaactagtgcatcttgggttttagtaactactaaaaaagccgccccgatgtaactttggaaggttacgggacaacaatattgtagttcaattaactatgccaccgcctttaaagcggcttgtaaggactagtgttgatcgtgctattcctttctaattttctcattttagcataattttgtgttgacttaaagctaaagcaagttatgttctgatatgtttttttcgattaatagcgataattagcaacccatggtgaacttttgtcccacttccaaaaaaactttgttttactcaaatgtgatacataagaaatgacatttgttataccagaatgtggttcatcatgcttgagaacataacgatgatgacctaagtacttatagtgaacgtttgtttccggtatcccgaatttaaacccaccttccggtccccacaatgaaaaatctttcttaccaaaattaatttttgttgatccgtggtgccacttagtatattttaagctgtttggcaaacctttatgccaactggacgcattaacagtgctaatgccaaaacttaccactgccattgctactaatattcctagtaaaattctacttttaatctccactaaaattttctcctatcaagtttcaccgtgtagttcttaaatattttataaaacgtgtgcgctgcctagctataacgacaaacgcaagaaaaagagccgccctgcataacttttgtaggttacaggacgacgaaatagtcgtttaactaattatgccatcacctttgaggcgggccatgcggagcagtgctcgaacactgctccattttcatacataaatactaacacaatagattatcaatattgacaatatattaacaactaaatagtaacacgcactgcgtattttgtacattagcattacttgaagttacagcttgggtatcctcagtggtatcagtgggcgtggtacttgtggccggtacattggtctcagtgactggtgtgacatcagtaacaacacccaacatacccagaatggttaacaccgtattaatgactgccacgatacttgcccagttaccagagaaactgtacccgaaaactgtcaacacttgctgtacaagaacgataccaagggagatgatactggcaatgagtttgccattgaaggtaccatcagcgttttttaagttaaatttcattgtacataatctcctttagactataagaacttttctgcaacataaatcaacaaagccattactccaccgctaaataacagggaaattaaccagttttgtactcgattaattcgttggatggcatgctgattttaaatggactttgccagagccctgtcagctttgtcttcaattctttggacttgattcagctgtgacttgatgtcttcaacttgagcttttgtcgatgatacatctttctgaatgtcgatcaacattcgggtaacatcgtcaatctcgttgttatctgccattatttcacccaatttttgttagctgtaaaataagtggtatgaccggcatgtaccgcttcatataccccatgtaccagcttgaaaccactgactagtaacgtggtaccctgtttgtaatggttcacctttttaccattgagatacatgttgttgccagctttgtttgttaccttcagcttcttgatgtaattggcatggtaataagcttgaacatcttgggcacggaaccagacaaccacggtggaaccattggacaaaaggactgcttggcgagactggcctgacttgatagttttaacctgtttgatagtcaggtttgtatccattagtgatggggcaattttgctggtaccaccatagaaagttgtctgagatctaacctgtaccgtttcaccaactgtacggctaccatatgggtactttgaggtactgatggcggtattaccgaaccatgtaccagatacttgcttggaagcatcaactgattgtttcagtgctgtcgaataatacgtatctgaatactgccatagctggtagtttttaggcgtcggtgtaactgaggtataggctgccaaccaaaattcgtgatacccactcaatgattttacatagctcgtgtaaaatctacggtaactatacagataaacgggttgaattgttagtgattgcatttcagtttcccaagctttagtggcagttgaatacgaactactggtaatggtgtttacttcagtatcattgacataaaaatctggcgtatagcctttagcacaggtaagaaaagggacaaatcattaagaacgatttgaggaattttccttggataaatcaaaatattgcttatccggaaaaagtgtaaaagcagttgaaggattttacagatcaaaatccagaagtcagtcctaaaaacgatcgacctagttattaggctgatcgttttttaatttatccggtttatgcgcattaacataatcggcaaatatttttaaaagttcttcggtttgatcgaccgataaattgtcggcatgaaagtatttttctagcaaagcccctttttgaattaaccgccgagaacgggctttacgggattgccgattttcatagtattttgattgtcgtaatttaaaatcttcccgctccattttctcttttaaacgagctttttgtgcaaccagtttttcgtattgattagccatcatcatcaccacttagttacaattggttatttgattcatgatttaaaatcgttgctattttttgcgcgaggtctttaatcttttgattagacaaattagcgtagtctaaatttgataacttaataatttgcttgccgagattttgttcaattttacttttttcagctttgatcttttgattaagttgtttcaatttagcttcttgcttttccaatgttgatagggtcatactaatgcctccttacaagcttatatataattaattaaaataataacattcaaactaataaaagtcaacataagcgttgaaaaagcgaaacgtcaggcgtacactaaaagtaaatttaagggtatcagcagggtgagcgaagcgaggtcaatgcgcacttacacacaacaactaaagttggttgtgttattgtgctaaacacttgtattagaagtcgccgatggcgacaacaaaatcaaacccataaacccaaagaaaggtagtaaccgatatggcaatttttcacatgagctttagtaatattagtgctggaaaaggaagaagtgcaattgctggatcaagttatcgaagtggcgaaaaattattcgatcaaaaagaaggtcgaagttatttttatgctcggtctgttatgccagaaagctttattttaacaccaaagaatgcgccagaatggtcgagtgatagagagaaattatggaacgaagttgaaagaaaagaccgtcgagcaaactcacggtacgctaaagagtttaacgtggctctaccagttgaattaagtgaagatgaacagaaagaattatggttcggcgatgaacaatctactacatcagctacctattccttgacctcaacaaatatttcattgcacgacttttgtaataacttcttc

SEQ ID NO: 710 - DNA, 12944 bp, Unknown
  Metagenome-assembled genome
aagtaacgactgatgagatcctagcagcacttgaactaattaatcaacgaccattaaaaatacatcatcaacagactgccattgaaagattccgggcttgttcggattaaacttgtaatttgcctttaaagtaaagactgtctaggcttagcggattttatgagaactgtaatttcggttgtgttgcaaatcctaaaacacatcaattgattcagcccaagcggcatcgccaagtactggcttgcctttattgaggcttgactaacggttcttgactaatcgaaggattttttcgttagagtgtaccctattgtaactaaagtgagaagggagtattattagttacatataagtgacccggaggcgacctagaattggctaaaatcggttatgcgcgtgttagtacgcgtgatcaaaatcttgcacgtcaaattgagcagctacatgatgccggtgttaataaaatctttcaagagaagctttcaggtaaaaatgccgatcgtcctcaactaaaagcaatgttagactatattcgtgatgatgatgaagtagtggtattgagccttgatcgacttggtcgcaattctcatgatttgactgacatcatcgaaaccattcgccatcgtggagctcaattgaatgttctaaatctgcctagctttgcaagtattgaagatcctaaccttcgtaacttgattacgacaattattgtcgaactatataagtatattgctcaagaagagcgcgaaactattaagatacggcaacaacaaggcatagaaattgccaaacgccagggcaaatataagggcaaaattcgcgaatatggtcctcattcacctaatcgtcaaaaacgctatatttataaagaagcctgtcgccttttaaataggaagaaagacggagatgaaactctgaccaagcgacaaattgctcgcatgttaggtattgcaccagtaaccttatatcgcatcgaaaagtatcaggcagaagatctagcaaacgttccccctagtgagaggtaaacatcatgatagatttaaggggcaaacgaattctctttaccggccgtttgcgatcttttcgtcgtttccaggcacaacagttagcaattattctaggagcaaaacctgtcaacgggattgacaaaaatgtcgatatccttgtggttggtattattagcaaaccctatgatcaactacttaccactcaaaagttaacgtatgctagaacctatggcattccaaagattgacgaattagcctttatttcatggtgccaatggcgattagatcaattgaaaacaactctttaagtaccttcttatcaaacggggagattagtatgcaaaagcgtatcgatttggccaatcaaacgtttggacgactcacagtcattagtttttggggaagcagttctaatggaaacgcgctttggctctgtcaatgtcaatgtggaaataaatgtattgttgacagtcaacgacttcaaaaaggattcactcgcagttgtgggtgtttgcgatcagaaataagcagatcaaacataaaagctaataaccagactaaaaaatacatgggcaatcccaagaattttcaactaattaatcgaacaaatttagttgcttctaaacttaaacgatccaataacaaattcggcatgataggtattagttaggctaaaacgactcaaaattaggtagcacgacttcactttcaaagccatcttaataaaccgtgtatatgttcatgcggagggtgcaatcgctgctccaaagacagcaaaaaaggatatcattcctttgcaagagcaatataagcaatcacaccaacaaaattgaacaaattgatcagacaatccgagtaggcgcaaatcccattacttatactgccgatgaacctatagaaaaggcgcttcgtcataaaatggttcagtactgtaatcctccaaatggcataaatattaagactagttttcaagaaaggaagccgtaacgtgcgtttatggcatcaagatttaattcagcaactcccaagacaacaattattgggacagcatcgtgaaattgcggcgcttcgcggtaatggatggggacggaaacacgctaccgttaattacgtatttgcacattccccatataaattatttcaatttcactgtattgtgttacgtgaaatggaaaaacgaggttatcatccagatcagaaatggtatgatcctctgtatcgaggtcaacattgcccagcatacaaacaactcaatccggttgcactcacaatacccatctatcctgagcatgaccaacgatataaacatgtttgcttaaccaatttacaaaacaagggaatctttttaaaccttccgtgatcctagtctgcgatgttcatcttgggacataggattgacaaaataggatatcgacagtatacttactaaaagtaattggaaagcgtaatgtcgtgttgattggagaaaattaaatggtaaatcttacagaagaaatgaagaatatgttaaagagtcagctccccttcctagcaacaacaggaatagatggcaaacctcaagttggtcccaagggctcactacatgtcttagatgactcacatttaatctactttgagcataccttcaggcaagcctatgataatctctcgagcaaccatttggcagcggttgcggttgctgatagaggcgctcaacagggatttcgctttgagggaacggctcatattcatgaaacagatgattttgctaatcagattttagataaaactaacatttttgaacgtttcccacgcgctggcgtagtggttattgatgttgaacgaatctataaattggataacaccttagaggctggtattcaaatcgcctagggtttttaaaacaaattcaaccgagtaagtcgaagaactttttagtgtccaaactcatacagtgtttatttcatgtcattaagtattcattagcaagcagttttgttatactttggttagaagtgatagaagtacgtctaattcttaagaaacccgtagcttactgttaacgccattacttcgagcgtgtcgattttcgatacgcctttttttgtgttattggataaaaatcatccaataaaaatggctctacgtcaactggtgttgaagaataaatttagggtctacactttctggtgttgagaaataatcaacactgaacgtataggccctttttggataacgcaaaaagacacctactcagtgtccatgctatgcttgttagcgtcgaaaccaaaagcaagcgaggttatgagtaaatgtcccaatacgatcctacactgtccgtccttggaataccagaccataatatcaaagtagcctttgttcgtcatgaatatcgcggcaacggggtacgtcgccgccagtatcatgtgattgatgccgagctgacttaccggttaacccggtgcccactgtgtggctttgaggccttgcaccctaacgggttttacacggcccacgtgcgcgtcctcaacggggttgaaatgccgacagtcattgacttgcacaagcaacgatggcgctgtcataactgttaccacacagtcagtgccaagacgccattcgtgcaacccaaccacacgatcgccgctcacatgacagaacgaatcatgaagttagcgcatgaacggttgccagtcaaaaccatcgcccgtattatcggaatctcagcctcctcggttcaacggatcattgaccgaaatctcaaactccgaccggctcaccggctacccacgcgactctgctttgatgagttccgttccactcatggcatgatgtcgtttatctgtcttgatgccgattcacatcgtctgattgccttgcttggtgatcgattcaaccgtacgattaaaaacttcttcatcgctcattattcactcgctgaacgcactcgggtccagacggtcaccatggacatgaatgcagcttatcagacgattattcatgaggttttccctaaggcccaagtcgtcattgatcggttccatatcattcaacttgcggctcgtgcccttgatcaggtacgcgtccaagcgctcaaacagcttgatgacaagcacagccgtccttataagatcatgaagacaaactggcggctttttcatcaaactgcgcctgacgctaaacacaaacagttcctgtttggtttgaatgaatacgtcacgcaacaggaggccatcgatatcgcacttgatactgagcccaagctcaagcaaacctacgaggcctacttagcgcttcatgatgctttgatggtgaagaaacatcccgcggaactggcaaacctgttagctacttacgagccaaacggtacggcaatggacatgacgatcgcgacgcttaagcgacacaaagtcgctgttctcgccgctgtcaccagcccttattccaacggtccaatcgaaggggttaaccgcctcatcaagtcactcaaacgatcctgttttggcttcaagaatcagctgaacttcttcaaacgaatctaccaaatcacggcataacatgacaaagacggctccccaaatggagaaccgcctcaaatgataaatttattcttcaacaccagttgacgcagagccaaaaataggccacaactgttaagttgtgtcgttgttattctctgttacagggtctaatttggagaatcctaatggatatctataaatctagttacatcacaaaataaccccctcggaaataaattctttcaagagctaccttcctagtattcaaggggattttcttcccactcaaaaatattttatcggaaaagttaaaacttatgtttatgttgtaaataatagaaaaatatgttctttatcaacaacttttcaaaataagcatttcatgtacttatgcggcgtaaaacatgctacgggtgtcagggaatttattaaagatttaaaacgcaaataattaaacctacaaactctatacctaaaagaagatggtagcactttccaaaaattagaagtgatagacaaaatcggactgcttgatactttggaagcaacagtatctattgggaatgatcagcaggtgacacttgagatgaaaagcctgatttaacggcgttttcgattgagtgaaacgagttgaaataggtagaattgaaatggttccctgccaaaatcctgccaagaaaagacgagccagtccggagaaatctgggctggctctgtttttaatttgaatcgaacgtgtgttcccttgatggtgaggctatgatataatcgttgttagagtgtttatgcttttctaggtaatagctggtaaaattatgaagtaatccatcatttgaggtttagagagagattttgaaatgaggtcgttccatgttgagagtgagaattgatattgaaagtctgaaactcaaaatttcagaatctaacgagatgttctttcgacaattaagtcgagaagagcagaaaaagattggacaatttacgacacctatgccggttgcagagtatatggcagaacggctgattgatgatgctgacgttttgaataatcaaagtgttaagcttttggatccgggtgcgggtactggagttctgggtctagctgtggttgagaaactatttttgaagtatccgagttgtaagattgaactagtaacttatgagaacgaaccaatagcgctccgtgtattaaaatcaaatctttcacttgctaagtcgtgggcggctgaatcaggactcaatttctcatatgagattcgcgaacgtaactatatcctcgaagaagatgggcttttagaggatagcgtattttcgtttgagtctaactatgatctcgtgattgcgaatcctccatacaagaaactcccgaaagatagtttagaggccgatgcaatgagctttgtggtacacggtgcacctaacctatatggatttttctgggttaaggctgcgattgagttacgtccaaatgctacatcagtgtttattgtgccacgatcatggatgagtggcgcgtactttgaacgtcttcgtgcctttatgttttcacaaggtagtgtcatcgaactacatgcgtttgacaatcgaaacaatgtatttggaagcaccaaagttcttcaagaactagtaattgtggtcttccaaaagaagcgagttgatttagtgaaaatttggtcacatgacgacattactactctagaacaaagtcaatctatcgtagtttctcgtgatttagttgttgttggtgaagagcagcgagtttacttgattacgaatgcgactcagttagcacttgcaaaatgggctattgctctacccagtacattctcggactcaggtctgaaaatgaaaaccggactgacagtatgttttagaaaccgagatttggttgaggatgagccttcggataacaatgtacccattttttatgctgacgatttcgatggtcatgaggttagactaaagcgagaaagcggtcagtatctatcaaagaagcgagagggctttcttcaagacaacgtggattacattttcgttaagcgtttctctactaaggaagaatcccggcgtattcaaactgcgtattacgatgcagaacgattttcgcaagaagaacaaatcagtacggataataaacttaacttcgtggttgcaagctccagtgatttgttaaggggtgcatttcttgttatgtcgtcgacgattttcgacgactattaccggctgttgagtggaaatacgcaagttaactcaaccgaaattaattcgatgaaatttccagatgcgcatagtctagcgagtcttggtgagaagtatcaagtttccgaactcacacaaatgacacaagaaaaaattgatcaaataatgttggcgaactttgggggagaagcttaatgggtaaattagtcgatgcttgccagatgctcaaagatgtcggttttgcaaagtcagttagtgaaaagagtatggcggcgcgttttatcctggcagccacgaaggttacagaggatatgagctggtcacaggccacaaattacggtgttcagattcatgaaggactcgtattcctaaatgatgagtatcataccaatctgaaagagaatactcgtgagtccttgcggaagcagggtccaaagaagatggccaccgttggccttgcaagggataacgtatctgaaggaattgcgacgaactcaaagaattatcgctggtttttatcagatgacttttttgaattagttcgtcactttgaggatgagagttacactgaacgtttgacacagttcaaggcaacacatctctcgcgtatgagccttcaagctgataagcgcaacaaagtgatgattccagttaaatattctgattttgagtttgaattaacaccggggaagcataatcagctgcacaaggaaattctagagcagttcgcgccgaggtttgccggcggcgctaggcttctatacgttggtgataccgccgaaaaggatctgaaatttgaagaatcagctctggaaaacttgggttttccgatgacgatgcatgacgttattcctgatgttgttttgtttgatgaaaaacgtaattggctatttcttattgaagcagtgtcatcagttggaccaatgtcggtggatcgggtttctcgcattaagtcagaatacgctggaaaggctggcttagtttttgttacggcgtttcaaaactggtctgtttataagaagtttgttggaaacatagcgtgggaaaccgaaatttggattgctgatttccctgatcatatgattcatatgaatggtgatcggttcatgggaccatattcaaattaattggggtgaggttgatgcttgataccttagatttacagaatattgatttatttaaaaataattctaaaattaatttctcagatataaatataatatatgggaaaaacggtactggtaaatcgacgatggtgggagccatcgaggagcaaattaatgatcctgaacattgcgttatttttaatggtattgaaagatttattaggccggacaaacaattaaattcaatattattagggacgcgaaatttagaaatcgaagctcaaattcaggatttgtctgcgacgagagcgactgcggcaaaagaactcgcagaatcctcaacgacagtgaagaaccagcagagtaaattcaatacattggtgcatgattatcaagattttgtttgggaaaatatttataaacactttcaaaaacaatttccgacagatttaactggttggggtggcagtaaaaagacgttctccgaaaagctaaaacaactcggaagacttgaaccaattaatcctaaacagttactaagcgaatctgatattcttgaaaaacgtagcttgattaaggctggagtacgattaccaaggtatgatactttcgctcagcagttaaatttcgaccgggtacgaaaagtgatgtccaaaacaattcgtagcgaggcaaagggacaaattgctaagcggattgaggaaagaaaacttgaagattggattcaacacggaaagccatttttaattcaaaacgaaccatgcccattttgcggacaggagataaatgaagaacatttccgactactcgaaacggagtttgctgagatcatcgatagcacgtataaagattttcaggatgaaatacaagcatgtgtggatcttatcaaccaagagcgaaaacagttaattgcgtggcaacgctatatcgatgaagagtcgaatacaaaggatgagtcattcaggcttataatttccaaggaagtagatgtggtcagtacggggcttcagcttttgtcaaaaacgttgctatcgaagaatgaacaaatgcaacaagaagtgcccatcgatgagcagttgaatacattaagcgggtcattagatgatttaactgcgaaagtaaacgaagttaatgctcgaatagattcaaacaacgaattagtcaagaattctgccgattcagagaaagagttgcataaacaggtacttgagctaatgaggcttcggtgccttcaagacgatattgcctcctgccaatcaaaggttaaagacgttcaatctaaattgaagaatgcaatcagcgagaataaacaaaaccagaacgcattaaatatgattgataatgatattgcagcgctcaaagcaaagactcggtctgagcaggaagcagtttccagaattaatcatcttttaggattattaggaaacaagcgctttaaattgtgtctttctgccgcggaagatggtctgagtggatactacacaattgagggaaatgatggaaagcgacgttcagtgtcagcccttagcacaggcgaggagaaccttattgcttttttatacttcttttatttggttgaggcaaaaatgtcggaacaaagcccaatcgcaattgttattgatgatccagttaccagtaacgacgatcaatccatgtttctgatagtaacacttattcaaaatttgctttttcgagcaaaggaaaacaacgtgcagggaagtcaaaaactccagatatttgtgtttacgcataattcaagtttctatatcaacttgaaagagtggacaaaaaatccatatacaaagaaaaaccgcagttttcgtctttctgctggcccaatcggcagtgtgattgaacaaattaagggtaaaaatgaagatattattaataattatgacgaactttggcgtgaagcccagtttagttatcagcaggatcagaagcaggcactttggaaccaaattcgtcgaatattagagacctacgtcaaatttaacaatcgaactgcgagtttggaaaatgctgttcgcaaaaagataattgcagccgaagataccgaaaaaaagctcatcgctttgcaacttgtaaaaattgcacatgctaactcgcacagtattgatgagttgatgcaagatctttctccgtggagtaaggaacagatccgtgatgcatttaaatttgttatggaatcacttggtggtcaagagcactttgaagcacattggaatccgagtatcgtgtaacagtatcagcggtgagtgcttgtgattatggaatttcgtacctcttgctgcatctttatcaggtgttgattcaggtaccgtcgatctagccactccgcaatctatcttatatcatcgtttcgccaggcgtacatttggatgatatcatccaggtacgccttttccattttctcatcacctttatcgtgcgatgcctgccttagcaaagatccattatgacattcttttaagttgtggcactgccattcttctattattcctgttacagggtctaatttggaaactccaaatgaacatctataaatctagttacatcacgaaattaaaaacggccactagagtataccctagtggccgtttttgatccattatcaatggctttttaaattagggcctagtacttttggaatggaaatactttccaacaccaaaaattctagacccgataaaattagtgatttcctgataattgaatgggatattggtggtgttaatatgaggaatcatggtcaatatctgattatgatcaatagggatcataccaacgtagaagttgtttaaatcaataacggtcaaagaattaggaacacgcagtttaagcgcttcttggactaaagctttcatattataggcattattatcagatattaaagtaatatcactgccttcacaaaggtagaaatctgctgaagcaacattaccaagtagctgaaaagttgactgattcatgatatctccctgactatttacaaaaaagtgctttattttgcagacttaggcatgtcattcttattctatgagtatataactgaaacttgaaagtatgaagacagactgatcccttggtatcacagggcatattttaattaatttaaccatttagcttgctgttaacagcgaaactaaccgtttcggcaaaaatgtgaagaaactgaggtcatcatctgaataatttgggctctcttgcataaacttcatgattaataatcgtttttaacgaatttagaagccataccagtgcttgagacaactcaatatctggcaggcttcgttcattataaagaaataatccccatggtgcgatcatcctgattttgccgttcctgccaagctaataggtcataagtcatcatgacaattgctaaatggccacaaagcccgtcataattttgaacttgtgatttgtcgagccgcaagtattgcttggcaactttaaagtaattctcaatttgccatcttcgggcgtatagttgatgatctcttgtggctgaaggcatactgggtcgttgccagtactaggtagtcatcttgacgggcccgatagccacaataaccaagcgaagctgaattttggttcccgacgtgcgcttcgacaagcagctgtatgataagcttgcttgggttgatattttgaggcctgcagtcgcttgtataatgctttaactgaatattgccgtccgcgatatgatagtaaatttgctggaccgttagcatgcccacgccgtttaatcccaacttggttaattcatagaacatttttggtgagctataccagctatcaaataacacatagtcagctagaacgccatttgcgagggcttgcttgacaagttgatgaaacgaggttcattttttgctgtgctgggcgagtctccggccagcaattgttcgttgatcggttgttttagctgatttccaaggacgttttgtggcttcttggaagacattaatgcaaagttgatcggtaagaatgtaattggcgtcactccaacccaaagttaaagcccggtatcccttaataataactgtttgtcatggtcaaagactcgcgctagtaattcggtttgggtggcgtactcacgggaaagaggtatcgtcaatgatcaatgctaaccgccgccggcggtcaataaacggtcgtaaatgcttgatttaaatgactcccaacttgacaaatcaagcgttgccattgctccggccatcgttcaaattatttctgacggtgcgactggtaaagttaggtgtttcatgggctcgataaagcgagcgtcccaggaactttgtcgtgagcagccattcaatgaccttcatcaagctgatttctgacatgccggcgataattcacacattggtgagtttagatagaccaatgagggaagtaattgatgaacaatatttgtgcagctcgtttttctgtattttttgtcttataatatttcatgacgtaagtctccttgtatcttggttttggtcgactaaagtatacacgcaggagcttgcgttatattttttgccaaaaaagcaataaccacacgcctttgggtgattattagctttcaagttttcagttcttagtttttatcgttattacgccattaaccaaaagtttgaatttcaaactattttaggttatgatgtgggatgttcaagtttggacatggataagtgaaattcaaccaattttttgacaatttagttcgaaagtcgaattaactggcgtgattacttgatcagtttgcaaccgaaaggaagaaagcaatgagtgtattagatgcagctaaaattatggatctaattcccaatcgatatccaatttgtttatggataaagtcgatgaattaaatccgggtgaatcgatcgtttgtaccaaaaacgtcacaataacgagaatttttccaaggccattttcctggaaatccagttatgcccggcgtattaattatcgagtcgcttgctcaagcagcttcgattttaatttctcaagacggaaaaatatcgtggcaagacagttaccttggtgccattgataatgccaaattcagaaagttgttcgtccgggtgatgttttgaagctacctgttgaaatgggaaaaacagcgtgacaacatg

SEQ ID NO: 711 - DNA, 370708 bp, Unknown
  Metagenome-assembled genome
agatcgttcgactacccaacgttggggcatgacttcgaatcgatgcaactcattgcgcttcgcaaccggcacggttgcgtttaaattacttaactggctacaagcgagcgaaagttaacgcctgaataaccccatccctaagaaccttttgaacctggcgtaaattgctgtatggtaaagcgatcattgcactctcggccccctgtctcgatcagagacgtttcgctcgcgtccatgtgacatgcctatgtgaaaagcccttgtatcaatctgccagttggcgctcctttagtccgctcgattttcgtaccaccagcgatcgtagaacctttgctttcaagcgcagtagcggttggctagagaattgtcggcgactttggaaaaattgtgagcgtcaattaaccaccagtctgcaaatggtcgttttagcgtttttagcactattacttaagagattttagacagcttcttagagtgacggtatctcattttcaagaaaattaattgtagcatacaaatgttttgctatttatgcgataaatgcttgctacatcccagttttcaccatttcgcgtaatgtaaaatactgtgatataataaactttgtgcagacatgatttaaatatggctgccactacttgaatgcacctacatggctcgtgctactgtgtaggaatgaccgaaaagcacctaaaactaaaactataatacttgaacgaatcgttatctgaaggaggacatgttcagatgaaaaaagttattctcgttgtcgatgatgaaaaaccaattactgatattgtaaaatttaacctaactaaagaaggatacgaagtggtcgtcgcccatgatggtgaagaagcacttaaacaagttgaagaagttaatccagatttgatcattctagatttaatgttacctaagatcgatgggctggaagttgcccgtcaggtacggatgaagcatgatatgccaatcattatggtaactgccaaagactctgagttagataaggttttgggcttggaacttggtgcggatgactatgtcactaagccattttcaaaccgtgaactggttgctagagttaaggcgaatttgcgtcgacaaaataccgttaacgcagctcagcctgaagaggaagaaaataaggatatcgaaattggcgatctggtaattcatccggatgcttattcggtgacaaaacgtggtcaaaatattgaattaactcaccgtgaatttgagttactgcattacttagcacagcatattggccaagtaatgactcgtgaacacttacttcagacggtgtggggttacgattattttggtgatgtgcgaacagtcgatgttactgtgcgtcgactacgtgaaaagattgaagatagtcccagccacccaacttggttagttactcgtcgtggggttggttattatttacgaaatactgaaagtgagtcgggtcaggcgtaatattacgcgtgcaaggcgtttaaggggtaaacggtagcgtgaaacgaaaaattaaatggtatcattcgatacaattcaaaatcgcgttcgtattcgcgatgatgctcattattacattggaaattgtcggcgccgtttttgtacagcagctggaaacgcagaatttgcggcaatttaagagccaaatttcactgcagcgctacgtcagtacgaacttaacgacccagctgtcacgatcaaatacaaacgcttctaacagacagattcgcattcttctgtctgatgcaaatattcctagcacggcgaatgcacaaatccttgttattgataataaaggcaccattcggggaacaaatgaggccaataatcaacagatcgttgggcaaaaaacgacggacgacaccgttaaaaaggtcatttataataacagtgccggaagtgaaacaacgacgtttgattcgtcgacaaatcaatattattacactaaggtcacaccactgatgaaacaaagcagcggaagcagtacttccgttggcgttgtgtacattcgtgcaaacctggcaagtgtctatgacagtattagtaaagttactgccatataccttgttgcggccgtaattgctattatcatgggacttgttctatcaatcgttatttcccgggcaattaccgtcccaattaccgaaatgaaggaacaaacgcaacgaatcgcccgaggagactattctgggcaggttcaggtatacggaaacgacgagttgggtcagttagccagtgcagttaataacctttctgttcgtgtggaagaggcccaagagtccactgagtctgagcgacgacggctgaattctgttttggcacatatgactgacggggttatcgccaccgatcgtcgcggtaacgtcacgattatcaacgaaacagcggtagaattcttggacgtggactctgatcaggccattggacaatcgattctagatattttgaatatccgtaagcaatataccttgcgtgatttgctggaggatccagatgaaattatgctggatttctccaccgatgaccacgatttgatcctgcaggcgtacttctcactgattcagcgtgaatctgggtttattagcggtttagcgtgcgtattgcacgatgtgactgaacagcaaaagattgatcaagatagaaaagaattcgtttcaaacgtgtctcatgaattacggacaccgttgaccagcgttcggtcgtacgtggaagccttatccgatggtgcttggaaagatcctaagattgcaccgaagtttttgaaagtgacacaggaagaaacggatcgtatgattcgcatgatcaacgacttattgacactttcaagaatggattcgggtacgcaaaagcttaatttagagctggttaatttaaatgaactctataactacattttgaatcggtttgatatgatcattgatagcgatgaacagaaagaccggtctgataagcactacacgattaaacgagagttcactaaacgtgatttatgggtcgagattgataccgatcactttacacaggtgatcgataacatcatgaacaatgcaatcaagtattcgccagatggcggtgtgattacctgtcgtttaattgaaacaaataataacgtgattatcagtattgctgatcaaggactgggaattccgcgagcagatataccacacgtcttcgatcggttctaccgagtagataaggcgcgttcgcgggcacaaggcggtactggacttggtttagccatttccaaagaggttatccagtcgttgggcggtaaaatctgggtagagagtcgtgaaggacatggctctactttctatatttcactgccatacgaaccttacgatgagggggatgatctttgggatgaagcttagaaatttatggctgccaacgagtttggtagcggcattgctagttagtttgggtctttcaggtatgatatggaccaacccggctcactctaacttaagcagtcgaacgaaagtgactaaaaattctgatagtaccagtaatacaacctttcaggatatctacttaccatcacagattatctcaaccaatgctgcgggtaaacaagaactattaactaataatcgggttaacgtggcaactgatttacgtaatagaatgagtcattttacggctgaaaaagctaaaagtatcagtcgagggaattcgaaaacctatctcgcgcagttaaagcgaaaagggactgtgttaatgaattataattctgctatctcagttaactttttccgtaaggcgttcaataatcagttgaaagtgccgaaccaaaagttcaaccgaatgcagtttctgctcaatgatcccaatcacctttatttgttgaacgatcagggttatcgaatcgttcgagtgacccttaagaataatcgttctgataagctacgtcatgttttggcggataaaatggttaagcaccaggtcacttttaaattacttaatggtaaagtgattttaaactaccctcacaatgttaagctacgaacttatagttatcagttatcgcagcagacgcaagattattatgctaaccggattatgacgaccaattctaacagtaacgttcaaatcaagcggcacaaaaatagcaccgattatgatgatcacggtttccggcatatgacggttgatgaatcaacggatactgttaacttcactaactataatgctcagattaagagtaatagtttcttacaaacaatgaacggtatttatgaacagttagtgatggtaggaatgccattggatagcgttcgtttttattcctatgattcaggaagcgataccgctgttttccgaacatacgccggtggggtgccagtctttgatcaaagtgactttggtgcgattcagatgaaagtactggaccaatcttcgtaccgaatgaaattttcactggacagtttgcaggtgccgattccaccagtgcaaagttcggccacaatcatgtcgactaatgagcttatcaaacaacttgaggcagctggtactcacgaaagcaagattcaaggcattgagttaggttatgagtgggttcgtgataagtcgctacccaaggtcgttgatttatcaccaacgtggtacgttaagatcggtaatcagtgggaaaattatcgcaaactgatcggtcaacagtgaaagggggtagccggacgtgaattttaaacgcattcagtcaattttcttggtgatttttatcattatggatgtgctcttatttctatcgtataaccgtaatagcgttggtgattcgactgcttcaggaagtaacaacattctggaggaaatgcggaaggatcaaattacgtatagtaagccgactaccaaaacgcatgaaggttattatttctcaggaaataacgggaacactttgcgacaggacgcacctgaactgcagcagcaggatatccgtttcagcggtgatgaactggtgagtgaatttaaacagccacttaagttaactaatggatcagttaaacagactttagataaagtggttgcggatcctggattaattgctgaaggcaagcattatagttacagtgagcaactatctagcaagagtgagattatttatgtgcaacgggttgcacagaagccgatttattcacgctattgtcaaatccgtttcgatcttaatggtaagaaccaggttattggttacagccagaattacttggaaggcgttaagatgttgaaggaagcttccaagacgatcagtgaagaacgagcgttgacttggctgtaccagtacaatgagattcctaacggtgccaaagtaacctgggttcacttagcttacacgagacttttaactgcccgcggacagtatgtctttttgccaacttgggtatttgccgtgaagctcaacaattcatcttccaccattttgaagcgggtgaatgcttacacgggtgaagttatcaagactggcgataataatcaaacaagtaatgctaattcagaaatttttacactcacatagtcacttgcaagcaatatttaatgattgcgtttcggcgtaaaatgcgttgtaatagtaacgacgaacaatcattgagaagtgagtacggataagtttattcacggccctaccaatgaccatgttggcggggtttttgtatttataaataaagggaagttggtcggtttatgcaagagcaaaatgacagcttaaaggtcagtgtgttagccagtggcagtaccggaaactgtacgtatattgaaacggctgagcacaagattttaatcgatgccggtttaagtggcaagaaaatcgaaaatctcatgcagtctatcggacgcgacttgagtgatgtggattcacttttcgtgacgcatgaacattcagatcaccgtaaaggcgtcggggttttagcacggcgttacggaatggacgtatacgctaaccagggaacctgggatgcgatggctagcaaaatcggtaaaattcccacggaacaaaggaacattattgcacctgattccgtgctgagcatgggtgatttagacgtggaaagcttcacagtgtctcacgatgctgctgaaccgcaattttatgccgttcacagcggtggtaagagttttgtggtactcacggacaccggttatgtttcagaccatgtcgagggtgttatcaaagatgcggacgcttacttaatggagtgcaaccatgacgtcgaaatgttgcggatgggcagttattcatggccacttaagcaacgaattctaagcgatacgggtcatttaagtaatgaagacggtgctgatgtgatgatggacgttttgggtaatcacactaagcgaattttcctcggtcatctcagtcaggaaaataatatgaaatcactggcccatcttaccgttgcttcaatcatggaagaccatgattttggtgttaatcacgattttaaaattttggatacggatccggaaaaggctagcggcttagtcaccctttagttgcttaataaatctttagaaaaatcttatcctttttacgagtaaagattcaaacaaatttcacatctcatcgatacaatagatgcataagtcagtaggttgatcaagtttaggggttgcgtcacaacctaaataactgcgttcatcactttgcctaaattgtgatgacatacaaggagggaagcgcgatttgcgcggaagtatggataatcaacaaaaaccaggatcaaataataaccgtgggctgcttattaaggttgctgtaacggcgttggtagcaggcttacttggtggtggtattgcgtacggtggtgccaattacatcagtaatcgcgatacaacgtctgttccagccggctccaacaaatctgggactgcctcaactagcaacatgaaggtgaatgtcagttcacaggcttctaaagccttctcaaacgtgaaggattcagtggtttcagtcattaatttgcaaaaagaaaatcagtcgtccaatactttaaatggtattttgggaggcagcgattcaagcagtgactcatcgtctagcggcagtctgcaggccagttcagagggctcaggtgtgatttataaaaaggctggaaacagtgcttatatcgtgactaacaatcacgtggtttccggttctaacgcacttgaagtgattttaagtaacggtaagaaaattgatgctaagttagttggtaaagatgcagtgactgatttagccgtattgaaggttaatagcgcggatgtttctaaagttgccacatttggtaactcggataacattaaggttggcgaaaccgctttggcaatcggctctccactgggttcacaatatgccacttcactaactgaagggattatttcagctaagaagcggaccgtggccacaacggatgagacgaccaaccagcagactggtaacgcaaccgtcattcaaacggatgcggctatcaaccctggaaactcaggtggtccgctgatcaaccttgctggccaagtggtcggaatcaattccatgaagcttgctagcagtggtacagggaccagcgttgagggaatgggctttgctattccaagtaacgaagtggtttccgtaatcaatcagctgatcaagaacggtaagatcgttcgtccagcgttaggtatcaagtacgttgatttgtcagaaatttcaaagacacagcaaaaatcgatcttgaagttgccatccagtgttgaaaacggggttgtcattatggagaaaccaggttcttcaacaccagctggccgtgctgggctcgagaaatacgatgtgattaccgccttagatggcaagaagatcagtacgaattcaacgttgagagatctattgtataagtacaaggtcaacgatatggttacggtaacgtattaccacaatggtaatcagaagaccgctaaagtaaaattgactgaaacaacgtcacaattgaatcaataattagaaaaatagtgtatgtgaagaaaaggctgaaacctgttttgcgggtttcagccttttcagttatattgaaaaagacgaatgttcgagttatacacaagtggataaatacatagtaatgggaacgcaaggaagacacagtcgaataaggaaagcgttatccttgtggaaaattcggaagtgtgagtaatccacaagaaactgtggataactttgtggataacatttaaatggatggaaacaccgtaatcactgattttctccaggcgtttcctaaaaactattaacaggctgtggataacttgaaaacatcgctaactaaattttaataaaacgttgctatgacggcgtttacattggtacaataagagcgataaagtacgatgcaatgaaaatgaatattcgttgttagcaaacagatttttgtccacaaagattcaaatcaagcacaaaatgggttgtggataactttgtggacaacttaaaatgagggaaaagttatgaacattaaactggtagttgttggtaaattaaaagagaagtattttaaacagggaattgccgaatacgctaaacggctgtcgcggttttgcaaatttgaaatcgtggaagtgccagacgaaaaagcgccagaaagtttaagtgacgcagagatggaacaagttatggaaaaagagggcgaacggattctttccaagattaaagaccgagaatacgtttatgcgttggctattttggggaaagaacggtcatcggaggaattcgctaaggaaatcaaggacctgaccacttacggccattctgatattacctttgtgatcggtggctcactgggattagcgccagaagttttgaaacgagcggatacgcagatttcgtttgggcggttcacgctgcctcaccaattgatgcggttagtgttgaccgagcagatttaccgggcgtttatgattaatgagggcagtccgtatcataagtgacaccgttttgtgttttaaaaagagtggggcgtgaatcagtttgaaatttgtattattttcgggggagtataaacttaaactatgtagtagataatagggagagaaggatttcatatgcgtaaagaaattatagctggattgttaagtttggcagcttttgtagctgttgggactgggacaaccagtgcttatgcgtcagcagtaaaaatcaacggaacaaccgttaatcgtcagttcttaaacacgaataattactatcagaccaaacgagcaactaaagttcatctggaatacgctcaaattggttcagataagggttacacgaagttggtgactttaccgaaggacaccattgttggcggtcagctaggtaaaagcaatacgactggtaaaatgaacgctcaactagatttcatgggtggccagttaaactatgcattggtcaataaatcggttaaaaagggttacttggccgatggtgatggctattctaccgccattagttccttcaagaaaatttcgacgccggcttatttaccaacttggagttatggtgatttatacttaggcggaacttcggttgctaagcagtatcgggctgtttatccgagtcagagcgtacaaattacgactaatgggtatgttgaagttcacaaaaaaggttccgttaagagctggatggactattatttaaataagccaattgcttcggtaaaaattaagaagaccacaactaaaggcaacacacgttacttatatttaagttctgcattaaagggcttcaagaccactcgtgttggtaaaaagggtgcttacgaatatcgtttagccatgactaatttgcacaagccagtaacaatcccttcacatgatgaggattcggatgtttcaagctttgttagtctttattcgcttggtggagtgacgtactatactccgattggcgtttctggggatgcggattgatcaatgattaaaaaaacagatcgagaataataatttctcggcctgttttttattttgcagctagtttggtttaacgaagcaaacttactttcccgtttcattcaattccagcaaccgcgcccgcaaagcatcatcataagcagtcagataaagtccgtacttaccacgcttgatcaacacgttcaagacgttcgcaataaaggctttgtattcatcacggctaaacttaatgtccttccgtttcttaaagacttccttatgagaatatttttcgggaatgacggtcatggtatctgtttctttgtcgtaaccaaaagatggtccaattaccatacccacgtagtttaagtcaaagccttgcagcgtataaatggttccaacttgagtaatggagccttcacgctttgcccatggtgtccgttgtgggtcccattcatcccaaggcaggttgaaagtatccatttcaacgttgtggcggccatcaatccgtgggaaacctgatgtggcaaccatacggctcatgccatatttcttattttgttccttaattttttcgaacatttcgccagctttatcgaatactttaaattcgaaatcgctgttatctggaaatggtttaatgggcttctcttcggttaaatcgttcatccatttaacctgttcgtcgctggccaccatccggtactggaagttcatgtcgaactgtttgtaagggtgattaccaatggttttgaagagtagtttcttgtcccagtacatctttgattggaagacttgatcaaaatcgtaaacaacaacgacgaccttggccaagttcatcaaatcagttagttggttttgaccgcggtaatgagcgtaaggttctgatttagaatacagcagatgcgcttcgtcgacgaaaataatgtcgtatttttcgtggttcttttgcgcgtagttaattagagatgtggggcggcgaatcgtgctgacattcatgttaggaatggctgaacccatttcgcgataggctttatataattcgggatggttgaccaccagtgaagtcttgtagcgcttgtccgtcatgtattggcgaaccagctccattaaaacaactgatttaccagttcccgcagcgccttcgataatggcaactgatgaggtcttgccggtgagtccttgtttgatataggcgttgatattcgtaatcacatttttttggtcatcggatagatcatccacaaaaaactgtgcttttaaaactttgttcattggtttggtcattagaaaactcctagttgattaattatttaagtgttgcggttttgtatggcgataaaacatacaacagataaacattatactgcttaaaccgatgacgataccagtggacaccgttaaattgttttacgaacttgtctcgtggcttgtaccattcgctctaaactagttaatgcatctgcctcaggtaacgtttttagcccacaatccggattgacccaaaggtgctctggcccgagttgtttaatactagcttgtaatttgattactagtgtatcagttgtagagagtttaaattgcgctgtatcaaacatacctaaacctactggtgtggtgaaatgcgcatcgtgcagtgcatctaataacgttggatccttagctgacagtgacagtgcatcggcatcgatttgatccagaacgtctaaaatatcggtgtagtggtcatagcacatatgaatatgaaagcgggtagtagattgtaaccgactcgcgactaatcgaatgactttaattgcccagttgaaatatcccatataccaatcagttcgccgtaagggtaattgactgcgaaaagcaggttcatcaatttgaatgatgtgaattccgttcgtttctagagcatgcgcttcatcttgtaacgccagtgcaatctgagtggcactcacacgtaagggcacgtcttcgcgaggataagcccaattaaccaaagtaaggggaccggttagcacaccttttacaggtcgattcgtgagttgctgggcggcggcagtttcagccacggtgatcggatgcgtccaggcaatatcaccccagataatgggtggctgtgcgcaataggtaccaaacgtctgaatccaagcatgctccgtgaataaaaagccgctgagttgatgatcgaagtcgctgatcatatcatcccggtcatattcaccggtgaccagaacatctaggccaagcttagtctgttctgtgagacatgcttgcattcgcttatgagtggcagattggaactgagattgggttaattttccctgcttaaaggccattttacgttgctgatcagccgcggtttgtggaaatgaaccgatggtcgttgttggcagcattggtaatggcacagcccgttgctgcacttgttgtcgcacagcccgttctggttggcggtgataatcggcactagttagcgtctgaagccgttcagttacccgagtgttttcggcaccacgtgagtgattgaatagttgttgattagccaagagaagggcaggttttcgacctgctaacaagtcgtttatggcaactaagtcagcaagcttttcgtcggcaaatgcgaggtaggggcgcacatgctcaggcagcgttgtttcactttttaaagaaatcgggagatgaagtaaagagcacgaggtggagagcaccacgtgtttgactggtagccgatgcaattgattcagtacagtttgatagttggtgcgccagacattacgtccgttaacgataccggcaaagagaatcttgttatcaggaaagccctgttcttgaatgcaggcttctgtttgctgaccatcgataaagtctaatccaagcgcatcaaaatcctgtgaaattagctgggtatatgcttctcgaacatcaccgtaagccgtttgcagtaatatcttcagctgacctttttggggtagtagtgcagtataaatatgtctgaataacgccaaatcagcctttgttggtgctaatactagcgcagactcatccagttgaagccaatcagccccaagttggtcaaactgtttgaataattgagcgtaagcggccacaaaaccctcgatgtaatcagaaattttctgagtgccagtgattcggctgaatttcaataaggtatatggtccgataattgtcggtcgagcgtggtagcccagttgtttggcttccttaaattcatcgaagggtttagttcctgttagttgaatagtggtgctatcgtctaattcaggaatgaaatagccataccgagtgttaaaccaagttgccatctttagcggtggtaggaaccccgtagccgtttgagtaccccgtgccattgcgaaataagtatccagcggtgacagttgtaattgctgaaaccgttgcggaataagattgaaaagtgcagcagtatcaagcacttggtcttcgtacgaaaaatcattcacaggtagccagtcgatgccagcttgagcttgtgtttgccagttttgctggcgaatttgagctgcaatccgatttaagtcagcagcggtaatcgtccggctatggtaggcctcaactgccttttttagttcaaggtgtcgaccgatacgcggatagccaataatggttgtggtcatggtggtcacgctccttcaatacgactattttaacgctttatagcataactgaatgtaaaaacagagaatgcgagaataacgcggtaaacggtgataaacttagtataaagtgtgtttgggaacctttgttaagttcaattcagtacgattgacatactgaaaatatcaatcttgaggtgattagtatgacacgagaccaactcattgaatattgtcaaaatgagtataattcagaagtcgataaaccctttaaacattttccagactatgttgccatccgtcatcctaacggtaagtggtttggcttagtcatgaatgtgccagccaacaaactcggtctatcgggtacggatgaaatcgatattgttgatttaaaggttgaaccagagctgaactccattttgcaagtgcagccgggctttttaccaggttatcatatgtccaaaacacactggatcagtgcgcgattggataagttcaacagtgttgatgacttggccgatttaattgaaggtagctataatgaaacgatgtagtagggattcttttagtgtgaacagcaaagacgcattcttttgaccaattttggtctgagaatgcgtcttttgtatttttttaagtttcttcgttggaaaatgtttcatgtgaaacattttcgcactgttaattttgatttaaagcatcaatcacttgttgtgtcgatcgtacctgtcccattttagggaagattatttctgtctcaaaagtctgggcttcttgcgaccatgccgtcatcgcatcttcgacgaaaatttggttatagccacgatcatatgcatctctggccgtagtatccacaccgtattcggtagctaccccgaataaaacaatcgtatcaatatggcgtcgacgtaattccatttctaaatcagtgccgtaaaaaccgctccaagcaattttaggggtgacatgaacactatcaatttgggctagttctggtaagagttctggcttcgcaattggtgcactgccagtctttaaatccatatcggtttttggcatcacacgatctttgccatcggttactggaatctgagtgaggtcgataaatgcaccagctttggcagccgcgttagcaagcttaacggcgttatcacttacttgctggtaagtgtatggcgcatagggcagattaagaccagcgtgtaaatcgatgccgacaaaagcggtgtgtgttggatcaaagtttaattcattcatgaagattacctcccaggtaaaggacttagttacggtttaaaagtttttcagcgttagttgcaaaaattttgttcttagagtttggatcgattggtaagttttcaacaaatttccgggtgtccgccattgaaacgtaagggtaatcaacggagaagagaatatgatcggcaccaacttgcgaatagagttccagaaattgcggttcggagttataacccgaaatcgtatagtagatattattctgcaggtaataactaacaggatgctgtaatttagaaatttctggtggcaacagagtgtctaaccgttggacagcaaacattaaaccttcgcccaaatgaccagtcactaattttagattgggatgtctgtcaaagacaccacctaaaatcagatgaataatgtgaatggcagtttcgatgtgccagccaaatcctgctgagctgaactgtgcggtgacttgttccgaaaaattaccgcgataacaagcatcaacaaccgttttcgaaggtaaaccagggtgtaaataaatcggcacgttcaatgactctgctttggcaaaaatgggatcgaaatcggggtcatccatgtagcggccttggctgataccgttaattaaggcaccggaaaaaccatactcgctaacagtccgttctaattcagcagctgcttcctttggtgcgcttgtaggtagtgttgcaaaaccaccgaaacgttcaggatactgtaaaaccgcttttccaagcagatcattggtctttttagctagcggaacggccttttcaggagccatattctcagtggccggtgccgtaagtgaaataatttgtcgatcaataccggctgcatccatttcggtaattcgtgagtcgcctaagttttcacagcggtcgagaatctgacggatggcttttgcctgaggggtatcaccggttttaatgttagtttcaaagtcgggtgtaatgaaatgttcttctaaagaaataatgtgttgttgtgccattttgttatcggcctcctgtgggttatcatgatgttaaacgaagaaaaaacttagtcgttaagcttaatgtttagttgctaagctacgagaagtaatgataaacttagttgataagtttatcaagccttttttgaaaaaaatttggaggttgttatgaaaaagagaattttgaacgatgatttggtgattaatgctgcgttagaaatcgcaaggaaatccggatttaaagaagtgacaatcacaaaagttgccaaagcattagatatccagccacaatctatgtatcgttacgcggaaaatagtgacgatttacgtggtaaagcaatggcaaagagcctacagaacctgctcgcttatttataccagcacctaatgggggaaactggtcaaacagcgttaaagaaattagcgatgattatcgtttttggtaatcaggatcaacagctgattaatgatttagggttactttctgaatatcgggaacatcccgctgttgccgaggcatttcaaggcttatacagtttgattacgcaattactgaaaagcagtattgagaatgaaaatgatctgcgacgagccacacagttactgattgatttggtactgggtgaaaatatttcggttcattcgcagtcggcggggaatttacaaacgagtaaagaagattttgaagctaacttagatcgagtactggcattgattatgtaatcagcaggatgaggctgtgacataagtcccttaattcaaaagcaggtagttaaaaatccaaggatttttaactacctgcttttttgatataatgacagaaaaaaagagtaccggtcacacccgatactcaaaaatcatcctcgaaggacaccaacagtacaaattataacatggtcaaacaattttacctctaactaccgacataatcgttcaaaaagataatcctgcttactatattaatgaacgggttgagtcactctcaattaaggagcactaccatttcggtcgtcctcgagtattattgggtgccatgatgaagctggttcttttcgcctacactcgcgggggtctttagtagtcgccgaatcgaaacctttgcggtggagaacttaacagctcgctgctgacccaggaacagatgcccacgtatggacaatttgtcgcttccggatttccgatgagttagaaactttgattcatgatgggttagaccagtgtttactacttgcgtcgtcaaaacttaattgacgtgtgaccttttgatggtaccaagattttggctgatgccaataagtatagttttttgtctggcgtaagataccgtgcgctttgatcagataatcgtgaagcaatccacaagatctggctgatattaacaccctacggtgcagctttcgttcccgagggcgaatttaaccctggaaatgatgatgaggtgattactcgacttgagatcggcctaataaactggataaggagatcaaacaatctccaattatcgcccaatccagctagacaggatcgtcgaaaaatcaagaagatcaagcgccagctcactcaacgcaaaggcaaaatgattgaacatcagcatcaattggaaaacttggtgaccgcaatagctactctaaacccgacatagatagcaccttcatccgtcaaagaagatccaatgttgaatgtcagttgaagccagccatataacttacaatcgccaccaataatcaattcgtattaggtttcggtttattccagcgtccaaccgatacgagacgtttattccatttctgagtaccttagcaaaaaccaacacgttggctgagaatttgtggctgatgctggttatggttcagaagctaattaccgtacaatagaagataactatgagcaccatcagccatcattccgtacggaacgatgttaaaagaacaaagccgtcatgcagtctgatgatcgtaaaatcatgaactggaattacagcgctgatgacactattatattgatcaacggggcgtagatttaacttccagcgttattctaagcgcactgacaagagtggtatcacgcgtgattcaaatctctcgggcagaaaaattccgacggtctcaccagtattccagcagccctgacgcggtctggacaacccgatatcagtatcaatcccagttgggaatattttaaacgcagcagcgggaccggttaaccacagaacacggcacaaatgtatgcccggcgtaaaatagatgtagaaccagtcttcggtagaatgaaggcttatttagggttcaaagatttatggtccaggtttagcgaaggttactaaggaaaccggtatcgtcattattggccttacaatatggcaaaaaagcaggggataaaatcccgattttattcagaaaaaaaggtttatcgagaaatcaaattttgatttcttcgataaaccttttttgaaagctatgatttacgacttaagtcacagcctcaacgtttgaaaatgatggcgccaaagtcttcattggccttatagttgcctgaaagtccttgagtgtgtttaggaataaaatcgaagtgttttgaactcacgattttaatcttaatcagctcagaagacttttttgaataatgtaggcgaccataataagttgatttactatgcttttttaggctggttaatgaccagtgataggtatgaccataactcttaactgtcatgtgattacccttaaaggtagttttatcgtgaaaaccaccttgagaaccatcagtgagccggtaccagcgatgactacgaatagatgaaggcagataggttgtcttcgcactggcagttagtggtacagagaaaactggcaaaagcattcctacagaaagcgttaaagccacgattcgttttgatttcaccattaaaatcatcttccccaaatagatttttgaacggttttagtataccgcaaattaaagggaaaaccgattcagcagtaatttaatcttaattatctccagccgacatcttccgcgcatcaatcagatggctgttcaagaaccagtactggtgccagtcaccgaccaaagcagtaaatggaacgggtgtcttaccaactgcttcgactttttcaatcaagtaattccgtaagatccaagggtcgttcagtgaactttgagttagcgtaaataagtggtccagcttggtcaaactaatgtgcagatcacttgcaacctgttccttagtgaggccactgagctcgaagttttgttgcagttcatttctggtgtttttcatttgttgtggatttaatgacatgctgttagattcctttcgtttttaaaatgttagtttaagtggaaaatttgttctgcgttaccatgagcgaaggcttccagttgatcaggtgtcaaatcagtgtgatcaaggaatgtccgagcgttttcaggttgtttgtatgggtagtcaatcgaataaatcaggtgttctggccccatttcagccaagaggaagttgagttgcggtttgcttaaaataccgcttggtgtgatgtagacgttgttgtggtagtaatcagaaaacgacttcttcaatccgtcataagcgtctagttcatcgtccagccgttctaggaacatcggcactaattcgccccaatggccagaaactaatttcaggttaggcagtttatcgaagatacctgaagcaatcatccgcatgacttgaatccctacatccatgtgccagccataaccagcagtggagaggatacccgttacgacatcagaccagttgtcactggcaaagtagtgttgagtcacgcttggatcgatgaatgacgggtggaagtaaacggggacgtccaacttgctggccatttcaaagattgggaagaagaaggaatcatcaaagtatttattttggtaattacctttgagtaaaacaccattcaaatgaagtttgttaacagcgcgttttagttcagtcgcagctccggttggatcaccaacgggcagaacggctaatccagcgaagcgagtgggattggtcttaatcgctctagcaagttcatcgttagcatcttggcacagtttaacggccacttttgggtcaaggttctgtggagaagagttaccgtacgaaaggatttgctgatcgatttcatatttatccataaaagcgatgcgttctttagtgacatcttgcataatttcgggtgtcggtagtgttgtttgcatatagtgcagcatttctttgctgacgttaggcatggcggctttaccgacggcttgattaatttcttgagtgattttagcggattcaaaatgttcttctactgtaataattttcatgtttataactcctttgccaaaaacagatttgtactttgacgttacattgagtattatagagggcaataaaatcgtatgaaaggaagatgcaagacatatgtgggccttgtgtcacattaaataaatggcgagagcgtttttaacaaatccagtaaaaatcgatcagcgtaaacagcgttcccacgcgaaactgtttaatgccatcgtggcgaagtatcgggctggaattccctttaagcagattgaaatcaaaacattttgtcaggaagcgggcgtatcacgagcgaccttctatcggcactatcaaaatctggcggatgtgatcgtggttcattttttaatcgtcattgctgattttgatcagcgaattgatgcactaccggaacctaactttgagaacagcagtcacgttgtggtgtcggaaattgagaagaaccttgatttgattagattggtttcgtggagtggtacccgacaagctgtccaatcggtgctaagtggtacagcacagcaaattttgattctgcgggattatccggttgccagaaggcagtttatcagtgaatttttgggtggcgcactcctgaatttcgcccaagaagttgctgaggcaccggaacctatgtcagaatcagaagttttagagttataccggttgttgattccaagtagcctatcataatgaaaaataacgttagtcaggattgagacctgactaacgttatttatttggcttcagtttcacggatttgatttagtgaagactgttcatccggggtaatgatcccggctttgatcatgaggcggatcgtttctttcaagtggtgagtcagggcagcttgctcgtctgcagaaagcgtttctgtgtgagcttggatgcggtcagcaatcagctggctgtgattacgaatggttgttttaccctgttcggtaccataaacgttgacgatacgccggttatcttcgttatgtcgacgctcaacgagatggcgtttttccagtgtggcaatcaagcgggtgagttgcgcccgagaaataccggtgatgtcagcgagttgactcatgctgataccttgtcgtgagtagacattctttagcgccattgcttggagtcgcgttaggccgaactcgtccaatgtccggttctgggtgatggcctgagtaagatcagtaaatagctgttctagttcgaggccatcgttattatgagctgtcatgtcatcacttccttaataattgagaatttaaaatagtagctagtaaacgattataaacaattgacaactatcaattgtaagtataaagtagattattgtcaattatcgactacttggttttaagtgtaaaaggtagtcattactttaggttaaatttgaaagggacgtggccaattatgaatgattttgaaacaattagtcaactcgttttaaaagaacggatgtatcgtggacggcatgttaaagaagcagccgactgttattttccagatgcaactgttactactagctggcaaagtggaccagtttccacttttttaggtaagcaaccggctgacttcaataattcattacccatcgtgggtcgatttggtacgccaattgtacatcaaaatgggaaccgtgcttatgttgaactttcatcgactactaatcattggcagatgatcaatgatgtggaagcagtcattgaatcatatatgcgacttatttatcgggttgaaaaacggaagaatgaatggaaaattgttgatttgacttcaattgacgaggccgataagattcagccagccattccgggtcaagatctcaagatcgacccagcagacgttgctaaattacgtcgtagctatcgtttcttagcctatggccgaatcaaggctggtggtaaaatcagccaagatttactggggactgatcgtaaagcagatgaagatggtctttatcaaaaagcagaagaatggcttcacgaaaaggattaattgaaaagcatctatcacgtacagggacaaggagtagtgctatggcagagaaaaagacggtgttaacgctgattactggtgccgacaaaggcattggctttgcgacagctcaagcacttggaaaaaaaggtcaacatattttaatcggttctcgtaatcaagaacgtggtgaaaaggctgttgaacaattgaatgcagctggcatcaaggctgattttattcagttggatgtaactgataaagctcaaatcactgctgcagctgataaaattaacgctgactacggttatcttaatattttaatcaataatgctggcattgcgctcgatcatcatcaacccgcatcaaaactcagtaccgatacgattcgtcaggattttgatgttaattactttggcctgattgatgtgacacaagccatgattccactgttaaaagcaggtaaaccagctaaaattatcaatgtatccagcaacatgggctccatggggttggctagtgaccctagctcacggttctataaagtgaattcactaggctatcaatcatctaaggcatccgttaattttgcgaccattatcttcagtaaagaactcgctactgatgatattaccgttaactcagtcaacccaggctggactgccactggctttggcggccgtccagaggatgcacctgctccagcagggatgcaagacattgctactggtgcagcacagatcattaaaatggctagtctgcctatggatgataagacaacgggtacctttacggaaaatgatgggacgttaccttggtaggcacattattatgattaatcggtgatgcaaatagaaaggaagctttcgaaatgcaagctgttgtgttaaatgaaccaggcgatgccaacgtactaaaggtgacggaggttcctacacccaaagtaaaacctggctggtctttaattaaaatcaagggttttggtatcaaccgttcagagatttttacgcggaatggctggtcaccaacagtcaaattaccccgaattttaggtattgaaggggttggcgaaattgctgaaactactgattctaaacggctaccaaagggtcagaaagtggtcacgttgatgcatggcatgggacgtcaattcgatggtagttacgccgaatatgcgctgatccccaatgacagcatttatccgataaacacagacttaagctgggcaacgttagcggctattccagaaacgtactttacggcttatggttcactgttgaatctgaaaattactggtacggattcactgctgattcgtggcgctaccagtggcgttggagtagcagcagttatcctagctaaagcaatggcaccgggtatcaaagtttatgggacgacgcggaacttagcaaaacgtgctgaacttgttgccaagggttttgatgacgtgattgaagattgtgataatgatctgcaaactgaccgtaagtttgataaaatattggaattagttggttctttaaccctcaatgattccttacgttatttacacgaaggtagcattctttgtgaaacaggtgaacttggcggtatttggagtattaaagacttcagcttgattggtaacttaccatctggtgcttatctaactgattttagttctgatagtgtcactgagagtcggttcaatgatttgttggatatcattgttaacaataaactggatgtcgcaccagtcaaaacgtttgatttagcacatacaggtgaagcgcaggcctatttagatagtcaagaaagttttggtaaagtggttgttttgccttaaaatataaaagttccagctactgattacttatggtgatttggtggctggaactttttgtgttttgcatttttctcaactaaaaatgtttcacatggaacatttgtgcccctccttttggattactttccctgaaaacttcttagctaggaaatccctgatttgggattataatctgggttaatgatagggaaggtgatcacgtgaacaatctagcccagtatctgaaacgcgaaggcgcgcatttttcagccattgaggaacaagaaattaaaaaactgaagaccgcgcttaaatcgttgtggttcaacattgcaatttacctattgatcacactaattgaatattggttagcctcaattggacattcacaggcgttaaaagcggatgcgatgaacaacctatctggggtgatttccaccttatttttgatcgttggtttgcacacagccaccgattccgatgatcactttttagtcggcaaacgcattccattgttgaacggccgaaatgacgaccggatgcagctgtcgcggtttcgaatggcaacgattttcacgttgatcactagtttgattattatctttatggccggacagatcattattcaaagtgtccaagtcgtgctgatagggtctggaaggcgacaacctaatttgttttcagcccttggtgctggaatcgcgacagttcttatgctggttgtttggtatttcaactatcataatgggaaacgtttgaaaaacgcggtactttcggctgctgctaaagacagtatgggggatgtggcaaccagctttggcactttagtaacggttttggcagctttttggttcaatattccgtggcttgatagcacagtgagtatcatcattgggttctttgtcctttggtccggactagttattttccaagagtgtacgttgaatttggcagattacgtcgatcctgatttagaacatcaaatcaaagctgctattattcaattcgacgaggttcaccagatcacagaatttagaagtcgctacaacggtgatgttctgattgttgaaatgttgatcatggttgatgcacggatggatgtgatgacactttataacttaacggagcggattgaaaagaaactggaagctcagtttcagatttttgatgtgacgactcaagcggttccggatcctgaagagaacttataattaggtttcataattaactgcaccataagttaaaagcagtctttattcatagaaataggggctgttttcatttaaataaagcatcactggcagaaggtaggttgattattggtgataacgtggaataatgggagtattgaataattacgggaggaaacgtcatgaagcacatcgtaacgggaattattgcccacgtggatgcagggaaaaccactttatctgaagcactgctttataaagccggaacgctttcacagctgggaagagttgataatggggatgcgtttcttgaccttgacgatctggagaaaaaacgtggcatcacgattttttctcatgaagcgaacttacagtaccagcaattaaatttaaccctactagatacaccggggcatgcggatttcggcgcccagactgaacaggtgctcagtgtgttggactatgcgattttagtggtatcagctactgacggtgttcagggctacactcggacgctatggcgtttgctagatcgctatcagattcctacctttatctttgtaaataaaatggatgctcctggggttaaccaagaagcgttgctgacacagttacagacggaattatctgctggctgtattgcttttgatggtgaaaatattgccgatcattatgaagatattgcattacaggatgatgcagtgctggatcgttatatgacgtcagagaccattagtgatgatgtgattcgacaattgatcagccagcgaaaagtttttcccacttattttggtgccgcgctgaagttgacgggtgttgaagcactcatgtcggggttgcagcggtggaccattgaaagaccaaaaaatcagagttttggtgcccgaatcttcaaggtatctcacgatgaaaagggtgaacgcctgacttgggttcgcgttacgggcggggcacttcacccgcgtgatgaagtgttgccagaccaaaaaattaatcaactacgtcagtacaacggtgtgaaatacacggtcagtcaggcgattacagcaggggaagtttgcgcgatcactggcctaactgggacgcgaccagggcaaggcctgggtgatctagccgatggtgaagcacccgtattacaaccagttttaacgtataaagttgatcccaaaggcaatgatctgcacgcttgtttaacggctttgcagcaattggaagacgaagacccgcagctccatgtcacttggtctaatcagttacaggaaatacgggtgcagttgatgggaacgatgcagttagaagtcattcaacaattactgcagcatcaatttcacctagatgtagactttgacgaaggcagtatcctctacaaagaaaccattactgattcagtagaaggagttggccattttgaacccttgcggcactacgctgaagttcatttgctcatggaacccactgaacctggcagtggtgttacctttgcatcgaattgctcgctagaagtcctggataaaaactggcagcatcagatcatgactaatctagcagctaaacagcatttgggtgtgctgattggggcacccattactgatatgaaaatcacgttgattggtggccgtggcagtattgtgcatacagttggcggtgattttagagaagccacctggcgagctgttcgtcagggcctcatgatgactaaacaacaaggcgaggcgcagttactggaaccgtggtatcaatttcgactgacggtgacccaagatcaggttggtcgggcgatgaacgatattcagttgatgaatggacagtttgaagcaccggataacactggtggaaccgtggtaactttaaccggcagcgcaccagttgcagagatgcaggggtacgctcaaacagtgaacgcctatactcatgggcagggcgagttggagtgtgtggtcgatggctatcacccgtgtcataacgctgatgatattattgatgcagccgattatgatccggtggctgacttagagaacacaccggattccgtcttctgtgcccacggtgcgggttatccggtaaaatgggatcagttgccggtaatggcgcattatccgtacgcgaaaaaataataaagaaagggcacctttaagcggaaagcttaggggtgccttttgaattattttaagatatagttattaggcttttaaaagatggtatccgcacaatttaacggctgacacagttacattgaaggaattagtatcaaaaagagccaggcgataaagcaaaagaggagtagcagaataactaaggctgtccaaagtaagctcttgtgattagttttgtggccgaagtatatcagtactagcatggtgaacgtaaagataagaatatacgttgtcatcgtgtccctcctctgtgttgaaattgtatcattttgcactgtgatatacagccagaggtgaattatttgtgaatgattaaattttagaaagcgctttaattgcaaccggaatgtgttaaaatcaaataagaattattctaaagtatattttagtgacgcatatttacaaggaggctttccggtatggcaattgatttaaaggatgtccagtccgtctataaggatgcaggcagtaacattattttttcaaccatggacttgaaacgtcaggatcatgatgctgatttagaaatgattcaagatctggcggagcacctgccagctttcgaaaattcactgaatattcgctatccagatgcgggattagctgttgcctttggtttctcgcgtaaggcctgggattatcttttccctaacgccaagcggcctaaagaactagaggaatttgaaccggtggttggaccaaaatacaccgcaccagcgacaccagccgatttgttcttccacgtgcgagccaaagattccgccgtcccatttgaattgatgaccatggtgatggaacggattcaagacaacgtaacggtacttgatgaaacacacggtttccgctattttgaaggacgcgccattattggttttgtggatggtacagaaaatcctagtgcgctggatacaccggactatgcggtgatcggtgacgaggatccggatttcatcaatgggtcatatgcgttcgcccagaagtatgctcatgatatggaagcgtggaacaagctgaagacggaacagcaggaacaggcaattggtcgaaagaaatttaatgatgtggaacttgaagatgaacaaaaggcgccgaatgcgcacaatattgtttctcaagataatgaggagggtgttgagcataagattgttcggatgaacgtgccgttttctaacccaactgaaggggtgaatgggacttacttcattggctatgcccggcactgggaagtcactaaacggatgctggagggcatgttcaccaagtcggatcggttgttagacttttccacgcctgaaactggtgaagtgttctttattccttcatttacggttctgagtaagattgcggatggcgaaggattttaatatcgaattaatgaaaaagcctgttacttgctaacgggcttttccattaccgtacgtggcatgaattgctggtatcttaataatcgcgatttacgtatttagaccgtccactagagaagaatagatttcacgggaattcatccagatgttgagtgaaaataattgactatgtcttgtattctgccataatagcaccaaaaataaagtatcggggtgaatacagtgactaagctgactttagtagtacccacttataatttaagtcattatttcaatgaaacactggaaacgattgtcaatcaaaccgcagattttgaattatggctggttgatgaccattcaacggatggtacagcggaaaaagcagccgaatttgttaatggtgtgccaatgtttcacgtggaacaatttgaccatcaccgaggcgtttcagttgcacgaaattttggtatcgaacacgccactggtgatgtagtggcttttgcagacggtgacgaccgattgcacccagactttgttaaaacactaataaatggctttcaggagagtacaccagccgttactgttggttatcagtggtggcataccccaatgaatccgcgggaccactacgaaacgttgtcacagcgcactatgtttcagcaggctagtcaacgtggttccgaaattggtggttatatttggaataaggcttattcgctagccgccattgaacagcagcatctacggtttgatgaatcattatccattgctgaagattacttatttaccgctacttttgtggcgaatgatccaggaatatacgtgtatgatccggcaattaggtataccaaaatcaatcggccgaatagcactttacggtcacgtagcttttcggaccggcgagttgaagatcaggtgtttgagcgtatctatcaaatgggagaacgattatgaaagtggtaaattaactggaggcagctcatgacagagagtagcattatgcaacttagagttacgcttaaagatgttaaaccggatacttggcgacgggtattagttcccacgagtattcgctacgatcagcttcacgcgatcattcaagttttgttcggctggacgaacagtcatttgcatagtttttcgccggtcaatgatccgagtacggaatacggtatggtgatgccagatcttgatatgggagataacatgttgaacgaaagtgagaacttcgcatacccggatctggaaaaaggtaatgtgatatatacttacgatttcggtgctagttggactcatcagattgaattggagaaaatgattacgatgaaagcttttattcaggcgggacatcatcaattaccagtggtggtagcaggtcgtgggccagaacgaatcgaagcaacgggggatcgtggcagagcgtttaacgcacgaaatattgatggcctatttgcggaatttgcgggtagctgggatgaagcttattaggataaacacgtttgcagcagagtgcaggcgtgttttttatgatgaacgaattaatagttgacgggtaaactgatttgcgttatattctatcagtggtcggcaacgtaaaaatgagaccacactcatctttgaacttaaatggaggatctcatatgaaaattgcaattattggcgcaactggacacgttggccaagctgtatataaggaagccattgcgaataatattgatgcaacagcgttcgttcgcgatgcaaaaaaggcgcagtcattactgggtaccgatgctaaaatcgttgaaaaggacgcactgacgctaacttacactgatttaaaggcttttgattacgtggtagacgcttttgcatcattaaaggcatatcagcatttagatttggctacgaatttgatcacagccttccgagagaagacagatacaaaactgatctttattattggtgctagcaccctgttgaatgatgctgggcagccaatgattaatgaagttttgaaaaagtacgctggacagccttggattgaggcaccggttcagcaaagtcatgaatttgaatatctaaaatgggtggataacgttgattggatcgcggtcacaccacaggatgaattaaatgatgggccaaaaaccaactacaaaattggcggtgatcagccaatggttaataaagaaggtaagcccaccacttcaactggcaacctagctgccgcaatcgtgcaggaaatggtagcgcccaagcatatcaaacaacgatttagcgttgttgatgcttaataaaacaaatagctcggaaactgcaaagaatggcagtcctgagctatttttagttagttgaatcaaagaaaattgtttcccgttgccaagtcgcaatcagctgatcaatttcactggtttcaaacacgtctttttcaggttcggagaagtttacgataatgttttccattccgggcgcaaagaataatttggccgccacttcacagtcggtgatatataactctctgttatttacacgctgctgtaagaaggccgccaacagttcccgcatatgatccgttccttcacgagtgataggggtgacatcggcttcaaagtcatctttgtaatatagcataatagacatcaaataccagttacgataaaaaatttcaacaaactgatgatagaacaaatgtagtgaatcaatgagcgaaccatcacttttatcggtcataagtttggctaacttgtcaaattcgtccttaatatcggtaattagcaggattttcacaatgtcttttttgccttcaggaaaatagtgataaagggtgctgacgttacgtccgctggcgttaacaatatctgcgaccttcgttttatcgtacccctgcgatttaaaaagatcctttgcagtatctataaatagctgtttcccgcgattatattgatcttgtcgttgtgactttttccccgtcatatcgattctcccccttcttcattaaagccattatacacgaaattaaattaaaataaactcataaagtaatacttgacgagtttgatgaaaggggatacactgtgttcaatgaaggaggttgtgaaatatgttactaattacctgtgcttacggtaaagttgggcgccaaatcgtcccttaccttgccaaaaagggttttgatattcgtgccattgacatgaaccctgatattaagaaacttgaacaacagggggttaaagaaacccttgttggtgatagccgcgatcctaaattcgttgcccaagcaatgaagggtgtggatcaggtgctatacattccaccgcagtttacttatcaagaagctaagatgggacgtatcgcaatcgatgcagctattgatgctaaggtcagcaagtacgtttacttatcctgcatgtatcctaatatgagtacgctcttgcaacaccggatgaaggctaaggatgaacaatacttgctttaccgtgggttcgaaagcggattagattggagtgtcctgcgtccttctacctatcaccaaaatatctttatgaagatgttctatgatatgggtgagtatccaagtatgtgtgacatcgacaagctggtttcatgggttgaccccttggacgttgccgattgtgccatcaagatgctcacggaagacggctacaagtacgctatctatacttgcagtaacgaatccatgacacctagagacgttgcgacgatcatgaccaaagtttctggcaaggaaattacaccaatctccgttcctgaagataagcttgtggaatactggccagattacttcgcaggcagtgacagttttgcaactgagaccttctacgcactgcgtaagacttacaacaagtggggctgggctggtaataacaagcaattgatcgaattactggatcacaaacctcgtagtgtcgctaattggtgtgcccgtcaattagttgctaatgatatcaaacctactatttcagttgaagatactgagaagacgtcgaatagtttcgatttattctaagacttcatgtgaaatagttattaaatgcttataagaaaaggagtgttttataatggctgattcaaaaaaagttgttacgttaattacaggtgctgaaagaggtatgggttttgttgaagctaagaccttagctcaacatggtcagtttgttttcattggcgcttatgatatggaacttggtcaaaagtcggttaaagaattacaagatcaaggattagatgttgctttagtacactgcaacattaccgatcaaaagacgattgatgaaaccatcaagacgattaatgacaaatttggttatctcaatattttaatcaacaatgctggtatttctggccctgaaggtggtttaccgtcagaaacttcagaaaaagatttacggggtgtctttgaaacgaacttcttcgggacggctgcaatgactaaggctgctgttccgctattgaagaaggcttcatatggtaagatcatcaccattaccagtgatatgggttcattagggcttgcaacggattcaacatctatgttctcacacatcaatgcattcccctatcaagcctctaagacagcattgaacgccatgaccatttcatatagtaaagaatttagagacacaaaagttaatattaccgctaactcagttaatccaggtatgactgcaactgacttggtgaacaaggaagagtttgaaaagaatggtgccaaacccgttgaaagtggcgctcaccgtgccattgaattagcgttggatcctaaaaacgatttaaatgggagcttcacagaagacggtggcatcgttccgtggtaatttaaagcatcatttggaaggagcaacacactttatgattacagttacttcagctgccggacatgccggcagccacgttgttaaagcattagtagacgctggtttcgaagttggcgcagctgacattaacccagcagttaaagatttaccagggatcaagcaggctttcgttggtgatttaaccgacattacggtgattgatgaaatcacgaaagctagcgacaagattgcctacattccaccgctgttttccgcagaggaaggtttgatcggtaaacaaatgatcgattcaagtattaagaatgatgtttcacagttcatctttatttctgtgacacacccaatcttaaccacgctcctgcaacacgttgaaaagcgtgatactgaagagcacttgatctatgctggtatgtcaacccaattgccatacacgatcttgcagccaatgcactacatgcataactttgatcctaagcgggtccacgacacggggaagtacgaaaacttctacgcttctgatggtaagttgtgctatgttgatcccttggatgtcggtgaagttgctgctaaagttgctaaggacccagagacttacaacaaggcaaccttcgaattagtcggcaccaagaagacttatactcctcaagacttagtcgatacttacaacaagttgactggtgagcacgctgttgccacccacattgatttagagaagttcttggacgagaatcacattaatgatctttatatgcgtcaagcatttaaacatttgtctgatacttattctaagtggggcttggatgggaatccattcgttcttaagacgttacttggacgtgaaccaactacctttgaagagtatttgaaacgtgaaattaagtaagcttaatctgtgttagaaaaggacggctcttaaaaagaaccgtcctttttgctatcgtgatttaagatattcgcaaaccttcttaaagctttctcaacattctttttggcttcctttaagttctgaaaactaaactgaatgtagtttcaaagataaggagtgtgaaacgtatgctacttgaccacgattctaaaatgattaacattgttgccgcacagattaccaaggtgttttatccctttgtagtcgcaaaaactgaaaacggtgactatctccatatcaatttatcagataaagaaatcgaagatcccttattttgggaggaactacgtagtattttaaatgctaaactttgggtaccagttggtcgaaaatatcaccagttattagacaatggctggctagtgtcggaacctcaaagagaagacggctggttagtatcggaaccttaaataaacggcaaattacaagtttaatccgaacaagcccggaatctttcaatggcagtctgttgatgatgtatttttaatggtcgttgattaattagttcaagtgctgctaggatctcatcagtcgttacttgcagtcgtttacgtggataaaattgagttttttcccccccttttttcccccctcccgccctccaatgaatacttgctatggatcgacggatctagctggtgttactatctcatgaaaagtttggatcgtatttaaaatgtgattccaatgttagcgaacctcgagtatcccgcatggtctgcagatgtgtacacgacagcggatgatacgtacaaaatggccctacataacctaccctttgtgtatcgactacacgcctccccctgttgctctcaaggcccctgtatacacttggatccaaacccccagtctttctcttccccttcatgatctttttttccccccttcactatcagtaatggattttacttggggaccgaaccgataggcccccataaactgccaaaggcggtgttttagagcctagccgttctattaggggctttgatggcccatagaagtcgggtcttacgttctacgaatgtaaccagacatgatcgtgactcacttcgactgaaagcacgtatctacttcccaatgaccaaaagctaaccgttgattaacagttgttggccgttgttcgatggaagtcccactgttaatttcccacgattttcgctcactcggtgctggcggacattccgattggggtagatcagtcaattgaagggagccagccacgattaagccaattataaattgacgcagtgctcaagttataagcggccgcatggtttctggtgaccaggttaatctaagtgattggtaattaaagtcgctaatgctgccgtcagcatcgaacgacgaccgcaattcgccttttgcgatctgcatcttgctgagctaattcggatcataaggtttaacccggtcaatcatagctaatcgtagctttggcgacgcctaaggcgtcagccattactggtaagatttatcccctctgaccagttgtgctagtgcgccgctgaaaacgtgataaagtagatgtacccaaagtaatcactccctatattggttggaattagctactaccattgtaagtgattgctttgggctttttaatttctgttcggattaattatagaatttgccaaacaaaaaaagactcttgaaacgtgttgttgggtgaaattactgataacacgttttttggtggttaaaagggagtttaattaaagtaatacgacctggttagtgataagctagaaacacgttatatgctataatgcctttaaatttaaaaccaagaattatagtgacaaccatttggactgatatcatcagttctgcaaaataaggttagagtggagggatcattatgaaactaagcgtgaagaaaacttcggagttatccgttcctgaattactggaaatcacgaaagcccgtatcaaggtgttcgtggtggaacaggagtgtccttatcaagagattgatgatcaagatgatgatgctatccacatgatcttacgtgttgatggtgagttagctgcctatacacggattattcgtaattctagcagtaattatgtgagttttggtagagtattggtagttaaaaagtttcggaaacagcacttaggccgggaaatagtaagtgccacaattgaggaaatcaaagaagatttcccgggaaatgatattaaaattgcggggcaaagctacttactagatttttacaagtcttttgggtttaaacctgtttctgacgtctacttagaggacggcattcctcatgttgatttagtgcttaagtactagaatagggccacgtgtatgagtgttattacagcgtatatagcagagcagccagctgaatttcaaccgcagctgaccagcttatatcgattactaaagggtgttttaccagatgcaaaagaaaaaatttcgtatggtatgccggcctttattcaatctcaaccgattatttattttagtgccaataagcatcatattggcatctatcctaccggtgagggaatttccttttttgcagctgaattagccgggtatacaaccacaaaggggagttggcacattagttataatgagccgttgcctgaacagctgatcgtgaaaatgacacagcatcggctggcgtttgtgcaacaaggttaagtggtgttttggaggctttagattggaatcaatagaaattcgacatgcccataagaacgaaaattttggtgccattagacaggtttattatcaaacttggctagcaacttatcggactcagttaccaaattcaattttaaaaaagttaacgccaaccacatggcatccggaacaacgatggcaagacatgcagttagcgtttaataatgaaggcaagatagttggtgtatgcacttacggaccagctcgcttggcttctttttctagttggggagaaatatattcgatttatgttttgcccgattatcagcatcttggtattggttcaaaactaattgatcaggccttagaagcaatgagttcaaaataccagcacatctacctcgaagtgttgtatagcaataccattgctaaacctttttatttaacaatgggcttttcagaaaccagattaacgcgttcgaggcaagtccctggaggaaaattaaaaacggtgattttcttacgataaaaggggcccatcaactcattatttctctaaatggcgggtcgattctcgttcgacaattttgaagggcaagtactgtttttgaatggtcctaccatcagtcaaaaacttgataccagctagtcccatttcgtaaaaagattgactaatactggtaatccgtggtcgtaccatgtccacgatgtctgtaccatcaaaactgacaaggctgatatcgtctgggactttaagacccgtttctgtaatggcatttaacatgccgattgcggtgagatcactggcgcagattgcgcaggtgatttctcgtttcttagcatatacttgccagtttttttcaccgtcatcatacgtacacgttccgtactgaatccaatcaggttcgactttcaaatgatgatccgacatgcattgtaaataacctgcaattcgctgattaatggacccggcagtgggaataccagcaatcgcaatcttagtgtgtcctttgtcaatcatcagctgagttgctgcataacccatctgatagttgtcagatgtcacgaaggggatggccgtatccttcacggaagtagacaggcaaatgctaggaatgctggtgctgttaagcgtcgtcagtacgttatcatcaagttccagagagaccagaatgattcccattacagctcgttcgatcaccgtcttaatggctttaagctgagactgttcatcgcggtttccggcatggaggatgaacacgttaaggtcatctgaagcagcttttgattcaatggcatcaatgatatgttcactgaaattggactttgtattggagacgataacggcaacgatgcggcttttttgattgaccaaatcggccgctgaagtatttcgcacgtagcccattttattggcagtttcggtcacccgtttaacggtcgcactgctatgctgcccttttttatgtaagatacgtgaaacagtggccacggatagttgagtggccttggcaatatctttaatcgtgactctattttgtaatgtcatgtgatcagtcctcaaaaaagattctcattttattatcgaccttcagacctagaaatagtaggggtttagtgtaattcttatttcaaaaaataaaaaaagttggtttaaaggtattgtaaacgtttacagaaggaactacaataattgctgtaaacgtttacataaacttttttgggaggtgtttcttgtggaaagttcacaaggaagcttaggtactgttaagccgcatgtaacaagtaagactaaagcagagaacgaaaagaaacaaacacattccctaccaaatattaacttaaaaacgatgttcgccattacctttggtttttgtggggtcaacatggcattttcactacaaacatcgcaaatgagtcgaatttttcaaacgattggtgctgatccaactaaactcggctacttcttcatttttccaccgctgattgggatgatcgttcaacctatcttaggtaagttttcagatggtttctggtcaccgcgatttggccgtcggatgccgattttaatggtggccgcaccacttgctgctatcgtgctggttctcctgccaaatgccggatcgtttggtttcgggtttgggtcactggctgcgttgctattcggttctattgcaattattttaatggatctttcaaataacgcatgtatgcaaccattccggatgattattggtgacatggtcaacgaaaatcaaaaggataaggcttggtcatggcaacaagccttcagtaacgttggtggtgtgttagctaacctatgcccattcttcctaacttggattggggtcgctaacatcgccaaacgtggggttgtgccgctatcagttcggttgtcattctacattgccgctattgtgttactcgctacgtcaatttacacaattgtatcagttaaagaatacgatccaattacttatgcaaattaccataattttgatcctaaagaaaagaagaaaaagaagtcatattggacactgatcaaggaagcaccaagtactttctggcaagttgctattattcaattctttgcttactttggtattcaatatctttggacttatactaccggtgcaattgccaaaaacgtttggcacactgctaatgccacttctgcaggttttcaatccgcaggtaactggtacggtgttttaacctttgttcaatcagttgttgggattctctacgggttcttagttctttcacggacaagtcaatacaagcggaagttctggtaccgaattggtttggccagtggtggtttgggcatgatctggactgcctttacgcataaccaatacgtattgatcatcgcctttgttttgattgggatttgtttcttaaccatgcacactgaaccatttgctatttttactacgacaacagatggtgctaacgatggtgcttatatcggactgtttaacgtctttatttgcttgccacaaattgttgcatcaatcagcagcttcgtgattttcccaatggtcggcgattcaatgccaacaatgatcgttattggtggtgtttcatggttaatcggtgctgctttaatggacattatcaaagttgaaaagaaaacggcataatatttaataagagggatgagatagacatgacgacagattcatttgattttactgataacaaccaacgcgttcaggtggtttcagccaataaaagcctgactttctcagttgtgaaacccgagattgttcaagtgtttcaggattatggtaaaagcacgcattcatacgctgtagaaggcgaaaaaaccgtctcaacaaagtatgccgtggctaaagatggcgatgtcattaccatcaaaacagatgcgttgacagttaaggttgatcctcagctgcacgtagatgtgtatgatcaagataaccaaccattagttattcactataatgggcagcgtgagtcaattaatcaaaatattgatgctgcacataaaaagatcgttcgttctgagggtcacgaagtcgcagcgattgatgaagcaagtaacacttactatgaagtgcttaaccaattagacgatgatgaacagttttacggcttaggtggcaagactggcttcttgaacaaacgcggttacgagtacgataactggaatactgatgaacctcggccacacattgaaagttttacccacttgtacaagtcgattccggttctatttgggttgaagcagggccatccatacgggctgttctttgacaatacgtatcgcagtcactttgatctcggtaaagaaagcgacaagtactacgtatactcagctgatgacggtaacttgaattattacattcttggtggccgtaccttaaaggatgttgttgctaattacacgtatctcactggagttgtgccactaccacaacgctggatgttaggttatcagcaatctcgctggggttacagcatggatcaaagtcgtgtcgaagaaattgtcgataagtttgaacagtatcatttaccgcttgaagccattcactttgatattgattacatgaagggctatcgggtatttacctgggatacagataagtttgctgatcctaaagcattcttaacctcactacggaaacgcggtgtccgggtgattcccatcctggaccctggtgttaagcaggatgacgattatgacatctatcaagaagggctcaaaaaaggttacttcgctaagaacaaagatgggtcggtttatatcaaccgcgtatggcctggtcaatcagcctttccagatttcggtaatccagaagtccgtcaatggtggggtaagcactgcaagttcctgttagacaagggcgctgctggtatttggacggatatgaacgagccagcaacctttgatggcgatatgccggatgatgtggtgatgtcggatgaaaatcaggcttcaacatcgaaaatgatgcataacgtctacggtcataacatggctaaagctacctataatggaattaaagacgctacaggtaagcggccatatgtgatcactcgggcagcctacgccggaacacagaagtattccacggtctggacgggtgataatcagagtctttggcaccatttgcaaatgtcgattcctcaactatgtaaccttggaatgagtggctttagttatactggaaccgatattggcgggtttagtgccgatacgacggcagaactgctcactcgctgggtcgaagcagctttattcagtccactgtttagaaaccacagtgcgttacaggttcgtaatcaggagccttgggtctttggtaagcaggtcttagacatttatcgcaaattcttaaacttgcggtatcgttttatcccgtatctgtatgattgtttccacaatgagacgcaggacgggttgcctgttatgcgtgcgctagtactgaattatcctgatgataaaacggttcgcaacatgaatgacgaatacatggttggtgacaatattttggttgcaccaatcgtgcagcaggggcaaaccgcgcgtgcagtttacttgcctgaagggcagtggatcgctttagataccggtgttgaatacgctggtaaaaccacgattttggccaatgtcccaatcgataagctgccaatcttcatcaagaaggacacactgatgccatgggggcaagaggttgaacatctctctgatcaaccggacgcaagcatgaccttcagattatttggtgatgctgctacttatacccactatcaagatgatggggttgattttaagtatcaagacggtgaatataacgaatacactgtaaagacaagtgttgcaggtgattgcagtatcaatcttgctcaccatggttatgatggccaatacaagacgattaacgtacagttgaatgataaagttgtgatatttaagtatgatgataagactgccaagtatgttgcggaaaaataagagtgtgataaaacttggtagattataggatttaacataaataagcactgatcccgtcaaatcggatgggaccagtgcttatttgtgttttcatcagtttcaataaatagctaaattagaattattatttttttgaaaatgatgaaaattagcagctattttaaaataatgattcattcagaaagttatcacatgttaaataaatgagaaaatccactaaaaattaatataacttaattgtcgtcgtgttaattagtggttgtgcaaaaaaataccatttttactcttggataattgaaataataagctagttattaaaagcggtatagatccactgaacaacggattttcctttaacactcactgcactagaaggaacggtcggctgcttacagtcaacggtatagatccatccacgagacccagtggaatcagctaaattgctaatgttattaaaataggggtaaccgttaactggttgagaaaagtaagcaatatcgttcttttgaaaatagcgcttagacacgtcaaaaacagtgtcactgtcccgccaagaaacatcacgtggaatcgtaaagaccttttgaatggacgtgttttggtgacggtattccgagggtgttaagccggtgcgttgcttgaaaatcttggtaaagtagctagtttgctggaagccagtttgattagcaatgtaattgattggtagctttgaaagtgccagtttttcacttgcaattgcaatttttcggtagttaatgtagtcgataaagttaacatccaagatcttcttgaagattcgactgagataggagggcgatagaaagacttcttgtgccacagttgatagggaaatcgtgtggcgaatgttcttttcaatgtactgaattgcagcgtcaatgctttggttgacgccgtcgtcttcctcttgagatgaagctttcggatcattttctgtattgtgatacttgttccgatcggttttgactggctgagttgtgatttgagtaccttcagctgttgtagcccgcaagaaagtatcaaagtagcgaatctgagagatttgttccgtgtccagcgcgtcccaaaccgaaactgtaatgttaaattccggttccagcagttggttgaagatgttttctaggtagctacgagataggtaaatacgctgttgagaaacgttgaccgagttacaaatgataaagccccacaaccgatgttcaatggtcaccggaaagatggcgtaaaccttgaattcatcaaagttaatgttttgttgaacttcgttaagacccgaaaaaacagtgttatctttgaggagctgttcatctaatgtgtagaaaacagtatcaatctgagtgatgcctgaaaacgttgcaacagccccggcaagcgtgcggtagtcctctttttttagtggatagtcaatcataaaggatcctcctaacgagcatgatagttctttcacatgtatctcatgaaaacggtaagcgctatcaagtgctctatatttgattctaaaataattgtaatggtaattcaacattatttttaaataaatttgtattattttacactaatacaacattcttttgaaagcgtttactatttttgacatgggaaattacacttgcttaaaatatcacaaataatatcacctataatgtaagtgttttcaaaactaattggaaatgcgtagaaattagataataacgatatttagcggttactgtctatcattactgcagttccaaaatttaggaggaagctctaatgaaccaagaagctttaggattaatcgaaacgaaaggtctggttgcttcaattgaagcagccgacgcaatggtcaaggccgcaaatgttgacctggtgggccaagaaaagattggtcatgggttagttacagttatggtacgtggtgatgttggtgccgtaaaagcagctgttgatgcaggtgttcaagctgctgaaaatattggtgaagttctatctaactacgtcattccacgtccacatagcgatgttgaaaaaattcttccagatcctaagaaactctctgctgaatagtcagaatgtctgattacgataggagattagggttatgagtaaggataaagacgcgttagttgagcaggtaatgggtgagcttctcaaaaagggaatctcacttaaagataaaaatcagtcaaatgcatcgggaggattcgaaatgaatgattttttaaactctactagtgttgtccctgagtttgttggaactcgtgaaatcggtgacaccattggtatgtgtattcccagtgttgacccaactctgttagatcaacttcacattacaaagcgttactctgtacttggtattcttagtgctcgttcaggtgctggtccacatattatggcgatggatgaagctgttaaggcaaccaatacagaagttatcgatatcgagttgccacgtgacacaaagggcggcgctggtcatggttctttgattcttattggtgggtatgatccttcagatgttcgttcagctatcaatgtagcattggataacttgagccggacattcggagacgtttataactctgctgctggtcacttggaattacaatttactgcccgtgcttcaggcgcctgccatatggcatttggtgctcctgaaggcaaagcttacggtttgatttgtggcgccccttctgggatcggtgttgttatggccgatactgctattaaaactgctggcgtaaacgtactttcctttgcttctcctgcacatgggacaagtttctcaaacgaaggtatggttcacattagcggtgattcaggtgccgttcgccaggctgttatggctggtcgtgaagttggcctgaaacttttggcacaacttggcgaaaagccagtaaatgattttccatcatacattaagtagcagggaggaggaacaatattgaaacgtcaaaaaagatttgaaaagttagagaaacgtccagtacatctagatgggttcgttaagaactgggacgatgaaggtttagttgctcttaatggtaagaacgacccaaagccaagtatcaagattgaaaacggtgttgttaccgaaatggatggtaagaagaaggaagacttcgaccttatcgacaagtacatcgccgaatatggtatcaatctagataacgctgaaaagactttaaacactgattcagttaaaatcgccaacatgatgtgtgatcctaatgtttcacgtgatgaaattattaaatatacgactgctatgacaccagcaaaggctgctgaagttatcagtaaattaaactttgctgaaatgattatggctacccaaaagatgcgtccacgtcggacacctatgactcaagtccacgccactaacactttggataacccagttgaaattgctgccgatgctgccgaagctgcacttcgtggggttcctgaagaagaaaccactactgctattgctcggtacgcacctatgaacgccatttcaatcatggttggtgcacaatcaggtcgtcctggtgttatcacccaatgttcagttgaggaagctgatgaattgagtttggggatgcgtgggtttaccgcctatgccgaaaccatctcagtttatgggactgaccgggtcttcactgatggtgatgatactccttggtcaaaaggtttcttagcttcttgctacgcttcacgtggattaaagatgcggtttacttcaggtgccggttcagaagttatgatgggctacactgaaggtaaatcaatgctttaccttgaagcacgttgcatctacattaccaaagcttcaggtgttcaaggcctgcaaaacggtggtgttagttgtatcggtatgccaggtgccgtcgtaggtgggatccgtgaagtcttaggtgaaaacttactatgtatgtcacttgacgttgaatgtgcttctggttgtgaccaagccttctctcactctgacattcgtcggactggccggatgattggtcaattcatcgccggtactgattacctgtcatcaggttatgccgccgaagaaaacatggataacaccttcgctggttcaaacatggatgttttggactacgatgattacatcactttggaacgtgatatggctatcaatggtggtatcatgccaattaccgaagaggaatctattaagattcgtcacaaggctgcggttgccattcaagctgtctttgatggcttaggcttaccacagatcacggatgaagaagttgaagctgcaacttacggcagtaattcaaacgacatgcctaaacgtgacatggtgcaagatatgaaagctgctcaagacttgatgacccgtggtgttaccgttgttgatgttatcaaggccttatatgaccatgatatcaaagacgttgctgaggctgtgcttaagttagcgcaacaaaaggtttgtggtgattacctgcaaacatccgctgtcttcttggatggttggaagtgtacttcagctattaataacgctaacgattacaaaggcccaggtactggttaccgtgtatgggaagacaaagacaagtgggatcgtctagagaacgttccatgggctttggatcctcagaagttggaattctaaccagtcaggtcgaagggaggtaagcacagtgagttcagaaatcgatgaaacattgttaagaaatattatcaaaggcgttttaaaggaagttcaagactctgatacgccaatttcctttggtggtcaagatacagctacagccacaaccccagttgctggtgcccaaaaaggtgccgaaccggaaaagaagttggactggttccaacacgttggtcttgctaaaccaggtttgtctaaggatgaagttgtgattggtgttgccccagcatttgctgaagtgttaacgcaaaccatgacgaagatccagcataaagacatcttacgtcaagttatcgctggtattgaagaagaaggtcttaaggcccgtgttgttaaggtttatcggacttcagacgtttccttcgtatctgccgatgttgacaagttgtcaggatctggtatttcagttgccattcaatctaaggggacaacgatcattcaccaaaaggatcaagcaccgttgtcaaaccttgaattgttcccacaagctccagttttgacattggacgcttatcgtcaaatcggtaagaacgctgcccaatatgcaaagggtatgtcaccaaatccagtgccaacaattaacgaccaaatggcccgtgtgcaatatcaagcactttctgctttgatgcacattaaagaaactaaacaggttgttgtcgggaagcctgccgaagaaattaaggtaaccttttaattgaggaggatttattaatatgagcgaagtagatgacttagtagctagaattgctgctcagctacaaaaaagtggaaacgcttctggtacttcaactaatgctggtacttcaaccggttccgaaaaggaattaggtccagatgattacccactgtaccaaaagcatccagataaaattaagacgccaacgggtaaagatgttaatgaaattaccttggaaaacgttgttaacggcaaggtagatgccaaggatatgcggattacacctgcaactttaaagttacaaggtgaaattgctgctaacgcagggcgtccacaaattcaacggaacttccagcgggcttctgaattaacttcagttcccgatgatgtcgttttggatttatacaactcattacggccattccgttcaacgaaacaagaattgttagataccgccaaggaacttcgtgacaagtacaacgcacctatctgtgccggctggtttgaagaagctgccgagaactacgaagttaacaagaagttgaagggcgataactagttaggggtttttagtatgacacgtgtaattggtgttgatatcggaaattcctctacagaagttgcacttgctgatgtgtctgacagtggtgaagtaaatttcattaattctggaatttctgaaacaactggcattaaaggtaccaagcaaaacttgattggggtacgtaaatctatccaaatcgttttgaaaaagtcgaatatgcaaatttccgatattgatcttattcggatcaatgaagcaacacccgttattggcgatgttgcgatggaaaccattaccgaaacggtcattactgaatcaacgatgatcggccacaacccaggtacgcccgggggtgtcggtaccggttctggttacacggtaaatttacttgacctgttgaaccaaacggataaggaacgtccctatgtcgttatcatctcgaaggagattgattttgcagatgctgcaaagctaatcaacgcttatgttgcttctggttataagatcaccgctgccattctgcaaagtgatgatggtgtgctgatcaataaccggttggatcacgagattccaatcgtggatgaagtttcgcagatcgacaaggtaccgctgaacatgcttgctgcggttgaagttgcaccgcctggcaaagttattgctcagctttctaacccatacggcattgcgacattgttcaaactttcttctgaagaaaccaagaacattgttccagttgcccgggccttaattggaaaccgttcagccgttgttattaaaacgcctgcaggtgatgttaaagcccgtgtgatcccagccggaaagatcttaatcaaaggtcagccaaatggccgtggtgaggtcaacgttgcggctggtgccgatgccatcatgaagaaactgaacgaattcgacagcatcgatgatattaccggggaatctggtactaacatcggtggtatgcttgaaaaagttcgtcaaacaatggctgagttaaccgataagcaaaacaaagacattgcgatccaagatttattggctgttaacacgtctgtcccagtgacagttcgtggtggcttagctggtgaattctcaatggagcaagccgttggaattgctgccatggttaaatccgatcacttacaaatgcaagcgattgcagacctcatgaaagacgaatttcacgttcaagttgaaattggtggtgctgaagctgaatcagcaatccttggtgccttaacgacgcctgggacgacaaaaccaattgccatccttgacttgggtgccggttcaaccgatgcttcaattatcaaccagaaagatgaaaaagttgccattcacttggctggtgccggtgatatggttaccatgatcatcaattctgaacttggattggaagatccatacttggctgaagatattaagaagtatccgttagctaaggttgataatctcttccagttacggcatgaagatggtgccgttcaattctttgaagatccattacctgctgatttatttgccagagttgtggctgttaaaccagatggttatgaaccccttccaggtaatttgagtattgagaaagttaagcttgtacgtcaaactgctaagaaacgggtattcgtaacgaatgcaattcgtgccttacatcacgttagtccaacaggtaatatccgagatatcccattcgtggtcatcgtcggcggttctgccctcgactttgaaattccacaattggtcaccgatgaattatcacattataacttagttgcaggtcgtggtaatattcgggggattgaaggcccacgaaacgccgtggcaactggtttgattctttcatatgcgagcgagaagaggggatagtatggcttttgattctgaacgtccgtcaattattttggcgacaccaacgggtactaatggccaacttccagcagttcttgaaccaatgcttaatggtattgaagaggaacagattccttttcagattctcgatatggaaggcgattcagcagttgaacgcgcctataatgcttcagtcgcttcacgattatcagtgggggtagggttcgacgatgcgcacatcattgtgcattacaaaaacttaaagcctgaaaatccactgttcgatgttgccatcacagatgctgcatcgattcgtaaagttggcgcaaacgccgctcgactggtcaaaggagttccattcaagaagtaaagacaggtgactattttatgcaatcaattggataccttgaagtagaaggtcttcctggcgcaattgtcgcggcagatagaatgcttaaaacagccgatgttgatcttaaatacgttgaaaatactaagggcggtggctggattacagtctctgttacaggcgatgttgctgctgtacaagcagccatcgatgccggaatcggtgaacttggcgatcatgtttactgttcagacgttattgccaaccccgcacctggtattgaaaccttaggtaagaacgatgcaattaagggcaatcatttagatgacaaaggaccggatgatcctaaaggaccagacgatccaaagggtccaaacgatcctaaaggtccagatgattcacagggaccagataatggtcctgccccgaaggacacccctaagccaaaagatgattcattggcggcatcaccggtggaagaatcgaccaatacaatcgatcaggctagaggagcaaatgctgctcctttagctttgtcaaagacaaaaacaccagatgccaagcaaaaggaagcaccaacgtcaggaaagtcagcttcggctaagacttccgacaaaaaagaaacaaagaaatttacgtgcaatttgtgcgaagatcccgcttgcccacgcaagatgggtgaacctcacaagaagtgcattcactacgaagaattaaaaggcaccaaaaaataggaggaattgaaatgaacaacgcattaggaatgattgaaactaaaggtctcgttgcatctatcgaagctgccgatgcaatggttaaagcagccaatgttgtcatggttggtcaagaaaagattggtagcgggttagttactgttatggttcgtggcgatgttggtgccgttaaggcttcagttgatgccggtgttcaagccgctgaaaacattggtgaagtcttaacttcattcgttatccctcgtccacacgctgaagttgaaaacatcctgcctcaaccaaaggaaactaaataatcaataattgaaaaaagggtggctgttaatttatggaattaactgatgagaaacttagacaagttattaaacaagtgattgcggaggaatgtgatcctaaccgcgttcaggttagcgtttcaaaccaccatattcacttgactgaagaagattttaagacgttatttccacacggcaagatggaagcgtttaagccattgaaacaacctggtgaatacgctaccgctaacgtggcaacgattgtcggccctgctggtaagattgaacacgttcgggtccttggcccatgccgttcgcattctcaagttgagattgcccgttcagaagccatcgctattggtgttgatgcaccgattcgcctttcaggtcatttggacggcacaccttctgttaaacttgtgaccccagatggtcaagttgacgttcagggtgtgattgttgcaaagcgtcacattcatatgagtgatgatgatgcaaagcgtttgggtgttaaactcggtgatacggtttgtgttgagatcatgtctaaagatcgtcggacaacgtttaacgacgtgattgcccgtcctcgtaaagactttgttcttgaaatgcatatcgacactgatgaagccaatgccgctaatgttggcatggacagcaccacttacggccggatcatcgttccggataagaaataacatgaatttataagggttggtggccaacatggatcatctaattgagcaagtactgacgaaaatcaggcaacgcgaacaccaatctttcgaagtcgattatcttgatcggactttaccacctgatgataaagtttttaccgactttgcaaatgtatcgattaatgatgtcacaatcgacctgttaattgaactttatcgggtgaatacgaccaattcttggatccactggattttgcaagggattagttttcaagtaaacttcacgtttaacattagtcaatacatggtcaactttattcctaagaagatgctgttggattggccggtgaaatttgttgttgacaaagaacgtcccgtggttacgttcaataaacaaactgtcagccggggtgatgttgcaggacttcctgataaggcggtcttagtcgttaccgacgcgcagtctttaacaaccgaagccaaggaagtcagccggttaaagcagattactatacagattaggactgatgaagattgtatatggcaaaagtagttggaagcgttgtctcaacgcaaaaagatcgatcactggtcggcagaaagttaatgattgtgcagccggtaaactctgatggtaaaccagtccgtcatgaagaagtggctgcagacagcgttggagccggaattggcgagtatgttttactcgttcgaggtgccggtgcaagacgcgcgactccagaagaaatttccaaggatgtcaacgattgctcgatcgtcggcattatagaccgatttgataagtgataaagaagggataagctaatggccatttatactaagggtggcgataaaggcaacacaagtttgttcgacggtaaacgtgttcccaagaactccctgcgagttgaaacctatggtaccttcgatgaactaaacgccaatgtgagtttagctgacaagttttgtcttgacccagaaaaccggaagatcctgcaacggatcgagtaccggatgttcttcctccaaggcgaaattgccactgaagagccagaaaagttccggcagcaaagtacgatcatcaccgatgaagatgttcattatctggaatcaataattgacaaatacacagctgaattgccaaaggtaacgtcctttatcttacctggttccagttgtgcaggtgcacaattacatgtttgtcggacggtttgccgtcgcgccgagagacagttcgtttcgttcatggcagaaaatgaagttcgtcctgaactagaacggtatgttaatcgtctttctgatttcttctacattatggctcgttctgaagaccatgtggcagagaatcagaagatcatcaacatggttgttgatcggtataaaaaggcaatggaggaatcctaattatgaacaaagaacaaattagtcaaatcatcagtgaagtcttagctgataatggcgttcagactcctaaagaggataaaagcaacgtttttgataagcacaagatggaacgtgctatcgatgccgggatcgccaaagctaacgaacttaaagttggtgtgacatttgcgattatggattgcaagcaagtggttcaaatgtcataccatatgcccaacggaaatttagttggtacgtttttagcacctaaaaaggcttggtccgctattgcaatgaaggaacctactaaggatatcagtaaagatattcaaccaggtggacctttataccaaatggaaacaatgctggatggtaaattagtatcattcccagggggtattccattgacttgcgacggtgagatcttcggtgccgttggtgtaagcggtggtttgattgaagaagatcaagctatctgtgaagctgtcgtaagcgaatttctaaaggagagtaactgagtatggcagatcaaaatattgaagcagaaatcagacgaattttacaagaagaattaagcggtaacgcttcatccagtgatactggtacaacgaccagtcaaccagatgggttaggcaacgggatcttcaccaacgtgaacgacgctattgcagctgctaagcaagctcaggaaatcttacaagataagccacttgccttccgtaaaaagatcgttcaagcaatcaaagatggtttcggcccatacattgaatatatggcaaagcagacccgtgaagaaactggcatggggactgttgaagccaagattgctaagttaaagaacgcactctacaacacaccaggtgttgaagtactggaaccagaagttgaaactggtgacggtgggatggtcatgtatgaatacacgccattcggtgttatcggtgccgttggaccaagtacaaacccttgcgaaacggttctgaataactccatcatgatgatatctgccgggaacactgtgttctttggtgcccacccaggtgctaagaatatcacacgatgggctgttgaaaaattgaacgaatttgtctacaaagctaccggattgaagaacgtgctggtttctctggacacgccatcaattgaatccgttcaagaaatgatgaaacatccagatattgcaatgctggctgttactggtggtccagccgttgtacaccaagcattaacgagcggcaagaaggccgttggtgccggtgctggtaacccacctgcaatggttgatgctactgctgatatcgatttggcagcacacaacttgttcacctcagctaagtttgacaatgaaatcctgtgtacttctgaaaaggaaatcattgctgaaagctcaatcaaagatgaacttctgcaaaagatcgttgctaagggtgcttgcctactgactgatcctaaagacatcaagcacttggctgatatgaccatccaagacaacggtgctcctgatcggaagtacgttggtaaagatgcgacattcattttggatgctgctggtatttcatacactggcgatcctaagttgatcatgatggatgttgacaaagacaatccattagttaagacagaaatgttaatgcctatcttgccaatcgtcggctgcccagactttgactctgtcttagccacagccgttgaagttgaaggtggcaatcaccatactgcttcaattcactcaaacaacattgaacacatcaacaaggctgctcaccggatgaacacctcaatcttcgttgcaaatgggccaacatttgctgcaactggtgtcggtgataacggctactacagtggtgccgctgcgttgacaattgctaccccaactggtgaaggaactaccactactaagacttttacccgtcgtcgtcgtttcaactgtccacaagggttctcacttcgttcttgggaggtttaatttatggaagagttcaaaattccaaccaaggtcttctctggtaatgacagtctaacttggctgcaaaacatttcaaataaaaagattttaatggtgtgtgacgccttcttacctgggacaccaacacttgatcgaatcaagaagaatgtcgaaggtaaaaatgaagtcaccatcttctctgatgtgaagccagatccacctctggaaaacatcatggctggcgttgaggtcttcaataaagtacaacctaacgtggttatcggtattggtggcggttctgctattgatactgggaaagcggttcggttctttggcgaaaaactcaataagtacaccatcgatttattcgttgctgtaccaacgaccagtgggactggttccgaagttacacaacatagtgtgttaaccgatacggaacatcataagaaagcaccaatcatggaagacagtattatccctgacgttgctttgttggacccacaacttgtgatgacggcacctaagagtgtcagtgcgttctcagggcttgatgtcttgacccactcactggaatcactagttgctcaggattcaaacacgatcaccgatgccttagctgaaaaagccgctagtgttatcttgcataacctagttgaatgctatcgtcatggtgataacgaagaagcacgtaaggttgtccatgaagcttcctgtgctgctggtatggcctttgccaatgccggcctcgggattgcgcactccattgcccaccaattaggggctaacttccacgtgccgcatggcttagcatgtgctatgatgttgccacacgttgttttatacaacgcaagcaagtcagaatttgctttgcacaagtacgctgaagcctttaagaagtctggcttagtttcaaacagcatgagtgatcgaatcgcagttaagcgtttagctgcccagattcaacacatgatggttgaaatggattgcccacagacgctgaagtcatttggtgttgatccagctgaagcagaaaaaatgtgcgatgtcgttgtcgatggtgctaagaaggatgggactttccctggtaacccagttgtgccttcagacgaagacctagctgcgttatataaacaagttattaaataagatttagagaggaagcacacctatgtcacagaaaatccttgccatcaatgctgggagttcttctttgaagtttaagctctatgatatgcccgaagaagttgtcctagtaagcggattggttgatcgtatcagtcatgaggacgctgtctttacctataagattggcggtcacgatgataagcatgaaacggtacaaccggtcaaagaccacactgccgctgttcaactggtgattgacgcacttctaggaagtggactcattaaagacaagtctgaaattatcggtgttggtcaccgggtttcacacggtggacgttattataccaagtccgttgagatcgatgacgatgttgccgaaaaaatcgacgaattgtctgttctgtcaccattgcacaaccctgttaacctgttaggtattcaggcctttgaaaaattattacctgatgccaaagaggttgcagtctttgatacttccttccatagcacgatgccacgtaaggcatttatgtacgcgcttccttataaatattacacagaagatggcgtacggcgctatgggttccatggtcaatcacaccaatatatttacggcgaggcaactcgtttattgggtgaacaagcgacaagtaaattgatttcttgtcatttgggtaatggggcaagtatctgtgccattaaggatggtaaatcagttaacacctccatgggctttacgccgttggctggtctcgtaatggggacccgttcaggagatgttgatcctgaggtgttaccattcttggaagaaaaacaccatctgaattctgaagatgtccgcagcatgttgaatcatgattctggcttaaagggcttgtctgacgtttctaacgacgttcgtgacgtccttgatgctgagagtcagggtaatgaccgcgctaagttggcgcttgaagtttacgtccatcagattcaagaatacattggcagttacaccactgatcttgaaggtctgacaacgttagtctttaccgctggtgttggtgagcattctgcaccaatcagacaacgtgtttgcgaacggcttggctaccttggcgttaagattgacgatgctaagaaccaagcaaatgaagtagagattgaagccgatgatagccgtgttaaagtgatggtcatcccaactgatgaggaattgatcattgctcgcgatacgcaaaagattgttggttaaaacagtcgtgacgaagggggttcagtaatgactaggaatattgagcgtacgattcaagaatacgtcccaggtaaacaagttacgctggctcacatcgttgcaaatcctaccgaagacatttacgagaaacttggtattcaaattcacaaaaatgcgttaggaattttgacgattacgccaagtgaagcttccattattgccggcgatattgccaccaagtcaagcaacgttcaattaggattcattgatcgttttagtggctctgttgtgatggttggggaagtttctgaggttgaatcagcgttaacacaggtgattgagaaattgcacacgttacttggctttgatattcctgacattacaagaacttaagtatggagtggttatatgaaaattgatcaaatattcagtccatatgaacttaacaagcgtgtgacgcttcgtaatcgccttgttttggcgcccttgaacatgcaatcatcgttatttgatggatctgttagccttaacgaccttaagtttcataaggcacgagcaaagtacgttggtctagatgtcatcggatcggcttacatttcagactcagcaaacactgcgtatggggcgattagcgttgccgatgacagtaaaattgatggtctgaaaaagctcgcgacagtgattcaccaaggtggcagtaaagcaattctgcagctggttcatgctggtcgaatgaccaatgaatacgtcttaaaaggcgctccggtatttgcacccagtgaagttagggctgcacacggtgaagttgatctaccaaaagcgatgacaaaagcagatatcgaaacggtgattcatcagtttgaagcagctactgttcgcgcgattcaagctggttttgacggtgttgaactgcacggggcaaatacctttttgttccagcaattcatgtcaccgctgtcaaatcttcgaaccgacgaatatggcggctcacttgaaaaccggattcggttctgtgcccaaacaacaaagcgtgttctcgatacggcacgtgcgcacaagccagggttcattgttggctatcgtatctctccggaagaatttgaacctggtgcattaaaattaggtgatgaccttgttttaatgcaagtacttggtaagcttggaatcgactatcttagtctttcattgcgccagtacgatcagacctcgattacctgtgatgccttgtcagatttacgaatcgctgacattgttaagcaggcggttggtgatctacctgttattgtatcgggtcatcttgggacacagtttgcgtttgaacgggcttccggtgacatgtttgccgtcgggacaaagttcttaaagcaacccaactggcccggtcagatgcgtaatccaggtatccagccggaatccactgtcactggaactgtgattccatatacaacattgaatctgtaacggtgaagggtgatattaatgacacgatacaatgaggcaattccaatatcaggtgcactgaactgtcgagatctcggcggtcacgtcacttgtgatggcagaactgtcaagtatcataaattaataagagccggtcatttgtccgaattaacacccattggtcaacaacaactgttagactatggtgttacagttgatatcgatttacggtctagtgcagaacttgaaaagtatcctgatttaattccttctgggatcaaatttgttcacttcccgtgtttggataacgatgatacagagagtactgaaacggtgaatgagttaaacaaattttactcaagcagtacccgtagtggttacctgcggatgctgtacgtttaccgtaaacttgtgattaataaacactcgcaatccgcgatgcgtcaggtatttgcttatttacttgctcatggtaatgaagagactgttctctttcactgctcagcaggaaaagatcggacaggattaacgagttggctgattctgtttgcgttgggcgttgccccagaagacgtgaagcaagattacttgctgacaaataaatttcttgtcgatcggttacatcagcgaatcaacgatgcaaagcaagctcatttgaaccagaactttataagttcgattcatgacttgtccacggtgcaggaggattattatgatcaggccatgactctgattaactacgagtttggcggtatgaatgcgtatttacgcgatatcgtccaacttagcgatactgacattcaacacttacgagccatctacctagagtaggggaatggtaattttaaatgaacaattggtacgattgaagccacctttcagtgaaatgcctgaagggtgacttttttgttgtctgttaatggcaaaatgtttcatgtgaaacatttgttaaataaaagcgtagtaattttaaggtgaaaccgctatactttgaagtgattttatttgtacgattagccggttataaaatgaaataaatggggtaaaataatgagctataaagttgattttaaaaacgttgagcaggtggggttagaatcatcgccagttgcaccagcattggcagggttacgagctaatgaagcacgctatttttggaataaatataagcatgaatacgttacggagcctgctagtgaacgtccggagttagtggcctatgtgaatggcgtgttatcagaaagagatttaaaaatccaatctaaaccactggaagtttctcagtttgaagttgaagggactaagtggacctatgttttctatgaaagcggcttagcaatcaacgtgatgtatgcgttagatccagagggtaagcgagcagttgggtttaaactatctgacggtatggaagtcccagcagaattagctgataaatttaaattcgcgcgtcaaaaatctaagctagccggtactatccgggggagttattttaagattaaacaggaacactaaaaaaataagagtgtggcacaactcggtagattccagaatttaacacaaaaagcgtattccgaactttgtcggaatacgctttttgtgttaaatggccgtaatcttagttgtggcgcaggtttagactagatgaaagtgttgaacaaaagcaaattattaatggtgtttcagtcaagaagccaaatgaaacttttatcaatatagacttatgccaccagctttatttagtgcttctgtttaataaatttttgcgacctgtgcttgagcaacttcgtgagccataaaatcatcataggtggtgtcggcgcggtcaacaacgcctttagggcctacttcgataatatggttggcaatggtttgaatgaattcgtgatcatggctggtgaagaccatagaaccgctaaaatcaatcagagcgtcgtttaaactcgtgatgctttcaaggtccaagtggttagtgggatcgtccaataagaggacgtttgccttactcagcatcaatttagagaggtaactacggactttttcgcccccagaaagaacgggaacttctttcagaacttcgtcacctttgaacagcatttggccaaggaagccacgtaagaaggtgttgtcgctttcttctttgctggcgtattgacgaagccattctaagatatttagcttatcgttactaaactctgggttcaagtcctttggcatataagcacgattagttgtaacgccccatgtaattgaaccagtatcaggttctaaggtgcctgctagtaattgcatcagtacgctggttgttacgtcagaacgggaaatcaaggctgccttatcaccaggacggagaagaaagttgacgttctctaagatttggtggccgtcaatagctttactgacgttttcaactcgcagaaaatcattgccaagttcgcgttcaggtgtaaatttgatgaacgggtacttacgcgagctgggtttgatatcatccagcgtgatcttatcgagttgttttttccgggaagtggcttgtttagactttgaagcattggccgagaaacgagcaataaagtcttgtagttgtttgatttgttcttcttttttagaattagcttgattacgcagttttaaggcaagttctgaactttgcagccagaaatcatagttaccaacgaagagctgaattttgccaaaatcaacgtcacacatatgcgtacatacactgtttaagaagtgacggtcatggctgacgactaagacggtgttttcatagtcagcaagaaagttttccaaccagctaattgtcatgggatccaaaccgttagtaggttcgtctaatagcagcacatctggtttaccaaacagggcttgagccagtaaaactttgattttttcgctctctggcaaatctttcattaacgtttgatgttggtcctctgggatgcccatcgattgcagtaattgactggcatcactttcagcgttccagccgtccatttcagcaaattcgccttcaagttcggcggctttgatgccgtctgcatcgctaaaatcggatttagcatacagagcgtctttttcggtcatcacttgatagagatgttcatggccttgaaggacggtgtttagcaccgtttggtcatcaaaagcaaagtgatcttgttttaaactactcattcgttcgttaggacctaatgaaacattcccagtagtgggggccagttgaccctctaaaattttaagaaaagttgacttaccggctccgttagcaccaataatgccgtaacagttgccgggagtaaactttaaattaacgtcatcatacagtttgcggtccgagaaactcatggacacattggttacagttaacaagttagtacctcacttttttgttgtcgaaatcgggaaatgagaatcagttcctatatagtatcagatttatagcgcagtttccatctaagagatgtgaatgggcaatttatttatgagtcaaaaaagtacgaggttgtgccataagtttatgttggtaagtatttcaatctaatttttagctgagattagtcatgatggtactttgattcaatgcgtcgatatagcctaatcatgcgccaaaactcagattcttgccatttaacgcaaataacccccatcccgacaaagtgtgtcggaatgggggtcatttacgttaaattctagaatctaccgagttttgtcacacactcgcatttttagttcaagttgatggataagctagtttgtagcgtcctttgcagcttttttagcttgtttatcggcttctttatgacgcatttccatttcgatctcttcaagtgtcttaccacgggtttctggaaccgcgtagataacgaagaagattgaaacgatggcgaagaaaccaaagactaagaatgggccaccaacgttgttgtggaagtagttcaacaataccaagaagaattgtgaaacgatgaagttaccaatccagttagcagctgaaccgattgaattaccaattccacgaacgttcaatgggaagatttcgcctagcatcaaccagcaaacagggccccatgaaatcgcgaaaccgatgatatagagggcaattaaaatcattgttggtacggcgacagccttaacgctcatagtgaagttcatgaatgctaagatgaaaattgaaattgtcatgacgattgaaccgaagagcaagatagtctttcggttaaacttgtccatgatcttatatgcgacaaccgtgaagacgaagttgacgatcccaataccaacggaaacccaaatcgcatcaccatcggggaaaccaaatcctttaataaagacttgtggtaagaagtaaataactgagttaataccgactaattgttgtaggagcattaaaccaatggcaacaccaacagctggacgggcaaaggtgaataattccttaataccgcctttaggctgattagcaacggcttgaatgtcagctaattccttatcgggatcttcgttggtcttagcacgtaagtcgtgtaagacttcgcgagcttcatcgatcttacctttttcaaccaaatatcttggcgattctggtaggatgattgaaccgaagaacaaacaaagtgcgggaatcaaagctgatcctaacatccaccgccagtcacggatacctaacaagttatgtcccaagaaacctaagtttgagacgtaagctaacaggataccagccgtaaccatcaattggaacatagtcccaagtgaaccacggtgaggtgcatcggcaagttcagctaagtaagctggtgttaatgctgaggcagaaccaacggcaaaccctaagatgatccgggcaacaaccattgaaacaaatcctgaagcggtcattgataatcctgaaccaagtaagaagaggatagaagcaaaaagtaagagccgtttccggccaaacttatctgataaagaaccaattgacaaagcacctactgaggaaccaattagaacggatgaagtaataaaaccagtctgttcaatgttgaggctgaaattggcttcaatcagggatgaagcacctgaaataataccagtatcaaagccaaataagagtccacccagtgcgccgaatgtgaaaataaagaaagtacttaaatgacgtacacgcacaataatctctcctaacgtattaataatagctttttgacaatcccaattgtatacgtttatcaaaaaaacacaaacgtttacattgcctataaattagtttttaaagcgatttcataatttggataggatagcaattatagttacttggagatgagtaaaatcatgttaatttagtcacataaagcgtcaccaaacaagtcacgttcacaagtcaacgtttagtatttttggtatggttactataagttagaaattagcaaattggtataccccacaatatttttttgaatttttttccaagttaaaagaattatcatttattttgtctgagttaatttcacaaaaatcaatcatcggcattgtgcgcttaagctgtcagaagtctgaataaactcaaaaacaccaccaattttcaattaagggcaaattacaagtttaatccgaacaagcccggaatctttcaatggcagtctgttgatgatgtatttttaatggtcgttgattaattagttcaagtgctgctaggatctcatcagtcgttacttggctaaaattggtctttttcgggaagaaccagcgtaaccgtctattaaaatattcattggaacctcgctcccatggtgaatatggatggcaaaataaactttgatctgataatcctgttctaaggcctgataattggcaaactctttaccatgatcaacactaatggattttacttggggaccgaaggcccccataaacttgccaaaggcggtgtttagaccttagccgttctattaggggctttgatggccctagaagtcgggtcttacgttctacgaatgtaaccagacatgatcgtgactcacttcgactagaaaagcaccggatatccttcccaatgaccaaaagtaaccgttgattaacagttgttggccgttgttcgatggaagtcccacttgaaatttccacgatttttcgctcactcggtgctggcggacattccgattgggtagacagtcaatttgaaggggagccagacgattaagccaattataaaatgacgcagtgctcaagtataagcggccgcaatggttttggtgaccaggttaatcgtaagtgattggacattaaagtcgctaatgctcggcagcatcgaacgacgaccgcaattccgccttttgcgatctgccattgctgagctaattctggatcataaggtttaacccggtccaactcatagctaatcgtagctttggcgacgcctaaggcgtcagacattacttggtaagattttattcccctaatgaccagtttggctaggtgcgccacgttgaaaaatgataagtagatgtacccaaagtaatcactccctatattggttggaattagctactaccattgtaagtgattgctttgggctttttaatttctgttcggattaattatagaatttgccatattcataaaatgcttggaagttaaaatcaactgttgggtacctaaacgatgtgatagttggtgactgaacggtttcatcaatgactaattcataaccaagattctgcatacctttacgtagcaaggtctcgttggcttggtagcggtgagttcgagcagtaacgccgccttcttgttcaagttcacggagtgcttcggcaaaggcgtagacaacgtgggttggggaagtaaagcgccacttaccgtcatgctcttcaaaggtctggtattgtgcgtagagatctagtgctagcgagcgagcgttgcctttagtagcctgtaaagtatttttcttggccaatactacactgaagccggggacaccttgaacacatttatttgaactggtgatcaggtaatcgacttgaagctgcgcaaggtcgattggaacaccgccaaaactagacatggcatcaactagggtgatgatgccgttatcggttaatgccgggatgatggtttcgatcgggtttaaaatgcccgtagtcgtttcgcaatgaaccattgcaaagtgggtcacttctgggtgtgctgttaacgctttttccactgcgcccagggtcactgcctgatcctcaggtacgtggagatcgacgtgtggaattgctaaataatcagcgatctcgatcattcgttcgccatatgcgccattggcagcgataagtaacgtggcatcccttttcggaattgctgtaccaatagcggcctcgacaccaaagctaccgctaccttgcatcaggacggctgtgtattcctcgtttgaagcatgaccgagagtgactaactcacgacgaacccattgtgtcagttccttgtagtcatcatcccaagtcccatggtcaactaacatggtttctttcactgtaaagctagttgtgagtgggccgggtgttagtagtaatggcatctcgtgctgttgatcatcaatcgattcaatcaggggaattaaatcagcgatgttattaatgatttcgtcagcacccgcctctttaagaattgcagtggctttagcacggtaacggtcacgctgttcaatgtttagctggtcaaatgcttgttttggtaagccaattaaattgccaccgtcaacaaccccaattgaaattgttcccgcgtttttgccctctaaaatgtcattgacagtatcaccaactttaatgacgtgagaagggtcagagatgtgcatcttctgcatagcgagtgccaccatgtcaggtttagggcggccgacgtgattggtttgctcagaagtgatgttatatgtgggtgtgtagccctgttgtgcggctaaaggtaaaatttggttcagcattacttgtgtatagccggtcgttgtcgctagttgaatatggtgagtgttggcaaacttaatcaagtctgtcattccaggcttcaattgtgcagtttccgccagtactttgttaatttcaatttgaaactgagcgtaaatttctgccgttgcttttgttagtgggatggttggctgacgagtttcccaagagtttgcaatttcaggaatctgcagaatttgacggacatgggtcagtttatccaggccaacatcttggcggatggtttcttcgctcaggtcaatgccgaagtgagcgaaggcgtttttaaaagcaatgatgggggcgcgactgccataatcgacggttgtcccggcccaatctaatacgatggcttcaatcataaggaaatcctccagtttgaattagggttgaatagttactgattagtgacggtacgcaagcggtaggaaataatttcaagtactaatgcaaaggccaagatcatataaaccatgacacccacttcatggaaattaaaatagaagctgcttgacatgaaaagctgataaccaatcccgccagcacccgctgctgccccaacagcaatagcgtcagcaaagttgatttcaaagcggataaacgtccagctaaggtaacttggcatcatgtaggggataattgcttggcggataatagcgctctttttaagtcccattgcttgcatggtttcgataatgccaggagaaagttcgtccatgctatccgcgtagacttttgtcagataagcaacgctgtgaaaggtaatacctacgactgctgcgttggctcctaggccaaagacaacgctatagatcaagacccaaaggacagttggaatggcacgaataacggccatcagactttgaatacctaagactaagtaggtgggagctaaccgtctagtactggcaagagcaaagaaaaaagccagcaccgagccgattaacgtggttaagaatgccaataggatactttgacccagtgcgcctaaaagcgtgataaaggtggtattagcaaggcgtggttgccaaaacataattttgatattttcagcaaaacttgttagtgcggtacctaatttgaagtgactaggaatcatagttggcaatgtcgccaatgtgatatacgccaacacaattagcgtcatcagaattgttactcggcgtcggtctcgaaaacgtaagggaattgacagtcttggtccggctgggtgccgtgttggtattgaaatttgattttccggtttaatcacgataacaacctcccgattaaattggagattagttcaactgcaacgactagaataatgactgagaggacaactaatccagcagccccgtaccttagacttttgaagtaaaggttgaagatgaagccaatgccagttcccgtaagcaagccaactagcgtagcgtctcgaacgttgttttcaatcatataaagaatccaagtcataagcgcaacggcgatttctggtaagagcccttgaaaaatcacttgcagataagtggcaccagttgcctgtaacgcctgaatcttttcagtcccaaaatcttcgatggtttccataaaagcacgggtcagaaaacccaaagtcatgaaaaatagggccaaaaagccagtgagatcattttgcttaaacgaaaagagtaaaatcatcgcccaagcaacaatggggatatttcgtagcagcgatgagaggcaccgaatgacccagctaacggtaattgctggtgtcagtgtttgggcaccgataatcgctaaaaatagggataccacggcggcacaggtcgttgaagcgactgctactacaaacgttcgaaagagctgttggataatctcattccagtaaccctgtgaggcttcgttggggataaagttgtgaattaaccaagcaatgccagcttgaacgtttaataacgattgtgtttgaaagccaaggccaatcgaggcaccaatgtaagcaagtccaaaaataaccagtatgatggacagccgtaaacgcttggtgttgaagaaattggtgacttgctgtacatcagaattcatgaacgacactcccttcagagttagcatccttttggtatatgctagcaatagcagtatctgaaagtgcttgaatccgatcgtcgaatacgacttggccattattgatgccaatgacgtgatctgcgtaacttcgggcgatatcaacttggtggaggttgattaaaactgagatgccatcgttagtcgccagatctctaagaatatccatgatagtgatagttgatttagggtctagggatgcaatcggttcatcacacagaatgatttttggatgttgcattaacgctcgagcgatgccgacccgttgtttttgaccaccactaaggttacggcattgctgataggcaaaatcggcaaggccaaccttctccaatagttttaaagcttcttctttttcccgattgcggtaaatcgaaaagatacccgctaggttagatttagtgcctaaacaaccgtgtaagacgttttcaatcgccgttagcggttcgatcaggttgtagttctgaaaaatcataccaattcggcaacgagcttggcgtaactgtgcccgattcaattgacgaatgtcagtattatcaaacaggatttcaccgtcatcgtcccggataagctggttaatactacgcaaaatcgttgttttaccggcaccagaaggcccaataatgacggttacttcaccaggttgaacgctaaatgaaacatcggttaatgactttttctcgccatcgtagcttttagctaagtgttttacggttaacattagaacctccttttaccagtaatctattcaccgagtactttatgagtaggggcgtaccatttgtcagaaatagcgatgaattgggtatcaccatcctttggcaataaactgtgtaccttagcgttagatggtgcaaagaattttttatccttagcaattcgggacgaagttaacgcactgatgattttcttggtatctgatttgctaagcatttttgagttcacggcaatgggttcgttttgtacagggtatgctgctaaagcaatgctttccttgccacggacactgttaaatggcgctggtgcgttggcattgattttgaaatctgcacctgctttagttgaatcattcgtgaatttaccgtatgaaactagatccatatcatcaaaggcagctacgtcagcatcacctttaagtaagttaacggctgatccttggtgtgaaccgccaaacaggactttagagaagaatttaccactttgttgcaggtcatccttatttttcaggttgaaattggtttggatggcgcctgctggaatggcgaaaccagatgttgatgtgttagaaacaaatgacattttctgacccttgattttttctaagctgaacttaccgtttactttatattggttagccttgtctttagggaccataatgtaactgtggtattgggcatcttttaaagtgccagatttaccagagtaagtgaggatcggttcaacggcggcgttttgcttgtgcgcctggatgtaactgtccggccccatcagcgcaatttgggctttaccagatgaaatagcctggatagcaacgttgtagtcggtagtggttttaacttcaacctttttcccggttgctttgtggatctcgtttgctagtgcagttctagccggtccagcctctttagctgaatcaccaggtaggaaaaccaccgtcagtgttttggcattttggtgactaccggtggcgtttgaagaactacagccggcagctgcaagtgatagacctatgattccggcagcaaacaaacttgttttaaaaatactcatattaataacccctatcttatttgatagagttaatgttaacgggtgagtgtaaatacaacataaatccttcgtaaagatttatggataacgtgtaaatgtttggtaaataagtgcagaagtggtattacccgttattagggggcagatttttggtttcatggctgactttgtagtatgttgaagagtgaaagataactcgcaaacaggagggcttaataatatggcgtttgattacgatacgattgtgattggtggcggccccggtggcatggcggttgcgtatggcttaaataagagtcaaagggttttggtaattgagggtaatctgtggggtggtacctgtcctaactttggctgtgaccccaagaagatgctctatggcgtagttgaggccagaagacaggtgattcgttatcagggaagcggtttgtcagctgagccaaaagttgactgggcaaaaatgatggcgtttaaacgcggttacacggaaaaaattccaactggaactgaagcaggtttaaagaatgcgcacattgatcatttacatggtgttgcggaatttattgatggtcatacattgcgcgtaggtgatcaaaaagtgagtggggcgcatattgtgattgctaccggtgctacgccaacgattccagatattcctggaaaagaagcctttaagacaagtactgattttttgaacttatccaatttacccaagaaaatcgggttcgttggcgctggctacgtggcaattgaattggcgaacattgcggtagaagcgggcgctgaagtgcatattttccagcataatgatcggctgctccgtaatttcccgcaaaaatatactgaacagttgaaagctattttgactgataaaggaattcatttccacatgaataccaacgttacggcgctaaatgccgatgataagcaggttgaagtaattactgataatgatggatctgtcacgctaaacgccatttttgtggctgcaggacggcgaccgaacttagatcaacttaatttaccgagtattggtgttgcggttgaaccccaaggtgtgaaagttgatgaccatttaagaaccagcgttccatccatttatgcgattggcgatgcaattgctaaatcagtgcctaagttaacacccgtttcggggattgaggggcgctatgtagtttcggtgattgcgggagaaaccgaagaaccaattcattacccagccattccgcacatcgtgtttgctggaccagaacttgcacaagtcggggttacattagatgcagctgaaaaacattcagagcagtacgcaattagtaatcaatcggtgggttcttggtatacttacaatcgtctgcaagataagactgctcgtgtaacgacaattactgataaatcttctggaaagttagtgggtgccgtagtattagcagtgaatgccgaagaactcattaacgacttttcggaaatcattactcacaaaacgtccgctaaacaagctactgactggacacctatatatcccagtgttaccagtgatctaggttacttttattaacttagtaaattctagaatttaagctaaataatcctcgttctgatggtaggtgcgtatcaggacggggatttagctttgtctaaagtgaggttaaatggatgatgattaactaaccaagtaaattgttctcaatattaattgatataaagtcgcatttgcttaccatgttaaaatagggtatcaagaaataggatgtgagaagatggggcgagcagaagatatttatcaagcgattatggcggatccgcaaaacgctgattttacacgacaaggtattgagcctttgtatcacgtggaacctgaggcaaggattctgattattagtcaggcaccaagccgaaagggccaagtttcaatgacatattgggatgatcctagtggcgaccggctaagagcgtggatgggtatgagtcgtgacgagttctaccattctggaaagttgggtgtggtccccttagatttttatttcccgggaaaaggtaaacaaggtgacctaccaccgagaaaaggttttgctgagaaatggcaccaacccgtgctcgaattgatgcctaaagtgtcgttaacgttgctcattggtgcctatgcacaaaagtattatctgcaaaaaaaacgtcaaaaaacgctcactgaaacggtagcccattataaagactatctaccagaatattttccaatcgtgcatccttcaccgctaaattatggctggatgcatcagcacccttggtttgaagacgaagttgtgccagaattacagaatcaagttagacgactgcttaagaattaggaagattcggcttaatttattaattaaaagtaagtatttggggctatcctcttgaagattaaatgtaattacggtagtctatacgccaggattactagaaatggagcacgctatgaatgatcaagttttctttgattttgatggaaccattgctaattctgaacgcggtattattcactcggttaaaaagatggtagatgaattgcagctaccgcatttgacagatgagcagtatcgacttttcattgggccgacactcgctgatagtttaacaaagtttttcccatcattatcagagaagcaggttagcgacagtatcgcaaaatacagggaagagtatgagtcccatggcttgtttgacttagaaatttatcctggtattgaatcagcgttaacaacgctgaaaacagcgggctatcagttaaatatagcctcagcaaagcctgagcctgttttacggcaaattattgataaatttcagttaaacgattattttggcggtatctatggtgctgctatagaggacccagttcgaattaagaaagtggatatactagcttatggtatcgaaaccagtggcgctttaccaactcgtagcatcatggtcggtgaccgctacactgacatgattggcggtagaaaaaatcaggtcaagactttgggtgtgacgtatggttttggcgatactgctgaacttaaagcctcgaatgcaacggcactggtaacttctcctgaagaaataccggctggcgtggaaaaattgtttgggaaattagtttaaagggcgcttgataaaggcgactcttttttgttccctagtaaaggattagtaactgtagtaatggacagttaaactgaggtgatactagtgattgaactgcttaatgtaaataaggaatatcaagatcagcacgcacttgatcacttaaatctcaccattaatgatggtgaattatttgtgttggtcgggccttctggtagcgggaaaacgacactgttaaaaaccattaaccggctagtcgtgccaacttctggtcaggttaaaattgatagtaaagatgtggcagatgcaaacgtgcaagaattgcgacgccaaattgggtatgtgttgcagacaggtgcgctatttcctaatatgaccgtagcagaaaatgcaagtgtacaactggataatttaaagtggccagcggacaagaaacgcactagaattgccgaactcatgactgaagtgggccttgatccggatcattttcttgaccggatgcctagtgaactttccggtggcgaggcacaacgagtgggcattgtacgcgctttagcctgtgaaccggggttagttcttatggatgagcctttcagtgccttagatccggtttcgaggcgtcaattacagcaaattgtgatcaatcttcaccgggatttggatagcacgattgtatttgtaacccacgatatgcatgaagcgttgcggttagctgaccgaattggggttgtgcataatggtaaactgcagcaagtaggtacaccaactgagattttgtcagaaccagccaatgcttttgtcagcaatttctttgcggatgaacagcaaactgatcagttattaggacaggtcttggccgctggttttggccgaacagctaaagctgacgaaccaggtactaaaatggtcaaaggtcaaagtatttttgagtgggcaaccgcccttcaaaaatcgcagatggatcaggtgatcgtggatgataaagtgctaactgatcatgatttaattgattacttagcatcgcttgaaacggagggtgacagtcattagtcaattaataagttatatcaataagaaccacagtgacttattacaggctttgtggcaacatatttcgatttccttgatcagtatgttgatcacaattctgattgcaataccgcttgcgatagcgctgatcaaccatcgtcgaatcggtgaattctttctacaagtgactggtgtcattcagaccattccaagtttggcagttttaggaattctgattccgttcgttgggattgggacagtaccagcaattattgcattagttttatatgctattatgcccgttttccaaaacacctatgcaggactcacaaacattgatccggttctcttggaggcggcggatgcccttggggtaacaccaaggtttaagctcttcaaggttgaactgcctttggcgatgcctatgattctatcgggtatccggattgccacagtattagttattggaacagcgaccttagctgctttaatcggtggcgggggcttagggacctatatcttgctgggaattcaaacgaataataatacggcactattagtgggtgctgttctgtcagctattttggctttattggctaattggttgattgaagtattatcgaaggtgccgttaaaacgcctgggaatcggcactttagtgttagtgatcatcggtttaggtggtactatcgggcatcaattattgaagccgcagaccgaaagagtcacgattgctggtaaattgggtggcgaacccgaagtgctgatcaacatgtataaggatttgatcgaacaaaacgattcgaaggttaaagtgacgttaaagccaaactttggcggcacgagttttctttttaagggccttcaaagcggtaaaattgacatttatccggagtttactggtacgattctgcaaacactggtcaagggtaacccagatgttaatcgtaatccgcagattgcttaccaaaatgcccgtgatgatgttaaaaagcagtttgggatgacgtatctgaaacccatggcttatcaaaataactatgctgtcacagttagacaggatacagcaacgcggtatcatttgaagaccatttcggatttgacgcgagttgctggccagctctcaggtgcgttcgatcctgatttttatcaggaaagcaatggttatcccggactcagaaaaacgtatgggttcaatctgaagtcagctaaaaccatggaaccgtcactgcgttatgaagcattggcgaacaaacgggtggatgtgacggatggctatacgactgatccgcagattaaagagtatcatctggttgtgctcaaagatgataagggctttttccccacttatcagggtgcaccgttaatgaaaacgagctttgccaagcagcatccagctattgttaaacagctggatcggttaagtggtaaaatttcaatttctgatatgcagaatatgaattaccaagtgaccgttaagcaccggaaggcttcagtggttgcacgagaatacctgaaagcccatcattatttagaataaaatgaaacaccaagcattactgtaaaaacagttgtgcttggtgttttttattttaggggttccgaattaattcttttactcgattaacttttacttgtaatttttattaatggtggtaatatagttttggtaattgagcgggcgctcagtcgtaataaatgattactttgaatgtttggatcagaagaaatgataacttgatatgggcttaaacacagatgcttaattttatatcaaatttgtatttcactgaccaaccgaatttctaagtcaatagaaaagaggttttaatgatgaaggatacagagaaacacaacttcgtacaaggcgttgacggtgaaggcaagagtcttgatgaggtaaacggtacggttgaagtccctaaaaacgggggcttttggaaaacattaatggcgtatacaggtcctggaatcctgattgcggttggatatatggatcctggtaactggatcacttcaattgctggtggtgcacagttcaagtacaaactactggcagtgattctgatttcaagtttgattgctatgttgcttcaagcgatgtcagccaaactggggatcgttacgggtaaggatttagctcaactgacacgtgaacgtaccagtaaaggtatgggaatcattctatggatcatcgctgaattagcgattatggcaaccgatatcgctgaaatcattggttctgggatcgcgttaaagctgctgttccggatccctctgatcgttggtattttgatcacggctgccgatgttttgattttactgttattaatgaagctgggctttagaaaaattgaagccattgttgcaacgcttgtgacagttattttattagtgtttgcttatgaggttgcgttatctaatccaagtattgcaggcattattggtgggtacgtgccaacaactgacattatcagcaatcattccatgttatacctgtcattagggatcgttggtgcaacggttatgccccatgatttgtatttgggatcgtcaatttcgcaaacacgtaaacttgatcgttcagatcgtaatgacattgctaaagccattaaattctcaacgattgattctaatctgcaattattcatcgcctttatcgttaatagtttactattaattcttggtgcggcactgttttatggtactaacagttcattgggtcgtttcgtcgacttattcaatgcgttaagtaatagccaaatcgttggtgcaattgccagcccaatgctaagtatgttgtttgcagtggcactgttggcgtcaggtcaaagttccacaatcacgggtacgttagctggacagattattatggaaggtttcattcggcttcgaattccactttgggcgcaaagattggtgacacgtttgctttccgtaactcccgtcttgatctttgccattatctatcatggtgatgaggctaagattgaagatctgctgactttctcacaagtattcttgagtattgctttaccattcgcggtaatcccactagtgatgtttactagtagtaaaaaggtcatgggtgaatttgctaaccatgcctggatcaaatatgttgcctggatcgtcaccgctgtactaatcgtattggatgtttatcttcttggacagcaattgggtggtatgttcagttaaaattgtagagacagctttcacgttaaatcaaaggactgtctcttttttataccagaaaaccaagtggggactgaatcatgagtaaaagtgaaaccaagagtgaccaacataaggaaaaaattctaaaaatttcccgggaaatgtttgccaaaaatggctatgaagcaacgactactcggatgattaatcaggctgcaggaacggctgaagggttgatgtattattattttcctcatgggaaacacgaaatactgaataccattgttcatcaaggaatcattaatcgagttaatcaactgcagatgacgttcaatgattgtgttacgaagacggatcttgagcagcgtttaatgttaattttcgagaatatttggcaagttttccaggataaagaaaattaccaatcgtttgtcattacaattcatgaacgcatgttgttgtctgacgatcaggcagattggctgttgcaaattttagaagggcttgtcgatgagattgcccaacagttaaaagcggcaccagtacttcagtcaataagtaaaagtcagtatcgaccattggctcgagtaattgtttctatttttcagaaagttatctatgacgaattgttgattaaaaataaccgacaactaactgatgaaatgaaagatttgatccgaccgcaattaagtgtggttttgtcaatttagcgatgaaagcgtgtttcttaaccactgaaggttgagaggcacgtttttttatgcccaacgttctcgctgtttctgcgctatactggataagtgaatatttttaaggagggaagtcacatgctgcacgtaattttaattacgatttatctgatagtagctggtgcgattgccggctttttaagttcagtggctggtctagcctccttggtatcttatcccgtattgttaagtgtaggtgttccaccagtgagtgctgatgtgactaatactgccgcattgatttttactgggttaggttctaccttatcatcatctaaagagctaaaaggtaatcatgcaactatgtggcatgttggtcttttaacggcagctgggggtattatcggttgcttgattttagcttttttaccatcttctagtttcgagcatgtggtgccgtttttaatattcctagctgcagtgatgatgatggtttcaggtaaaaagaaacaggtcagtcaaacggctcaaccaacaaaattatgggtccggattttaaaaaatagtgccatttttttggttggcatttacattggctattttggcgcagcagctggtatttttatgctagcgattctcactgtgaccttgactaagccttttgtggtcagtaatgtcattaagaacttctcggcactgcttaccaatgtgatttcacttgtgatctacgcatttaccattaaagtttattggttgatggcggttcctctcgcgattgggatgtttgctggtggctacgttggaccagttgttatccgtcatctgccagttaaattactacgaaatttaattacgattgcggctttttgcttatctggctacctgttctacacggcctacttcggtaaatagcctaatcttgacattttaattggggtcacgtatgctattaaagttaattaaatcgctaatagcttgatcatcgtcgggtgatcatgataggcagctcttctagtcgcagatacaatgttctcagaacgttgaaggctaggataggtgcctttttctatgtgaattggaggaaagtcaatcatgatggcagtagttttacggggcatgttgattagttttgcgcttgtatcgtcaattggaatgcagaacttatttgtttttaatagcgctatgagtaaccgaatgcgacgcgctttattaatttgcttatttgtatggatagcggacacaaccttaaccaccgtcgcctttttaggaatgggtgcgttaatcagtcattatttgtggcttaaaattatcattatgttgcttggtggtttaatcgtgatttggatggggattggtatcttacgttctgctagccagatagaacttggaaaagacgattcacaattaccattaaaagacgctttcgctagtgcttggatcgtggcttttgccaatccacaagcaattatcgatacgggggtcaccatgggagccctgcgaggaacgctgacaaatagtgaggtgttaccttttctgggcggtattattttagccaccgcaatttggtttttctcgattacgattattgttggtattttaaagaatcgattacctaagcgtattttgatgtggatcaatattatttcaggggtaattgttttaggttatggaatcgccttgcttatcaatgctgcacggttaatcctttagtaaaaaatagccttgaatcaggctcgataatggttatcggtcttgattcaaggctatttactactgtttttgaagacgtagtgcgttcaagatggcaatcatggtcaccccaacatcagcaaagacggcttcccacatgccaatgatgccaaatgcacccaaaatcaaaaagatgattttaacggccaaagcaaagctaatattttcccaaacgattcgcttggtggcttttgcaatttgaataatagtagcaacttttgacggcttatcatccattatgacaatatccgcggcctcgatggcggcatcagcaccaagaccacccattgcgattcccacgtcagcccgagctaagacaggcgtatcgttaataccatcgccaacgaaggcaacttggtgatgagatgtatgcgcagcttgggtcaatgcggtcattttggcaactttttgtgcaggtaataactcggactcaacctgatccaaaccaagttgttcaccaatatgattagcaatgctttgattatcaccggttagtagctcagtatttttaacgcctaggtgtttaaggtgcaggatggcagcttttgagtctgctttcggctcatcagcaacgcgaatgctaccggcaaatttttggttgaccgcaacgtagactgtagtactgttggtgttagttgcaggcatggtaatgtgatttaatgatattgcttttgcgttaccaaccacaactatctgatcattgattgtcgcttcaataccatgacctgccgtttcctgaatatcatgaagtttaaattgagtcaaatcaccgtcataagctgctatgatggaacgggcgatagggtggttagagtgctgttcagcggcagcggcaatgcctaacagttgctgattagtgaaaggcgcttccgcgttgatctcactaactgtgaagtgtccttttgttaaagttccggttttatcaaatgcgactgtatttacgtgtgttaatgcttcgagaaaattactgcctttaactagaataccgtgtcgtgaggctgctccaatgccaccgaagaaacttagcggtacggaaatcaccagtgcgcaggggcaactgataactagaaaaactaaagcacggttgatccaagtagcccaaggacccaggtgaagtaagggcgggaaaagggctaaaagaatcgctaagccaacaacaattggcgtatagattttagcaaaacgagtgataaatttttcggttgttgttttttgctgagcggcgtttgagacgaggtctaggattcgagctaccgttgattcctgatagggtttggtaacacgaatatcgatgacaccagtaagattaatggcaccgctcaaaacagtttcacctttttgaatgtcacgaggtagcgattcgccggttaacgctgaggtgtctaagctggtatgaccacgaattaattcaccgtctagggcaattttttcgccgggccttacccggatagtctggccgggaataacctgctcaggggtaacaaccttttcgacagtagaagttaaaatcgtagctgtcgttggtttgagttttaagagggcagagatggattgtttagactgttgaacggcgatgtcctcaaatagttcaccaacttcatagaataacattactgcgatggcttcgggataatcgccaagtgcaattgccccaacagtagcaactgtcatcaaaaagttttcgtcgaaaaattcgccactgatgatattggtcagtgattcccagataacgggataggcaataatcgcataagaagcgatatatagcaggattttttcggctgaggctggtaaactgaccgcaattaataatataatggttgaactggcaatcattattaagtcacttttatgatttagaaagccacgtaccgtgttgtaggtgcgtgtgggaacagttgctgatttcatagccatcacctcaatacatatcaacatatgtgcatatcttaatgtgaattgtacccgtgctgatgctaaaatgcaaccgcattcgtagctaaccgaataccaaatcatgactattatgaaggaagttaaatattcaatggaaaatcctaaacatttagaaatcgtagaacacttaaaagatcatttaaccgtctcatcggaattagaaaacatggttgcactgttcaaagcgttgggtgatgtgactcgagtacgcattatcttggcgttagctgaatcgacccttagcgtaacggaacttaccgaagtgttggatttgaatcagtcaacggtttcgcatcaattaagtctgttgaaacagcaaaatttagtcaaagggactcggaacggtaaaaacattcattacgagttatctgacaggcacatcatgacgattgttgatcaggtcaaagcacacgttttggagcattgatcaccgcctatcgttaaacatattcactgtaaagccggctattttgcattttgcaaagtggccggcttttgtggttgacaattgtaaacgaagcatttatcatgtagttatggtttacaaatgtaaacgtaaaaataaaaatcctggaggtttttatcatgattaaaatgtttgtcttaatagttgggcttgtactgattggttttatcgcttggtggttctttggtaagcatgcagtggctactgaaactgctgacgttactaatgatgtccaggagattgatgtggacgttaatggcggctactcacccgaaaaagtggttttgaagaagggtgttcctgcagttttgaacttcactcgtcgggatccatcaacgtgtttggatcgggtagttttccccgattttggtatcaaccgcgagttaccaaagggtgaaaaacaagccattgatatcgatactagcaagcctggagaattccagtgggcttgcggaatggatatgtttcatggcaaattgattattaagtaaattgattatcaatattaagtgaggcttagttaccaaacgcaaagttttggggaaagtggtgaacaaggatgtcaattacaagtcgtttttggatctcgttgatcctgtcgttaccaatgttagcagaaatgatttttcacccgtttggctggatgctgccgggtggtgaatggacgatgttagtactgacgacaattatcatggctgtttcagcaggtccgttttggcagagtgcctgggcgtcttttacaaagcatcattcaaacatggatacattggtagctattgggacggcaacggcgtatttttacagcatatacgccatgattacccatcaagcagtcttttttgaaagtgcagcgtttgtgactacctttgttctattgggccaggttttcgaagaacggatgcgaaataacgcctcgaatgccgttgataagttagttaatttacaggctaaagaagcttcggttttgagaaatggtgaactgattaaagtaccattaagcgaagtggcagttggtgatttgattcgggttaaaccaggtgaaaagattgccgtagacggtgtgattaccaagggcagctccgctatcgatgaatccatggttactggtgaaagcatgcccgttgaaaaacatgcaggtgaccgggtaattggttcaacgctgaacagcaatggaacattcatgttcaaggctgaaaaagttggcagtgacactatgttgtctcaaatcgtcgagttagttagaaaggcgcagaatagccatgcaccgatccaaaagttaacggatcaagtgtcgaatatttttgtgccaattgtactgatcatttcgatcctaacctttttagtttggtacgtattacttggcgcaagtgttgctaacgctttgatttttgctgtttccgttgttgtgattgcctgcccatgtgcgttaggtttggcaacgccaactgctctaatggttgggacgggtcgctctgctaaaatgggcattctcatcaaaaacggtgaagtccttgaagcggttaatgacgttaccaccgtagttttcgataaaactggcacaattaccatgggaaaacctgaagtaacggatattgtcggtgatcaatcacagattttaccattagctgccagtttggaagctaattcggaacatcccttggctgctgcagttttggctaaagctaaaggtgagggcattacagttgcaccagcggccgactttcaagccattgagggtaagggcgttgccgcaacagtaaatggtcaaaccgccttcattggtaacgataaattgttggcagaccacaacatgacagctgatctaaaacagacagctatcaagttgcagacagcagcaaaaacggttgtctatgtcggtttggatcatcaagtgattggtttgattgccattcaggacgcaccaaaggcaacctcaaaagaagccatcgcagctctgaaacaaagagggttgaagacggtaatgttaactggagacaatgaacgagtggcaaaagcgattgcggatcaggttggtatcgattctgtcatcgcggatgttttgcctgcagataaagcagatcacgtcaagatgttgcaacagacaggcaaggtagcctttgttggtgacggtatcaatgacgcaccagctttaacggttgcggatgttggtattgctatgggttctgggacggacatcgccattgaatcgggtggtatcgtactagttaaaaatgatttacgcgatgtagatcgggctttggccatgagtcgtaaaacctttaacagaattaaactcaatttattctgggcgtttatttacaacgtactgggtattccggtggcagcaggtgcgttctacgccattgggttaacgctcagtccagaactggcgggcttggcaatggcctttagttcattatccgttgttaccagttcggtgttactgaaccgtgctaaaattactaccaatgtttctgaaactgtgtaaggtgtataacagtataaaaaagcaggctaattatcaggagatgttactactgatattagcctgcttttgttatgctaaacaatgtgataactctcagtaatctcccatttttctcaaaaagcggaccgttataatagtttgagtaaactttttgaaagtaggaattgattgtgaaatcaaatgaaccatcaccaaaaggtaatttcgttggcttgctgccattgattttcttccttattctctatattagttcgggtattctcaccggcagctttgataatatgccgctactggtcgctatgatgctggcgagtatcgtggcctttttgctgaaaggcgataatcgcaaagatacttttagtgataaattaaccgtgttttttaaaggtgcgggacaggaaacgatgattctgatgatcattatttttctgttggcaggcgcattttactacgtaacgaagtcaatgcacgcggtagaaacgattactgatattgggttaacgtatttacccaaatcatttttagttcccggtgtttttattcttggctgtattcttagtttcgccatgggaacttctatgggaaccgtggcagcgttgatgccgattgccgctagtattgcccagatggcccatattagtatgccgctaatggctggagtggtggtcagtggcgccatgtttggtgatgatctatcattaatttctggttccgccattgtgtcagctaaaacgcaaggcgttaccatttttgataaatttaaaactaatgcgatcatggttgttcccgcagtgttgattactattgtactgctaatgattgttcacgttggtcatgcggatgttggcagtcttgggaccattcactggcttaatattttaccgtacattgtggtgattgcgctatcctttatgaacattaacgtgctgatcgtcctgtttttgggaatcgtaacggcaacagtgattgggattggcgctggcagctttgatttcattggtgcactagattcgattcataaggggatgctatccatggcggatatctccctgatttccattgtcgttggcgggctagctgctttaatgacgcacatgggcggtattcagtggttactgaataagatcaccaaacatgccaatggcgcgttgggcggtaagtttgccattgccttcttgattctgttgttagacttaattaccactaataatacggtgtccattatgattgccggaccgatatcgaaggatctgtcagacacgtatcatatttctaaatcgtatactgccagtattttggacgttttctcttgtgttggccaaggactgatcccctatggtggccaattattgatggcaggggcaattgctcaagtatcggcagcctcgattgtaccgtatagctggtactgcatggttttaggaattgtttccattatcttcttagtcagccatttttcacccaaggaagctcgggtaagaatttaggtgtactaaaagcaatctaaaaaatgaagctgcgacaaaactcggtagattccagaatttaacgaaaataatgcctattccgcaaaaaacgcggaataggcattattttcgttaaatggccggaatctgagttttgttgcgtaattaggctatatttccgtatagctccaaagtacagtaaacactaattctagctaaaaattaattgagatacttaccaatatagacttatggcacaacctcatttttagattgaacgaattctaattaccacattcgcttaatcattcagttgaaatttcagtttcatttgtggttcaccaagtgctaacatttggccaagtagagtgtttgaattcgttttggcaatgtcagccatttggttattaaccttttcaagataagcggggaggtttgattgagcaaccgccttttgatcggccttgatttgaaggttccggcattgcgcaacggtgtgttcttcaaataagttttcttggtcttcataaagtgcgaagtcattatcaccaatcaaagctaaaacgtttggcaaccagtacatattggttgggtcacagttacccgttgtgttcttgtaggcttcgggcgtatcggtcacgttcgcgtagaagggtactacagaattaaaggtatttggaccgaatgctaaccagtgaataccagcaatttcgtccggaacattattccgaatttgtagaatatgcagttcttgattccggttgattccaattggccggaactgctttttctgagcttcagtaccagtaccataaggatcgtatggcgtattttgatagtgtgaactgagtacgaatttcatatcttcgatggagatcttcttatccgtgcggcaaatgaacggtaagtcttgatcgattggagtggtatcaaattctgggttgaaatacttttgaccataccaagcacgtggattgttataccgagtgtctttgatagtagcactgccaaagatgtgacgtagattgacctggtctttatcaggattcatgtgatattgttggatcatgtgagacaggtctttagaacataacgtattatcggagttgaaattaaattgatcgatgtttagccggttaggtgcgatgacataagcatcatcaggaatacggatggctgcccagtgatggccaccaatggattcaaagtaccaaacttcatctttatcagagaaagccatggcgttcatttcatacgtaccatacttttccagcaagctgcctaaacgttgaacgccttctcgagcagagtggctgtaaggtaaagttagtgtggtgatatcttcttcaccgataccattttcgaccaatggatcaacacctaaaattcgtgaattagaggtgatggtttcagtagccgtcatggcaacgttagcgctgttgataccagctgcggcccaggtaccatggccatcggtggcatcaggtgttgatgtgtaacgcagtggatcatcaggcaagtcgatctcaacctggctcaaaactgatttgtaatgtcgaggttggtcttcagggttaacgacgacaaacttctgtgggtttaatggcccagcgccatcctcatttcttgcaataatagtggaaccatcaattgaggcttttttgcccactaacattgtggtgcaagaacccttgattcgtttagtcatgcaaacactccctttaatttgattactagtccattgtatcacgttcatttgcaaccctctcagttagtgcaggcaacttaattgtttcacatgaaacattcttcggcttagaaataattatctttgaaacgaggttgatttgaataatctttatagcgtagagtgtatggtaaagatgagtggggagagttttaattgaaatcggtcgttaaaaacagcattcaaattattctcggtgcgttgatctatgctttggcaatcaactattttttgattcctaatcggatcggtgagggcggagtgactggtttaacagctattggatactatacgtttagaattccgccagcattaaccaatattgttttaaacggtattttgattttagttgggtttaagttcttaaaacgtgaaacggtgttctattcactctgggcggtagtctggatcagcctttttttgagagtacccgttctttggccgtatcataccagtcagacaattatcgctgccattgccggtggtgtcttaatggggatctccatggggctgattttccgtgctaaagggacgattgcaggtagtacaatattggctaaaattgttaaccgttatttcggtatccggaatgggtcagccatgttgttttttgatcttatcgtagccattccttcaggcttcattatcgggtttcaaaatatgctattaaccgcactggaactttatgtttcagctgttgtactgaataaatacttggatgcaataggcgccaaaagatcagtattggtactgtcaaaaaagaatcgggcaattggtgaagctttatccgccaacctaggacaaggggtcaccatgttgaaagcgacaggcttttatagccaagaaaatatggatgcacttttttacgtctgcagtaatcgggattggacatcggttatgccgattatcatgtcggtggatcctgaggccttggtcgtgacggatcaaattcgtagcgttcgtggacggcatttgccggatttatagatagcggattaatggttgagattagatgaacgtattacactggcttattcagggctcgactcctctccaagccaaataattttaggcatccctaaaatgtggtatcatgtaagacggaggcggtaacaatgacaacaatttacatgcgtccaacaaaaaaggatgaaacagttaaattatctgatggtagtcaagcagttgttgacgtcattaaggcaccagatggtccatgttaccagtttaggtttaatgagcatacgcacgccaatttctggtgccagcagccagtgaaggatggtcaggtaatcaaggtagcatcgattaatggaccagaaaaatttcaaattcaattacgttgatgagttgaaacatggtcatatgtcaatcaatatgtggaaatatttcagattagcagcttatcacgggctatgtcccgggaaataaaaaaggtgtgataaccagtcaaattgactggttatcacacctttttgaatacctaatgtttagctaatacgatctttatgcagtcgattccaatgtaatcgaaatagtttaacaatttcggttacgattaaaacaatgaatcccataacaattgggattccccaaccgtagtggaaattaattgctgtcgtatggaaaacaccttgcataaatggcaagtagataatcgccagctgtaagataatcagcaggccgataatgtagaatgccatcttattttggaagaaatacttggaaataacgggatggttatttcgcagattaaacaggtagaaaatcttaccgaaaatcacaatattcagtgtcatggtactacccattaacgcactgataccgtggccaactagctggtcataagcaaagatacctaggccagaaattaacagtgagacgtaaataacttccacgacatccatttttgataagatgccggctttaacatttcgtggtcctcgtaacatgatgcccgattcaactggctcaaaaataaaggcaaattgaatcgtgagggcagaaaccatgttaatccatagtaattgtgtcgggtacaacggtaatgattgatccatcacaatactcaagacaacaatgagaccttcagcaaaactagttggcaacaggaaacgaatggttttacgaatgttatcaaagacgtgacggccttccttaacggctgccaaaatggttgtgaagtcatcatcggcaagcaccatgtcagctgcacctttagcaacatcggtacctttgattcccatcgcaacaccgatatcagcttgtttcaaagcgggggcatcgttcacaccatcaccagtcattgaaaccacgtgaccaagggattgctgagcgcgaacgattcgcagtttatcggcaggggtggttctagcaaatactgtgtagttatcgatgacatttgccagttcttcatcggagagctgatttaattctggtccggtaatagctttaggagaatctgctaagtttaactgcttagcaatagcagcagcagtttctggatcatcaccagtgatcattttgacttgaataccagcgtaccgtagctttcttacagcatcagcaacttctggacggggtggatcaatgataccgactaagccgactaagtttagtcccttaccaatcatattgggatcgatttcggtaatttcctgggaaataatttggtaacccagagcgacaacccgcttaccttggcgagtcagttggctcatttgttctgccatgacaccagcgttaacttggccaccttgtttttcgattaatttagcaagcgtctgcggtgcacctttaaccatgagcacgcgctgaccgttataatctaccaaacgagcggaataccgaaaagctgaatcaaagggcaatgagtcgatttcattaacggttggttcggtgtggtttaacttgtgaaagagcgctgtgagggcaccatcggtcggttcaccagttaaaacccaatgaccgtcttcttcgttaaagacggcgtcagaggtttgtccagcgatttggactaaccagcgtaaatgctcattatgctgccaatcgacggcctcaccgttaccgttttgaatttgaccttctgaatcatagccgacgccggagacttgatactgatgttcaggcgttaagatatcggtgacggtcatttcattcttagttaaagtcccggttttatcggtgttaacaatatcaacagcgcccagtgtttcaacggcaggcagcgttttaacaatggcattttgtttcgtaagttgtctagttcccatggcaagcacaacggaagtacttgctggcaatccttctggcattgaaccgacaaccattgtgataaccgcgattaggagtgtcggtagactgtagacgtgaattgcagcgcctaaaatgaagagcaaaattgcggccaccacaatggcgactgaaagcccaacacctaaccggtttaagttctgcatcagcggggttggttgcgccttgacatcagcgacatcttgttgaattttaccaatttcggtatgtgaacccgtcgcaataacgatacctaaaccagagccactggtaacggcggtggatgcaaaggcctgattttggcgttcagctaaaggtacatcggcggcattaattggttcttcgattttttcaacggaatcagtttcaccagttagtactgattcttgaatttttaggttatcggcctcaacgagtcgtaaatcggctggaacggaatcaccagcttccaacctaacgatatcgccagtaacgagttcgcgagacggcaatgtaattttttggccgtcacgaatgacaaaactttctgagactaacaggtctttgatcttttctagggcattgtcagccgatatttcttgaaaatagccgatcagcgcattagcaataatcaccagtccaataacgattgaatctgagtaacggtgcagcacaaatgtaatgatggctgcggctagtaaaatgtagataatactgttgttgaactgttttaagaatcgcaacaaatttgaaactttcttggcttctagctcattgggaccatgttctgcgaaacgttttttagcttcaactgtgctgagtccgtcttcgcagttggtctgccattgtttttctagttcagaagtcgattggtgccaaacttgttgctgactgggtccggcgtctttgttgtcgtcggttgccacggaagtaacttgctgattgtctgaatgtgttgccataaattgatcatcctttcgtgattaacgtgtgattagcggtctggaaataccaaattactcaataattccctcaatttaatcccttctttctatattgctaagtattagattaaatattaataatgcgaaatacaagcaaaatcgctctaaagttgcacattatgcctagtttgttaaaaaaatctattttttttagatattggcctagatgaatgggcttacaaatgaaagcggaaccaaaaaataaaaatgttaaggaatacctaaaaactattttacaaattcgaaataaattgtacaattaacatgcttaacaaatctaagaagggtggtatttatcttgaaggatcaaaaaacaccacgtaagcaccatttgatcgaatacgccaatggaaagtcattggaagagatcaatggttcaattgaagttccaaagggaggtttctggaaaaccctgtttatgtattcggggcctggtgcactagttgccgtgggctatatggatcccggtaattggtcaacatcgattaccggtggtcaaaatttccagtacttgctgatgtctgttatcttgatgtcaagtttgattgcgatgttactacaatacatggcagctaaacttggcatcgtgacgcagatggatttggctcaagccattcgggcacgtacaagtaaagcattgggaatcgtactttggctgtttacagaatttgcgattatggcgactgatatcgcggaagttattggggccgccattgcgctctatctgttattccatattccacttgtctacgcggttttcattaccgtttttgatgttttgttactgctattattaaccaaaattggtttccggaaaattgaaggcattgtggtttgcttaattctggttatcctatttgttttcgcatatgaagttgctttatcaaatcctaattggcttggcgtttttggtggcttaattccgactaaggatacgttctcgagttcaattaaggctggtggcagtacgccactgactggttcgttaggtatcattggtgcgactgttatgccgcataatttatatttgcactcagccatttctcaaacccgtaaaacggatcataccgatgaagaagctgtggcacggacagttcggtttacaacttgggattcaaacattcaattgtcacttgctttcgtggtcaacgcattactgttggttatgggggttgccgtatttaagaccggtgccgttaaagatccttcgttcttcggcttattccaagcattgtcaaattcttctatgttgagtaatcccattttgattgctgttgcaaagtctggtgcactgtcagtattatttgctgttgccctacttgcttcaggtcaaaactccaccattactggaactttaactggtcaggtaatcatggagggctttattcacatgaaaatgccactgtgggctcgtcgattagtgacccgtttgatttcagtgattcctgttttgatttgtgttggaatgaccagtggtgaaacacctattcagcaacatgaggcgctaaacacgttaatgaacaattcacaagtctttctggcatttgcgttaccattctcaatgctgccattattaatgatgacagacagtgagttggaaatgggtaaacggttcaagaatactttggtcgttaaggttcttggctggttctcagtcattgccctaactgcgctaaatatgaaaggtttaccagataacatcgagggctttttaccagctaatgctagcccagcagcctttgccatggcggataacgtggcatatttccttattgtatgtgtcatgttgatgttagtttggatgatttatgatctccatcagggaaacaaacggttaaaaactaaacttggtttagctggctagatgggagtttaagatgactagaaaaactgaatttaagcatattttagtaggtgttgatgactctgaagatgcacttctagcctttcagtatgccattgatacagcgaagcggcgtcatgctgagttgaccattgtctccatacttgaaagtcatgaaatgagtgtgtatgaggcattggataaggactatattcatggggaacgtagcgaactcgataaccatattcagatgtatgttaagcaagcacagaatgctggtgttgaaaaagttgacgctttggtttcagaggggaaacccggggaagttatcgttaaatctgtgattccgcacgtcaaacccgatgtattgatcattggttcaattgctaaaaagggatttaaacgccggtttggttcacaggcagcttatatggcgaaatacgcaccgatttcagtattagtcattcgttaattgggagagtgtgacaccactcggtagaatccagaatttaacaccaaaaagcgtattccgtcgaactttgtcggaatacgcttttttgggtgttaaatggtcgaaatttgagttgtggcgccatcttagactagattaaagtattgaacaaaaacaagttttgagttgcctttcagtcaagaaactagatgaaactcttattaatataaatttatgtcacagcttctactgtcaatttttacctgaatagtcatgaattgatgcttaattattcacaatatcaaggtagaattaattatataatgaaagaaaagtattccctgggaggtgacatcatgcaaaagctttcgaattatcgacgattgtgggctgtagtaggggttggcgcagtttccttaatactagctttcgttttgaatcagccgtttggagcgcaaatcttggtaaccgttcttggctcgctgattgcactgctgatgtttattgatatggtgaaaacgctacgttccggaaagttcggtgtggatctactggcgattaccgctgtgattgctaccttggcaattggcgagtactgggcagcgctgattgtgttactgatgttgacgggtggagacgcgctagaagactatgctgctcataaggccaattcggacctgcagtccctcctagaaaaatccccgcagaaagcacatttaatggtcaacggtaacatcaaagccattgccgttgatcaggttgatgttggcgaccagctgctagttaaaccgggtgaagtggttcccgtagatggcacaatcgttgacggcagcacgactttagatgaatcgtctctgaccggtgaatctcggccagttgacaaggtggttggcgatagcgtgatgtcaggttctgtcaatggcgatgcatccattcagatgattgcggatcaaaaagcggctgacagtcaatttcaaaacattgttcggttagtgaaacaagctgaagcgcaaccggcacattttgttcgtatggctgatcgatatgcagtgccattcaccattttagcctacgtcatcgccgggactgcttggatcgtttcaggagaccctgttcggtttgcagaggtgttggttgtggcgtctccttgtccactgatactggctgcaccgattgctttagtggccgggatgagtcgggcaagtcaaagcggtatcatcgttaaaacggggacaacgcttgaacaattagccaaggtgaagaccatggcgttcgataaaaccggtacgatcacccaagggcatttacaagtgaaccaaattattgctgaacctaatattgatcaggagcgattgctaacactggctgcggcgactgaacagcagtctaatcacatcttggcccggtccttaatgcaggcggctccagctcagttgcccacggtcagtgatgtgaaagaaaccactggtggcggggtgcaagctcaaatagacggccaagtagtgcgagtgggtaaagcggattttgcgatgcctgatggttcaattcaaaaagttgaagatacggcggtatatgtttcggcggatgatcagtatttaggctgtgtcacgtttacggatgaactacggccggaagcagcaacgaccatgtctgaactgcacaagctgggcattaaaaacctgatgatgatctccggtgatcgcaaatcaattgctcaaaaaattgcgaaggcagtgggtattgatcaaatccatgctgaatgtctacccgggcaaaaaattgaagtcctcaaacaagtgccagaggagcaaaaaccagttgccatggtcggtgacggcgtaaacgatgcgccgtcactggtgactgctgatgtgggtattgccatgggtgctagtggcgcaaccacggccagtgaatcggcagatgcggttattttaaaggatgacctgcgtcgaacggtggttgctgttcgaatttctagagcaacgatgcacgtggcccgtcaatctgtcatggttggtattattatctgtacagttctgatgctgattgctagttttggtgtgattccggccatcttcggcgcactgcttcaagaagttgtggacactgtgacgatcttatgggcgttgcgggctcggagtatcgccattaaagaataagttcactaagtccagtaatgttacttgctttttaaaagtaatcattgtacgataactcgtgaaaactgaatagatttcttcggggcagggtgtaattcccgaccgatggtgacagctagattgaacaagcaatcgcaacatggctgaagtccgtgacccacgttatgcgtggttgacccagtgagagtctgggaccgacagttaaagtctggatgggagaagaaaagtactatttcgtaccattggtgtacactttttgtgtaccataaccgtatgaaatcttgtttagcttatcaatcaacgaggccccgcattttaatgcgaggccttttttgtgaggtgaatgaggtttgtgtgagtcaaagtattttcaaatagcagtagctgctgctaaacggggaactgatacctggaccaatccccaagtcggtgcagcaatcgtgaagaatcaacgagttttggcagttggttatcatcatcaatttggccagcgacacgcagaaattgacgcactagccaaactggatgatatcagtcaggctcaaggtgcaaccatgtatgtcacgctggaaccgtgcagtcactatggaaagactccgccctgtgcaaaacggctagcagaagtgggtatcgctgaggtgatcataggtcaactggatcctaaccccatcgttagtggcaagggcgttgcaattctcaaggcacatggcatcaaggtaaaagttttgggtgatagccagggactcaacgtagcgtataactatttttatcagcatggacgccccttagtgactttgaaatacgccatgtcgttggatggcaaaattaatggtgctgagaagaagcgaacgttgctgactcagactgctgctcagcaggacgttcagaagttacgacgtcatcagcaggtgatcttagtgggcgagcataccctatcgattgataatccgcgactaacagtgagaacgtcatcaatggtatttccaccgattcgagcggcactggttcatcatatcgatcaggtagacccaaagagtcacttgtttgatgagtctgcatctacctggtttttcagcgaaacggcagctaccaggccgctgcctaaaaatgttcaggttttcgtaaagccgcgttggactcctgccactgttgtccagcacttggctagtgaaggcatccaatcacttttagttgagggtggtagccatcttcaggctgcgtttatcgcggctggattggtggataacgttgttgtctatatttcaccaatgatgttaggtggtgcggggttaccagcagcaatcggacagccactgacaagtcagacgcaattcgaagtgccaacgatttcggtgcttgggcccgatattcgacttcaaacaaggaaggtgtaaggatgtttacaggtattatcaagggaataggtcatgttgtgtcaataacgaggcaagcagaaaccgcaaaattaacggtttcgtcacccttattcacacaattaaacccgcaactcggtgatagctttgccatcaatggcatctgtttaaccgttacagctgcggtgtctggacaactctgcgttgacgtgatgccagagaccactcgcctaactaatttagggcagttggaaaaaggtgacacagttaatttagaaccagcccttggtgcaacggaacgtttggatggtcactttgtgttgggccatgttgatacaacagcgaagttagtgcaacgtgttggggatcaaaatgccagcgtgctgacctttaaaattgcgccggaatatgatgattacattgttaaaaaggggtcaatcgcaatcgatggcgtgagtctaaccgtgacgcaaagcgaaccttatcaattttcagtcagcctcattccttacacgcaaaaccagaccacgttggggaaacggcaagttggtgacttagtcaatattgaaacggatgtcctaggtaagtacatcgtgggcgcacagcgaaaggaagcaatccaatgacgaatcaagcattaactcaaaaaatcgaagcagctattgagcatcttaagcaaggtaagctgattattgtagcagattctcttgaccgagaagctgaaggtgacatggtggggcttgctgattatgtttctcctgaaaatgtgaatacgatggtgacgaaagcgcgggggctcctatgcgttcctatgagcgctgatgtggctcaacggctaggattgagatccatggtgactgatgctacggatgcctacgggacggcttttacgattagtaccgatgcccgaacgactaccactggtatttcggcttatgatcgggctgctaccattgcggcgctggctaagcctgacagtcaatttgatgatttttatcacccaggtcatattttccccttgattgccaaggacaacggtgtgttagaacgcgatgggcatactgaagctgcggttgatttggctaagcttgcgggtgttcagccggtcgcctatatttgtgaagtgcttaaaaaggatggtactatggctcggcgaaaagatcttaaagcctatgcagaaggcactcagacaccactgatcaccattgaagagctgcagcagtatcgccagcttaaagctatcgaggtgattgctagcgttgaattgccgacaaaatacggcgacttcaaattgaaagcgcttaaaacaagtgctgacggcgaacccactttactcattactaaaggaaagatatctggagatgagccgttactacttcggcttcattctgaatgtctgacgggggacgtgtttgggtcaaaacggtgtgattgcggtgctcaactagcagagtcgttgaaacggattgaactggctggacgtggagcggttctatatttacgtcaagaaggccgcggtatcgggctggcaaacaagttgaaggcctatgagcttcaggaacggggtcttgatacggttgaagctaatttgcatttaggcctacctgcggatgatcgcaactatggtctggcagctgctattttgcgtcaggaaggggtttcaaccgttaatttaatgactaataatcctgataaaattaagcaattggaacaatatggcatcagggtgaatcatcgaataccgcttgaaatcggcttgacccaagaaaatgaaggctatttgaaggctaaaaagaataaatttcatcatttgttgaaggaggtatgattaaatgcaaattttaacgcattcaagacttggtaaaagcgttcgtgtcggtattgtggtggcgcagttcaacgaaattgttaccgaaaaattgcagcagggggccgtttcacaattagaaaaatacggtgtggccgatgctgatattacggtcgctagcgttccaggcgcattagaattgccgcgaatcgctcaaaagctggctgatagcggtaaagtagacggtattatcgcattgggtgcagtaattcgtggtgaaacatcacattatgactatgtatgtgcggagactgccagtggcctcgcacgtgtctcgttagatggtcctgtgccggtgatgtttggggtactgactactgataatctggatcaagcaattagtcgtgctggcggtaaaggtggtaacaagggtgcagattgcgccgatggcctaattgaaatgattaacttggagaagcaactttaaggagtatctgggttagctttcaaacttactgtaaatttttagaaatgaaataagtcctattctgaatttttatcggaataggacttatttagatcaaacaataaaaatgtttcacgtgaaacatatcctcaaatcattaactgttttgcagatgattaaaaatatcttgcatatgagtttcaatttggttgagttcagtagaatatccctttagttggctggcatattgctcaacatgatgtttatcaacgtctgttttgtatcgtagcttgtgctccaagcttgcccacatatccattcccacagttcgcagttgaatctcaacggggatttcgattggaccgttggcctggaacaccggaacagaaacaacgaggtgaaggcttcggtagccacttggtttgggatgtgaaatgtaatctttacgctttaacagggtaacatcggattgcttcgtcaacgcgtgttcaacggttttgatgtcatcaaggtaattagtaatcacccggacacccgcaatgtcaaaaatattatgtttgaccgcatcaactgaaaaatcgtacccttttttagctaacttacgaattaagctttggggcgccttcatccgggtttccatgtggtgaatcgggttgtgattctcaagcatttcaaactcactgtcgagattttctagtttagtaccaaactctttggcaccggcttggcactgctgatagtagacaaagaatcgacgtagttcggttgcatcataatcacccaacacgtgactcatttcatcggaaatctggttgatgttaggcaagttattacgttgtaaaatcataaagtgagtctcctttagtggtgatgctactattctagcacttggtgggagcacaacaaaattggtcaacggttatgaacggtgattaacgggtagtgtgcgcgttaactgttgcttgccccatgaagtgagtgctagtagtgtttgctgaaaatcttgaccctctgaggtcaactgatagtgatagtcgttggtcgatatcacgaggtttaatgccgttaactcgttaagctttaacagtaaattaaacgttgagataccacgaacggcatttcgcagctgcataaagtcgctggtagatgacgttaaatttaacagaatcaacgcgtaccacttatctgaaagaactgctaagccagcttgggtgctaatatttaaatcgcgcatgggcaacgttgttcaactcctctttttgcattaaaccctaattctagtctcttcacattaaggtgaccagtaaagacacttgaacggcgtcatagaaaggatgcagaatccccaaaagttgtcttttaggcttgacttcgtggaaattaagcgtaatatattgtgcaattaaagcagcttgaagggagctgggcatatgaaacgaacttggatgattacaggaatgagcagcagctttggtcaacgcctgattcaaaacttgatcaagaagggtaagctggcaacaactaatgcccagaatgaattgaaaatcaaatcgcgtgaccaaggtcaggttgatttgatgattaacttacgtggttaatgacaattaataaacatctaataagttctgatattaatcgatgtaaatcgattggtatcagaacttttttattaggtttttagaactgtgatacaactcgaatttcaactatttaagacgaataaacgccatcccctaacttggatggcgtttattcgtcttaaatggttgaaaaaatctatagatgattagttttgatgtctaccgaactgggcaagcaccaccgatgcagtcggactgatcaagcagatccagatcctttttatccatcgtctttagtgagtcatacacgtccttcacgttattggtgatctgggcgcgatgctgttcataaacggcctttgaaattggttctttaggggcctgcttaaagtcgctaccactgtaaggcagtaatgaagtggacttgatgttgtggcggtactgcttcatcaaaccagcaatcttgctaccttcttgctttggctgaaaggtgatcgtgcagctgacagcgttatctgaccaatatttctgtaagaaggcttgggtagcaaattgttcttcaattgagacagttcctgcagaagcaaattctttgctatcagcgtgagcagcccgaactgggaactcaacgcaaacggtattcttggtgtaaacatctggttcagtcttgtagccagaaagccgtaatgctggtagcagtggatcactgtcttggaatcgaatccgttgaattaagtaaccagcataatggaagtgcatgccttcggaaacgccggctaattttgccaccgttcctgatggtttaacggtagtatgcttcacagaaggggcgcaatccaatgtgttggagtatgcgttgtccgctgcaacaatatcatgataaagttcgtcaaacttagcaactacccgttggtcgtaaacgggttctttgatagcttcgtgggtttcgggatcaatgccatctttaaagccacggacgactcggttaccaaaggcttttaggatccagtcctgaatgcctgacattgagatgccgattcggtgattttgattaatgacgttgcgggaaacttcccaatcgtagttactaaaggttacccgcttagcaaagcgggttcctagtgtaaaggcttggtcaaggtcaaagccctgttctgttgcgacggaagggaagacttcgaagaggttgcaaggttctccgttagctagtgaaatctcgccacaagggttcgttccttcaacggcgccatcaataccttcctggcggccgtcaatcaagcgaccgtagtttttggataattctaggttaacgatcccgggttcaccattgtgtaaaatagaatcagcaaccgctgtataatcagttttatgcgtatcgactgcgacactattattagatgcccagcgatggtggtatagcttcttttgatcttgcttcatggtaataaaagcatcgtcatcgctagaacctaaggctaattctgcagagcgccgcacgtttccggctaccaccgttttgccaatcaagttacccatatcggtgcagtccactgaagatagcttttgacccacgcgagaattcagcagggtattcgtgtcaaataacatttcaatcagtggcattgggccggaagctgtaccaccaaaacctttgattttagcaccctttggtcggatgtcactgacgtctaaaatcaagttgttcatgtgttccgggttagtcccgctgaagtgcatgtccacaaggtgggcgtttgctaaaacccagccttcgcgagtatctggcagtttgtagtaacgaccttcatctagggaatggtctttcaaccattcctgtttatcagtcgcacctaaggcaacggaatcagtgtaagactggcttgccttatccaccaaaatggttaagtgaacattgttatctacggctggaatctgctgaacgttgttttgtacaacagaaaagccgacaccgccgcccttcattaactgatcaaacatgaacgaaaacggcattgaaacggctggctgatctcgatcaaggtattccggcacaatgtgactgtcaccatatggttgtggtcgaaccgcaataaaccagcagttgtttaacgcatcaccgttacgctcttgatatggcgtcccagaaatccataagttccggccagatggtgtagcagaaagactgtagattaacttaaagaggtcttgtgcttcggtttcaagttcactgatcacctctgggtcgatgtgatcctcgtgaagtcggggatccaagttaatgtttccttcaacgactcgtttaacggtttcatcccactcttcgtgacgattttccgcttcaatccaacgtgaatatgtacgtttataagtgacccatccaagttcgccccagtgtggtttgatctcggctttgactttttcaataaatttatctgataatgtaattaaacggttaactgcaacttgcataacggttcctccttctcaaactcaacactatatatagtatcgtcactttaacaaaatatcaatatacagtgtttgaacacgagttcgattaagcaaaccaaaaacccctgtagcacggatttcgtcgcttacaaatttatttaagcgtactgatatgctaggcaacgtatccaatatgttggtaggctactgagactaaatcttcaaataaacaggatgtacgttgcctagtaaactaagaaatcaattagaatagtcagcgttttacgatttgagtagagggctcgcatcctctcgtaatattgattgtaggccgtctatatgacgactgatatagatgtctattcgtttattaatgaaggtccgaatcgttgacaaaacaggtaatgacttgtaatctaatcaattagttagtagatgtgtcaattaagttaacatggttaactaatcgaacagcattaattttgtaagagagaaggcagttacgtgttagagaaaaccgtgtatcgacaattattgagccacgcatttgatatcccgatttcagtaacctattgggatggtaaagaagaaaattatggtgaaggcgaaccagttgttaaagtccggtttaatgaagaacttccattgaagagcttcactgacgagccgactttaacattagctgaggactacatgaagggtgccatcgaaattgatggtagcattgaagaactagtggcttcagcatatcgaacagatcatagctttttaactaataatccgttcatcaagcattttccaaagcgttctcattccgaaaagagcagtcaaaaagacgttcaaagtcactacgatattggtaacgacttctatgagatgtggttggataagaccatgacctattcatgtgcttattttgaacacgatgatgatactttagaagaagcacagataaacaaggtgcaccatattttgaataaactacaaccagaacccggcaaacgtttactggatattggtagtggctggggtactttattatttgtcgctgctgaagaatatggtttgcatgctactgggatcacccttagtcaggaacaatatgactacacacagcaacaaatcaaggaacgccaccttgaaggtaaggttgacgtgttattagaagactaccgtgaagtggatgatcaattcgattacgtgacttctgttgggatgttcgaacacgttggtaaggaaaaccttggtctgtactttaaaaaggttgccgatttcatgaagcctaatggccgtgcgttgattcacggtatcaccggtcaacacgaaggcgctggggtcgatccatttattactaaatatgtcttccctggtggctatattcctaacgttgctgaaaacttaaagcacattatggatgctaagttacagttttctgacctcgaaccattacgtcgtcattatcaaaagacccttgaaatgtggtacgaaaactacaagaaggtcgaagataagactgctgaaaagtacggtaaagaatttgctcgcatgtggggcatgtatcttcaagcctgtgctggttcatttaaaggtggcaacattgatgtcatgcaatacctattggttaaagcaccaagtggtactggcttaccaatgactcgtcagtatatgtatgatgctgataagaaagaagcaagtgtaaagcaacttggctaggttttagaatataatatccaagagcgtcatttcgatagtttttatcgggatggcgttttttggtgttattcggccggagaaaagtgataaagcccaaccacaatattttacaaaccaatcctattatcgctatgatagtgatagaagctatcgttggaggggataatgtggtatcagttcaagttttagaagcgtttattcaaggaaaagtgaacgatgaaaaatgtgaagataccatcgtgaacacgtcggatttcattgcgatcgttgacggtgttaccagtaaatctaattttcaatatcagggtaaaacgactgggaaacttgcatctaccatgattgcaagtattttggagcgactgcctaaggacgcgacgttatcaatgctgataaaacaagtgaatcaagcattcgctgctttctatcaaaaaattgacttcccagttgaccgtgatagccaggggttacaagccgttgccgtggtttattcacgctttcgtaatgaactgtggcaggttggtgatgcgcaaatcaatttagacggtcaattactcatcaaccccaaacccagtgatttagttttatcgaatatgcgtagtttgatcctgcggctgtcacctgatgataagcagtcagaccccggtcgcaaagctattttaccgtggattttaaaggctactcaatttgctaatgcgactgatagtgagtggggctatgcgatttttaacggacaacccatcccagattcactgttgaaggtctatccactatcaagtggggagcacgaaatcgtgttagctagtgacggttatcccaaagcggcggttaatttggctgagtcggaagcgggtctacgagaggttttgcaaaatgatcccacctgcagccatgagtaccggtcaactaagggtattgtgtctggtaaccgctcatttgatgatcgtagcctcattcactttaaagtattgccaagttaatctaatgaaaaaaatccccttagaatttggctgatgaagtcagctttcaattctaaggggattttatgtttaaccattactttttcgtattagcggcgttacgcttagcatcacggatgattttcatcgcccgtttacgcgtttttaaactgggactcttaagtcgccggtaagcgctagccatatcagttttttccatgagtgatctccttataactttaccaagaagccttacggacaccaggaatttgaccaaggtgagcgtatttccggaaattcaaacgggacatattgaacttacgcatgtagccacgtggccgaccgtctaacccgtcccggttacgtagccgattagggttagaatcctttggtaagcgagccaaagcttcatagtcgccttgagcctttagttcacgccgaatagtggcatatttcgcgatgagttcacgctgtttgttatactttgcaatctttgatttttttgccatatttcctccaatgacttagtgatgttagtgcaacaaactcattaagtaactgccaggtcaatggtgttagtagtatttattccgtcacaacaatggtaataacttaccaataataagggaaaattgccactatttagacttgatttaattaaactgtaataattacgctttaccattaacccagactgactagaagtatgttaaaataataactgaaaattaaatgcactaggggcgccatgtggctgagatagatgaatctagtcccttcgaacctgtatagttaatacttgcgaaggaaagtgtacgtgaacatcaaaaaattaatgatggtctttcagtgcgcggaactaactgcggctgaaagacctttttaattggaagaagggtttttaatgggaaatacgaaaccaagcggtctgtttctgctctggatgggtgcggcgatatcaattgctgagattgtgactggtacacttattgcaccattagggtggaagagcggtttgctggcgattttaattgggcacgtgattggctgttttgtttttctgctgccagcgggttatttgtcagctcagcagaacaaaacggcgattcaagcgactaaaaccgtttttggccagcaaggtgtttggctgttttcaatgttaaacgcactgcagttgctagggtggacggcggtaatgatcgtcaatgctcagcaggccatgaatgggctatcaaaggcgttgttcaactatcaatcagtattggtgatgtcactcatcgtggcggtgttgatcgtggtttggctgttaatggatcacgactggcttttcaaagtgaacaacgtcattgttgttctactcgccattggcatgatcctgatgctgtggaccattatgaaggaaggccgcttgcaaaatagtgccaatttagcaccattaagttttggcagtgtggttgaacttaacgtgaccatggcactttcctggttaccgctgattggcgattatactcagcatactgaccgaccgtttcgcacgagtatggccagcgtgagcggctactttattgccagtgtggcgatgttttcactgggactatttacggtgattttgaccggccaatctgattttacgacggtgctttcacattccagcatgggaatgattgctttgctggtgattgttttttcaacggtaaccacgacctttatggatgcctattcggcagctaccaatatcgctaacttgataaagacgaaagcggttaatttggttgctataggtgtcacggtattaggtttactgattgcgctgtttgtttcaatggcgtactatcagaactttttatacgctattggggcggtgttcacaccgttatttgccattttatttgtcagcgtcttcttgatgcaccaacggctttcgttgccgctaaactttctttggtggctgatcggcgttgttggttattcgtggttgcagaagttggacttcttcttggggacgaccttcttcctactattggtgctggggttaggcgtttacctaacaggtttggctaccaaaaagtacccgttgatgacggattaattgagtggcttattatggagaagaatggaaaggaacgagcacgatgactaagagagtttattatttaaccctaacttcggttcttgtggcattaggtgtaatcggtggcagtttgtttgaatttacagtaggtgtagcaaaagttgcgccaatgcaacacttgatcaacgttgtatctggggccttgttaggaccttggtgggcaatgacacaggcatttttaacgtccttgattcgtaatttactgggtactggtacgattttagcttttcctggtagcatgtttggtgcttttttaagtggtttactattcagatacaccaaacggttgattgcggcggtgtttggtgaattgattgggactggcatcataggtgcaattgtcgcttacccaattgcagcgctactattaggagcgaagggtgcgctttggctatttgtaccaagtttctttcttagtgcgttggttggttcagtgattgcttatgtgttgttaaagagtatctggtcaacggtgattcagccacagatgaacaggctgagtaagtagtattaaaataacgtgcttatcagtaagaatactggtaggcacgttatttcactaaataatctggtattgattgtccgttaatgcaaagtggtctttcaagccggatgtgatggctaccttgaagtcacgagtgacaaagatagcgtccagtcccggctgtttttcaattaacgggatgcctttatcgatatcttgatagaaggcttcagtggtccaaatatcgccatcaatggacaaatcgctaacgatggtgacactttccaagtcgttttgaatcgggtaacccgttttagaatcaaacatatggtggtaattgtgaccgttaatcacgaggtaacgttcgtaaatgccggaagtgacgattgatttagcagttgtggtaaggacaccaagagccacatgacgctgtttcaacgggttttggacaccgatgcgccataagccgttagtgtgagtactatcacctactagtaaaatattaccgccaaggttgatgatgccgcttttgacacctcgggaaagccataatgttttgacagcatcggcaatgtagcctttagcgatggcgccaaggtcaatttccatcccaggtttggtgagaaaaacggttcgatcgtgatcatctagttgaatatcagctggatcaatcagttcaagacgttgtttaatatcagcatcggctggtaagttagcaccatcaaacccaattttccataactttaccaggggtccaatagcggtgttaaagcctaagtgccattgactgacttccacagcacgcttgattaactgataggtgatatccgatacttgaacgggttcttgaccagctgcgtggtttacggacatcacttctgaaacgggacgattaaccgttaaaatatcttcatagtgtttgatgaggtcattacctgcatccaaatcagcggttgttgctggttcgttcactgagagggtgatagcagtgcctaagccataatattgtttttgaatcatttggggttcacgccttccataaaattcctatgagtttaagataacacaaaaccgcgctgactgaatataacagtcaacgcggttcattgtctaacatgaaagatctaaacttaagagaatggaatttgcacttctatcgttcgttcagatgtcttgattacggtcgacagggtggcgattgcttgatgagcaaaactcgcttgcgaacctgctaccatcatcgttttacagtagtttctttcatacgcatgtcctccatttagtcctgatgatacatatgtacggaatcttaaaacagcaacgtcacctcctagattcaaaagacatcatgctgaaagctaaagttgattgcgtatgccttttgttgaattgcagttactataacattaaaaacaaatgagttcaatattaaattaagattaaaacaataaaatttgaagctggacgattaatacccctaagccttgccatttaactcggagcagcgtaccttaaaagttgtgtcaaagagaaaaagagaagagagggtcaaaagtgaaagttgaaaaactatcgaacttaacggaagtaaatgagaaggcgctgatggccatttggctcgcaggaaatttagattctcacccgtttattgctgcaacatattggcaggatcaaacctctgaagtttcaaagcaattcgaaaaagcaacggtttacgttgtattgcaagatgagcagattgtggggtttgcggtgatgaagacgcactatctagctggtatgttcgtcaaaccgggataccgtgacgaggggattggtagcctgttactgttcgcactgaagtcagactataagcaaattcgtttgagtgtttatgaaaaaaatagtaaagcagttcgtttctatcagaatcatgattttgggatcaaagatcggtctgtgaacccagatacggatgaagttgagttaaaaatgaagtggaaagaataacaagtagtggacgctacggtttgactgatgtagctgaattcagggataattgcgggtcgtaacacttatcctttgaatccttgttcacccctagtcttctataggacaaaaggcttataatagacaggtaataaagagaattgaagacaattagttcaaagcttcgatattataattaggggggtaatctagatggggatcattctagtatttatatttggtatgatgactgttatggggggattatcgtggtggtatgcggctcactataacggactagtaggcacgacacggtttttgacgattatcagtgtggctggcttactgtttagttttggctacgtttataaaaatggctgggtgaagccaaagcagacgcagacgacttcacaaaaggcgaatgttaattctaatcaatattttgctcaaaagagttcagaatctgcgtcaattgcgcaactgcataaaaatgagcaaaacgttttgcagcagttgcaaaaatcatacagtaagaatgttggtgacgtcagttttgatcaggattctaagacgtatacggttacgccaacgaacgcaaagtacattaaggcagttaccacaatgtggcagtatcctaaaacaaatgctaagaatatcaagacgatgtccgataattatttgaaaatgtctcagtcgatagataaatccttgaaggggagttatacactccaagtaaagaagtcgaagagtgggccagtgattttgtctatcaaggatggtaaagcgactatcttgaatgagagtcagcagaagtaaaaatagacgttattccgataaaaacggaatagcgtctattttttagattgtgtcatcagagttgttctctattctgctgtcaccggtttagaaacacccgttgttttttgtttatcataaacaattcgggtctgtttggtgacctgcgtcaggatcaggtagtggttatcattaatggcagagctatagccaccataataatggccgtcgattttttgaggctgaatacgtttatcgaaagtgtagttggatagtgaaagttcactggccatgatcacgttagcgtcgccgtactgaaccgtttttaccgggtagagtttcagcccgaattgttcaccatgagattgctggactgccgtcagtgggtaggcgactggtgcggcgtacttgcttggattgtcatgaattgcttcattaatctttaaatattgctgtaaggctttaacctgtgatgggtcactatttgatttttgcagacgcttcaagtctgatttaataccagcaatgctgctagcaactttatcttgttgtgtggtaacacccgcacgaaaggcttgtttgtcctgattcttcgcccagttgatttgcgctgacgtggacatgtgagataaccggttgagcgccaccttatttttgcccgttggcagcatataggtggttactttgccttttttaaggacaaacagggcgttaactgaatctttagctgttacgtgactatgagattgggaaaaatgataccaaatacgtggttgatcagtctggcctgatttaaccagtgccagtttatcgataggttgagtttgtcttttttgattaccgcaagccgttaaccaacaaccggcaaagacaatcaaaaagctgagtagtaagtgtttaaagcggaacaaaattttccctcctaaaatgatgtaccccaaagcaaatttaattagagattaattttactataaaaagggcgataatcatacaaacctgattaaattgtctgcaaaattaaagttgaatatttctgaaatcgttttcaaatagttcgtgtgaaaatgcaaactagcattaataaaattcatttgaattgtaaaaaaatgtaaaacagccaaattatccctttaaatacctatatatcaacctcataacaaattgtaataacgttatgaatgtttgactataacaggtatcagttattattctaaatacgttagtgaataatatcacgaaataataattgctattacttatatattccgtcacaaaatcaatggaggtcaaaaacatggcagactacagaattgaatcagatacgattggcgaagttaagatcccttccaccgcactctggggtgcgcaaactgaaagaagtcgtaataacttcccaactggcgaaaagatgccacttgaaattatcaaggcgctattacagattaaaaaagccgcagccactgctaataaagagttaaagaacattgacggtgctaaggcggacttgatcgttgaagcgattgatacgttattagcacttgatgacgaggatttacgtaaggactttccactggtggtttatcaaacgggttcaggtactcaaaccaacatgaacgttaacgaagtggtagctcaccaagcagctaagcttaacgctgagattgaaattttacccaatgatgatgttaacaagggtcaaagctcaaacgatatcttcccaacagccatgaacatcaccgctgcaaaggctgttagcagcttggaagaatcaacccagcacttaatcgatgaattaaaagttaaacaagaaaaatactggaagacggttaaaattggccggacccacctgcaagatgcgactccattaacttttggccaagaagtttctggttgggtcagcgcattagaacatgatttagactacctgcaaactttaggtaaaacccttagcgaattagcaatgggtggtaccgcagttggcactggtttgaacgctgcacctggttttgccggcattattgctgacaagatgggcgaagtatacggccttcacttcactgctgataccaacaaattctatggtttggctcaccactctggtttaaacgttgtccatggggccatcaagacgcttgctgctgatctgatgaagattgctaacgacgtgcgtttcttggcttcaggtccacgtgccggttacggtgaattgaatattccagctaacgaacccggttcttcaatcatgcctgggaaggttaacccaacccaagctgaagccatcaccatggcggctgttcaagtaatgggtaacgatgtggtcgttgatttagcatcaagccaaggtaatttcgaaatgaacgtttacaaacctgttctgatttctgcattccttgaatcagccgaattacttgcaggaaccatgcgtggttttgccgacaagatgatccatggtttaactgtcaactcagaacggatggaagaattggttgaccgctcactgatgacggttacggcattgtcaccacatatcggttaccacgaaagtgctacgattgcacaagaagccttaaaagaaggcacccttttgaaagaagccgctttgaagtcaggcttattgacagaagaagagtatgataaatgggttgtgccaatcaacatgactaacattgatcaaaagtaaacttaacaacacaatcaattaagaacaggaggtatgaacagtaactattttgttgtaaaaggatatcaatctttgtaaagtgttgcttctatactattgcgtatgcttataagcctagtagaagatatcacaaggttaaagttaggcgtttaattttccgtattagctgatagcttatatgtagtgatttatatgaatttcattaaaaagctttttaagataaagccatcccgtataatatgagggacacctcaccttggtgattaaattcaataaggcggaacagttgatgttactcacctataaagtcgaaattaaaccgactgaaaaacaagcctggcagattgattgtcatattggtggcagtcgttgggcttataacctgtttttggatatcaaccggcagcgctatgaaatgggttattgctacttaaacgcttacgcctttagtaagtggtttaaccatgagtatctagaagctaaccctgatgatctatggatcaaggatttatatgccaaatccattaaacaagcctttattgatgctgattcggccatgaaacgctttttcaaaaaacagagcggtttcccacattggcgctcgtttaagcgtggtcagggcagttattactttgttaagaacggtaaaacgcaaatcattgcctgtcagcgtcaccgaatcaagctaccaaagcttggctgggtacgcttgaaagagctgggctacattccgacagactcagaacacttcgttatcaaacaaggtcggattaaattcaaagctggtcggtattacctgacctgtttagtggaacaggctgaactaccaaaatttgaattaaccggcgaaccaattggtattgatcttggcctaaaagaatttgctattttaaatgatggtactttgtatcctaatcagaataaaagtagtcgcgtaagacggatcagaaaacgtctgcgcagactgcaaagaaagttgtcccgtcagtatcaagcactgaaagctagaagacagaaagaaggaaagtctgctactgatttaaatctagctaaaactcagcgggaagtgcaacgcttgtatcaacgattaaccaatattcagtcagattatcaaaataagattattactgctgtggtgagaaccaagccacagtgggtagccttagaagacctgaatgttagaggtatgatgaaaaatcggcatttagccaaagcagttagttaccaggggttctataattttagaatcaaattagtttctaaatgccaacagttaggcattcccgtacatctgacccaccgttttgaaccgacttcaaaattgtgtcaccaatgtggccataagaaagttgatttgaaattaaaagatcgggtgtatgaatgtcagaactgtaattataccgaagatcgagatattaatgcggtcctgaatatcagggatactgaaaactttgaattagcctactaaaacaggcttcaaaggatgtaccggtggctagccgggaattaacgcttgtggactatcatatcaactgtactagtgagctttgtgcgaggcaggatagggagaagcaagaataatctataactttttataagttatcagtagcagcataaaaatggctgaaaaatttcattttcaaccaacctcactcacgaagttgcgcaagcattatgacgtgattgtgattggttcaggtgcagctgggatgacggctgccattcaggcacacgagttaggactaaaacccgttatccttgaaaaaatggataaattgggtggtaacaccaaccgagcttcatcagggatgaatgcggctgaaactaacgtccagttaaaacatcacgtggtggacagtttccaggaattctacgatgaaaccttaaagggtggcggtggccaaaacaacactgaattattgaaatacttcagtgaacacgctgctttagcaattgactggttagcagatcatgatattcaattggacgaaatcacgatcactggtggcatgagcaagatgcggacccaccggcctcattcactggccgcaattggtggctttctagtgactgagctgttgagacaagttcaaaaggcgcatattccgctatttgccggtcttaaggtgactgaattaaccactgatgaagagggtaaagtcaccggtgtgcgtgccacaactgggaagcaaagcggtccgttgacggcggatgcagttattctggctgccggcggttttggtgctaaccaagacatgctgacaaagtatcgtcctgatttaaagggcatgaagacgaccaaccaacctggtgcaactggcgatggcattaagcttgctcagtcattaggcgccaaattagtcgatatggatcaagttcaagttcacccaacagttcaacaagacacgccacacgcttatttgatcggtgaagctgttcgtggtgaaggtgcaatcttagtgaataagcatggggaccggttcgttaacgaactggatacccggaagaacgttactgctgcaatcgatgaactgaatgaaaacggcgcttatttgatttttgaccaaggcattcgtgaccgtgctaaagccgttgagttctacgattcaatcggtttggttcacaccggtcagtcattggatgatttggcaagtcagctgggcttcgatgctgaaacattgaagcaaacggtcagcgactggaatactgccgttgcagatcaaaatgattcagcgttcggtcgaactactgggatggatcgcgacatttcgacagcaccattcttcgccattcacatcgcaccagccgttcactacaccatgggtggtattgcaatcaaccataaaactgaagtactcaatgaagatggccaagctatcaagggtctctacgctgctggcgaaattgttggtggtcttcacggtaataaccgaatcggcggtaactcaattgctgaaactgttatttttggtcgtcaagccggcgaacaagtcttcaactacattaatgaaaaataatgccctttatttaggagaacatctaaaatgacacttaataaaattaattataagaaatttattttgccgattattgtcggtttaatcatctggtttctagcaccgattaaaccagctggtgtttcgctggttgcgtggcacatgttagccatcttcgttgccacgattcttggctgtattactcaacccctgcccatcgctggggtagcacttattggaatgacaatttctgttttacttggcgttgtcaagatggaagacgccactgcaggttttggtaatgataccgtttggatgattgggatggcttacttcctgtcacgcggatttattaataccggacttggtcgtcgaatcgcgatgattttcgttcgcttatttggtaaacgaacactgggattatcgtatgctttacttggtgttgatctagtcacttctccagccacaccaagtaacacagctcgtgctggtgggatcgttatgcccatcatcgagtctttgtccgaatcatttgggtcaactcctaaagacgggacccaaagcaagattggttcgtacttaatgttcactgaattccacggtaacattattacttctgggatgtttatgaccgccatggcacctaatttggttgccgttgctttagctaaaggcatgcacgttcagatttcgtggatgggttggtttattgcggcacttgttcctggtattatttgcttaatcctagttccatggctgatctacaaaatgtatccgcctgaaatcaaggaaactccgaacgctaaggaatgggctgacaagcagttagctgaaatgggtaagatgagtttacctgaaaagattatggcagcggttttcgtgctcgccttagttctttggatggtttctagctttattggtttggaagcatccacggttgctttcttagccgttggattattgctgttgaccggtgttttaagcgtgaaggatgtattgaatgaaactggcgcatggaataccatcatttggttctcaatcctgattttcatggccaatgaattaaaccttttaggctttattccttggttatcaaaagctttgggtaccagtcttcacggtatgagctgggaaatcgttcttgtggtattggttctgttctacttctacagtcattacctgtttgcatcatgaactgcgcacgttacggcaatgtacggtgctttgctggccgttgctatttcagccggcgcaccagcaacctttgctgcaatgattctcggctttaccggtgcaatcttcggttcaacgacacaatatgctaacggtcctgcttcagcaatttttggtgctgggtacaacaagcaaagcgactggtggcgtctaaactttattctaggtttggtctacctcgtcgtttggggtggtattggttctatctggatgaaagtgcttggtatgtggtaaaaatttagaatataataaaaaagttgtacctactagtgaagtgggcacaactttttaatttgtgataagctatggtgaatgatttaatctgaggagatttgcggatgaacaccaaagacctagcttattttaaagccttagttgaaaagcgaaactttactgccgttgcaaaggcgtttaacgtttctcagccaaccgtcacgcaagcagtgaagcgactggaacgagaattcgaagatgaattagtccacgtggaccgggcgcacagtcgaaccgaaatcacgcggtccggcttattattgtacgaaaaagcgagttcaatcaccgctagcttaaatttagctcatcaagagattgaaaacgctaagttatcccggatccggtttggcttaccgccgattattggttcactgtactttccctcactagctggtcaactgttgaaagatggtctgctgcaacgcttggatgttgtcgaaaccggttctggcggcttacttaattcggtgaaaaatggtgaaactgatattgctttgctggcttcagtactgccgctgcatgatccttcactaaacgtgattcacattggcagtcggccattcgtagtcgtcgttagtcggcagcaccgattagctaatcggggaagtgtattctttaaagagctggcggatgaagagtttatcatgttaaaccgcaagtttgttcacccagcggcttttaaagcatattgccagtttgcgggggttaatccgcctgttatttataagacgccagatatttcctggattaccagtttagtcaaagaaaatttgggcatcagtctgttagctcgtgacgtggttagttccagtgatgaagaagaattagcctgcttaaaggtgctggatccggtagctgagcgtttcaacgtctcaatcgtgacacggcaagggtacgttttcacgccagatgaagaacactttgtgcaggatttgagacagttaaagattccacagagttaaggctgttaaattgaattaaaaaagcgttgtcccgaagaaaattgggataacgcttatttttgcttcaaatgattattgaagatagtaaatagttccgttgcttcaacctctttgttattgtcgcggttcacaagagcgaccagttcatcatcggtgaaagtcagttcataatcgtttaaatctgctaaagcagcgactgcaattgcggcagtttgcaaattcatattgacgaatggtttaccggaaatgatggcatcaagtaaaaaaccagttttattggcgaccatctcgtgtaaattttgatcataagcattagattgtggtaccgcaatgactttatccaattggtcagcgtttttgataccgggttgcttgccagccctgatggctaaacgactattaatagcaactaattcgtctgctgttaaataacgcattacatgtccccctgtatttgatccaatatgccttcaaactgatcgatgaccgtttccaaactttggaaaaagtgagcatcgagctgcacgttattacggaaagagacgtcgatgtcatctcccttttgaacttctagtttgcgggcaatgtttgcggggatcgtaattgccaatgagttaccaacctggatgatttgacgctgtgatttgatttcgttcataagctcaaatggttcctttcgttataacaaattcataatttcttaaagtagtatagcatatttgatctagttcgtcataacaaattagctgagatgtccttatattctgattttatatggactattgtggaatatatttctgtgaaaaaagaatgttggaaaacaatgtcatttcgctaaaacgatagtagtagggcgtatacttgcaatttagctcatttattttcaggaatattagaaaacggtttgtcagctctcatttgatatgctagtctgtgagcatactaaaaacgacgaaagataaggaggtacatctgatgactgttcaattcaataacaactcaacacttgcaacctctttattagccttattattatgacctaggatttgacaatgtaacacgtcaagtcctatttgcgttatggaatggggcttgtcaaaacaacaccccattcgatgcgaatgaggtgttgtttttggttaacaatcaaatttgaagggatgattattatgactaaacagattcagttttttgatacgacgcttcgtgatggtgaacagacgattggggttaacttcagtattgatgaaaaagtagcgattgctaaacagctcgaagcttggggcgttgacgtgattgaagcgggtttcccagtggcttctaagggtgacttcgaggcggttcaagcagtgtcgcgagccgtgaagcaggcctgcgttactggcctagcgcgggcccgaaaaggtgatattgacacctgtgtaaaagcaaccgcggatgctgcacataaacaagtccacgttttcattgcaactagtccgattcaccgtgattcaaaactacatatgtctaagcaacaagtgattgataccattaccgattgcgtctcatacgcccatcagttctttgatatcgtggaattctcaccagaagatgccacgcgaaccgaacccgatttcttggttgaagccattaacgccgcaacggcagctggtgctactgttatcaatattccggatacggtagggtataccaaccccgctgaatttgccgcactctttaagaaccttcgcgaaaacgtgaccgactttgacaagtacaccttctcagttcactgtcatgatgatcttggcatggcggttgctaacagccttgcttccattgaaaacggtgcgacccgaatcgaaggcaccatcaacggtatcggtgaacgtgccggtaacgccgcgctagaagaagttgcagcagcgatgtatgttcgcaaggattactatgatgccacgaacaacatcaatatgaaggaaactaagcacaccagcgatatgatcagcaagtttgctaagatgccggtaccgcataacaaagccgtggttggtgccaacgccttcgcacacgaatctgggattcatcaagatggaatgctgaagaatccacaaacctatgaaattctcacgccagaatgtgtcggtgcccacaagactacgttgccacttggtaaactttcagggtcacatgccgtgatgactaagctgaatgagatgggctatcatgtcaaccgtgatgatatgaaagttattttcccacactttaaagataaggctgatcataccgatatcgtttcagaaaatgatcttcgagtgattatgaacaaatttagtgaggtgagcgcataatgacagccaatattacagtacttgctggtgattatatcggtccagaaatcatggcggcgggcttaaaagtattagccgcagttagtgaaaatcaggatttcgattatcagcttcacaagatgccctttggcggtgccggaattgaccagacaggagaaccactacctgctgaaacacttaaagctgctcagcaaagtgacgcggttttactcgctgccattggcggtcctaaatgggacggtgcgccaaagacaccagagcaaggactattggcaatccgcaaagcactaaatttgttcgcaaacattcgaccaactgaaatcagtaccgcgatgcagcagtattcaccacttaaaaatacggaaccagtggattttgttatcgttcgtgaattaaccagcggaatttacttcgggactccccgtgaaacgactgcggactatgccttggacaccatgcgttacaccaacgaagaaatcgaacggattacccgggtggctttcgacatggccatgaagcggcgtaagcacgtgacattggttgataaagccaacgtgctggataccagtaaattgtggcggaaaattgtcgctgaaattgcaactgactatccagaagtgacctatgatactagctacgtagacgctgcttccatgaaaatcattgcttcaccaagccagtttgatgtgatcctgactgaaaatctctttggtgatattctcagtgatgaagccgctcagactaccggttcattaggaacgattccatctatgagccgcggggttgacggaccatcgttatacgaaccaattcacggttcagcacctgatattgctggtaaaggcattgctgatccaatttcaatgattcgttcagttgccatgatgcttacccactcgtttaaccgggacgacatggcgaaggaaattagcgatgcgattaaccagacagtaacggctggcgttgtgacacctgatttgggcggacacgcgactactgataagatgacagagacaattattaattatattaaggaaagcaggcattcatatgagccagaccatgtttgataaaatttggaatcagcacgtgattacgggaaaggttggggacccgcaactgatctacgttgatctgcacttacttcatgaagtaacttcaccacaagcttttgaaggcttgcgtgaaaatcaccggcaagtacgccgaactgataaaacctttgcaaccatggatcataacgtaccgacgaaggacatttttaacattaaagatgaaatttcgcgtaagcagattgacactttaggtaaaaatgccaaggaattcggcgttcgcttagcaggtatgggggatgaagatcaaggcattattcacgtcattggtcctcagttaggtctaacacagccaggcatggttatcgtttgtggggattcacacactgcaactcacggggcttttggttccattgcgtttgggattgggacttcggaagtcgaacacgttttagccacccaaaccatttggcaaacgaaaccgaagaccatgggtattcacattcacggccagttgcccaagggggtgtacgccaaggacatcattatggggttgattgcccgtgaaggcgtctcgtttgggactggttacgctgctgaattctacggtgataccgtggaacggatgagcatggaagagcggatgacactaagcaacatggccattgaaggtggcgcgaaagtcggtaccattcgacctgatcaaacgacttttgattacgtggctggccggaaatatgcacctaagaatatggataaagccattgaatattggaaacagtattacacggatgatgaatcagcctttgaccgggtggtggactttgatgtcagtgatctggcaccattcgtttcatgggggaccaatcccggcatggcggtaccggtggatcaaccgtttccagaaatcaaaaacgctgacgatcagaaagcatacgactatgtgggcctcaaaccagggcaaaaggcgccagaaattccaatcgaatttgctttctttggctcctgcactaacggtcggctatcagacttgaagattgcggcctcagtattgaagggtcatcatattgcaccgcaagtaacggcattggttgttcctggttcgcgaactatcaaggaagcagccgagaaacagggcattgataaaatctttaaggaggctggctgtgattggcgcgaacccggttgctcagcttgcttgggtatgaatccggatcaagttcccgcaggtgtccactgtgcgtcaacttccaaccgaaactttgaaggtcggcaaggtgctggctcacggactcatctggcaagtccagcgatggttgctgcggcagccatcaatggtcattttgtagatatcagaaaggcaggcgtggcataatggaacccattacgacgattacaagtccttcagtgccaatcatgaaggataacattgatactgatcagttgattcccaagcaatttttgaagaatatcttgaaggttgggtatgggcagcacctgttcttcgactggcgttacgataaaagtggtaagcctaatcctgatttcatcttgaataagccagagcggcagggcgcggagattttaattgctggtgataactttggttgcggctcttcgcgtgaacacgcggtatgggcgttgaaagactatggtttcaaggccgttattgccggtggcttcagtgatattttctacatgaatagcactaaaaatgggttcttggccattacactacctcgtgatcagcgtgagattctagcgactgctccagccgatgccaaaattactgttgatctgccaaatcaagaagttcggtacgacgatcacacctttgcttttgaaatcgatccactctggaagcataaatttattaatgggttggacgacattgctattaccatgcagtacgaagatcaaattgaggcttatgaggccaaaataccgcagttttagcgggattaaagctgtaaaataataatgtagtaacaaaaagattaaaatttgatgttgacattctcatgcgaagtgattagtatgggacttgttaaatcaattacaaaacgctatgagaaagttaagtaaccgttcagcacctgtaagcgagcttcgtttggtgagaggaagccagagttgaacagtgaacatcccttttgagcgacgtaccgaatttaagtaacgtacgttgggcactcccattatcgagttagcgtatcgtccttgtggccgtacgtgaagaggttattttagcgataaaataacaaaataaggtggtacagtgcagaagcacccttagtttacacaagttgtgaactgagggtgctttttagtctacatagcgtatcaaacatataaaggtggtggtttccgtggaagatcagattagtcagattagtcagtatcaaatgaattctaaattatttagcaatcatacacatattacggaggtcttcaatcatggaacaggtcaaagatttaaatccaaaaccgttatcagttaaacaatacttagtcgtcagttcaatgctattcgggctcttcttcggtgctgggaacttgattttcccaattcacctagggcaattagccggtgctcactggggcatggctaccgttggattcttagttaccgcggtgctgctaccaatgctttcagtgcttgccgttgccgttacccactcaaagggtgtttatgacattggtcgtccccttggcccagcattcgcgttggtattcatggttatgattcatgccaccatcggaccattgttcgggacaccccggacagccacgatcccattttcagttggggttcagccactgcttcctgcaagctgggcacacgttggtttgttagtcttctcagttcttttcttcggtacagcatttcttgtttcgtacaaggaatctaacgttatgaccagtgttggtaaagttttaaacccggtctttctgctgatgcttttcgcagtcttcgttatgggttttgctcacccaatgggcaatgttagcaaaatggctgctaccacagcctatcagcacgcatcgttcttcaacggcttcttacaaggttacaacacaatggatgctttagctggtttagcctttggtgttaccgttgttacggccgttaaccaactaggcaagacaacaccgtcgagcaacgctaaagttacggctcgtgcaggggtccttgctactagtatgatcggtgtgatttacgttggtttgattttcttaggtgccactacgttaggtaaatacaaagtttctgcagatggtggggttgccttcaaccaattagtcacttactacttaggtacttttggtcacgcactgctggcaacattgctgactgtaacttgtttaaccactgctatcggcttagttgcagcgttcgcacaagatttccacaaacacttcagtcgcgttagttaccgtcaatggctcggatttatgtgtgccgcatcgttcttgaccgctaacttcgggttggatactatcatctcatggtcaacaccaatgttgatgttcctgtacccatttgccatggtactgatcctattgtcagtcttctcaccactgttccatcgtgatggcgtggtttacgcgttcgttgttgttttcactgctgtaccagcgttcttcgacatggtggatgctttcccagcagttgttagccaaagtgcatttggtaaggctgttgctggattccagcaaagtgttctgccattcgcaaaccttggtatggactgggtcgtaccagctgtcgttggtttggtattaggtttaggtgtacatttcttacgtccggtacttgctgcacatcgtagtgttactgcacaacaagttcataatcactagagagtgtgaaaacaagcgtttgggaaaatatgtgacataactcggtaaattccaaaatgtaacgtaaaaagccatttcgacgtttttggtcggagtggcttttttacattacatggctggaatctgatttttagagcacgattaggctatattgaagaattgaacgaaggccaggttttaagttgtatattatgtatcataatataatagtaggaaaatgaagtagattccggtgcaaagcgtataattaaagtgtatggtttcatcactagaagatgaaggcaggtggagttgcttatgcatcaagaatcacttttttctaatcaatcacaaaatgtcccgcttgccagtcgggtgcggccaaaggatttagatcaatttgttggtcagcagcaccttttaggcaaaggcaaaattttacgggaaattatcgaaactgatcaagtttcatccatgattttttggggtccgccaggtgtgggcaaaacgacactggccgaaattattgcgcagaagacgcactccagctttttgagttttagtgccgtcgatagcagtatcagtaaaatcaaaaagattatgaaacaggctgaactggaccgtgaagtgggtcaacgaacgatggtgtttgtggatgaaattcaccggtttaataaggctcagcaagatgctttcttaccctacgttgagagggggagcattactttaattggtgccaccacggagaatccctcgtttgaaattaattcggcgctgctttcccgttgcaaagttttcgtgttgcatgaattaaaacaagacgacattgtcactttgctcaataacgccctcagcaatccggctggttatggtaatcaaaccatcaagattagcgatgatgaaattcaagccattgctaattttgccgatggcgatgccagaactgccttaaatacgttagagatggctgttctgaatggcgataagcagggcaatgaaacaaccgtcactatggatgacctcagtcagttgattaccaggaaattttcactctacgacaaaaatggcgaagaacactacaacattatttccgcattgcataaatcaatgcggaatagtgacgtggacgctgcaatttactggctttcacggatgttggaaggcggggaagatccgctgtatatcgctaggcgattagtgagatttgccagcgaagatattggcttagcggataccaacgcgctgaacgtggcaatcaacgtgtttcaagcctgccagtttcttggcatgccggagtgtgacgttcatttggtagaagccgtgacgtacctgtcgctggcgccgaaatcaaacgccatttataaagcacgcttggcagctgccaaggatgtgaagcaaaccgctaacgacccggtaccactgcagattcgtaacgcgccaactaagctgatgaaggatctgggatacggtgagggctatgagttggctcacaacgctaaggataagctgaccaccatgaagaccatgccgccgtccgtggatgggcatgaatactacttgccaacggatgaaggtcgcgaaaaacggtttaaagaacggcttaatcaaattaaggcttggcacagacagcatgaagaatgattgtgcctgttataagttaagaccgcgctgagatttttctagcgcggtctttttgaccaccatggttaatcaggttgtgtataatagaagtacttattacagggaggggctgctcatgccactattagctattatcatcgatgtgattaccgcctttacttatttctttcaggtcaagtcaggatcgatgggcgtttacgtattgggaatagtcgttcaagctgttgcaacactgctgttacttatttggacctttacgtaccagcgcaaaaagtatcgtaatcccatgatttttggcttcttcacggctacgttttcctatgggatcattttaatttcagccgccgttaatgctttggtatttattttatatctcatgaatattttaggaatcaatagcattattttcagttaaaatgtaatcgataatgttagttttaaattaattactaatggtatatataattcaatcgagatgtgttctcataggcctaacactaatctgttaggtttttttatttcatattcatattttttctaatagtatccatagatatatgcttaataaaagttgctctaatcgtgttataatcaatttgtaagcgctttataggaacgcttagcttattattaaatctctctggccagacgatttatgattaggggatcgacacgtatagcaatttaaatgctatctaaacttcctttcataccacaaacttttaaagcgtgctcaactacagcccttaatggtgatcgttttctagagagattttgttgtgtaaattgataattattaccgtttttaaatcagctatggtggtttgattcttgtatccaacaggaatcagaccatttttttgaaaattagcggatttagtatgataagctaaatgtaaatcatacatcattttaaagggagctagatatgtggcgcaaattcactagtgatattctgtttgacctttcaattctattgattctgcttgtggttcttatcattggcaaaggcgcttacgatttaattactagtggacacctttacctttggagatacgccacttcacttatttacgagatgcttggtgcggcagtcttcttttcacttatagaactcatagatttcgtgtggaaacggcataagaaaaactaagcgattttgacatcaaaaaacgttccagccgatatgactggaacgtccttgaatagatacacactaatagatagccaaccaaaaacgcctattatgttatagcgtcttaacacttaatccattatcattatcacgtttaagtagcaagttaaatgcaatcgcccaaataatggcaccgatggctggtaatagcgattcgtggctgaagaatagacttacaaagatagcgataaagaaggcaattgttagtggattgctccatttgtatccaggcatcttgaagccatcgttttggaaatcgatggaacgacggtacttgtagtgtgccaccatggtcagaatgcagaccagaatgtaaatgtcactggaaacagaagcgatgaaggtgaacgccgcactcagcgtgttgaaggcactaataatgggagcgaataacatgcaagctgctgagaacaagacggctacgattggaatcccgttggttgaaactttagtgaatggtttcatcggtttagcatgtgattccaatgccagctggtacaaatgacgaccagttgagaaaatggaactgttcagagttgacattgcggcagcaataaccaccacgttgatgacttgagaagcagctggtaacccggcaagagtaaaaatctggacgaagggactttgagatggattcagtgagcgccaaggggtaattgccataatcacaagcagtgaaccaatgtagaataagagaattctgaaaatgatttggttaactgctttaggcaaaacgtgcttgggatctttagtttcagcggtagtaatccccacgaattccattccttgaaaggcaaagaagaccattgggaaagccatgataaactgatggaacccatttgggaacatggtgaagttgttggtgagattgccccaagatgcgtgagtgcctgcaggattttggtgatgcgtaaagactaaataaataccaactaagattaatgcgataatggcaaaaattttaattccggataagaaggtttcagagtgaccaaatgaactgaccatggcaatgttaacgccggtcaaaacagcccagaatcctagttgaactaggccagcggaaatgtgtggaaaccagaatttgacgtaggttgacagcgcaattagttcagcgttggcaactaaaatcagttcaagccagtaactccattcagcaaattttcccaaccttgagccaacgtactttctgataaacgaaacgaaggtgtgttgatctggatcggagtacatcatttcaccgattgcacgcatcatgaggaagaagaaaccaccgatgattaaataaacgagtaaaatcgatggtccggttctgtgaatcgtactaccggcacccaagaagagtccggtcccaatcgagccaccaaacgcaatcatttgaaccgcaacgttggacagaccacgacgggtaccatccttgttcacctgaattttttccttttttaacatattttagcctccttaaataaccaatgaaccattaaaagcgatttttccaacctcgagacttttacataaatgctatttcgtaaagaaatttctcagtaagtaagaaagtaacttttggcaaaccattgttggccgaatgatgcaccaacatctgagttacgccggtttgataatcacgttgtaatttgccacgactgaagtttgtatcgcattcaaccatctgatttccctcactttccaaacaaaaaagtcgtccctgcacagaatgttctgtacagggacgactcttcatcgtgttaccacccatcgttcgtagtgatgttgccatcactacctctaaggcacatacatgcccggaattttatcgtgtttcccacgtatcgcaagctttcacttttgataattgctcagagctcatcttcaaaagacgttttggtccatcctttcaccaacgatggtcgctttccaaccctactgatctttctactcttctcttcattgcagttcgtattaagttatgatagataatagcacatattattagaaaattaaacagttttcacagaagtttttaatattaatgttaaaagaaaaacgcgccaatagttgcaactagtgcaataactgtccaccagtactgggctaggaaatcccaaaagttcatcacaccacggcgacgctcatacaaaccagttgtcggattatacacgaaaactgaagagtcaatgtggtcgccagtagctggtttggttccaaggaccaaagtgtctaaactaacgtgcaagatttcggctaacttgactagtgttttcagatccggtgtaccatcgccgttttcccattttgagactgcctggcgagagacgaaaagttgagatgccaggtcgtcttgtgacaaatgcaattccgaacgtaattttttcagttgttctgcaaatttcatgatgaagtctcctctctattctttcaaggttgattatgctcgcaaatcaaggcaaagacacgcaaacaaagtgataaatttcgcccgaatcaactgctatttgcgcaactgggagttgcaaagaatgcgcaaaaccctaatacataggagttgcgatggttgcaaccaaaaaactcgcgcttctctgtcgttttggcaaataagtgcgagttgatgattagtcatgtaatttttctggttccttcaaaatcaaatgtccaagtagtgcgatgaccaaaaagacgacagctactagacaaacaccgttccacttggcaatactccaagcccaggtggcggataacgtgcctaatgaaccgccaagaaaatagctgaacatgaaaatagaattgttgcggctgctttctttacggttgagcgattgaacgatggcttgattggaaacctgactgaattgagttcctaggtccagtagaataataccgatgattaagccaaccatccaatgaccgattaaccagaacagtaaaaaggccaaactggagaagaagacggataatccaatcgtcagtcgtggtgagcgatggtcgactagattaccaatatagggagcggctaagacacctgcaatccctaataagcctaatagtccagcaacgttactgcctagatgatattgatcagccaagtagaacgcaattgtcgaccacatgacgttagaaaccgcgaacatggtaaaaccgttaagtgaagaacctcgtagtcgacgctgagtggtgaatagacgaggcaatgatttgattacgttggcatagctcaaattttgatggccacgaggatctcgtggcattgcttgatggactaccagcagtaagatgagatccatcaccgctgcaatcagataaatgtattgccagtcaatgacactaccaagcagaccactgaaggaccgcgacaataaaatcccggtcaagaggccacttagaacggttcccaggacttttccacgctgcatggcaggggcgagaaagccagcgtacggaataatgatttgcggtgccacggaggtgatgccgattagcgtggttgcgatggcgaacaccacagcattgggtgatatgaacgcgattaacagtgaaatgatggataagaccatcatgaattgaattaaatgatagcgatcaaaaatatcaccaaggggaacgattaataatagcccaacggcataacccatttgggtcagcattgccagcacaccgacaatggctttagaaaggtgaaaatcggtagcaattaacccttcgataggttggataaagtttagattagcgacgataataccagtagcaatcgccatgagtaagacggtttttcgtgaaattgattgtggttcttccatcattattgcctcaattctcttctttctgatgttgagtactaatagcagtagggctatgtttcaagtgaaacaagcgagtgacctacttttaatgagtacacaattatttattatacgacaattctaaataatttataaaacagaaaaatccgacaccatcactggtatcgaatttttaagtaaagctgtaactaaatttgctgctcgcggtcagccatttaatttaatcagtttttgttagtcttcgtcatcatcgtcttcttcaactaagccttcccaggcagtgcggcctaagatagcttgcagttgttgaatggcgtggttgttttgttttaatagggtagttaaggtagcagccaatgctggacggtcttctttttcagccaacttgattgcccgggtgacgaataggttttcggtgttgtaatcgtgagcagtaatgtcaacgatttctgaagtggtcaggtatttgttacggccgtcttcgtctaacatcttgtagttaccgtattcttcggtagtcgagggcggtagctcgttttcgtctaagagggcttcggcaaccgtatcatagtccttgcgagcttggtcgataagttcgtcatagagtgggcgaaccgcaacggcttcgaagcccttcatgaaccatttggcctggtgaagtttcacgtccagcacccgtagattggaaacgatgtggccggtcatggcacccgcggttggggtgtggtggtcaatgtcagcttgcttcacttcggcttgatacttttcttctactgcgtcttttaaatcggttgtcatattttggttcctcctgtctgttggttcacgactacttagtagcaacggtgtccttaactttgatcttcttaacttcgtaacctaatttatcaactacttggcctaattcttcagcggagactttgctgtcatcgaagtcggctttagccttgctggcattgaagagcactttcactttctcaacgcctggttgatgtgccaaggcactttcaatcttggtcatgcatgatgggcaggtcaaaccatctaattgtaataccgcacgttttgttgtcataataacgatctccttttttagttgttcttgatttctttgattatctatagtttagtcgcttctccttgatttgaaattgacgtaaatcaagttaatgaagttttttgagtagctgcttgttgtgcttgggtaggcatcttgccgtagctaatcaaccgcattgcgttgaagataacgacgaggatacttgcttcgtggacaaacatgccactagccatgtaaatgaagccgacgatcaaaccaatgagtaggaagacgacgacaccaatggcgatggcgatattttcctttgtgttgataacggtctttttagaaagggcgtaagcgtgaaccagtgcttcgaaactggattgcatgaggacaacatcggaagtttcgatagccacgtcggttccgctgcccatggcgataccgatttgtgcggtagcaattgccgggctgtcgttgatgccatcaccaacgaaggcaacggtacggccttgatccttgaatttcttgatgtagtcgactttttcttcgggtaagagttcagcgtgaacttcgtcaagcccgatttgttcagcgacgtattgcgcggtgatcttgttgtcgccagttaacatgactaagtgcttagcaccgtggtcacgtaatgcttggagctgtgctttgatacctggacggatggtgtcagaaacaccaaggattaatttcaatgcgccgtcaacggctaccataacaacggaactaccggtgtgctggacgtctgttaagtcagctttttgtgtatcggttaaagcgatgctgttagcgttcatcatcttcaagttaccaactaaaacgtggtgaccgtcgatggttgcggtgaggccttgacctttaaccgtatcgttttcagcaacgtctaattgttcgaaatcaactttctcgtgggtcgcataatcggtaattgctttgccaagtgggtgattggataaccgttctgctcgagcaaccaaggccaaagcttcctttgaatcgtcagcgtagtctttaactgcggaaacggcggtgttaccaagggttaatgtcccagttttatcaaagacgaaggtatcaactttcgcaaagtcgtccatgacagccccacctttcagcaggatgccgcgtttagcaccgttaccgataccggctacgtttgagactggcgcaccgatgaccagggcacctgggcagccgagaacgaggacggtaatggcagttggaaaatcacgggtaaagaggtaaaccaaaacggcgatgactagcactgcaggggtgtaatactgggcgaacttatcaatgaaagattcggcaggggatttcgcatcctgagcgtcttcaactaattcaatgattttaccgaacgtggtgtcttcaccaactttggtggcttcaacagttaacgttccgttacctaagattgaaccggaataaacggaatcgccggcagttttggcaaccgctttagattcaccggtgatgacggattcgtctaagtagcctgagccagaaacgatgttgccatcaacgggtaccgaagcaccggtcttaaccatgatgtgatcgccctcgtcaacgtcatcgatgtcaacttcttcttgggtaccgtcgtcgtggagaataacggccgtttctggtgccatttgtgtcagagatttgatggattgacgagtcttggatagggtccgttgttccaggtagctcccgaacaggaagaggaaagtcacgatcgcggattcgttatattcgccaataatgaaggcaccgacgaccgcgatactaaccaacagttcaatactgatgactttaacgcgtaatgattggtaagcgtgaatcataattggtacagccgcgatgatggaggctagtatgaacgcccagtcataaaccaccgttgagcttagaaggtacttacctgcaaaaccaattgcaatcaggatggcacttgctaaggtgatttggttttggtgattttgaatataacgttgaaatttcatgtcgatcgctcctttgatcatttgattatctatagtgtaaagcgaattggcatagggataattgacgcaggtcaagttcggctaaaaaaacaaaaggacttgccaattttcgcaaattatcccaaaatgaattgagataataaactttgggagaaatgaacagtaactgttttgctgtagaaggatatcaatctttgtaaagtggtgcttctatactattctgcattcttataagtttggtagaaaatatcacaaggttaaagttagatgtttaattttccgtattggttaatagcttatatgtagtgatttatatgaatttcattaaaagacttttggggctaaatccatcccgtataatatgaaggacacctcaccttggtgattaaattcaataaggcggaataactgatgttactcacctacaaagtcgaaattaagccgactgaaaaacagtcctggcagattgattgtcatattggtggcagtcgttgggcctataacctgtttttggatatcaaccggcagcggtatgaacaaggttattattatttgaatgcctatgcttttagtaagtggtttaatcatgaatatcttgaagccaatcctgatgatatgtggatcaaagaattatatgccaaatcggttaaacaggcctttatcgatgccgatacagctatgaagcgatttttcaagaaacaaagtggtttcccacattggcgatcgtttaagcgcggtcaaggtagttactactttgttaaaaacggtaaatcgcaaatcatcccttgtcagcgtcatcggattaagttacctaagcttggctgggttcgtttgaaagagtttggctacattccgacagactcagaacacttcgttatcaaacaaggccggatcaaattcaaggctggtcggtattacttgacctgtttagtagaacaggccgaattgccaaagctagtattaaccggtgagcccatcggcattgatcttggcctaaaagaatttgccatcttaaatgatagtactatgtatcataatcagaataaaagcagtcgggtaaggcgcattagaaaacgtctgcgcagactgcagaggaaaatgtctcgtcagtatcaagcactgaaagctagaagacagaaagaagggaaatctgctactgattttaatctagctaaaactcagcggaaggtgcaacgcttgtatcaacgattggctaacattcagtcaaattatcaaaataagattattgcccatgtggtgagaaccaaaccacggtgggtagccttagaagacttgaatgttaaaggtatgatgaaaaaccggcatttagctaaagctgttagttatcaagggttctacaactttagaatcaaattagtttctaaatgtcagcaattaggcattccagtacacttaactggccgatttgaaccaacttctaagttatgccatcaatgtggctataaaaaagttgatttaaagctaagtgagcgcacctatcaatgtcctaaatgtagttatactgcagaccgagatattaatgccgccctgaatatcagggatactaaaaactttgaattagcctactaaaacgggcttcaaagcatgtaccggtggctagccgggaattaacgcttgtggactatcatatcaactgtattagtgagtttcgtgcgaggcaggacagggagaagcaagaataatctataactttttataagttatcagtagcagaaaaatatgaaaattgaattaccagataaggtagcagaacagcttaaaatcaaggatagcgagggtgtcaaaattgaattacgaaaccatgacgccgtgataacgactgaagccagtgaaatgtcgctattccaacggatatcactttggtggtatttagcgccagctctaatcagcgcgctggcgtttaacgttttctttgcaatgaaaaatagaaatcaaattccaatgtcagggaatacctcacttgggacgactgtgattttagcgggcgtcgtgattgggacattgctgtttaccatcttttttattcgggggcggcgaagccaaacgaatgatttttccgcgaccatttattggcgaaatttcccagtagtgatcctatcgtttggattgatccttgctttagcgttattaggggtattttggttattaggaacgatttttaaaggcgcaacgtttgatcgactgaccgcaacgatcatcttcttcatttttgaaagtatgatcaattacatcatgatctacgctgcagtttctacttcttcacgaaccctgattcggatttttatgttggtgatcatgagcggggtagttatcgctatggctacaaacagtactcggaagtggtggcagtacaacctgagctttttggggaccaaacttgctaataatagctggcaatttaatatgactctgatgttttcggctttgatcatggtcgctttgattgactatatcttcgtttcaattaatgcgaaccatcctcgttccgtgcgcttattgattttacgcgtgctcttaacggctatggcaattgatatgggggcagtgggctttttcccgaataatagggcttcacatgatattcatgaccatttagcgtcatttctggtgtatttcatcattgtgttaatcgttggcattcgctggttcttgcctaaaataccgaaagaatttttgcggatgtcgtatactgttggggctatcttggtgacggccgagattctgtttaagtttgttggctacttatcattaacggcgtacgaaatcattggttttactctgacttttggctgggtacttctgttattggagcttttgcaagagcagatcgatacggggacacgggtcttttatatcaaacccgaaaaagataaacacgactaattttaattttccagcggtacttcttggtaattgatatctaagttatgtattataggaatagtcgaactgaatgccttaagaaatgaggggattccattgaagaatagatctaagtggttgctgggaacttttgccttgataaccaccattgtgttagctggctgcggcaataacagtagtcagggaagtaagaagagtattgcgctgatgcagacgtcagatttaacgagtttggataatacgaatcaggcaactatgccggagttcaataccctgacgaatatctctgaagggttgtatcggttgaatgcgaaggaccagcccgttcctgccatggcgaccaagattgagaaaccaacggccaaagggactcagtataccttccatattcggaaaaatgccaagtggagtaatggtgatcccgtgaccgccgcggattttgagtattcttggaaacggtcattgaacccaaagaataatccggtttatacctatatcttcagtggtatcaagaacgcggatgctatcattgccggaaagaagtcgtaccagacactggggattaaagcgactggtgaaaagacgttgaccattacgctggatcacccaatggcttatttcaataagttagtcgccatgccagtgttcatgccgcaagataagaagtttgtggaaaagattggtaccaaggcttacgggacatctgctaaaaataccgtttcaaacggggcgtttaagattaccggttggacggggacaaattcgaaatacacgttggtaaagaacagtcattattgggataagagtgccattaagctggatgagattaactatcagacggtgaaggatgccaataccgcacataatttgtttactagtggcaaattagatgacgccacgatctctggtgttaccgccaagagtctgcagaaaaacaaagatcttaagcaggtaccaaaggcgtggacttattatctgcaacttaatcagcgtaagggtcagccaatggctaatcagaaattgcgtgaggccgtttcattagtaatcgacaagcagcaactggtcagcaaagtccttgctgatggttcaacgcctgccagcagttttgttagtccaggcacggcaacggatccaacgactggccgtgatttcagtaaggaaaccagtacgacctacaagccgaacgtgaagaaggctcagcagttgtgggctgaaggcttgaaggagacgggttctaacggcacggttaaaatgtcgattattggcgatgatcaagatgtgactaagaatgtggcgcaatttgttcaaagtcagattcaagaaaaccttaagggtgccaaggttgatatcagtaatttaccggataaggggtttgcggatcgtaaaaccaacggccagttcactatgagtcagtggtactggttggcggacttcgcggatccaatcaactacctgggtattttgacgtcagggaacacgatgaaccctggtcattatagcgataagacctatgacagcttggttgataaagccaaagcggcaccaacgcaagcaagttattggaagtacttgcggcaggcggagggtcgcttgcaggaccaaacgggaattatcccactatattatgtaaaagaatcacacttagtaaatccaaaactgagcggcgtggcgtatcatgttgcggggtttgcggattatacgaggagttcgaagtagagtgtgaaccaaggcgcttagagatcggagtacaccaaaggcccaccataaatcccgaacttggatttgtggtgggcctttggtgtactccgatctctgccttggtgagcacgtttagtctaagtaaaagcaaagcacgtaaatcccgaacttggatttgtggtgggcctttgttgtatgcaggtctctgccttagtgaacacgtttagtctagataaaagcaaagcacataaatcccgaacttggatttgtggtgggcctttgttgtatgcaggtctctgccttagtgaacacgtttagtctagataaaagcaaagcacataaatcccgaacttggatttgtggtgggcctttgttgtatgcaggtctctgccttggagaacacgtttagtctaggtaagattaaaaagcgttgtcacctatttcaaaactcacccaacaacttccccagcatcggattttgattaacctgattataaagcgctacgatgtcataactttgaggaagcacgctactgattggcaaataccgaatttgaccgtccgcactgatacggcgatgattgatcaatccaccaggataaaaagcgaatgcctgattgagtgccactaaaatatccatttgttcggtacttgtgacgcggtgaatacggctgtaatcgtctaaaaacggcatactagccataaaactttccaataagaaagtcgaggtttcggggctgtagtagaggattggcaacgtggaaaggtcttgggcggttaagacagaatgtttgcttaacgggttgagcgtgctgactcccatgaccatttcatcagtaaaaatagttcgaacggtgaggttagattgaggagaaacagctggctgaccgtaactaatggatagtgctaaatctaagctgccatttcttacactttcggtcagatgctcgttactgccttcacggatggtaagagaaagcttaggattcactttgagtagcgagtaaagcgcgttttgcagtagttttttctcaaatacggagaagtatcctacgcgcaacatttggtctgatgaaattgaacggtgtaagtcatttagtgcagtcgtatagttattcacaatgtcttgtgctgaggaaatgaaacggtgaccctcgggagtcaacgtcactttattttttcctcggtgaaatagtgttacgttgagttcgtcttctagttgtctcatttgtttagaaactgctcgctgagtaatgaaattttcgtccgcaacttgtttaaaactaccgtactgggcgacttttaaaaaggtttttaatcggtttaggtccatagattgcctccttttactcatactattagttcgcctgatgaactaaacggttgttttcgataacatattctaccactataataatctcatcgaagctttattcgaaggcataagttagagagtcatgctcaataataaacataatgtgtggagggatatttaatgtcaatcagtcagaatgatcattacgatgttgtcgttgttggtacgggtgctgcgggaacttcagccgctttggaagccgctcaaaatggtgctaaggtccttttattagaaaagggtcgtcataccggtggtagcagtaactatactgaagggttgtttgccgttgattcttatcttcaaaaggagcagggcattaaagtttcaggtacggatgttcttaaagaggaagttgaatattcaaagtttaaagctgattcacggatttggcgtaaatacattgataacagtgctgatacggttcagtggttgaaagaccaaggcgttgagtacgaaggcgttcaagcgatgggtgccggtgaagcaacttggcatatttacaaaggcatgggtcaatcagttttgcatgacgcattgttgccaaaagctgagaagaacggcgttgaaattttgacgttaaccactgcaacgcaattgcatactgacgataatgatgcaatctgcggtatcaccattcaatcagtggaaaccaaagaaacgcaagacgtctcaactagtgcaatcattttggcaactggcggctatttgaacaatgcaaaaatgatggcggatttaacaccttatgatacgtcacggttgatcccagttagttctggtaagggaaccggtgatggtctgcgtttaggctggcaaacgggtgccaagcagtacggtactggcatggcgatgttattcggcggttatttaaaggatcccgatgaaccgtcatttaagatgatgccttcacaaatgaacgcggcagccggccaacagccactgctttgggtcaatgagaagggtgaacggtttgttgacgaatccgtcgtttacaacttctcgtatgccggtaacgcgatgtatacccaaaatcaagtttacagtgtgcttgaccaaggcgtcattgaccgcatgatcaaagacggtaacttcatggggttgggtgtttacgttaagcgcggtgaaaagatgactaagcttcagaatgaactggacgctgcagttgccgcgaagaaaccattcatctttaaagctgacactattgaagaattagccgaaaaaatgggtgtaccagttgaaaccttcactaagactgttaacacgtataacagctattgtgaaactggtgatgaccaacaatttggtaaggatagcgactatttagttagcgttaatcatgggccatattatggtttcaagctaaacattggcgccttttgtaccatgggcggtatgcaagtcacaacgcaaaatgaagtgatgaacgaagatggtgaagcaattaaaggcctctatgcagcgggtaatgatgccgctggtttgactggtgatacgtacggtcctaatatgccgggtacctgtgtaggttatgccttttactcggggagaaatgctgggaaacacgcagcagagagtgtgagccaaggcgtttagagaccgtaatagaagaagcccccaccttaaatcccgaacttggatttagggtgggggcttcttctatgcaggtctctgccttggcgaacacgtttagtctaggtagaagcaaagcaccaaatcccgaacttggatttgtggtggggtgctgttctgtgcagatctctgctttggtgaacacgtttagtctaggtaaaagtaaagcacaaaattccaatttgtaatctatgctggttcaaggtgtacacacgttaaaacaatatcattgtgctgctatttaatcgacttaacaatctacagaataaaccagattaagttaccaatatcgagcaacgaactcccagaaattgatttgtcagcctgagttaggcgcttttacgtcaaaagaaggtttactttgccttcaaacttatctaagataatactcagaaacttttaattttaggaagaaggtcaatgaatgtgaccgatgaacataagggtctcgcttttgtcatcaccggtaccacgttatggggaatgtccggtgttggcgcacaatacttattttcccatcaggcggttgagccgggttggttagtaggcgtcaggttggccatcgcaggtattttactggtgatttggggcgccgtcagtaactttaaagaactaatttcgatttggcaaaatcgacacgacgcgatattgttggtcatattcgccatttgtggcatgatcccgtcgcagttttcttactttatggcagtcaaatacggcaacgccccaacagccacgatcctgcagtttcttggacccattttcatcattgtttatctggcacttaggcattggcggctaccacgacggatcgatgtaatttccatgttgattgcgctacttggcacttatttattagttgccaagggtcgcttagacagtcttgaattagcaccagctgcggtattctggggtgtcatggctggggtgggacaagcgctgtataccctgattcccattcgcctgctcaaaaagtatgacgctaaaatcgtcaccggctgggccatgttgattggcggtttagtctttatgccgcatcttattacaacgccgattcccagactaagtgtattagagtggtcagctgtgttgttcgtggccacttttggaaccatgtttgcctacttgttctatttaacgagtttgaattacattttaccggcaactacgggtatgctcagctcctttgaacctctaacagccacgtttttatccatcatcgttttacataccgcttttggcttaccggaaatgctgggtggcgccctgattttagccaccgcctttttacaaggattagccgttaataagccaacgcggatcatcaaaaagaggctgtgacataagtcccttaattcaaaagcaggtagttaaaaatccaaggatttttaactacctgcttttttgatataatgacagaaaaaaagagtaccggtcacacccgaatactccacatcatcctcgaaaggacaatccaacatgacaattatacatggatcaaacaatttttacttctaactaccgacatatcgtcaaaagaatcctgcttactatattaatgaactggttgagtcactctcaattaaggagcactacctaattcggtcgtcctcggaatatgattttgggtgccatgatgaatcgggttctttcgcctacactcgcggggtcttagagtcgccgaatcgaaaccttgcggtggagaacttaacagctcgctggctgacccaggaacagatgcccacgtatcgacacattgtcgcttccgattccgtgagttagaatcttgattctgatgggttgaccattggttggactacttgcgtcgtcaaaacttaattgacgatgtgaccctttatggatggtaccaagattttggctatgccaataagtatagttttttgtctggcgtaagataccgtgcgctttgatcagatgaatcgtgaagcaatccaaaagatcttgctgatattaagcacgccgacgttgcagctttcgttcccgagggacgaatttaaccctggaaattgatggatgaggtgattaccgacttgaggatcgctcgataaactggataggagatcaaacaatctcccaaattctcgccaatcccgagctaagcaggatcgtcgaaaaatcaagaagatcaagcgccagctcactcaacgcaaaggaaaatgttgaacatcaatcattggaaaactttggtgtaccgcaatagctactctaaaaccgacatagatagcaccttcatgcgcgtcaagagatccaatgttgaaatggtcagttgaagccagcctaactacaaatcgccaccatatcaattcgtattaggtttcggtttattccagcgtccaacctatccgaagacgttttccatttcggagtaccttagcaaaaaccaaacacgttggctgaatattgtgctgatgctggttatggttcagaagctaattaccgtacaatagaagataactatgagcaccatcaagccatcattccgtacggaacgattttaaaagaacaaaccgtccagtggcagtctgatgatcgttaaaatcatgaacgtgaattacagcgcgatgacgactatatatttatcaacggggcgttgattttaacttccagcgttatctaagcgcactgacaagagtggttatcacgcgtgatttcaaaatcatcgggccagaaaattcgacgagatcaccggttttccacagccctgaacgcggtctggacaaacccgtatatcagtatcatcccagttgaatattttaagctcagcagcggaccgttaccagagaacgacggcacaatgtatgcccggcccgtaaatagatgaaccagtcttcggtagaaataaggcttatttagggttcaaaagatttatggtccgaggtttagcggaaggttactaaggaaaccggtatcgtcatgccttaatctggcaaaaatggttaaaatcaggggataaaatcccgattttattcagaaaaaaaggtttatcgagaaatcaaattttgatttcttcgataaaccttttttgaaagctatgatttacgacttaagtcacagcctctttttcgtgttattccacggttaccgtccagctggcgcttggacagtttcagtcgtttcggacggcaccgtttgtttttttgacattaatagatttaagatgatcgcactaatggcagcaatcgtaattggtgaccctagcagatattgcagcatttgtggtgcttcgctaacaactttggcgggcaataagaccatcgccatcgtcaaaacgattggcacaccaatgacataaatggcactttcaccagtcttcaagtaacgtacaacgttaagtccgttcagcatgatgatgacacagatgatggaataaacaccaccaatgacgggtgcgggaacggcagcgaagaaggctgacaatttaccgcagaaaccaaggatgataaaccagaaaccagcggagacgaagacccgtttgctggcaacaccagtaacggagataacgccggcgttagttgaataaccggtcataggggtggcacccagcagagctgatagtaaacagctgataccttcgccaatgatccccatattccactgtttcttagtaatcttttcacctgtaacggcgctcatagcaaaccaagtacccgttgtttcagtcgttaacactaagtagatgaccacaaacgttaaaatagctggaagtgaaaaatgcagtccgtaatgtaatgacgtgaactggggcaggctgaaccatggtgcagagctaacggatgaccagtcgaagacgcccatggcggtagcaactaccgagccaacgatcaaagcaataatgattgagctgactttgagggcttttcttaactgtggtacccgcgaacttaaaataatagcaattaacatggtaatacctgtagcaccggcaatgatcatattggtattaatgttgccggatgccttaaagatattatcgttcaaagcgcctggtagtagtgataagcccacacaagtgataatggttccaccaacgatggctggaactaacttggaaatgactttctgaaagacaccggtaacgcctaatgccataagtaaaaatgaccctacaactagcgagcctaaaacggttgccatcccaccgtgtgcgccaccgtttgctaagtaaatcccagcaacggcgcctacgggaacgaaggatgggccttgagaaacgggcaattttagaaagaattttgtctgtaaaattgtcccgataccgcaggcgatgaaggcagcttgtaaaaagccactcttttgcgctacagacatcgatagtaaaccggccatgataattggtgcgacgtacacgtccattgcaagcacgtgttgcaagcccaagaaaccagcttgcgtgtaaggcactttatcgtctggtccgtacaataagccattttgattgcgatccataatattggttattctccctttgaattgacttgagttccttgaacatcatcaaccgtctgcttagtcgtttgatatatctgttatgtcaagattggcaacactgtcaggtggaatagagggtgggcagtgaaaccaggtataaggcggctaagtagccaagtatgattttcctccttggcttctaggtgtggttattgagccatacctagtgaatattccgctaagtttgcgacaaatgtaaccacctcactttactatttagttttatgaaagcattggaaagaacgaatgttgactattaaacattatgcattattcgcttcaataccttgtgagctattataagcacaatttaacagggtttcaatggaatttcacgaacattttaaactttaatctttgaaccgagaatattcattgaaaaaatttttttgttagcggtttcgttactgctagtaaggatttaagcccttttgcataaaaatgataaatagtcggtgcttgaataattaatcatgtcaggttacaatacatgctaattagaatttaatattctaatagtattttaatgcataggaggattgcgcatggacaagacatcgacacgaacagaaaaacaaattgctgctaatatcttaaaagggtctttaggtaatatgattgaatggtttgattggtacgtttacgcttccttcgcaatttacttttcagctgcttttttcccggccgaaaataaaacggcggaattgttatcaaccgccgcagttttcgcggttgggttcttgatgcgaccactggggtcatttgtgatgggtcgttttgcggatcgaaaggggcgccgagcagcgctgacactatccgttacgattatggcgacaggttctttgattatcgctgttacaccaacgtttaaatcgattggtgtatggtcaccgattattctggttgctacccggatgttccaaggattgtcacttggtggcgaatacggaacatcagccacttatttatcagaaatggcatcgccaaaacgtcgtggtttttattcctcattccaatatgtcacgttaatttcaggtcaattattcgcattgctggttcaaattgtgttgcaaaacgttttgactaacgcgcagttgtttgcttttggctggcggattccgttcgtaatcggtgcctttggggccgtgggtgtgctatggctgcgactttccatggaagaatccgatcaatttgaagctagaaacaaaaatagtaagaaagctggtactttaacgcttctggccaagtatccgaagcagttctttacggttgttgggttgacttttggcgggacgattgccttttacgcttacaccacgtatctgcaaaagttcatgatcaacaccactggactcaatactcgggtggtttcagttatcaacttctttgcattgttaattatgttgatcctgcaaccaatcttcggtcatttatcagataaaattggtcgtaaaccattactgttatggtttgggatcggtggcacggtatttactgtaccaatcttcagtttgttagcgcacgttcattcgccatgggcagccttcttcttgatgttagctggggtcgtgatcgtttctggttatacttcaattaacgccatcgttaaggctgaactgtttccaactgaaattcgggcgttgggcgttggtttcccatatgggctgaccgtggcactcttcggtgggaccgttgaatacgttgctctctggttacgttcagttaacatggaatcgttgttcttctggtacgttgcgctggcatccttggtttcgttggtggtttactggcacatgctggaaacatccactgcttcagaaatcaacgtggacagtgtaccagctgcgtctgctaatccagcggttaagaatggtgaggcggttcagtaggactgtgttgatcaatggtacgttgcgcttgtaattttaggtagccgaatcgtgttcagcaacactgactccggccgtataagcaataaaatctatgagccaacatagccgaatcgtgcttcgcaactcaggttccggccatataagcaaataaaaacgggcattcccaagtacaggaatacccgtttttatttgcttatactctggaacctaaccgagttgctccgcacactaaacaaaaaagtcccacgaatagatttcgtgggaccctctcttaagtatcagctatttaactgaagtctccgtagctgatgctttaagacttattccgtaactcaaagcatcacccccttttttgattgaggctataatacaatgatattgattgaatgtcaactacttattttgcggtaatggtagcgcttatttaaacccttgattagtcgaattcttcgtactcgtttggatcctgatttgtggttctaccatccggtttatttagcgaattaatggcctgaatttcgtcgtcagtcagcttaaagtcaaaaatatcgaggttttgtcgctgatgaaccaaactgctggacttgggaattggaacgatcccccgttgcgtgtgccagcggagaataatttgacccgcgtttttattgtacttcttggctaattttaaaattacgggttctttgagtgagttgctgccgcgacccagtggactccacgcttcagtagcgatgccccgatccttgtcagcttggacgttggcttcgttgatccagtaagggtgaatttcaatctggttaacggcaggggtgacgccggtttctttaatcaaacgatccagatgttccggcatgaagttggaaacaccgatggtatggatcaaaccgagcttttgcgcagtgatcatggcccgccaagcttccacgtaatggtcgcgctttggtagcggccagtgaatcaggaataaatcaaagtaatctaatcccattcgggctaacgactctgtgatagcgtctaaggcatcatcatagtggtgatacttacccggtaatttagaagtcacgaagaactggctgcgtggaataccactttgacgaatggctttacccacgataccttcattatcgtaattagtcgcactatcaagtgaccggtagccgtcgtgaatcgctgacagaatctggtcaacaccttgagcgccgcgaatttgatacgttcccagtcctagcatgggtagctggtgaccatcatttagtaaaatgtttggaattgtcatcgatgttcctcctcatatatttattagtttaattatagcggttagagccgactataagtcaaataagatgtcgcgtaatgccgttttaaatattgacccattagtcattgacttactggtcaatagagaatatactctgggtgaaatttcgggttagcttaactgatggcaatcaataaggaggggttagttatggcacagacagtcgtgaacattaatcatctacagaaatcctttggtaaatttcaggcattaaaagacgttacttttgacgttaatccgggggaagtatttggttttattgggccaaatggtgctggtaaatccaccactatccgggtgctgctcggcatcctaaaagccagtggcggccaggcaatgatttttaacgaggacgtgtggcagcaggccgttgccattcacaatcgcatcgcttacgtgccgggggatgtctatctgtggcctaacttgactggtggtgagatgattgactttcttttaaaattaaaccatcaaaagcgtaccgtgaagacggatgaacttattcaggaatttgagttagacactaagaaaaaatcacgttcctactccaaaggtaaccggcaaaaggtggcgttgattgcggcattatctacggatgctgacctatatatttttgatgaacccactagcggactagatcctttaatggaagaagtctttcaaaaacatgtgttagctttaaaacatcagggtaagagcgtactgctttcaagccacattttgtccgaggttgaacgaatgtgtgatcgaattggaattattcgagctggtgagattgtggaaactggtactttggatcagatgcgtcagctgacccggacgcaagtggttgttcaaactaagcaggcactggcaggtatcgagacgttggcgggtgtgcacgcgttcaaagccgatggacaagttgccaataaagcagtcttcgccgttgatacggcacaaattggtgcagtcatggcggaattggtcaagcgtgaaattgtgacattgcaaaccactccgccgaccttggaagacttgtttatccgctattacaacacggaggggactgagggacatgaaaagtaatcagacggctcaaactgggtatctgacacggatgtatctcagacatgaccggttcgccattacgatttggttgttaggaattgtagtgatggtcgctgccggtgccagtaaaattattggtttgagtggcgatgataagcagatcgcctcattggtaaccgcactggatacgccgtccatggcggctttattcgggccctttaccgcagtgaaaccctatacgacggctgctatttttgcggcttccatgatggtctttactggattactaatggccatcatgaacatcttctttgccgtgcgaaatacgcggacacaggaggacaacggtgtgttagaaatagttcgtgctcacagtatcggccggcaaagcccactattggctacgatttatgaactattgatcatcaatgtggcaactggtttactctcagcaatgactctgcaagcaatcaacatggatggtgccgatactgcagggaactggttatttgggattggaattgcttctttgggaatgatgttcggtagttttacgctattttgcgcccagttggctagtaattcccggggtgccacgaccatgagttatagtttacttggtctgttgtaccttttgagggcgatgacggatgttcaaaatgtaaaatacacctggtggacggttttcggctgggtggaaaaaattgatccgtacggtgaaaatcgcatatcaccagtgctatatatgcttggactagctgttgtggtcctggttatcacattggctgtcagttcagagcgggatttgggttccggcctattgcctgatcgaccgggtcgcagtcatgctagtagattattggctggtccggtgacgttggtttttcggctagaacgaaccagtatgctggcgtggtttgttggccttgctgtgtacggcgtcagcatgggaaccttgttcgatactattggtgacatgatgacaaatagtcccatgattgccaaaatactgggtcctgatgcagcgacagcagtaggtcggactacaaccctgcagtttgcagctatgatgagcgtgatgatggccattggtgccagtgtgccagcgattgctaccatgctgcgacttaacagtgatgaacggaagggttggctggaatcgatccatgcctgcagtgtttctcggttccatttattcagtgcctataccttagtgggactagtggctggcctgttgacactgtttgctggcacgtttggcatggcactgggcggtcaaggagcgaagcatgcatttacgttaagtcggctgatgcgctcgttttgggctttttcaccagcagtcctggtggtaattggtatcgttgctgtgctgataggattattgcctaggtatcagcaaatcgcctgggtcatcccaatttacgccatattgtcgatttaccttggtggattactggattttccggaatggacgaagcagttaacgccttttggttggatcaataaagtgccgttgaaggcggttcagtgggatcaagccggttggctggttctcctgagcatcgtattaatattagtgggttacggtctatatcaacgccgagatttggttgaaaattagagggggaatagatgcatgtttgaaataaatcccgatgttccaaaggatccagaaaaagttgagcgaatcctagtcagcgcgacgaaaatttttgctaaaaacggttatctacaggctaaaacggctgatattgcgaagactgctgaggtctcaaagggaattgtcttccgctactttggtgacaaaggccacctctatttggccaccgtaacggatgtgattaaacggctgacagaccaagctgattttagcgtttggactgacgccaaggatcttggagatatgattgagcgggctgttcgctataagattgagctgcaactggaataccccgatgaatttcgattgtcggtacaatcattcggtgaaatgaatgtgctgccagcagaaattcaaccggcaatgcgtgctctgtggcaacagcaaactaccacgtcactgacaaccttagaggaaccggtgctggaccgtatgaagttacggccaggagtcgataaaaccatcttgaaaaaattattgaatgctatcggaaccacggcttttacggatgctgaagcgtttatgaggcagcatccagacgcgaagattgaggattttgaaccgattattaaacagattcaggcggagtatgagattttggaacatggctttgcagctaaataaaaacaggccggaagcaaatatgctttcgacccgtctttattttagtttgctggtgctaccttagttctgaaattatgggtgagatgcggccaaatatacttgtcagctgcggcgataatgaagccgttgcagatgatggagaataaggtcgccagattgatcgagtcaattctgccggttggaaagtaagcaatggcgcaaacaatcagcggtggcagaaagtccaatagctgagaagccgtggcattgccctttaaatacatgaaacgcaagatgttggtcgtgtcatcgttcgggtgcatgacgatgtttgcccgctggtagagtgagataccaacacagaacaacgcgattcctgtacagctcaagattagccgtaagatgattggtgcagtgttgacaccaatcgagtcaaaccaaccaacgaagtactgaacgaaggtcccaaagaacatgacgaacaagatctcgccaaagaatcgtttggcatcccagtgatgaatcaggagctggttagtaatggcgttgatcacaccgatgcaaaataagagcacgccaagactgatacccgtccaattatgtaagttaaccgcggaagctgaccaaacgccactccccatattaccggcaatcgatagtgcattaccaaaagcattgcaaattagaccggcaattaagccgatccaccgttctttcatcgtatttttcacattctccgcctcacttcctgattagtttagcatttttaagcaaacaatgaaacgggggtattctaattagtgagactggcctagcagtcttttcattaagggtggctctagtgcttgtgaaaattgggaagatgacttctacctaaattgtagattgtagaccaattttgaagatgctgattttcttaggcggatgatatcgaactaaaattaacgtaacatgagaaaataattgtaaaatattttgaactagttatgaatacttatataacggtatttttaaagtgaattttgttactaaaaatgagaaaatagttaattttatcttgacaggaattatttcgagcaccataatgggcaccagttattaaatacgaagcaagcgacaagatgagtaagtcatgcgtagtctttagagagttatcgtttggtgaaagataacggcggcgcattgctgaatatggtcttgataatcgctctactgctgaaccgattggctaggtagtggcgggtactcccgttacagagttagggtatgcactgatagcagtaagtactgaaccgccgttagttagtacccgatgaggaatatttccgcgaggggtattcgaactaaggtggtagcacgatttaatcgtccttttatttagagataaatagaggggcgatttttttgtaccgcttgtggacagcacctcagcttcgttgttaacagattaaaataacaaacaatataaaaggagatcatctattatggctaaagttgaaagttttacattggatcacacaaaggtaaaggcaccatacgttcgtttgattactgaggaacacggggcaaagggcgacactatcagtaactacgatttacggttagttcaacctaacgaaaacgctattccaactgcaggtctgcataccattgaacatctattggctggtttgttgcgcgaccgactagacggtgtgattgactgttcaccatttggttgccggactggttttcatttgattacctggggcactcattccactacggaagttgctgaagccctgaaagggtcattggatgacatcgccaacaagattgaatggaaagacgtacagggaactgacaagtacagttgcggtaactaccgtgaccattcactgttctcagctaagcagtggtctcgcgatattctagaaaagggtatcagcgacgatccattcgaacgtcacacggtctaggttaataagggggtgccaggatggcaaaactagcaattgtaacgggttcaggacaaggtattggtgaaggaatcgcacatcgtctagcgaaagatggttacgcgattgctgtagctgatatcaatgacacaacggccgcaaaggtggctcaagatctgcagaatgaaggctatagtgccaaagcttaccacgtggatgtggcacatcgtgacgaggtgtttgccttggttgacgcagcgaccaacgatttaggggagttagccgtgtacgttaacaatgcggggatcgccttcattgatagttttgtggattcggacccagaagatgttgaacggttactggatgtgaatttgaaggggacttactggggcattcaagccgctggtaagaaattcaaggaacagggccatggcggccgaatcgttaacgctgcttctctggcaggttacgaagcatcagccttacaaagtgcctattctgcttcaaagtttggcattcgtggattgactcagtctgctgccaaggaatttgctaaggataagattaccgtaaatgcttataacccaggcatcgttcgcacaaaaatgcgtgatgctatcgataaaaagacggcggcaatcaaacacaagacaatccagaagcaacaggaagattgcttatcagaaatcgctattggaagggaagccaccccggcggatgtagcggaagtggtcgcctggtttgtgagccctggtgccggctatattacggggcagagtttgcaggttgatggcgggatgaggtttcactagagagtgtgaaacggggcgtttagagaccggagtgtaactgggactcgccaaaaatcccggttttggatttatggtgggtcccagttacatgcaggtctctgccccgttgaacacgtttaagctaggtaagagtaaagaaccaaaaatagagagtataccaaacgcttgatagactgccgtaaaattacagcctaccaagcgttttattttaaactatttgtgtaacaatcaccattagagagtaaaattaaggcagtagagattaaatcggaaagaagcaggccaaatgaccgttcaattaaaatccgcaaagccgtcacgacagatgtatctcaaatcagaatcacatccacaatcgcactataagtacgtaattgggtcaaccaccaaagttaagcacccactagttgaacctcaggagcaagccagtgtagagacacgtactggcaagaagaaaaaacgctcttggtgggttactatagggacgggctatctcttcttaaaacttggtatttgggtgtggccgtacatcgagtcctgggtgatagctctgggaatgctattcttcatgttattggggttgttcttactgtacctattctgtgtatggctcgacaacaaaacaggtggtggcggtggctactcgggtgatccgtacgatgatagttacgatgccggctggtttgattcgtgggcgtttcataatgatgatcataacgatgataatctgtattagagagtgtgaaataagtcaaaatcagtgagcaaaatagactaacttaaaattaatactttatagataataaaatggctctatctctaataaataccgagatagagccattttgttcataatagttagacagaaatctaacttgcttgctgcacctcacaatggtgttgtactcaaagtcagctacttagttaaaaaatcaggcgccataaattcaggattcggccagtgataaaagccttcaccagtagttggtcctaatttatttgcatcaatccgttccttcatcttctcagcaactaaccgtaaatcatcgttaccagtggcttcagcttcagtcacaacaatgttgtaatgcgtcttcataccgatagcatctaagacagcaaatggtcccacttgaacgcctaaatcaatcatccacgttttatcaatcgtggttggctctgcgacacctttagcccacagaactaaagctgaatttagccacggaatcagcatcgagtttagcacatatcttggctgttcctttttcagtgggattggaaccatgccaatggttttggcaaaatcaacgacttgatcaaacacatctgttgaagtctcaggcgagcccataacttcagcagtattgcgactccaaatctggtttgcaaaatgaatgtgtaagtaacgttctggtcgaccagtaaaatcttttaactgactaggtaatagggttgatgaattgctagcaaaaattgtttttgctggggcaactttagctaatgattcataaaacgttttcttgatatctaatttttctggaatggcttcaatgactaagtctgcattcttaacagcggtagccaaatcagttgtataactcagctgttggagtcctttttcaaaatctttatcggtaatcttcaaatcgcgctgataagctgtttttaactgttcaatatgtttctttgcagttttcatcgcatcatcgttaatatcgtaaaggaccacttttaggcctttaaaggcagtttgataagcaatttggctaccaagaactccgccgccaattacagtaacattcttaattgtcataattaatccctccagattttataggttatctaaagggtataaaatttctacttgtgcgtaaatacacaataatccttttcttgaattcttgtgataaaatcatctttggtatctggtatgaccagtacaaggaggcaatatgatgaaattcaaaccgattgaagcacctagcgctacagaattattagtcacacaaatcaagaatgctattatcacaggacaattaaagccaggtgataagttacctcatgaacgtgaattggcacatcaaatgaatgtcagccgatccgtcattaatagtggtttaaaccgattacagcagcttcacttcatccatattcgtccacgccaaggtgcgtttgttgctgactatcacagtgaaggtaacctagaaacgctcaatcaggtggttgattttgatgggggttattatcagacttcattgcttcaatcgatttacgaatttcgtcttgttactgaggaaaacatcgtgaccttggcagcacaaaggcaagataagcccagtttgaaattagctaagcaagccctggatcaatttaaacaagcagtcaacgttcaagaatggtctgctgcaactttcaacttttttcatgctctcgcgttagcttcccaaaatcaagtttatccgctgattattaatagcttccggccaatgtatctaaaattggcggaatggaatagtaaggatggcggcaattctgagattattcagcgtaatcaagatttgctagaggctattagtcagggcaacgttaaactggccgttgaccttgatcacgctttgattgaatggagctttcgagatctcatgcgggcttaattccatagactagtttacttaatagaacataaaaaagtgtggttcatgtgtaccagatttgttaagtaaatagctaaagtactacaacttctttaattttcaaatcatgtaacaaatggtatcgaggcagagctgccactcagaataagtaccatttcaaaactggtttttggaaccattaattgaataaaccactggcgagctactttaaatgagtagccctttttttggctttttttatttgtcagcaagcgttcgccagtccacataagcggaagcctcatcgctcagcagatcagcgatggacaattggctcaaggtttctttgtatttagcctcggcacgttcaaactgtaggctgacctggtcgaatttttgatcaaatgcagcctgatcaagccgcagtacttgatcgcgcaagttattccaagaggcaaacgactcgtcgccttcaattgcagtaaaaatatccagcagcgaaatctcgctagttggccgtgctaaggtgattccaccggttttgctggcatcagtagcaacgatgccatgtacggccagctgatgtgtaattttatgcagataagaatcagacacttgtaggatttgactaagcagtttactttttagtggctgttgatccttttgacgcgctaggattactaccacgtagattgcttgttctactccaattttaaatttcatgttatacctcctacggccagtcagccggtcataatagtttgtaaaacaactttaaaactagtctcgcctagatgcaaacagcaccgtcaaaccaaaaaagcttgtctttgataagctatcaaattttttgattattagttgactttctcggagcaagttgtaaaatagctttaatctttggacaatgattatctatagataaaaggagattttaaatatgacagacgactcaactattgttgataaaaaagtatcagaattagcacgcttgacacctcagctcagccgagcaatcactaacactggtaaagaactgaacgataacgcaatcatcggcgaccgccagtgggcaatgaataccctggcaatgctgattggcatgggcgatatggacggtcagcttcaagtttataccaaggctgcccagcaagccggcgcaacagatgacgaaattcaagatgtgatcaatttagctagcatttatgccggcaatccccgcgccgttaacgccacccggttaattgcgccttacctgcaaagtgaacagcaacgcttacggccaaacgtcactgaagaattagtaaacgttggcgaccatgaaacgatggtttgggacaaccacggtgaaggttttcctatcgtcttgattcactgcctggcactggatcaccgtacttggcgtgaagtttatccccaactggctaagactggtgcgcgggtcatcgcgtatgatattcgtggtcacggttgggctcgcaatgcgccagtcactacgagtttggatcaattagctgatgatttgcacaagttgttgggtaaactcggtatcaaaaaagcggatatttacggcgcttcatacggcggtgcagttgcacaggccttggctgccgactatcccgaagacatacgctcattagctttaattgccactggacttaaaggattcccagtgttggctgcccgggctgatgctgctgaaaaagatggtatggaagcacaagtagcggtatccttgattcgctggttcacacctgaaaccatcgctcgaaacccttgggaagtccgctacggtcgcgagtgtgttcgtcatattagcgtggctaactgggcagcagcctggcgtgcaatggccgcaggtgacgcaacggaaaccgcaccgaacatcaaagtgccagtattggctttaggcggtaaacaggatgcttctgcggttcctgccctcatgcagcaaatggccaatgcctatccaaattctaagctagtcaccttggaccccggtacccacatgatgccgatggaacaaccacaggctgtctctgatacgttagctgcgttttatcaatcggtagattcaaacacttttaaaaaggatgaatgatggggaccaaaaaacaatactttgtggtgacttacacccatgataatatcgttggctggaccaagtacgtcctggcccacgtaaaatatctcaaagaacaaattaaaattggcaatttagtagtttccggccccagtcagggcgatcacaagcgccaggcaattttgatttttcatgtagcagaccgcgatgctttgatgaccattatcaagcaagatccgtactatatccatgacttgataacttcgatgaccatcacgccatggaaaccacagtttggcaatttagatgaaagcaattttgaatgaatttatcaacaatagttgccaaagaaccgtcatttactggatttgagaaaaacatcatcaaactaaaaaagaggctgtgacttaagtcgtaaatcatagctttcaaaaaaggtttatcgaagaaatcaaaatttgatttctcgataaacctttttttctgaataaaatcgggattttatcccctgattgaaccatttttgccctatttaaggccataatgacgataccggtttccttagtaacctcgctaaacctcggaccataaatcttttgaaccctaaataagccttcattctacgagactggttctacatctattttacgcgggcatacatgtgccgtcgttcctgtggttaaccggtcccgctgctgagctttaaaatattcccactgggatggactgatatatcgggttttgtccagaccgcgtcagggcgctggaataacctggtgatcctcgtcgaatttttctgcccgatagattttgaaatcacgcgtgataccactcttgtcagtgcgcttagaataacgctggaagttaatctaacgccccgttgatcaatataatagtcgtcatcagcgctgtaattccagttcatgattttacgatcatagactgccactgacggctttgttcttttaacatgttccgtacgaatgatggcttgatggtgctcatagttatcttctattgtacggtaattcttctgaaccataaccagcatcagccacatattctcagccaacgtgttggtttttgctaaggtactcagaaaggaataaacgtcttcgtatcggttggacgctggaataaaccgaaacctaatacgaattattattggtggcgatttgtaagttataggctggcttaactgacattcaacattggatcttctttgacgcgcatgaaggtgctatctatgtcggttttgagtagctattgcggtcaccaaagttttccattgatgctgatgttcaatcattttgcctttgcgttgagtgagctggcgcttgatttcttgatttttcgacgatcctgttagctggattgggcgaaatttgggagattgtttgatctccttatccagtttatcgagccgatcctcaagtcgagtaaacctcatccatcatttccagggttaaattcgtcccctcggaacgaaagctgcacgtaggcgtgcttaatatcagccaagatcttttggattgcttcacgattcatctgatcaaagcgcacggtattcttacgccagacaaaactatacttattggcatcagccaaatcttggtaccatcaataaaggtcacatcgtcaattaagttttgacgacgcaagtgtcaacaactggtctaacccatcatgaatcaaagtttcaactcatcggaaatccggaagcgacaaattgtccgatacgtgggcatctgttcctgggtcagccagcgagctgttaagttctccaccgcaaggtttcgattcggcgactactaagaccccgcgagtgtaggcgaaaagaaccagcttcatcatggcacccaaatcatttctcgaggacgaccgaataggtagtgctccttaattgagagtgactcaaccagttcattaatatagtaagcaggattatttttgaacgatatagtcggtagttagaggtaaaattgtttgatccatgttataatttgtcatgttggattgtcttccgaggaggattttgagtatcgggtgtgaccggtactctttttttctgtcattatatcaaaaaagcaggtagttaaaaatccttggatttttaactacctgcttttgaattaagggacttatgtcacagcctctttgcgtaacgactaaactgcttccgtatgatcactagtggatttatcgtccttatctggtgccttatccttcttttcgtcgctccacatatctttaatgtctttttcaatcttatcttctgtgtcaggatgcttttccaaataatcaatcacgtttggttggccttgaccaagccgttccttttgataggaataccatgaaccggatttttgaacaatgtcgttatccaccgcaatagtcagcaggtcacccgcatgagaaaggcccttgccaaagaagttttggacttcgacctgtttaaatggtggggcaaccttgttcttggtgaccttgattttgacgttggtcccaatgatatcctggccctctttgatgttgtcgcgacgacgaatatctaggcgaatggtcgagtagaatttcagcgcacggccaccaggagtgacttcagggctaccaaacatcacgccgactttttcacgaatttggttgatgaatagtagggtagtttgggtttgattcgccaaactcgtgaggccacgtaacgattgcgacatcaagcgagcctgtaggccaacgtgattatcaccaatttcaccgtcaatttcagcttttggtagcatagcggcaacggaatcgaagacaatcatatccacagcaccacttttaactagttcgttagcgatgttgaagccatcctcggcagtaccgggctgtgatagtagcagtgaatccagatcgacaccaagattcttggcgtaggctggatccaaagcgttttcgaaatcaatgtaggctacaataccgttttccttttgcagagcagcaactgctgttagcgccaaagtcgttttcccagatgattcgggtccatagagttccatgatgcgaccatacggatagccgccaccaatggcgtgatctagtgaaagtaagcctgacgagaagcgtttaatgtctaggttgggtttatcgcccatgcgcatcaacgcgcccttaccaaattttttatcaattctctttaatgtttcgtccaacgcttgtttacgttcctttgaatcagtccgttgcgctggatgaccgggttcgaatagttgtagagccatacggcaatccccctttatttcgaacatacgttctaaactatattactattgtagtcttatttgctaaataaacaaagcgaaagagaagaattgatgacgattgtttcatgtgaaacaactgagcggttattgaaactacataatgaaagtaattgttaaacaaaaatcgtccgcacagccacaacgtgctgcagggacgattattttgtagaaaatcatatactaattaagatgtagccgcagacaacgcccaaggcaatgaccatgttgagcttgtccaactgatgccctcgctggtagtaacgtttgcactgcttgtaaaggggttcatcatcctgtgaaagctgtttatcatccttagccatgaacagcttgaattgagcgactgcacggttttgacgattaactttgccaaacatcatgatgatggtgacaccgatgacgatgagtaccaggatgaacagccaactggaagtagatgcggagatgaggtctctgccaccaatcaggccgtttaccacagttgcaccaagagccacaacgaagataacggtgttaaatatttctgtccaccaatacgaacgcaaatatcgatgataataggttaattctttttgcatagcattaagtcctttttaatgaaggttacttagccattatagtcgataatgcggtggaatggtaaagaaatgaaataacggcgaatcaagtttacagctcggtttcttctgcttcttcgcgtaatacagttgctttgtcagcagcagtttgcattttacccaatacaaatctcgcaataggacccacaatcagtagttgcagtggcaatgccatgatgacgttgaataaccaagcgtgaccataagcaccccagccgacgttaccagccatgataatgccgaataatgacatgcaggtaaccattcccaataccattagtacagagatggttaaaccgatcaataaaacattcttcttcatataatcgttgatgatgtatttgaacgcaacaaacttagcaatcttgccgacaactaacaaatcaagaataacggcaacgagcaagccaccaggatattccgtgatggtgtgcagcaggaagtcattcgtgaatccttctgctaaaacaacgttgtaaccaaccataacgaggaccattaagccggccatgatggcagtaaaaacaatttcttctttaaaattacgaggcatttgaatctccttttcttttcacaatgttgctaagcatagcaaagaaagagggtgcttcgtaagttacattttgattacgaatttggaagcggttgaatgttcccctgtaatcactaagtatgtttctgaaattaggtttgatattcagcattagtgatgttaccagattatagttgcttgttgagccagttctctctgtctttctttgatgtgtcatctattttccagtcagaaagtgataatgctgagttttgatttataacaatgttaaatgcttcaatttatatgtaattggcaaattacaagtttaatccgaacaagcccggaatctttcaatggcagtctgttgatgatgtatttttaatggtcgttgattaattagttcaagtgctgctaggatctcatcagtcgtacttggctaaaattggtctttttcgggaagaaccagcgtaaccgtctattaaaatattcattggaacctcgctccatgggattggatggcaataagatgactgtctgataatctgttctaaggcctgataattggcaaactctttaccatgatcaacagtaatggattttacttggggaccgaaggcccccataaacttgccaaaggcggtgtttagagccttagccgttctattagggctttgatggcccatagaagtcgggtcttacgttcttacgtgtaacccgacatgatcgtgactcacttcgactagaagcaaccgtattacttcccaatgaccaaaagctaaccgttgattaacagttgttggccgttgttcgtggaagtcccacttgtaaatttcccacgattttcgctcactcggtgctggcggacattccgattgggtagatcagtcaattgaaggggaggcagcacgtgtaagccaattataaattgacgcagtgtcaagttataagcggccgcaatggtttctggtgaccaggttaatcgtaagtgattggtatttaaagtcgctatgctgccgtcagcatcgaaagacgaccgcaattccgccttttgcgatctgcatcttgctgagctaattcggatcataaggtttaacccgtccaactcctagctaatcgtagctttgcgacgcctaaggccgccattacttggtaagatttattccctcattgaccagttgtgctagtgcgccacgttgaacacgtgtaaagtagatgtacccaaagtaatcactccctatattggttggaattagctactaccattgtaagtgattgctttgggctttttaatttctgttcggattaattatagaatttgccaattactgatatagtctgaataaataatgtgatttatttagtgatttaactacataacaatccgttatgtagttgacgtatccgaaaggagtttaataaatgacaactttccccccaaaaccatcagtagataatatgaagaaacagatttttcaagcttattacagctaccacaatgattatgatgtgattgcggaattattacaaaatgctgtagatgctatatatatgcgtaaggaagaaaagaaaaatggctatcaaggacgtatttccattcttattaatgcggataaaagagaaatcattgtgcatgataatggggttggcatgagtcctaatcaattagataaggcagttcagttttatgagtctgaaaaaatgaatgataaaaatacggttggggaaaaaggaattggactttcatttgcaatattccagagtaactcagcaaaaattactactaacaatggtattaattctgcacaaatagttgctattggggcaagaggttgggcagagagtgagagtataaaaccatttaatatgcctattgaaaatagtccggaaaccagtttacgaagaggaactgaagtaattcttagtggattaagggataatagtttttttagtcttaattatgaacagttggtttttaccatacgtacccatactgccattggaaatactttaggaatatggagaggagatcgacggaataatctaaataacattaaagttaagctaacttatataaatgaaaaaaagtctattaactatgttgataagtcaattgatttttcatatcatcttttggatgatattgatgataatcgtattgtatcaatgaatgaatttgaagataaatttaaagatgctaataacaccgatattcaaaaaattgactttttaagaggtaaatatgttaccgaatctggtgagcataagattgccaaccgaacttttaaatattttgtttactttacaccaactacaagtgtatggaaagagcgttctgaacatttaaatctcataagttcggaagaaccaggtaagtttgaaactgaaccagaatactcacattttaaatatggtattacaatgagtgtgaaaggaatgccaactggtattaatttgaatactgatagtttaaggggaatgtcaggctatattccaagaatgtttatgataatagaagatgctgggcttaattttgatattgggagaaagaccatagctggcagtacaacaaattcttataacaaagttgcaattcatgtttttcaaaaatatagaaaaatagctcaaaaatggatggcgagagactatccaaaaatggaaaaagaagatcgaactgttaagtttaatcaacttaagaagttaccaaatctatctggggatactgctttttctaaggtaccagaacaagaaggcagtttgtcgggcatttttttcgaacaacttggtaagggaaagtttcaaggattaagtatcttacagcatggttataaagatgtatatgatttgtatgctaattataaagatgctgatattgttcttgaatttaaacagcatttaagaagtttcttaagtgaagcaataaaagatagaaaaaggtggcaagatgtaaattatctggttttatatgatgtagacgatctagataaaagaattgcagctgaggaaggagtatcattattgcaattgaatttttgtgactctgcgcatttaaatgctagtttaacgatgagttctcaatttacagatattatatatgtgatacttttaaaaaacattatttaactaaaggttgaaagttaaaaatgtacgaggctgtgacataagtctcttaattcaaaagcaggtagttaaaaatccaaggatttttaactacctgcttttttgatataatgacagaaaaaaagagtatcggttgcccccgataccctaaaaatcatccccaaaaggacaatccaacatgacaaattataacatgaatcaaacaattttaccgctaactaccgactatacagttcaaaaagataatccagctttttatattaatgaactggttgaatcactatcaatcaaagaacactacctattcggtcgtcctcgagagtatgatttaggcgcaatgatgaaactagtccttttcgcatacactcgtgatgtttttagtagtcgccgaattgaaaccttcgcggttgaaagtttaacggctcgttagatttaacttccaacgttgttacagtgcccgcactgacaagagtggtgtcacacgtgatttcaaaatctatcgtgcagaaaaatttgatgaggaccaccaaattgtcccggcagctctaattagaactggacgaacccgatatatcagcgttaatcccagttgggaatactttaaagcccagcaacgagaaagattaactactgaaaaaacggcataaatgtatgcccgtcgtaaaatagatgtagaaccagtcttcggtagaatgaaggcttatttagggttcaagagatttatggtccgtggtctagtaaaggttactaaagaaatcggtatcgtcattatggtcttaaatatggcaaaaatggttaaaatcaggggataaaaatcccgattttgaccagaaaaaagactcatcgagaaattaaattagatttctgcgataagtcttttttgaaagctatgctttatgacttaagtcgcaaccgcacgttttttttgaaatttatgattagtgataatagtgttcctctgaaaaatgatggttacccagtttatgagcagttcccttgctagtgtaaaagtggttatcaatccagaattctgcaccgccgccttcactcaatacgcgtactttcttgtgatggtaggttttagtttcaatcttatatgaactgccgtcaccggctgattggttccagcccatcacgtttgtccaggtggccttaccaatatggaaagtatgaccaactatccaagagtgactttttatcttatcaggatccgtattggcattccgataatgtaacgtagatgtggaacgataccatttatgatcgtaatactgtgcataactcattttcttagacgaaaaatgaatggtgtcgtatcgaccatgaccatcataatgataccaagttctgtgtagcgatgttggaaatgactttaaagttgtttttgccgatgcttgtgctggcaaggaaactagtgataagcccaatattgcgataatactaagtacaaatctggtaactttttttcttaacattgaaatgacctctttattgtttaagttacttagtccaagttcatgttgtactaattttaaaatgaagagtgctgatggaaaatgactagattttgtattgtggaaacaagatattgaatatgcatattttatttttgcaacgatccaatatcttttgcaagtattgttgcaaagtcataggtagtatcaaagacatcggtactatcatcaatatcgtcgttatcatcattcttgctagatattgcagactttagttctttagtataattatcataaagaggatttagtatgcgcttttgagcggaagtgaatctagtttcaaataggttataaattttacctattgtattcatttcatttatagaacttgcatccaagtcttcatattctgaatccaagtcatcggggccatattccatataagaactcatatctttagtaacgttagaaataccagaatatgctctccgaggagtaacatcatccatttttactaaaaagtcagctcgatcatcagggtccatggtgttaatgatgtcaatcatggcgttaatatccgatttctcttgtgaatatgtttttactgcggaaagattgccacgccaaatccaaccctttactgttttggagttatttgagatatagtaatagatagatttaacaccatgttgttttttgattgtggcagattttgttaccgaaaaaactgtgtttggaaaattacttgcattgtgaacctttttggttaattttgcattgctgtagatgttcccatataaagcgtgatatcttttcgagctactaactttagagtatgacactacttttgcaggagcagtttttgcagatgctgaactgggtgacaccatcatactaactccagctaaacacgtacatatgactaataaaatacccttaaaaacctttgacgacctcaaactaaaacctccataaaagaattattagttaaataatgaataatttaacatttcaattataggcttaatacaaaataatagataagaaaattcatttttttaaagtgtaattagaaattcgactagtgaagagtaattctaaaagatgttttggcaaaaccatcttgatggtaaatgtgattccccactcattctgttctgaagccgttttagatgtgataatatattgttattagacgagaaaacggaaggtgttcagcatgaaaaaacaaatcaacgtggttggagccgctttaattgaaaatggcaaggtattagcgacaaaacgcaatgatgatcgcgtgttagggacactctgggagtttcctggtggcaaaatagaacctggagaaactccagaacatgcgttgaaacgagaattaaccgaagaatttaatgatgaaattattgttggtgaacgtgttactgaaacgagtagtcatgagtatgatttcggaactgtgaatttaacagtgtattatgcaaaatttttaacacatcattttgatttagttgcgcatagtaaagtagagtggcttaatcaagctgaattaggtcagttatcatgggcagaggctgatcaggcagcagttaaagttgtttcgaaagcagatttaacacaggtgaaattttatggatctaactgatattcagtctaaaattgaaaactcattggctaatggatttgttgatcgagaaattgccggatccgaagaactaatgccccagttcatccacaacagtcgtggcgacacgatgttgctacatattgagcgggaattgtcacattgttcctcgttcacttttgcaatcgcatttataacggaaggtgcactaacctcgcttaaagtaaaactagctgatttagctgctaaaggtgttcatggtcgaattctaacttccacttatttgaactttaattcaccaaaggcatttcaggaattaaggaagctagataacgttgaggttcggattgctgagaatgataattttcatgctaagggctatatttttgaccatgaaaagcaacattatcagtctgcaatcatcgggagttctaatttgactgagcaggctttaatgaacaattatgaatggaatattaagtttacttcttacaatgatgggtcaatcacagaaaagcttattgatgaggtcgaactagcatggaaaagggcaataccactgacgtctgattggattacgatttatagtgaaaactatcaaccggttgttcaacgagaatcgggaacggttagctcaaagttagctaaaaagattgtaccgaatcctatgcaacggaatgcattaaataatttggctgaaattcgaaataatggtgccgaacgagcccttgttatttcagcaactggtacaggtaaaacttatttaggtgcttttgatgtagctagttatcagcccaaaaagtttttatatattgtccaccgggaacaaattcttgataagacaatggctagttttaagcgagtattgagtaatgaaccagataatgcttttggaaaaatctcaggtacgagtaaagataaggacactaaatatgtatttgcaactattcaagccttatctaagcaggatttcttaacacagtttaatgtggctgagtttgactatattttagttgacgaggcacatcgagtcggtagtccgacctatcaacgtgttctaaagtattttcaacctgattttctattagggatgaccgctactccggaacggatggatgattataatctttatgagttgttcgattataatattgcgtatgagattcggctacaaaaagctttggacgaagatatgttgtgtccatttcactatattggcattaccgactacgaaaaagacggagaaataagtgatgatactagtgcgcttaaatggttagtatcagatgagcgagtcgaatacatcatcaaacagacagaatactatggttattcaggtgacagattacagggacttattttctgcagtcgaaaagatgaggcttacgagctagctaaattaatgacagatagaggccatttgagtaaagcacttactggagaaacgcctcaaagtaagcgtgatgaagtggttgctgagttggaaaatggcgaaattgaatatatcattaccgttgatgtctttaatgaaggaattgatattccctgtgttaatcaagtggtgatgctaagaaatacacaatccagtattgtttttattcaacagttaggtcgaggtcttcgaaaagctaataataaatcatttgtgactgtgattgattttatcggtaattataagaataactatttaattccgattgctctgactggggataagtcgcggagcactgataaagcgcgtgacgatttggaagttagacagatttcaggagtatcaacggttaacttctcggagattgccaaggaaaggatttatcagtcaattaataatacgaaattagccgggtttaaagttttgaaagacgactatactgatcttaaatttcgtttaggtcggataccgttactttgcgatttccaaaagtctgagactgttgattgtacagtgtttgctgataactatcagaattactataagtttcttgttaggatgaaggaagatgttcaccttactgcggatgaagaagctattcttagttttatttccattgagttaatgaatggtaagcgtagtgttgaattgttgctattaaatgaattaatccaaaatcatggaagattcgataaacatgattttgagggattattatttgaaaaacagactttttataacgctgatgtatctcaatcgattgaacgtgtactttcgttggaattctttcagaaagctgcgcaaaagaaatatggaaatgatccgctagtttcagttcaagatgatacttatgtattaaatcccaaaatacttgattggatgaaaaataattctctgttcaataaattattcgatgatgcaattcaagcaggtttaataaggtctgaaaggtataatcaagatgagcaatttactttataccatcgttatacacggaaagacgtttgtcgattgctttgttgggatagtgatacaagttcgactatttatggatatcgagtaagggataatgaatgcccaatctttgtaacatattcaaagtcagatcaaatcgattcaagtattaattatcaagatcgctttatcaacacagatacgtttcagtggtatacacgtcataatgttaaaatagattcaaaagaagtcgttgaaattaagaatagtaagaccagtatccgactgttcatcaagaagaatgacgacgagggtaaaggtttttattactttggtgaagtgcaagtaaaagatgcagaacagcaagattttcaggttaaagatggtaaagtcgaaccaatagtacagatgctgctgcagttggataatagtgctcagtatgataagtatttgttgtttgaaaagtagtgttggagaaaagtctttgaaattttacgatattagtgaaggtgatctaatgaattacgaagaagtatccgcagcattaatcaagtttcgtgacgaacgtcattggcaaaactaccatacacttcccgccttagccagagcattatctatagaagcagcagaagtaaacgagcacttcttgtggaaagacgaccagagtaacgagcaaatattagcgaataaaaatgatttacagtcgttgaaaatggaactggctgatacgctcacgtacgcatactatatgtgtgataaacttggtgttaatccaaatgatatcgtgtatgagaaattacagacaaataaaaatcgtcactggaagtctgataaatagagttaggaggatacgcgtttgagtgatattgctaggccattagttaaaaaaattccatataatgtccaggggctcacacaactatcccatgaagtcaaaggtactccagccgatgaactattgtttgactatccaactgtgtacattatttacaagaagaataagaaagatatgtatgatgtctatgttggcgaaaccaataatatttggcaacgaactcgtcaacatttaattgaagatcccaaagttagaagtgattgggcagattttagagctgctaagaatgtaaatatgattgtgattggacacaatctatttaataaatcactgactttagacattgagaatagaatgatgttatatatgtcaggagttagtagtgtacagaatctgaataatcggcgcgaaaatgaccaaaataagtattatacggaaaatgatagagatggtatcttctccaaggcttggcgacagctcagaaagctggacaataagctttttccattggaacaaattattcgtgactcggcattatttaaagcctcacctttccataaactgactcaagaacagtttgatgcaaaaaatttggttcaagatcgaatcacagaggttttgttagcaggtaaagaggatcaactgatacttgtccaaggcgaagccggctcgggtaaaacggtgctgctcagtacaattttttatcagttgtttcagtatagtaatagcagtgatcatccacaatttagtgatcttaagattaacttgattgttaatcatgacgaacaactgaaggtttacagagatattttgatgaaattaggaatcactgatggtaaggatgaggacactgtatcaaaagccactcgctttattcataaccatgatccaaagaataaagtcgatatcgtattagttgatgaagctcacttactttggacgcaagggaagcaagcttatcagggtaagaatcagttagatgatattatgaaacgctcaaaggtaactgtagctatctttgatccaaagcaagtattaaaaactgaggaatatcttgagaagtcagatattgagaagattcggagtaaggctgacagtcaagggaacctgattgaattgaaaaagcagttgcgaatgaaagcggatgaccaaaccattgactggatccgtgcaattacagattctcgtaggcaaatattgccatttcattctgattcaaaagggtatgacttgcggatttttgatgatgctaccgagatgtatcgtcaaatcaaacaaaagaatgccgatcaagcaaacagcggtatatctcgtttagtggcaactttcgattggaagtttacgcaagcaaaacgcgaagacgggaaactgtggatggtgaatgccggtaacttagagttaccttggaatcttcagctaaagagtgaacgttcagtaaaaaaattagcctggccagagcaggagcaaacgattgatgaagtcggctcaacctataccatacagggattcgatttaaactattgcggtgtaatcattggcccctctgtgacttatcgcgatggcaggattcaatttgatcctagcaaaagtaaaaacaagaatgcaattcatcagcgaaaactttcttcgactggtgaaatggcgtatgtcagtgatgaattactggcaaacgaattaaacgtccttttaacacgtggtgtgaatggattatatatttacgcggtggacgaagctttaagaaataaattatctgaaatgtttaatagttaagaaacgagaccatgataatgtggtctcgtttttcatttactttcacaaatactcagtaatcttacagaaacaccatacctaatctgatgtgcagaaatgcaatatgtagtctaacagttacatacaacccagtaaaactagtgattatccacaattagattattcacaatccaattaattagtatacatttaaactaaataaataatatctaaacaattataaccgataaatgccataaacgttattaaatcgggcaataatcaaaaccattctaaattttaacgtaaatattattctctaattttatacaaaacaaatcgtataaatacttaatttatattgaatattcatctttattacataaacctttccaaatatacaacgtcaaattaaaacgtgaaaaaacgtacattttgagtgtgaaagcgctttagaaaacggttacaatatcggatatgatgatgttgttcaaatgagataggaggtaacaaaatgacaaaaccaattcacgtcacttccgagattggcaaattgaaagttgtgatgttaaagcggcccggcgttgaagttgaaaacttcacaccagatatgatgccccgattgctttttgacgacatcccatacttacctgtagcccaaaaggagcatgatgcttttgcggatacgctaagggataacggtgttgaggtcttatatcttgaaaaattggcagccgaagcactagatgctggcggcgaccaagttaaagatgcctttcttgaccaaatgttggcagaatccggctacgcagctggtgtcctgcacgacgttttgaaagaatacctcagttcaatgtcaactcaggagatggtcattaagatcatgggcggtgttcgtaagaacgaactcgactttgtgccacgcgaccttgtcagcgcggccgaagaagaggattacccattctttatggatccaatgcctaacctctacttcacgcgcgacccagcagcctcaatcggcgagggactgagcattaaccacatgaccttccctgcacgtcgtcgtgaatccttattttacgaagaaattatcaaatatcatccacggtttgctaaccaaggccttcaggtatggcgtgatcgtaaccacgatacccgtatcgaaggtggggatgaattagttctcagtgataccgttctcgcaattggtgtttcgcaacggacttcagctaacgctattgaagacattgcccggaacctcttcaagaacaagagcggttacgaaaagatcattgccatccgcatcccacacaaccatgcgatgatgcatttggacaccgtctttaccatgatcaacaaggatcagttcaccgttcacccaggtatcttaggtgaaggtggtcacattgatacttggacgatcacccaaggcaacgatggtgaattaaaccttgatcaccgaaccgacttaaaacaagtgcttaaagacgctcttcatttagacgatcttgacttgattccaactggtgctggcgacccaatcgtctcggccagagaacaatggaacgatggctcaaacacgttggcaatcgccccaggtgtcgttgttacttacaaccgtaactacgtctccaaccgggtacttcgcgaacatggtcttaaagttctggaagttctttcaagtgaattatctcggggccgtgggggtccacgttgtatgagcatgccattagtaagagaagatttaaaataagggagaattttaacatgacagatttcaaaaacagtgtatttcagggccgttcagtattggctgaaaaagactttaccgcggctgaacttgaatacttgatcgattttggtttgcatttaaaggctttaaaaaaggccggcattccacaccattacttggaaggcaaaaatgttgctttactgtttgaaaaaacatcaactagaacacgttcagcattcacgaccgctgccattgatctcggtgcccacccagaattcttaggtgccaacgacattcagctcggtaagaaggaatctgtcgaagatactgctaaagtactgggaagtatgtttgacggcatcgaattccgtggcttcagtcaaaaagtggttgagcagttggctgaattcggcggtgtaccagtttggaacggcttaactgacgaatggcacccaacccaaatgctggctgacttcatgacagtgaaggaaaactttggtcacttaaagggtttaaccttaacctttatgggcgatggccgtaacaacgttgccaactctctgttagtaacgggtgctatcttaggcgtcaacattcacatcgttgcgcctaaagaattacacccaactaaggaaatccaagacctggctaacggattcgctgctaagtctggcgctcagttactcatcaccgatgatctggatgagggtatgaagggttcaaacatcgtttataccgacgtctgggtctcaatgggcgaaagcaactgggaagaacgggtcaaattattgcagccataccaagttaacatggccgcacttaagaagaccggcaccccagatgatcaactgatcttcatgcattgcttaccagcattccacgatactgatactgaatacggtaaagaaattcaaggaaaatacggtattactgaaatggaagttactgatgaagtctttcgtagttcatacgcacgccaattcgaagaagcagagaaccggatgcactccattaaagcgatgatggcagcaactttaggaaatctcttcattccaagagtttaatcaattgcgataattggaatcaaagacgtttaactcccaataaatgaggggccgcgctcaaataatctggttcaaggattatttaagtgcgacccctcatgttggtgaaattgaaattaaacaagcaaatcacaattggctcatatcgaaacgaaaggatgtttataatgtcaggacgaaaaatcgttgtcgcgctgggtggtaacgccattctatcaaaagacgccagtgcagcagcacaacaacaagctttattagatacagcccgctacctcgtggaatttatcaagcagggggatcatttgattattgctcatggtaatggtccgcaagtgggtaatttattgcttcaacaagctgctggcagtacggaggctaatcccgcaatgccgttggacaccgcagtagccatgacccaaggcagtatcggctactggatgcaaaacgcactgagccaagtgttggctgaaaatagcatggatattgacgttgccacggtggtaactcaagttgaagtggcagctgatgatccagccttcaccaatccatctaaaccgattggtccattttacagtgaagccgagatcaccaagttgcgtgcagaacacccagaccagacttttgttgaagatgctgggcggggataccgtcgcgttgtaccttcaccaaagccaatcggggttaacgaggcaaatgtcgtgaataaattggtcgatgctgatattatccctgtggcagttggtggtggcggtgttcccgttgtccgcgaaggtaaccggtttgttggccgcgaagccgtgatcgacaaggatttcgcttccgaaaaactggctgaattggtaggtgctgacctgctgatcatcctcactgccgtagataacatttacgtgaacttcaacaagtctgatcaaaagcagttaaccaatgtcaccgttaaagaattgaaacattacatgcagcaggatcaattcgctaagggcagcatgttgcctaaggtggaggctgctatcaagtttgttgaacaacgtccggatgccaaagcggttgtgacgtcgttagaaaacgttggtcaatttctcagtacgggtagcggcaccatcatctccgctgccccagtaccaactaaatagtccaggtacgaaaacgcattagatcgaaaaggggactcaatatgaacagaatggatgaacttgaaaaatatcgtaaaatcatccgccagcaagaggagtttgcttcctttactgacaatgaatttgaacagctcgctcagcagatgcaggtcaagaccttcgcaaaggggcaagtgctgtttgatcagggcgatccacgaacgcgattttactacgtgctcgatggggtagtgcgccttgaacgggtggacgagacgggcagttttccattcattaactacgtgagtccccacaaggcatttccgtaccgcggcatgtttgtcggtgaaacgtacacttacgctgctatggccatgactgccatcacgattgcctcgtttccaatgccagtttttgagaaattactgcgggataacaagcaaatgatggtgtgcctgatttctcaaatgggccaaattatcgatgatgacgaaaatcggctgcaacggatggtgacttccagtgcaacacaccgcgtgaaacaggcgctgatgatgattgcagaggatctggggactcaagatgaatcggaaacaactcagattccgtaccccatcacgctaaaggaagttgctcgcgttagtggtaccacacgggaaactgctggccaagttgttagcaagctagtcgatgagggtgtcgtagtctatcagcacaagaactttcagtttaatccagaattgctgacctaagagcattctagagcgaaaggatgtgtaactattggaagaatcaaataagggtaaattaaatctattagaactggtttccttagtcgtgggttcgattatcggtggcggggtcttcaacctgatgcatgatatggcagcgggggctggtgccggggccatcatgattggctgggtcatcaccgctatcgggatgttgaccctggcaaaaacgttccagaacttaaccatgaaacgccccgacttggatgccggtgtatacagttacgccgaagccggtttcggtaagtacatgggttttaactccgcttgggggtactggttatcggcctggctggggaacgttggttacgccaccttgctgatgagcgccgtggcgtacttcttcccagtcttcaaagatgggcaaaatttgtggtccatcgctgctgcctcagtgattctgtgggcatgccacttcatgatcttgaagggtgttgaatcagcgtcatttgttaacgctattattactgttgccaaactgatcccaattttcatcttcttagtcattatggtcatttctttccggttgggcgttttcacccacggtttctggttcacaccaagtggtggtttccaattcggtaacgttatgggtcaagttcgaaacaccatgctagttaccgtgtgggtcttcattggtattgaaggtgccgtcgtcttttcaggacgggcgaagaagcgttcggacgttggtaaagccacggtgttaggaattatcaccgttatcttgatttatgctttgatcaccctgttatcgtttggtgtgatgcgtagagccggtttagctagtttgagccaacccgctatggccgccttattacaaagcgttgtgggtaagtggggcgccatcgtggttaatgctggcttgatcatctccgttgtgggtgcttggctatcgtggaccatgtttgccggtcaattaccatacgaagctgccaaggtggggaccttccctaaggttttcgctaaggaaaatgcgaatggcgcgccaatcaactcgttgctgtttaccaacgtctgcgtggaactcttcatgttcagttatctgatcacagcgtcggcatacaacttcttctactcaatcgccagtgctgccattctgattccgtacgccttctcagcgttctatcaattgaagttcaccatgcacgaatcaattggcaccctaggacgtactggaaatctagttgttggctggattgcaagtatttacgcaatttggttgctatacgcttctaacttgggttacattttactgatgagtttgctgtttgcggttggtatcccggtttattacatgctgcaaaagcgcgataaccacgctgacaagatcttctcatccggtgaacggatcctcgccattggtatcttcatcgttgcgttattaacggtgtttgaacttttccgtttgggtgtcaatggtttgacagatctcgactggagtcagatcactaaattattttaagaagtaggtgaaacaagatgaaaaagactgttcgccaaactaaaattgaacagctgattaatcaatatgtgatttcgacgcaagaggagctgatggaacgcctgcgtcaagccggcatcaacgcgactcaagcaacgatatccagggatattcgtgagatgcagatcgtaaagcagcaggacgccagcggatcttcccgctatatgatttataaagcaggtaatcaaaacgagatgcagcatctataccgttcgattggcgatacagtcacgcaagttgatcgtgtgcagtttcttaacgtgattcacacgtttccaagctatgcgaatatgctggcagcgattcttgatgacctggatctacccgaagttaaggggactttagctgggcatgacgtgattatcatcattagtgcggatgagattgaagcacagaagatgtatgatctttttacgaagcatatgaatgaagagctcgtggaatagagtgtgaaaacaagcgtttaggctatattaacgtgttgagctgaagtacgattatagataaaattagttattactgtactttggactctatacgtcgatatagactaattacgtgccaaaactcagattccggccatttaacgcaaacttactaacattagtgatgtaatcaatctcgacggagatggttacatcacttttttgataaagtgatagtggaactaaggtcgtaaggcttttaggcatacatgccgtaacgcaaaattggccgtttcacagtgtttttctagaactttgctctaagtaagttaggcgctcgacgccgagtattgaaaattaaactgtagttacattttgaaacaagttccaaacttcgaggaggtaattactatgcgtacagtgattgaattgatgtctcaaaggcttcttcacaggttgccatattggtagatggtcaattgtctcaacgaattaagaggatataacacagattggctttcaagaacttgatcatttaattcagattgccacaggatcagttgagattgtttttgaggcaactggtgtttattcccggcgattacagcacttcttggagcagcatacttatcctattgccgtcttaaatccattagctgccaaaaaggatatggatcgattacggccaataaaaatgatatcaatgacgccattggactcgctcaatgccaatatgaacttaactatttaaggacatatgttgaagcaccagtatatcaagaacttcaaaaaattatgagtcgttatatcagcaagtaaatgatgacttagtacgcggtaaaaaccgcttgcataagccttacaatgacttttcccgaacttgaaggactttgtcgaccaccagcggtgatcaatattggaccttagccgcacaatttccacatgcagatttagttctacaacatgaagttgaaatactggcaacaactatcttgagctcaactaaacgcaatatgtcagctaacgagctaatgacttggcaattaagctgttaaaattggcgcatctaacagcagccacagttttcggcaaatagctacgaagttaagtaatccacaaattagctactcaattaatgaagcctccatcatgagaaacaagaaattattgatcgcatggttaagctttgcgaaccgttacctgaataccggatcactaatgagcatccctggttcgcagaaaccacatcggtatccctaattggcgaactagtgatattcgtagattcaaaacccgctaacaaacttaatgctttcattgggattgatttacgattcaacgattctggtaactataaaagtagcggttttatcactaagcgaggcaatcacctagcgcgtaagatactgttaaaaagctattggcaacatggctcatcactcatcagctcatcatcctcattacattaatgattggtatcagaaaaaaaaagatctctttcgtctaaggggacgaaaaagatcacaattggtgcaatggatcgtctatatccacaattcaccatttggttctaacgaatcaaacctatgattatactgttgcccaacacacaggcataacaaatttagcctagcatgtcctaaaaaagttggcaagaggataggcttatttaagtgtacctaatatttaccaaactactattcagtaagcaacgaaaaggcctgaagtacttgacttttggtagaaaaaggcctgaagtacttgacttttggtagaaaataatgcctattccgcaaaatacacggaataggcattattcacgttaaattctggaatctaccgagttttgtcacagcttacttcgttaatcgccgactgacaacgttcccgacactttgaatcacttgtactaggacgatcaagatcacgatagaagtatacataatatctggttgataacgttggaacccgtattgataggcaatgtccccaagaccaccagcaccgactaaaccggccatggcggtagcgccaatcaaaccaatagtggctaaggtcaaaccacggatgataccgctgcgtgcctctctcagtaggacgcgagtgatgatcttgtagttactgatccccattgattggtaagcttcgatgatgccagggtcaacgtccagtaaggaagattcaatcaaccgtgctaagaacggggcacagtagacgaccagtggcagaattacacctcggataccaatagtggtgccggctaagagccgcgtaattggcaggatcaggaacagtaaaatgatgaagggtaatgaccgcagaatattgacgatggtttccaaagtggcgtgaacggacgcgtttggatacatcccgttaacgttggtttcaactaggaagatgcccagcggaatcccaacgatgatggtaatgatcagggtgatgatggtcatgatcaaggtatcagtcaaaccagtcgtcaaggtatttccccattcagatataaaattagccaacctattcaacctcctctacgatgacgccttgatctttcaaatactgaatctccgcgtcatagttatcattatattcaatcgaaatcagtaatttaccatagggctgttccttcaaatactcaatggatccggccatgatattgggttcaacgtgaaactgcttggtgagctgtgcaattactggggtagaagcttcgttgccgataaatttgatcagcaaaacgtgattatgtttctgcgtttcagtcaggattgcagctggtacaccggacagatcactggaacccaagaactggcgggtaacttcctgctttggattagtgaagacatcgatggttcggccttgttcaaccaattcaccggactccatgatggccaccttatcgcagatgctcttcaccacgtccagttcatgggtgatgatgaagatggtcaagccaagtttctggttgatatccttcagcaagtccagaatcgaactggtggtttcagggtccaaggcactggtggcttcatctgatagtaggatctgtggttcatgagctaatgcacgagccacggcaacccgttgtgactgcccaccagaaagctgtgatgggtagctgttacgccgatcccagagaccaacgattttcagatacttttcggcacgctgcttgatttcttcagtgggaatcttttccagcttcaaaggaatcgtgatgttttggtaaatcgtagcagtttttagcaggtcgtagttttgaaaaatcatgccaattttatgccgtaactgtgctaaagcggccttatccagttgggtaacgtcttggtcattgactttaacggtaccttcagttggcgtttctaggccgttgatcatgcgaatcagcgtacttttaccagcaccagagtaaccgataaccccgaagatctctccttggtccactgaaatcgacacgtcatgaacagcgtggacttctttggttttggcagtgcctttgaaggttttgctgacgtgttcaaatttgatgagtggtgtgtttgcattttctaccattgtggaaccacagctcctttaaattccttgttgatgtagtttttgatcgtcttagattggtagtacttcttaacttgcttgatgactttgtcgttcttgtgacccttttggacaacgaagtagttagcataaacgttatgcttcaaaggttcgtgagcaagggccgtcttgaggtaaatgtgatttgccaaagcgaagttactgttgatggctgcgacggtgatgtcacctaattgtttaggcaattgtgaagcatccaattcgtaaactttgaggtgtttagggttagaaacgatgtctttcttagtggctttttcgccggcacccttacgtaacttgatgacaccgttcttctggaagagttccagtgcacgggtttcgttagcagggtcgtttggaacagcaatcttatcgccgctcttaaggtcatttaaactcttgatggacttagagtagagacccattggcagagcgatggtcttgaaggcggcatcaaacttgtagttcttatcgtgttcttgttgcttcaagaattgaccagtttgatatgagttagcgccaatatcaccagaagatagcgctgagttaggtgtgttgtagtcggtaaatgaacgaacggtgatctttaaaccgtccttggctgccagttttttgacttggtctaaaatctgttggtgagggccggcggtaacgccgatcgtgattttcttggtgtccaattgtttgcttgaaccgttaccgcaagcggctaaagttgcgctggtggctaatactaatcctgcaaggcctaataatttcagtaatctatgcttcatgatgaattcctcctaattttcctttaagacgtagttggcgtgttcagatttaacggcggagtttggatttaccattgcggtactgccgctcccttaaacttcttcaaaatatactgtttgatctgtttagactggtagtacttcttgatttgcttgaccactttatcgtttttgtgaccttttctaaccacaaagttgtttggccatgcgttgttctttaatggttcgtgaaccagtgctgaacttaatagaatgtgattatcgagagcgaagttactgttgatggctgcagcagatacttcgttgagttgcttgggaatttgtgaagcgtctaattcgtaaatcttaaggtgcttagggttatagctgatatctttcttcgttgccttctggccaacacccttcttgatctttaggacaccagcactttggaagatccgaagtgctctggcttcttgggtggcgtcgtttggcacagcaattttatcgccgttcttcaggtcctttaagttcttgattgaatttgagtagatccccattggtaaggcaatcgttttaaaagcaatttcgaacttgtagtttttatcgtgttcttgttgttttaagaactgggtcgtttcaaatgaactagcatcaatgtcgccggaagataaggctgagttaggtgtgttgtaatcggtgaatgaacgaatcttgattgttaaaccatctttggcggccatctttttaacttgctccatgatttgctcgtgggggccagctgtgacaccaaccgtgattttctttgtgcttaatggctttgatgaactgtttccgcaagcggaaagggttgcgccggtagctaatactaaaagtgaaatccctaataatttaagcagtgactttctcatcctctatttcctccactattaatctaaaattaagttggcgtgttctgccaaatgaactaggtcgcgtaaaaagtcatgtgaattggcgctgtaaccattcttttcaccgagccggtaaatgtagccgttgatgtaatcgacttcagttaggcgtttcttgaccaggtcttggtacattgaagggtagtgaagtggtgtaactttgcttgtagcgtcaacgatgacctgagtttcttcgctactattttgaagtggcttaatacctgcagcatcacaaacttcgtaagcttctttaatcaggcggtggatcaatttaggtgccacgtcggctgatatgaattcgccctcttttagtttgaacatggaacaaagcgtgttcacaactgagttatagatgactttcgttaagagggtgccaagaaagttgtgtgtgagtgttggtcctaagccagcttttgtaaattccgccacaacttgatcagtgaagtcgtctgcccgttcggtttgattaaccaggttgatggtgccggttccttttttgccaatgaaatcaacgtcgcctggcttgttaaggacggtgccaatcatggcggtaccggcaatcacgtgttctggcttaaagtactggttgatcttctcaatgtggcccatgccgttcatcagcgtaatcgcgtattgatcgtccgtgaagaagtgggcgcaacgtgtcaacatttcttgcagacccatttgcttgcagaagatgatgtaggcatctggatgacccgtgtaatcttctgggaggctgatgtcgatgtttactaagtgacggccctcgccatcacgggaaacgtaaacgccgccttgtttcttgatggttgctacttggggatcccaatcgtcaacgaaatcaacttgctgacccgtttccttcagtagaattccaaaacgaagacccatagcgcctgaccctaacactgcataatgcatctatcccacatccctctaaaaatattgaaaaaatgaaacgccaaacaaaaagtccctgcgctgcataatatatgcaacacagggacgattggttaaccgtggtaccacccaaattactagtcaatgactagcctcttgaacacagataatgttcgggattatatcgtatcctcacgaattattggctttcaccgcaaattgaactccgagctcatcttctgcatcattcaatcacccgttctcaccaatcggggctctcttgaaattaaagggtgcgtactcttctcatcaacgtttcattttttaacttatgagttgaatgttatcagttagttttgaacttgtcaactttttatttagtggctaacggctgatttaagtggatattatagtagaagccaagatgatgatgaaaatgagaataatgagttttaaattagatttaggatatttttatcataaatgagttttaaaaaacaaaaaaattttacccgaatgagtgccgataaatcaatcttttcaggctcatacacgaaaaaatagcgttaaacaggtttgacatccacaggccaaacgattatattaacctcaagttataaatcgaaggaggatcaacaatgataacccattcagttaaaggtcaattgcaaaatacttgttgtcaaatgtcgcgtgttctgcgatgtttggcctgttaagcattgacttttaaagggtaattgttgatttaacctaaaagtctctgttccaggtggaacggggtcgaggagcgcgccaattctgaaagaggaatgggcgcgtttttgtgtgttgagcgtggaacaaaacgggttgatagcggcgtgtaagggctggctgggaaaaatcccggtcttggatttatcccagccagtccttacacatagctatcagtttttgtggaacgcgttaaggcacggcagcctgaaaaagccacgccactcaaccatcacacacaaccaagaaatcacaattatcccaaccaaaattatccacccaataatttaaggaaagggatcataaaaatgttaatcaaatcagttcagcaactcatcggcaacacaccgttaatcgacctgcaaatcgaggttccgaatcactcgcatatttacgccaagctggagatgttcaacccaggcggcagcatcaaggatcgtttgggccaatacatgattcaggatggcatcgatagaggcaagatcaacgctaccaccaccatcattgaaccaaccgctggtaacacgggtatcggggttgcgttggcgactcaggaacatcatttaccaactattctggttgttccagagaagtttagttatgaaaagcaaacgctcatgaaggcgttgggtgccaagctgatcaatacgccatcagaagatgggattaaaggcgcaatcaaaaaagcccgtgaaatcgctgctgaaacgccaaacagttttgtaccgatgcagtttgagaatccggctaatccagcggcctattaccacacgttggcaccggaattgattgcggatcttgatcagcccattgatgcgtttattgctggcgctggttctggcggaacctttgcgggtatcgcgaaatatttgaaagaacagaatgccaatacccaatccatcgtggttgaacctgaaggatcgattctaaatggcggaccagagcatcctcataagacggaggggatcggcgttgaatttattccgccatttttcaaggatgttcaaatcgaccaaacgctcactatttcggatgcggatgccttcaagtacgtgcgtcagatggcagctgaacagggattgtttatcggtagttcttccggcgcagcgttggcggccagcttaaaagtggctgaacagctacctgagaatagcaccatcgtaacggtattccctgacagctcagaacgttacatgagtgaaaatatctacgccacacaagactaaattaaagaggagactttatcatgaaatttgaaacgaaactattacacggcggcattagcgaagatccatacacgggcgcaacttccattcccatctacatggcatccactttccatcagaataagattggtgagtcgaaatacgaatattctcgttctggtaacccaacacgagaagcggttgaagcgttaatcgctgatcttgaaggcggcactcaggggttcgcgttcgcctctggttcagcagcaattgataccgtcttttcaatgtttagcgctggcgatgattttatcgttggtaacgatgtttacggtggcactttccgcttgattgataccgttctgaaacggttcggcatgacctttaccgtggtggatacgcgggatttggctgccgttgaagctgctatcaagccggctactaaggccatttacctggagacaccgactaacccgctattgcgcgtgaccgatattaaagccgttgctgatttagctcgcgaacatggcttactgagtattattgataacaccttcagttcgccttacgtgcaacggccattggaactgggtgtggacatcgtgttgcactccgcttcgaagtatctcggcggccattcggatgttattgctggtgtgatcgtcactaaagatgagcaattgggcgagaagatcggttatctgcaaaacgcgattggcggcatcttggcaccacaggaaagctggctgctgcaacggggcatgaagacgctggcacttcggatgagagcacacttggccaacgcccaagctgtcttcaactacctgtctgatcagccagccgttgctaaaatctactatccaggtgatcctgaaaatcctgattatgagattgccaagaagcagatgcatcacggttttggcgccatgatttcctttgaattacaaccaggactggatcctaagaagtttgttgaaaacctcaagattgtgacgttggctgagagtctgggtgctttggaatccttgattgaaattcccgctctgatgacccacggcgctattccacgcgatatccggctcaaaaatggtatcaaggacgaactgattcgcctttccgttggcgtcgaagatgaaaaagatttactggccgatttggaccgcggcttcaaggccgtacaagggagcgaacgccatgctgcaaacaccgcgagccatcctaaagcgtgatccagcagcgcacagtttgctggaagtggtgcttacctatcctggcgtcagggcgttgttttggcaccgaatcgctcactcattgaacacacatcggcactatgttttggcaaatatcttgagtcagcacgctgcaagaaccactggcattaccattgcgccagctgcagaaatcggtaaacgggtcttcatcgatcacggcatcggggtagtcattggtgccaccgcggttgtggaagatgatgtgaccattttgcaaggggtgacactgggcgcgcgaaatagcgtgaagaatggcagacgtcagccaattgttaggcggggagcctttattggcgctaatgcgttattactgggcccaatcgttgttggcgaaggagcgaaagttggtgccggcgcggttgtgttggaagatgttcccgctcactggactgcagtgggaaatccagctaggttaattcgaaagcgcatcaaggtcatgcccatgtccttaaagtctgctcatgaacgagcaaaagcatagacgcatttatcattaattacccatagttttctaatcttaacattgactctcttcagagactgcttaataattgaaagtaatcaattatcagtgcattaactgggagagtgatgatcccttactgttcaattcacgaactggaagggattttatttgattaaattttgggtaggagaaatgagcagtaactgtcttgctgtaaagggatataagtctttgtaaagtggtgctcctatactactccgtattagctgatagcttataagtagtgatttatatgaatttcattaaaaggcttttggggataaatccatcccgtataatatgagggacacctcaccttggtgattaaattcaataaggcggaaccactgatgttactcacctataaagtcgaaattaagccgactgaaaaacaagcctggcagattgattgtcatattggtggcagtcgttgggcctataacctgtttttggatatcaaccggcagcgttacgaatgcggttatcactatatgggcgcttatgagttcagcaaatggtttaaccatgagtaccttgagagcaatcctgatgaccgatggatcaaagatttatatgccaaatcggttaaacaggcttttattgatgctgatacggccatgaaacggttctttaagaaacagagtgggttcccacactggcgctcgtttaagcgcggtcaaggcagttactactttgttaagaacagtaagacgcaaatcattgcctgtcagcgtcaccgaatcaagctaccgaagctcggctgggtgcgcttcaaagaatttggctatattccgacagactcagaacactttgttatcaaacaaggccgaattaaatttagggctggtcgatattacctgacctgtttagtggaacaggctgaattaccaaagttagaactgaccggtgagcccattggcatcgaccttggcttaaaggaatttgccattctaaatgatggcacttggtatcctaatcagaataaaagcagtcgggtaaggcgtatcagaaaacgccttagacgcctgcaaagaaaaatgtcccgtcagtatcttgcactgaaagctagaagacagaaagaagggaaatctgctactgattttaatctagccaaaactcagcggaaagtgcaacgcttatatcaacggttaaccaacattcagtcggattatcaaaacaagattatcgctgctgtggtgagaaccaaaccatggtggatagccttagaagacttgaatgtttcaggtatgatgaagaatcggcatttagcaaaatcggttagttaccaaggattctacaactttcgggttaaactgattgctaaatgtcagcaattaagcattccggtgcatttaactggtcggtttgaaccaacttctaagttatgccatcggtgtggccataaaaaagttgatttgaaactaacagatcggatgtatgaatgccagaattgtcattatactgaagaccgtgatattaatgcggccctgaatatcagggatactgaacactttgaattagcctactaaaacaggcttcaaagcatgtaccggtggctagccgggaattaacgcttgtggactatcataccaactgtattagcgagcttcgtgcgaggcaggataggtagaagcaagaataatctataactttttataagttatcagtagcagaatgacacataatgacaaagattttagcttacaacgtacggattgatgaacagccatttgttgatcaatgggcagaagaacatggtgtgcaagttgatagtactgataaagaattgcacgatgatacggttgagatggccaagggttacgacggaattgattttaagcaacgaaccgtagtgactcaaaaaccagacttctataaaaaattagccagttatggcattgttcaaatgtcagcacgttcggctggtatcgacaccgtcaatttgaagtgggctaaggaaaatcatttacgggtaaccaacgtgccgtcctattcaccagaagcggtggctgaaatggcactcactcaggcaatgcaactcattcgccacatcccacaatttaacgaccgactcagtgacaataattatgttgtgcttggattacggtcacaggaactaactgagctgacagtcggcatcgtgggtgttggccggatcggtggcacgttagcacgaattttccacgcccttggtgcaacggtgattggcaatgatttgcgtgcaccgcgtgaagatttacgtggggttatgacctatgtcagcaaggaagaactgtacaaacgggccgacattatttccgtgcacgtttggggtggcgacgataatttccatttgatcaacgacaaggcctttgcacaaatgaagccaaccgccttcttcatcaacgactcccgtggcccagtagtggatacccaggcgttgatcagtgcgctgaacaaccagcagattgctggcgcggcgctggacgtggttgaggatgaaaccaaggtcttcaacaagaagtttgatgggacaacaccggttgatcactataatcagttgaagaaaatgacgaatgtgttactcacaccgcacgtggcgttcttcactgaccatgctgtcaagaacatggtgatgcagtcgctggatgatactttggcaatcatcaatggtgggaagagtgagcatgagttttagagagcgtgaaacaacacgggttgattccagaatataaggcacaaaaagaggttccctgtacttggggaaccccttttgtgccttatatggccggaatcagtgttgtggagttagagcgtggaagcaggcgtttcggctatctaaccttaacgctcagaaccacatccaaatcccgagttttattttttacccaaactcttcaaatacttcaaagcaacttctttataaacgtcatccatcaccaagaattggctcaattcaacgtattcgttcatcttatgagcattctcccagtcaccggcacccataacgacgattgggaactggttttcggctttacgatactctgaggcatcggtggcaccatggatgactttaaattcagtgtcatgtttcaaggctttacttgattctgattgtgccaactgaaccagtgggtcttctttatcggtgaccactggatcaaaggacatatccacgttgaaggataaatcagtatcggcagctgaactcaggccacgacagatcatattcaaccgcttgatcacagcaccgttaccaaattcaggtgtggcacggatgtttccttgcagttcggcgtgacctggaatcgtgttgacttggtcgccactattgaagacggtgatactgtgaaccagtgggccgacttccttgcttggcttcacgtcagcgaaaagatcggcttcagcgttcacaaacttcaccaagttagtcaaggcgttgacaccttgttctggcatggaactgtgaacgggtgtcccttcggaagttacggtgtaattcaatgaaccgttgtgggcgtaaaccacatcgccactagttggttcaccgatgatcatgccatctacgtcatcgacttcaccctgttcggttaattgtctagaaccagcggcaccgtattcttcaccgactgtggctagtaaacggatgcgaccaggaattttaactttgctgtccgctaaatcaatcatggcgataaccatagcagccagactgcctttcatgtctgcactgccacgaccataaaggcggtcaccgtggacttcagctgacaatgggccatgtgcccaatcgtccacattaccgaaactgacagtatccatgtgaccagcaagcgcgaaaacaggcgttgcgtctggttcgccaagctcagcaatcaggttgttgcgcccaggagacgtttcaacttgtttaactgtgatgccgtgatccgtaagtaacttttctaagtaatccgcaatcattttttcgtgatcattagccgaatcaatttgcaccaagtgcgttaggatgtcaattttattttgtttatccatagtgacctccgctttcattttcagacttatactttacattataaacttttttcggacaattgtcccctttagcactcggtgtttagtgtgcaaaagcagttttaaatggctttatggcggtattttaatcaatttaagatgatttatttgcacaactttcacaaggacgatttttaaaattttacacagtttattgaaaatgtaaaacgacgctactctcattttcggagcagcgtcgttacttgttgtttacttttgtgatgcgccagttgtggtatctaaattttctggcatctttggttttgccgatgaacctgttgcagcatcggcggtgttactgtttttacccggctgagatgacgcaccggaaatcgcatcaaacgcgccgttttcaaacatactgatcacttggtcaacgtttgcggtgcattccaaagtccctaagtaggcaccggcgtcatcacgtaacgcatagtaagtggtcaaaattttgtggccgttttgtgtgctggggatgttcacggaatcctgtttacccgctttaaaactttcgataagtgatttgatggccggcagaattttggcaggatgaatttctgccagcgttttgccaatctggtcttgagagcggccgtggttgcgattcggctgatctgaataccaactaaagcggtcgttagcatccaccaagtccaactcaaaggggagcgttttaaaaatttgctgaagctcagtcaatgttaaagtcccacttggaaaagtgacgtgggcatctttcgtgaaaggctcattatctggatctggcataaaatcatcctccaatgttaatttgatgtctatattatagtacgaaactatgaggacttcagaaatttagaaataatgcttgccaaataagaacatatgtttgtataatgtatgcaaacatatgttcgaggtgagcgtgatgaattaccaaaatgaacctcacggggtcttctttttaatcgataataagtcgttttacgccagcgtcgaagctgttgcacgagggtggaatccactaaagattagccttgtagtgatgagtgaagctgagaatacgaacggtggtctggttttagccacgtcaccggaagctaagaaacgctatcatttacaagcgaacgtttcccgggcccgggaagtaccgcaggacccgcaattagtggtggtgcccccacggatgaatttatatattaaacgcaatctacagatcaacgatatttttcgccggtttgttgccaacgaagatttaatgccatattcgattgacgaatcgattttggatttaacccattcttggcgattatttgggaagacaccaagagaagttgccgttcgaattcaaaaaacggtgcgacgagaattagggttatacaccaccgttgggattggtgataatcctctccaagctaagttagcgttggatctttatgccaagcatgatgcagatctgattggtgagattcattactcaaccgtaccgcaaacgatttggtcggttgatagtttaacggccatttgggggattgcgaagcgaaccgcagctcatttaaaccgtctgggaatccataatatgtatcagttggcccacgtggatccgtatcagttgaacggtgaaatggggttgatgggtcagcaactgtttgccatggcgtgggggattgatcggtcacagttaaacaagcgccgcgggcctaaaaatgccagtttggggaactcccaagtgttgcccagagactacgtgaagcaagcggagattgaaacggtgattaaagaagtcggcgaacaagtagcttctcgtctacgtcatcaccataaacaggcaggctgcgtgtcactgggtatcggtttttcttacgcagccagtgaaactgatggccgtagcggttttcatcaggagatgcgcattgcgccaactgatcagaacgcagagattacggctgccattctaagtttatttagacacaactgggagggacaagccattcgaaacgtagcggtttatacgtctagactgtgtccttcaaccggtttacagctgaacttttttgaaccggctaagacgcaacttaagcgtgttaaagctgaccatgtggttgacacaattcgtgatcggtttggttttacccggttagtgtacgctaacagtttacaaaaaggtggtaccgctattgatagagcgttattggtcggcggccataacggagggaatgcttatgaataaggacttaaaattaattacggaacgtttggatgctggttttagacgattgccgcaagttcgctatcaagttcaaatcacggatgatccgtatgataaaacgtataatttctttcttaactatcagcaccgtggtcaacggttgaagtctcagcctttgcacagtattcagcaataccagttaacctatttggaacaggtggttaaggggctaagagaacataccaaactgagttttgaatatgttgggtttaccggtcaacgctggccatctagtcagcgattgattcaaagcaggcgattaaacaatgagtaaattacggcaaatcaatgatgatcaattagtgcagcgcttcttcgaccacgattatcgggatcgtggtgtggtgaagtggcagggattctatctgtcggatcacacagccgcactgaaaaagcaggccaaacaagaagccaaaaagtatccggctagggcgcagcaatccatggaagagatcgcccaagtattgagtgaagcctatgcgaatggtcaaacagtgagcgttcaattgaataaccggaatctgaatggtgaattcttaccagatttggttggcaaggtgattgggtatgaggatgagatggtttatttggaagggcgacaagggtttgagatgggggatgtgagaaatatagagcgtggaagcaggcgttaagggactggcgtgtaaggggcatccggtggaaatcccgaacttaggatttttaccggatgcccccttacacataagtccctgcctgctggaacgcgtttcggctagagaggagagacgctctttaatttcacctagccgaaacgtgttccggtaagcagacagctgcatgtaaggggccttccccacaaaccccaagcccatgggtttatgagaaaggccccttacactccgctatctaatcgcttacctccacactcaaacgtgttccaacaggcaaggagctatgtgtaaggtgatgttggcataaatccaaaaccgggatttttaccaacatcaccttacacgtcgctccttaaccgcctgtttccacactctaatctggatccttcaacgacttcccactcttaatctgtttaaaatccgcaaacgcatcatcaatttgcttgaattcttcgtcgctcaattctacatttaacgctttcgcattagctgccacttgttccggctttttagcccctggaatcacaacgctgatcagtggatttttaatgtaccaagctaagacagtctgcgccaccgtggcatcgtgcgcttccgcaattggccggacagcatcaaccgccgtgagaattttcccgtaacgcggttcttggaagtcagctatttgactgcggatatcgtcttctgggaaggcgatatctcgttgatacttacccgtcagcaaaccactcgctaatgggaagtatggcacgaagctaatattattttcctttaagtatggcagcatatctgcgccacggtcttgatgcagcaagctaaattcatcttccaccacgtcaacgtaaccatcagcgttagcttccttgatttgatccagactgaagttagaaacgccaattgctcgaatcttaccttgttcgcgtaaacgttgcagtgcacccactgcttcggcctttggtgtatcgtgatctggaaaatgcaggtagtaaatgtcgatgtagtcggttcctaaacgcttcagactatcatccacttgctgggtgataaactttggatcgttacgaatgacttgttcaccagatgaaaaatcgtgagcacctttagtggcaatcaccaactgatgacggtcaaagtccttgatagcttggcccaccaattcctcagaatggcccagtccgtaaacgtaggcggtatctaacaacgtaatgccgttttcaataccggtcttaacgatgtttaaaccatcctcgtcattcaaatttgggaagaggttataaccaccaactgcattggttccaaggcctaacggggttgaggtgacttctgatttaccaatttttactgtttttgacatcgtaaatcctccttgtaagcgttttagcatacagtcttattataaccagtttgacccgcaaaaataaataaaaataaagttagcactctacttgcaagagtgctaaaaaggtgatactatataattgttgacggggatataagaactatatcagacttgtgtccgatataatattgatatccgcctcgactgactagactaaccaacttaatagcaatcagcgaggcaccgtcgaccagacggtgcctttgcgttttgcttgggtgtcaaatcacatgggggtgtatgtaatatggcaaattattttaacaatgatccattcttcaataacaacatggatgatatgtttaacagtctatttcgacagatgggtaatggtgaaactgcacgctacgaagtcaacggccacgagttaacgccggatgaattcgcacagtaccgtgcaacggggaagttaccagaccgcgaacacgaaattgaagtgaacgatgctggtgatcacgccgttaaaaaaggcggtattttggagaagttaggtcgtaacttaactcaagaagctcgtgatggcttactagatcccgtcattggtcgggacaaggaaattcaagaaacggctgaaattctaagtcgtcgaatcaagaacaacccaatccttgttggtgacgctggtgttggtaagaccgcggtggttgaaggtttagcacaggcgattgctgacggcaaagtacctgaagcggttcaaggtaaggaaatttggtccattgatttgtcctcactagaagctgggacacagttacgaggttcatttgaagataacattaaaaacttagttaaagaagtaaaggctgctggtaacgtcatcttgttcttcgacgaaattcaccagattttgggtattggttctactggcggtgaagaaaatggcggtaaaggcttggctgacatcatcaagccatcactttctcgtggtgatattaccgtgattggtgcaaccactcaagatgaataccggaacaccattttaaaggatacggcgttagctcgtcgattcaatgatgtaacgatcaacgaaccatcaccggaaacgactttggcaatcttgaaaggggtcaaaggcctctatgaaaagcaccatcacgtcagtttaccggatgatgtgttgaaggcggcagtggactattccgttcaatacatgccgcaacggacattaccggataaggctatcgatttgattgacatgacggcggctcacctagcggctggcaacgctggctccgatgaagcaagtctgaaagaacaactgaaggctgctcaaaagactaaggacgaagccgctaaagccgaagattacgaaaaggcggctaaagctaaggaacgcgttgaaaagctggaagctcaaatcaagaacgccgatgataccactgaaaataacgtcgttgcaacaccaaacgacgtggctgaatccgttcaacggctgactggcattcccgttgctaagatgggtaccaacgatattcagcgtttgaaaggcattgctgaccggctgaagtctaaggtcattggccaagacgaagccgttgacatggtagcccgtgccattcgtcgtaaccgtgcagggtttgacgaaggtaaccggccaatcggtagcttcctgttcgttggtcctaccggtgtgggtaagacggaattggctaagcaattagccctggacatgtttggcaacaaggatgccattatccggttggacatgagtgaatacagcgatcggaccgcggtttccaagttaattgggaccagtgctggttacgttggttacgaagacaacggcaacaccttgactgagcaagttcgtcgtaacccatactcaatcgttctcttggatgaaattgaaaaggctgatccgcaagtgctgacgcttttgctgcaagtcatggatgacggtcgtttgacggatggtcaaggtaacgtggtcaactttaagaacacgattatcatcgccacttctaatgccggtttcggtaacgaagctttgactggtgacaaagagaaggatatcagtttatctgaacgtttggcaccatacttcaggccagaattcctgaaccggttcaacgggatcgttcaattcagtcacctgaccaaggatgatctgagtcaaatcgttgacctgttattggacgacgttaacaagacattggccaagaaggggattgctttaacggtttctgacgatgctaagaactggttgatgactgaaggttacgatgaagcaatgggcgcacgtccgcttcgtcgggtcattgaacagcaaattcgtgacaaggtcactgacttctatctggatcacttggatgccaagcacctgcaagcggatctagtagatggcacgattaagattagtgaaaaggctgcggttaccgcataatttccgctagtagttatttaaaaggacgctcacttaccaaaatgataagcgagcgccctttttatttttcaaaatcattgtggttcccaactgcccttgaatagctgactcttcaaatcttcagcagtgagttttcgtttgtgatcgaaacctttaaacggccggatggtctccagtgccgaattctgataacgcttagcccggatcagtgcgtactcttctaatgaatcgtttttaacgtgtgtcattaggcgtgcacttggtgtggtataagggttctcaatccggtcttcgagatcttctagttcttcttggtattcaggtcccaactggatttggttggcatacatttctagccggcgcatgagtgctttggccttagcttgaaacttagtgacggaagtaggttcttcttctgaaacaatttcgttcattttatcggaacggttgatgactttttcgacctcttcagggtgcaaagcgggtgtcatgataaaataactggccattaatcgtaagaaacgtagcgtgccggttctcacgcccactgaactgctggggtctaagtctagcattctcagttcgaggtatttaaccccagttttaggcaggtctttcaaatttgaattaccctttaaacgaacggcaccgtggaattcatagtcggagattaaggtaccatccttggcacctttttcgatgcggtcaacataccgctgaacactggtgtagtcacctttgaatttcgtgccaaagccatagacactttgacggatgctccgtacgggatgacccgggccctcatttttatcaaagtaacctgcttcggcaattggactggcgccgaaaaggtaggtaattagccagcggtagcgacaaaagccttgagcgatgacagcgtaaaggtaattttctagatcgactcgattcgggaaacggtcctttagatgctcataaactaattcgaaaacgtgattatcaatactgagattaatgtgtgcgccacatggtgtgccggcagaaaagccatgccgtttgacccattcatgcaggtaggcttccttatcaggccccattttggctaacggaatagttgatttatccttgggtaagcgtggcggcatcgataatggccacagtaattctcctggtgaaagcgcggtacgtaaagcgttatttaagctaaataagtagtgcatcgcatctagtgcgtgactggcaggcggtgtcacaacctctgacatggtttccagaaagtcgttggtaatccacggattcgttttttcatcgccggcaccagcaggataaggttcctgacttaattctccggtttcatcgactcgctgcatttcgatttctagccccatggtaaaatcttgcgttttcgccacggcttcattgtcaaaaattaattgaccgatttcactaaacatggttggttccccctatatgtatttccaattagattattaatattctatgagaaaacattattccttagtgtacacttttctaataatgtagtacagcaaattcgtaaattaattggttaaatgtattacggcagtgacaacggacttattgcttgcgcattggcaggttaaccagtatgctaaatctgatgaaagcgcttatttagaatggagggtttcctatgaaagtcatcgtcatcggcggcattgcaggtggagcatcctttgccacccggtttcggcggttgaatgaacaaaacgagattctaatactggaacgcggcgagcatatttcaatcgccagttgtgcgttgccgtactatttaggtggcgtcattactgatcgtaatgcgttgatcgagcggacaccggcgattttgaaacagaataataatattgatgttcgcgtgcgtcacgaagtcacagcgattgatccggcgcggcataggttaagtgtaaagaacctagatagtggtgagcagtatgaagagacctacgataagttagttttatcaactggtgcgcgaccagtgttgccaccgatcagcgggattgaaacggctactaacgcctttacgttgcgcagtttgacggatggtgaccggattaagaactacattcaaacagaagcgcctcaacaagtgacgattttaggtgcaggtgcagcaggcgttgaacttgctgaaaatttcagacaactgggactatcagtgacactggttgatcaagctgacaaagtgatgcagccatacgatattgaactggcggatttcttggaaaaagagctggagaaaaatggtgttgatgtgaaactgggcgtgacgattcagttggttgccgacggtggtcgtgagctgcacttatcagatggcagtgtactgaacacggatatgctggtagtggtcaccggtgtcacccccaatagtgaaattgctgaaaacgccggtcttcaattgtgggcggatggccacattattgtgaacgatcaatttgccacttccgcgcccgatatttacgcgattggtgacgttatcgaaacaaccagtcggattaccgggttaccgattccaagtttactgtccagcgccgccaaccggcaggggcacttactggcagatattttgaacggtgaaccactgcattatcccggatttgtgggcgtatctgccgtgaaggtgtttaatctcactgcaagtatggtggggtactctgaacaaaccctgcaggctgcagggatcactaactatgccagtgtcttcattaccccctttgatcatgcctatttctacccgaatgcgaaacggttgaatattaaactgatttatgaaccagacaccggtaaaattctcggcggtcaattcgtgggtgaaaacggtgttgataaacgatcaggggagctctcagcggcaattgctggtggcctcaccattgacgaactgccagggattgagttgccatattcaccgccgtattcagcccctcgagacccgttaaatatggctggctatgtgggaatcaatcaacgccagcaggctaatcagacggtcaagtatggcgatttaaccgagactgaacgctgtgacgggacctttcttgatattcgcgagaccggtaaacctgttagtggcaccattgattcagacttggccattccactaacagagctacgtgaccggttaactgaaattccgacggggcacaccgtctacattctctatcggaagggacttggcccttataatgcttccagaatactggcagggaacggatacgatgttaaaattgtgacagaatgagtgtgtgacaaaacttggtagattccagaatttaatgtgaataaccctcattccggcgaactttgtcgggatgagggttattcacgttaaatggcaggaatctgagttttggcacacgattaggcaatattgacgcgttgagccaaagaacagtatcactaattttggctgaaaaagtgattgaaatacttgccaatataggcttatggcacaacttgtttttttagaggttgtccaaaaactgacgaatcccctgtaaccacgccgcaatccaatcggaatgtaaggatagcatgacgagcattagcgataaaataaacatcaatatgatcatgatcatatgtaatttccgctgacgcataacgatggcgatgtattcacgcatgacagcgtttggcaggaaaaagccggctgtcttagagccaataccagtggcttttagtcctgccgattgggcaaagatagcagcccgaaacgtgtggtagttattggtgacaaaaatcgtttttggttttttaaccggtgattcatcgatgattttttttgaaaagaccatgttctcataagtcgttttggaggccgtttcagcaagggcatcgttggcgccaacaccgtgagcaaccgcgtattgacgcatggcttcaccctccggcatggtttcgtcgccaccctgaccacccgaaaaaatcattttcggggcgtgacccgttttcttaaactggcgttggtagaattgaatccccttattgattctttgcgctagcaagggggtgacttggtcaccgttcatcaaaccggcacccagtacgatgatgaaatccttattgtgacggggccaatagaactggtagagtaccagtacagtcaggtaattatagaaccagaagatggcatacaagatgcataggactggaaaggtcgtgaacacctcagcccaaaaaacgggtaaatgtgcccgaataagtttgattacaaatggcagtataataatgccgattcccagataaagtgtcagtgaatttgccagtgaatggctttcccgacgccaaacaatggctgcgttccagaatagtaaaattgcctgaagcgcaaagaacaggccaatacagaagaggataaataagaataagatgccaacggggtaaataatagcattattgtcagtattcaggatggttatggcaagtgtcagccaaaagctgtagaaaaacaggttgaaccaaatgccgtttctcagccaagttcggttgtaggcatagttgatcccaaaaatcacaaagaagactccggtgatcagccagcccagtttaacgtaaaataaataatcgccttgcaataataactcccccttaatcgtctcattaaattatactctaaatccggtgttaattgcttgataccttggcgttttaggcaaagaacgtctatactatataagctggttatgatgtttgttgtgtcgtcataatcgttaaaatgacatagagagaggatctttattttgcaaaatcaagccattccgagaaagacaatgctggcgattattggtgctggtttaatggcgttttgcggtgttttagttgaaacatcgatgaacgtgacgtttccaacactgatggcgcagtttaagctgtccatgagtgtggttcaatggctgtctactgggtatttattactggtttcactgaccatggcgacttcggcgtatatccagcgacgatataaaattcgcagtatttttattttttcaggggtgtcatttatcttgggtagctttgtttgtgccttggccccaagttttgtcgtgttattaattggccggctgattcaggctgtcgcaaccggttatgcgattccgctattattcgcgattattctgcagcaggttcccgttgcccggctaggtttatttatgggcatcggtggcatggtggttggtgtcgcgccttccattggaccgacttacggtgggatgaacacctatttatttacctggcgtgaaattttctggtttattttacccgtggttgtgatcgctgttttactgggtgcgttcacgattccgcaaaagatgaagacccggcgcgacacgtttgattttcttggccttatattattggggatttccttctttctgattgcggaaggttttactgaagccggtgactttggctggctcagtattcagttctggggcttcttagcagcaggactcgtggttctaggattgtttatttatcattcatttcactctgaccgtgatttactagacctcaatatttttaaatcgccgacctttgttttgagcattctgtcgtactttttgattcaactgatgaacattgggatttcatatttactgcccaactacagtcagttagtgtttggcgcaaattcactggtcgccggttcagctatcctgttaggtagtttagtttcaggaatcgttcaaccaatgagtggccggctattggattcacatggcgcgggctatccgattcgaatcgggagtgtcctaatcgtgatctcgatgattttgtttgccatcttcggcctgcatttgaacattccaatgattatcttcttctacttaatcttcggtttaggttttggctttagttttggcaacgtcatgaccaatgggattggacaagtagatgttaaattacagcaggatgccaacgctgcgtttaacaccagtcagcagtacgctggttcaatcggaactgctattatggccgctatcctgaccagcagtcagcacagtgatccgcatttgtcacaggctgtgctctcagctcgtggcggtgatcatgattttagtttgctggcattacttgctatcgtgacgttgatattgattttaattaacttccggaaacaggcaaagaatagccaagcatagcttaatagaaataacagaggagttaccgtaaaacgcggtagcttctttttttacggcaacgttaagaaacccttcagatgccttttacgattaggtgattagatgaggaactggtaaaatagaggtaactttaaggtagcagtgaaatggaggaataaacatgattgcagggatcgttatcgcagtggtagtcgtcattttaatcattgcctatgtcagcgcgtataacgggttgatcaaaggtcggacttacgttcaggaatcatggagtcaaattgacgttcaattgaagcgtcggaacgatttgattcctaatctgattgaaacggtaaaggggtacagtcactacgaacaaagcactttggaaaaagtcgttggtttgagaaaccagttggtaaacagctcgggtgaagatcatcaaaaaaccatggccgtttctgatcaattgagtaattcgttgaaaagtatttttgcggtagctgaagcgtatccagatttgaaggccgatcaagaatacaccaaattaatggaagaattgactaacaccgaaaacaaaattgcctactcacggcaattgtataattcaagcgtggccagctttaacctgaagattcagtcgttcccaagtaacattgtggcttcaattcaccacttcaagatcagtgaatacttacaggtaccagaggaagaaaaggcagcgccaaaagtttcttttgataaataagcgaggatgacggtagatgttatacgaacaaattgcccggaataaaaggcgcacgatttatgtcctgacggggttcgtcatcttagtgctggctattggggcagcgattgggtacgttttctttaatagttatattgctggtctagtgttggcactggtattcgcaggggtctacgctgcaatcatgatcggtaattcgaccaatattgtgatgtccatgaaccatgcccacgaaatcaccaaagcagaacaggcccccgaactgtggcatattgttgaagatatggcactggtggcacgcgtgccaatgccacgggtgtttatcatcgatgatccgagtccaaacgcgtttgctacggggaatcatccgcagcacgctgcagtggcagccacttctggtattcttgaacgcttaaaccgtgaagaattagaaggtgtcatgggacatgaaatgacccatgtgcgcaactatgatattcggctgcagacagtggctttggcgctggcagctgccatcactggaatggttaacttagcgggtaactatttctggtggggtggcggtagtcgtcgccaggatgatgacgatgataatggcggtaacgtgatccaaattgtcatgctgatcgtatcgatcctgttgattattttagggcccatcgcggccaccttagctcaaatggcgttatcaaggaaccgggaatatttggcggatgcgggtagtgtggaattgacgcggaatccacagggattaatctctgcattgcagaagatttcgacttcggaaccgatgaaagaggcggatccgagtagtgcggcgctgtatatttctgatccaatgaaaaagaaaaaatcggtcactcacctgtttgatacgcatcccccgatggaggagaggattgagaggttgagaaagatgtagagcgcaaaaaagctcgggttgattccagagtataagcaaataagatagggtcttcctggtctttgggaaggccctatcttatttgcttatatggcaggaatcagagcttttttgcgcgtttcagctagataggggcaaaggtcttttgggggagaccgcttttgtttgcttatatggcaggaatcagagcttttttgcgcgtttcagctagataggggcaaaggtcttttgggggagaccgcttttgtttgcttatatggcaggagcctgagcctttttgcgcgtttcggcaatataaggggcaacaagtttccctggctttgggagactttgccttatttgcttatacggcaggaatcagagccttttcacacgttaaggctagataagggcaaggaggtcttttgggggaggccacttttgcttacttatacggcaggaatcagagtcttttcgcacgttaagggctagataagcacattttttagaagaacttaatcttattaacctacgtacctagaatatcagccttttcacccagaaaaatacctccccaaaattcaccaacttcaatttccagtcgccacatccctaataaaatggtaagataataacaatccgattaggaaattattaaaatagaggtgcgtaacatgactcgaaaaattggtgtcattggaatgggtaatgttggtgcaactgctgcccattatattgtggccaatggttttgctgatgatttagttttaatcgatattcgtgaggccaaggtaaaggccgatgcgttggattttgaagatgcaatgccaaatttacccgtacatactaatattacagtgaatgactattctgcattaaaggatgctgatgtcattatttcagcggttgggaacattaagttacaggataacccaactgatgaccggtttgctgagttaccatttaccagtgaagcagctaaaaaagtcggtgctcaaattaaagcttctggtttccatggcaagatggtggttatcactaaccccgttgatgtgattacgtctatctatcaacaagtgaccggcttacctaagaaccatgttgttggaacagggactttactggattcagcacggatgaagcgggctgtggctgctaagctgaacatcgattcacgctcagtggttggctacaacttaggcgaacacggtaactctcaatttactgcttggtcaactgttcgagtattagggaaaccaatcactgaaatcgctaaggaacgaaacctcgatttggatgaactcgatcaccaagccaaggtcggcggtcatacagtgttccatggtaagaaatatactaactatggtgtcgctactgcagcggttcacttagctaacacgattttaagcggtgctgaaaccgaaatgccagtttctaattaccgtgaagaatatggcacttacctgtcatacccagccattgttggccgtgatggtgtgcaggaacagttacaactggaattaacggaagacgaattaaagaagcttcagatttcagcagattatatcaagactaagtttgcagaaagcacgaagtaaccttaatattaaataaatgaaatcagcggttaatccaattacggattagccgctgattttttatgcgtccaactattaaataatatcagtagagttataacggaaaacctgatatactacaatacttgtgactaaaattcgtgggaggcgatagatatgtcgggaaaagtaaaacgtgccatcttgattttaattttaagtgaattcttggtttgcctggggattggcctggtcattccagtaatgccatttcttcgtaaccagcttcatttgtcggcttttgatatgggggtcatgacggccctgttttcttttgcccaatttatcacctcaccaattatcggcaaaatttctgatcgagtgggaagaaagccgattattgccattggactggcactttatgctgtttcagaaatcttatttgcgctgactaatttactgggcatgttcgatattgcccgggtaatcggcggtatttcagctgccatggtaacgcctactgggatggcgctggcagcggatattacgactaaacggcaacgggcgaaggtcatcggctggctgtccgcggcgtttagtggtggcttgatactgggccccggaatcggcggtatcctagccggtattagttacaaaacgccattttggtttgcgggtggtttaggactgctgagtaccattgccttattagttttattacctaaagattctgaaattgaaaaaccggatcaaattaccagccagggccaaaaatcagctaatctcatgaacggggattggcacgatctactggttaaaccggtgatcttactgtttattctgattctggtatcttcttttggcctgcaagggttcgagagtatctacagtttgttcgtaaaccaagtctttcattttagcattgctaacattgcgttagttttgacgttaaacggactgatttcgctattcttccaagtaatgctgtttgaccggttagtgattcggttcaaggaaacgcggttaattcgcatctgttttttctttgcacttatcggaaccgtttggatcatttttgctcatagcaagattgaagtcattattgcaacgttgctggtctttacggcctttgaccttttacggccggcaatcaccacgttactgacgaaacttagcgccaagaatcagggtttgatcaacggattgaatatgtcgttgaccagcgttggtaacgtgattggaccgctgatgtctggcgcactattggatatgaacacgcattacccatacatcgtcgttgccggttttctggccgtctcgtatttaatggcgtttgctgttaaaattaaaccacatcatttagcgtaacggaggctcaaggtgaaaaaagcagaattagcaagtcagtttgtgagccagcatcggtcacagtttcagtgcccagtatgtggtggcgaaattgcgtcggtgatcggccaaacggttcaatgtgaaaatgaacatagttttgatatttctaaaaaaggcacgttgtttatgatcaacgcaccggttaaaaccgagtatacggatgagatgttacgttatcggcagcagatgttaactgcgggctttttcgagcccatgttgacggccgtatcggctcagattaaacacggtggtttagtgttagatgccggctgcggtgaaggaaccactaccaaatggttggcgcagcaaaatcaaaatgacgcttacgttggcttagatatttccaaaccagccattaatattgccggttccggtgcagtcaacgatccgcagccattatttatggtgggcgatttggcgaagttgccctttggtgatcagcaggtgactacaatcgttaacatcctgtcaccggccaattatcaggaatttgaccgggtattgcaaccgggtggcaagttgatcaaggtgattcccaatagtcagtatctcaaagagttgcgtgcgttgatttatccggaaggtgaacatgccacctacgataattcaccggttaaggatcactttgttgaacactacggtaacgttgaatttacaccagttcactatcagtttgacctaacaccagcattattcagagcgctgtttgaaatgacgccgttgacttggcgggcagctgaccgcaaagatagtattttaaagcaaggattaacacacatcacagctgattttgagattggtgttgtgacgaaataagatgaaaacaggctctagggacacagcagttgatgcggtgacttcttggagtctattttttagagaaagtaatgaaaataagaaacaactactagttatttaaccaataagttgctatactaacagcaaacttaattaagttatttggggtattgagttggtatatagttaatggtattaactatttaacgatatttttggttggagatgttagcaggtcattaaattttgctggagggcaataaaatgaataagcaaaagatacaaaagcagcacaggcgggtactgcaagatagtggtcaaattaatgaacattttaagatgtataaaagtggcaaaatgtggatttttgcaagtctattcacgatttcactgggtaccagcttcgtttttggcggacatcaggatgcgcatgcagatgcggaatctgaatcagaaacgacgcaagcggtgattaacgaacaaccggcttcacaagcatcgcaaatagcgctcagggataatggacaaacggtgccaaacgtcactagtgatttgaaaacgcatacaccaccagtggatgataatgttcaggagactataacgccggcaacatcaaaagctgaggacgctgcgcctaaagccactgaaccgcaaactgtacaaacaaccaatctgggtgatgtaactgacgaaaataccattgcgcaggctaagcgtgctgcatcggcaacttacgctgaaacaggtacgccgcaagagataacggcggtagctggtactcaagaaacagcagataaccccagtacggatcatattaccaatacaatgacgtctcatattcaagttcggatttatccaaattgggaaaaaggaactgatcccaatcgtactaatttgggtaccgattatgccgatggtggtaatgttcagttgacatggtctgtagatttagatctagtttcaaagacagcgacttataccttaactgacaccaaagttaatattcctaatggtttagacttaaataaacccggttatgatatgaaagctactgttttgggttttgatcagccacagcctcgcgttgattattggaattggcaatatcaaccggatgacctgtatgaccgaaaagcggtaattaacaatggcaaaattaatgtgacttatcaaaatcactatcccaaacaatccggtattagcagtcagccagaaggatttataccagtaaacgtgggcgatacgttagtacagcaaggtgttgatttgaccatttataacaccaaagatgccatcatcaatcagaaatcaactttagtgccaggtgacattctggtctccgtagtctatacgccacgttggcaagtcgtccacgtaaccgttgaagatactgacgctaatcctatctctagagatgttgtaaatggcgcttctgataccgaacttacagctgatatggttactgacaaagttccggccggttacgaaatcgtgacagatacggacccatctacgggaattactaccccaagaattacgatggacagcacgtttgatcacgatgatggtcaagatcaacaggccactattgttgttgccgctgaaacagaggtgctagagccagtcacggttaaacagacgattcattatcagatggctgacggtacgcctgtaactggtattactgataacgcccagaacttaacctatactgctgtccaaaataaagttactggggaggttacctatacgccaatgggatggcttacagcagtaactagtccaccggtagacggttacgcgcctaatattggcattgtaccaattaacggcgatatgattactggtataaaaccaacagatacaacagtcaacgttacgtacatcggtaatccgcaaacggtcatagtacattatattgatgtgaatgattcaaacaagacttcgggctggactgcaacagatggtatcgaggtgctgccagctgaacaaacactgtacggaactacggatgagacttacgcgaacacaatcacattaccagataattacgttcaggttgcagccgatgacggtgcatccagtgggacatttgataaagatgaccagactgatcagagctataatgtttacgtcaaacatgctacaaagacgataacaccgacaactgattcccaaaatgatgaattaaatgcaacggtacttcgaacgattaactatgtttatggaaatgatactgtggcgcatcgcaaaggcgatcaggtaatcgcaccagttaaccagcagcaagacttcacacggactggaatcgttgatgaggtcactggtgatgtaatttactacagtccttggacgccaattagtcaggatgatggcgggcttatagcagtaccatcgactgcaatcaccggttatatgccggatcaactttcaatagctgcagaaaacgttgatttgactggactgaagacgggtgagacgacattaaagtcagaaacagtaacttataatccggatgctcaaaaaattcagattcactatatcgatgttacaggttcaaataaggaatttggctgtacagcgatggatggcgttgaactgacttcggcgttgcaaacgttgaatgggaccacggatgatgtttatacaaaccccattatcttgccgataaactatgttaaagtggctcaagacgcgggttctgccagtggctttttcgacactgatgataagatcgatcagaactataacgtctacgtcaaacatgctacaaagacgataacgccgacaactgatccccaaaacgatcagctaaaaaccacaattacgcgcaccattaactacgtgtatggtgatgatgcggttgcgggtaagcggggaacgactgcagcaccagcagtggttcagaaacaggactttacccgaacagggatagtcgatttagtcactaacgatgtgaattacagtacgtggacggctgtaaccagtgttggtgaagggtttgtagcagttgactcaccaactggggctagtgatactgagctgactggttatacaccggacaaggatacggttgtggctgtggcaacgagtagtttaacggccaatgatcagccagtggtagaaacagttacgtatcatccagacaaacaaaaagttacggtgcactacattgatgtgaacgactcctccaagacattagactggacggcagcggatggtacagaagtattaacggcagtacagacattgaccggtaaatcgtctggaacgtacacgaacacgatcacgttgccagataatttcgttcaggttgggatcgatgatggtgcatccagtgggacgtttgataatgatagtcaggttgaccaaagctacaatgtctacgttaaacatgcaacaaggacgattacgcctgtaactgattcccaaaatggtgagttgagggcaacggtgactcggaccatcaactatgtttacggtaacagtacagttgatcatcaaaaggatgataaagtggtcgattcagtagaccaacaccaagattacactcggactgggacaatcgatgaggtgacaggtaagatcacgtacagtgcatggacgccaactattggaacggatgaaggtctcaagatggtaacaccaactaagattaccggctacacacctgatcaagcgtcagtcagtgctggtagcattgacgtgacaactttaactggtaacgaaacattgaagccggttaccgtgacgtacaatcccaattccaccaagattgctgtcacctacgtcgatgatgtcgaaaacggtaaggtagttgaaggcacatcattagacggatttgttgaccaaacaggtacgtttaacgttgtgacaccaaataactacgagttgagtaagggtcaaagcgataaggttaattacacgtttacacctgataatggtacgattatcattcatttatcgcatcaaatcgggcatgccaccacgattacaacccggacgattaattacttcgttcaagggacgacaatgccagttcatgcgtcagaagtacaaccattgacttggcacattacgacggataaagtcacgggcgctactgtggcagttcccgagggtggttatcctgcagtgaattcgccagttgtttcaggctatacacctgaccaaacaagtgttgataatgaatacccaggtgttgtgataggcaagagtgctgggaatatggcagtaacggtttactacgttgctacgccggatgcgccagataatgatgtgacaccgccaactacgcccgagacaccaccaactacacaagaaacgacgcttattactgatggtgatacagtaccaaatgagccagtgagtgagacgactaataacggacaggtgccaactcaagaaggcagtgattcgaatggcggtgaaagtcgaacgggtttggctggtcaagcggagcaacctgggttaaccgaggctggtgagcatgctcaatcagtatttagtcagcagacgtctaataacacaggcaaagcaacatctgagttaccgcaaactaatgaacagaacactcgcatttggacttcattaggacttggtttaatgagtatcatgagcttgcttggattagttaagcggcagaaacgggaaaatgattaagcattgtaaagttaattgataaagatggtgttgaagagtcaaatgacactcctccatggataagcaaatgcctattcatggaggagtttttgtatggtcggaaaggtgagacccgttcgatggaaattggaagaacttcgtatgttgttttgtactttaaaaacatgtcaacgatacttgcaaagtcaacttaaattaaaatcagtaaattccgttctgttactggtttttttgataataaattgttatactatgggcaaacaaaggttagttaattgttatgtatcgttggaggatatttaatagcgttaactaggtatatcggcatcctatgaatagggatactaaaagttggagctaggtttaaattttgctggggggcaataaaatgaataagcaagatctacaaaagcagcacgaacgggtactacgggatagtgctcaggttaaagaacactttaagatgtataaggttgggaagacatggctcttcgccggtctattcacgatttcgctaggcgcaggcattgtgatgggtgaccatccagatgttcatgcagcgactactgaaactgacccagaaacatctcagtcgactgcaacacagactaatttacaagcaaaaagcgtcgtgattggcaataaaacccaatcacaagattctgcacccgaaatgaaagcggctgcagacacaactcaaacgacaacagaacctgaaactcaaaacacagaaacacaggaaacagaaactcaaggaacagaaactcaaggaacagaaactcaaaactcagaaagtcagtcttcaaccgatgtgaaggcacctgaaacaagcgacacgcaaacagcaacttctaacgtccaaaccactaatttgggtgacgttactgatgaaagcaccattgaacaagcgaagacggcagctgcaagaacttatgcccagactgggacaccgcaacaagtaacagcgatttctggtgttcaagggaattcgacaaccgctgctgatccggtgcaagccgtaagtgtaacggtggaagatgcatctaagacgtatgacaatcaaagtgatacgccagcaaccattaacgttaaattgtccagtaatttgactgcgcctaccggttggtttgtgaccggtaatccagacgaatatcaggtagcgactaatagtggtgatctggatttaagccaagttaatcaaaacgcaggtacttacagtatttcgttaagtaccgatggtttaattcggctaaatgcggtcaaagctaatcaagataagaatttagtcgtgacgactgcggatgttactgcgggtaaattaacgattgagaaggcacctgtagcaactggttcagtagcaattgaaaatacttcaaaattgtatgataatgacgcatctacagatccaactagttacaaggttaaaatcagtaatggtttaactgcacctactgattggactgctaatgctgatggcacctacaccgtaacgatagcttctggtgatattaaagccaatattgacagtcaaatagctggcagttacctaataaccttaacagatgctggattgactaaaataactgctgctaatcaaaattatgaaattactgctgatcgagttactccaggaatttttcagattcaaaacaatactaaaattacagttggtgttgtgcgaattatgacaacggatcctgctaaaaatgaccctaaaaccttttacgtaaacgtttctcgggaagaagcagtaccgtcagactggacccagagttatgataatacggctcaagatgaagttgtttatgaagttccgattagttactttgacacttctaaagttgaccgcaacaaagttggaaattatgaaataaacttaaccgcggctgctctgaatagtttaaacactttaaacccaagcacccccttagctgctattaacatccaagcaggtgaatatatcgttatggatggagctagtgattatactactcgtcatctgtccaattttggcggtggtggtggtaatataggcagtcatgtgcttaatgatggtgatggggccacgttacaattaggtatttttggcaccactaaagaaaaagataatgattttacggatattattattattccagctggcttagcggttgctgatgtaactaccgatccaacggatgcaacgaagattctttcctataccaaggcaactgatccagtaaaaacgattactgatagtgctacgcaggctcttaatgatgctggtaccccttacactaatttagttgtaaaacagttaaataattataaaggacgtcaatcctttatgcttcaactaggtacagttgattctagtatcgggactgacactaaagtaccaataaatgtcgtagtagaccctgatgtaacaaatgttactgatggtaattggggtgatcgggttgttcaaaacgatgctgccattttatatgccactgatgataatgctttaactcacggtggcaacgtaatctatgctgacagcgcataccctaatgttccggaagtagctaatgcacttgggctgactaatgctcatacgattagtcaaggttatgataatgtaaactgggctggaacttataccattcgtcatgttccagttcaggacacctacaagttggaagatgctactggcaataaaattgctgattctgttacaacttctggtactgtcggagatgcttatgatccattgtcagttgtccctgataaaatcactaccactgacggtactgaatatattttgaatcaaactacagttcccgttgaacaaacctttaaggcggcgacaggcaaaatagatgcaagtaccacggtcgcagccggtaccacctacactgccacatacaaaaaggttatcgatactaccaaagcagaaaaccaagttaagatcaatgatcaatctattgcctggggtaatccagcaccaactagctatactgttactttaccaagtaacttaaaagctccggctgattggataaagactaccggtaacacttacaatgttgatgtaaacagtggcgactttgctggagcgctggatactgcagttggaacttatactgttactctgtcgaagcagggtttaactagcttggctgcagcaaaccccgattacttgttcgataatccgatcaccggggcaggcaagcttactatcaccgcagatcccgtcaaagttacggttacagataccgctggcaataatttaaaaaccgtaccaacaattcaaattggctcggataccacaaccaatggtgatgatgttacagttgctggcattccagtttcacaattaaatcacattacctttaattttaccgatgatgcaactaacactcaacacataaaaaccatcactatcagtgctgacaaaaccactaatcaagcccttggtcttggcacatattatgatggcaagcccgacgaaaaagttgcttatacagcagagcaatcaggtgctgcaactccaggtgaagcagttgcgaaattaattagttcctataattacagtccaatgattagttttgatggaactaccccgcaaatcactaaggaatttacgcgaaatttgaaaactttacaaggcatgaccagtattgatgtcgtctacaaccaaaaagcatccgctacagttacttacgtggatgatgataatggtggtagcgtagttccaaatacgggtaccacgttgaatggctttagtggtgatgtgatgtcttacaccgtcactattccaacaaattacgtactagcagatgatacagttacgaatccaaccaacgtcacgctgaccactgatgatagcgataatctcaccattcatttaaaacacaagattatcagcggtactaagacaactaaccgggtaatcaattatgtaatcgataatcctagtgccgaatctgtaccacagacgccagcgaccgtcactcagcagattacgtggaacacgctaactgacaaggtgacaggcgagacggtggcaaccgctaaaaataatgttccagcagttgccattcaaccaattaccggctacaaagccacaattgatgggcaatgcattctatgcaggtgcggcgaatgttactgatttaaaggatacggccgtaactgtcacttatacgccaaagacagtgacagccgatgttaaagtaccaagtaacatgggcgatcaaaccgttactggtgtatcaggtaccgttgataaccatgttgaagtggcggttcctgatctaccaggctacacgaaagataagactactgtgccagccaccgttaattcagatggcacgattacagtagataatccaacaacgactggcaaagttacttacacaccagacccacaaagcatcaacgttaccttcgaggatcaagataagaatgtattaggcacagttgaactgactggtgtttctgacggtaccgttgattacacatcggcgtaccagaaacagcaagacgtaattaaacaaggctacaccttgaaggatgggaacaataacggcttagcaaatgcacctaagaattttgaccacgatgataagagtacgccaaactacgtcgtggttctgtcaaagatcaatcaggtgaatgtgacggttaacttggttccaagttatagtgatggtaaaccaattccaaacaccacaccgaagaaggtcaccggtttacctggcactaccgtcacagctccgaacgttccaggttatacgacttcaacgccaaccgtaacgattccagaaactcgtgatgataattttaaagtaacctacacaccagatcctcaaaagattaacgttcactttgtggatgataagggtgctgatttagggacaacgactttgactggtgtttcggatggtgttgtggactataaaccagcctttgctgctcaacaagctttgttgaaccaaggctacacattaaagaaggggaacaataacggtctagccaatgcaactaagacgtatgaccgtgatgataacgtcactccaacttatgaggttgttttaactaagattaataatgttaaggcgtcatataccatcacaccggtattgcaaaatggtgatccggtgccaaacagcacggtgaaaactgcccatgattatcctggtactacagtgaacgtgccaactattcaaggctatacgccaagcactgatactgttactattccagatgaccggacaccgggaatcaacgttatttacacaccgaatgatgttaagactaatgttgatgttccaagcaataaagggccacaaactgtcactaatgtgacgggcaagactggtgatcatctgacagtaaccgttccaactattccgggctatacgccagacaagacgaccgtaccagcgaccgtcaatccagatggttcgattactgtggatggaccaagtgctaaccctggtgataaaaattacgtgacctacacagctaatgaccagacaatcgttgtaaactttgttgatgataagactggtgaagtgattggtactgctgtacttacaggtaagactgacgaaaccattgatcgcagtccagctattattgctgaacaaaagctcatgaatatgggcaactacacaccaaaaggcatgctaaagggcactcaacagggtggcttacacaacggtttagctgatttaccagcaacattcacaagtaagtctcagacggttaccgttcaattaaccaagatcaataacgttaaagttacagtcaacctagtgccagtcggaccagatggcacgacaccaattcctggtgccaatccaacaacggtgactaactatcctggtactaacgttactgtaccaactattcaaggctatacgccaacaaatacgcagctcacgattccgccaaagaatggcgatgtgcctgtggtttacacaccaaacacagtaacgactgacgttaatgttccttcaaataaggggagtcaagtcgtcacaaacgttactggtaagactggtgaccatatcaatgtcaccgtgccaaacgttcctggctacacaccagataagaccaccgtaccagccactgtaaatccggatggttcgattactgtggataatccaacttcgactggattagtcacttacaatccagaccagcaaaagatggtcgttacggtcggaaataaggcatatatcatcacaggtgcttcggacagtccaatcacttatgatgaaaatgctattttgcctctcattccagctgggtatgacttggctgggttcaactctggtgattttagcaaattcctaacggacaaccatgtcgtcgcaacctttgatcatgacgataatacagatcaaacttggacggtaccgcttgttgaaaaggttgactatgaaacgaccaccacgaccagaaccattcacttcgttggtgacaatggtaaaacgctggcacccgaccaagttcagaatgtgacctatgtccatcctgttggggcagtcacaagaacgccattgggtctctactcaccaatgggcttgtacgcagaatacacagctccaacggttcctggttatacgattaaagctggtactggttatactgttgaaaataaaattggcacggtttctgccagcgatccaatgattgcggacttaccaaaggatgctaaggatattacggtttactacactgctaacacagttacacgggatgtcacagtaccgactaataaggggaagcaaaccgttactggtgtcactggtaagactggcgagcacctcacggttgatgtgccgactattcctggctacacgccagacaagacgaccgttccagcgactgttaatccagatggcacgatcaccgttgatggaccaagtactaaacctggtgataaaggatacgtgacctatacagctaatgcacagacgattattgttaactttactgatgagactggcaaagcgattggtacagccgtgctcacaggcaagactgatagcaacgttgatcgcggaccagccattgccgaagaacagaatctcatgaatatgggtaagtacactccaaagcttggcttacaaaacggcctagatgtacttccggcaacattcgcaagccattcacagaactttaccgttcaattgaccaagatcaatgatgttaaagtcacaactaccttagttccggttggtgaggatggtaaaacaccaattccaaacaccacttcaacaacggttcatgattatcctggtaccaatgtgactgttccagaaattccaggttatacagcaacaacaccaaacgttcctgtcccagctggtaaggataatactgttaaagttaagtacattgctaacgctcaagatattacagttaacttccttgatgacaagactggtgcggtattaggcactacagttcttcatggcaagacggatggtcaggttgttcgtgatccagccattgctgcagaacaaagcattattagtttgggtaactacacaccaaaggttggtttaaataatggtttagctggtcttccggcaacatttgcaaatcactcacagacctttaacgttcagttgactaaaatcaacaacgttaaagtgacggtcaacctagtcccatttggttcagatggtaaattagttccaaacaccacgccaactacggtacatgattatccaggtaccaatgtgattacaccaaacgttccaggttatacaccaaccaatgcgctgaccaccattccgaagacgaatggggatgtctcggtagtttacacacctaatgaacagacgatcactgtcaacttcattgaccaagatggtaatcagcttggtgaggtggttaccttaactggtaaatccgatagtgacgttgatttaacaccagctattaaagcagaacagagtattattgactctgggtacacccctgttaagggcaatcaaaatggtttggatagcattactaaatccttcacggcttacggtaaggttccaacttacaccgttcagttgagcaagattagcgatgcagatgccaacttgaccttagttccaagtgatattaacggaaatccaattccaaataccacaccaacaacgtttaccggcgttcctggtaagacagtcactgtgccttcaattcctggttacacaccagaagagaccacggttgctattcctactccagtgccaggcaaagacaatgttactggtggcaaggtcactactccggataagcgcggtgtgactcaaaagattgtttacacaccaaacacggttactggtaccgtcgatattccaagtaataagggacctcagaccgtgccgaatgtgactggcaagactggcgatcacatcaacgttgatgtgccaacgattccaggctacacaccggacaagactacggtgccagcgactgttaatccagatggcaccattaccgttgatggaccggatagcaaaccaggtgacaagaactacgtcaactacacggctgatccacaaagcgttaaggttcaatttgttgatgataaaggggccgatttgggcgctgttacaattagcggacactcagatgaaacggttgattacagcgaagcctttgctaaagaacaagacctgctcaatcaaggttacactttgagcaagggtgacaataacggtttagttagtgctactaagacctttacccagtacggcaaagttccaacctatgttgtggaactaagccacgtcgaaggtgttgaactggataaggtgccaacggacaacgttccatatgccaaccagtacacggttaacttcgtcacaccaaatggcgatgtagttggtaaagttacggtgccagctaacccaggtgtggacaacactgttgatgtcacaccagacattcctgctggttatgtgccaacgccaggaaatgacaagattctcgttaatattccaaagggtgcggatcctaagacaccaattacggtcaacgtcacgacaccagcgggtcaagatactgacggtattcaagtttggactaaggatgaagtcccaacggataacgtaccatcagcccaccaatacacgattaacttcgtcacgccaaacggtgatgtggttggtaccacaaccgtagtaggcaatccaggtaaccaatttgatgtttctggtaacgtgccaaacggctatgtcttaaacggtacggatggcgatgttgaggttccgaacaaccaagatccatcgaagccaattaccgtcagtgtcacggtaccttccaatccttcagataatggcggcacgacggatgtccctaatggcagttcaactgacaatggtactggtacaccaacggatggtcctgatacgactactgatggttccgacaataatacggttcctggtggcgatgagacagacaacaatccaactaccggtggaaagaccgacaataatgtgatttctactgataatggtcaaaagacggttggtcagccaaccagtttaagtggcactaatagtaatgctggtgctactcaatctggacttgtacaccagagcagtcaggctgcagctactcaaccgcaacagacaagtaactctagcgctaacaattccggtgttacagctaacaaagccggaagcttgccacaaaccaacgaacagaataccagcgtttgggcattgcttggccttagtctcatgagtatgttgagtctgttaggtttcacgaagcaaaagaagcgtgaagacgataaataattagttattcacgtcactgaaaatggcgttgatgagcgatcatcagcgctatttttgttgtttaaattcaaaaaatcaaaaagagacggtgtcataagtctatattggtaagtatttcaaccaatttttcaatcaagattagttattatcgcgcttttggttctgtatgttgatatagcctaattacgcgccaaaactcagattccggccgtttaacgcaaataatgcccattccgcaaaaaccacggaataggcattattcacgttaaactctggaatctaccgagttttgtcacagcttgtttttatgtcattattattcagacttttgccgacaatacttcaaacgaagcattgatcttttcagcacacatccgtccctcgtaaatcgcccagataaccagactttgaccgcggtgactatcaccggccacgaatacctgactatcgttagtgctgtaattagcgtttaccttagtaattccaaaggcatcgaacagccattgttcagcaccagtaaagcccatagccagtagaactaaatcagccttgatgcgtttttgactgccagcgattggcttgtagtggtcggtgcgactgacttcaacttcggacagctgaccgttttcaccaaagaaaccggtggcagttgccgtatacgttgtaatctctccgaataaccgttgggcttccagttgaccatagccatccttcagcaccattggccactctggccattgattgtctaacgtgcgttcctttggcaattccggactgatttccaactgggtgatgccagcgcaaccctgacgaatggcggttccgatacagtcgttacccgtatcgccaccaccgaggactaccacatgcttgccctttaacgcgtcggttgcttcagtaccatttttgatcactgacttagttgcgtcagttagaaagtcaacggccttcataacacccttaagttgtcgaccgggaacgtctaaatcacgagcttcacgagcaccggtacagatcacgatgcgatcgtactcagcctttaaagtttcaacgtcgatgtctcgacccacttcagtattggcaattaatttaatacccacgtctcgcatggcttgaattcgccgttcaacgatttctttaggtagcttcatattaggaatcccgtacatcagtaagcccccaaagcggtcagctcgctcataaacagtgacggaatgtcccaattggttcaagcgccaagcagcggaaataccagcaggaccgctaccaataaccgcaatctttttaccggttcggtgagcgggtttacctgaatcaaccacccaaccgtttttaaaggcctgttcgataataaatttttcgttattacgaatggtgattccgggaccgttcagggcgttgacgcaagccacctcgcatggcgccggacaaactcggccagtcatatctggcaggtagttggttcgggtcaagcgttcaaaggcggctttatcgcgctgcttataaaccagatcgttccattctggaattaaattatcgtttggacagccactaacgccgcgcttaccaccgtaaaagacaccgtggtggcaaaagggaatgccacagttcatacagcgactggcttgaatccggcgatcagcgtcacctaagtcgatttccataatgttgaagtccttgatgcgtgctggaatcggccgcatggggttgctctttcgatcgtgtttgatgaatcctcttggatctcccataccgatcactcctttcccgtttgagtggcgacgtcgaaggctttttgaatcacttgattttcaggaacacctgcttgttcaaacttgtgaatcaagtcttgcatccggtgataatcggttggatagactttcacgaataactgcgttgcttcttcccagttgtcgagaattttctttgcctgtgaagattgggtgtagtaatagtgtttttcaatcaaggttttgagggtactgtcatcgcctgattcgtctaaatcatacagatcaacgagttcggtgttgcaacgctgtttgaagttgtgtttccaatcataaacgtaggcgacaccaccagacataccagcagcaaagtttcgacccgtttgccctaaaatgacagcgacgccaccggtcatatattcacagccgttattgccgataccttccactacgacgttggcaccggaattacgaacgcagaaacgctcaccagcacggccgttaaagaaggcttcaccactggtggcaccgaaacaggcaacgttaccaataattggcgcatgggcgtagatgtcttctgcaccttctggcgaggcaacgattagtcggcctccagaaagtcctttccccacgtaatcgttagcttccccgcgtagcttgagttccagtccctgggtaataaaggcaccgaaactttgaccggcaataccggtgtagttcagttgcagagcacccggtttgagcccctgattgccaaagcgagcagcaatccagccaccaagccgggttcctgttgcccgatcggtgttgttgataggctgattgatcgatgttgtagtcccgtttttcaggctggcttcagtaatcgcgttgaggtcaggccagttgtatttagcacggaagggatccttagccttacgctgaatggtgatggttttaccaatcatcctatcatagttaagcgatttggctttgccagctggaatgtaacggggagtcagatgttcaccatgaccgaccatttcatccacggttcgatagcctaattgggccatttgttcccgcagatcctgtgccagaaagtgcatcatgttgataatgtattccggtttaccggcaaataaacgccgtaattgtggatcttgggttgtaatgccaatggggcaggtattaaggttgcatttccgcatcatgatacagccaatagcaaccatggtcagggtggcaaagctaaattcttcggcacccagcatgatggcaaccgcaatatcgcggccagtgagcagtttgccatccacttccaacgtggtccgttgacgtagatgattaagtgctagggtttggtgcgcgtccgctaagcccatttcccatggcagcccgcagtcacgggtggagtttctcggagctgcaccggtaccgccatcgtagccagcaatcactactgtgtcagcaccagccttaaccacgccggctgcaatggtgccaacgccagttgaagagaccagcttaacgttgataatcgcgtaagggttaacttgcttcaggtcatagattaactgggcgaggtcttcaatcgagtagatatcatggtgaggcggcggtgagattagttggacaccggcaatggaaccccggatactagccacccaaggataagctttaccagcgggcagctgaccaccttcaccgggtttagcgccctgcgccattttgatttgaatctcatcggcactttcgaggtattcagcgttgacaccgaaccgggcagtggagacctgcttgatacgactattacggtttaacccatcagcaccaactttgaatcgcttccggttttcaccgccttcaccagagttgctgcgtgcacccaatttattcatggcgatggcaattgtttcgtgggcttcttctgaaagggccccaaaactcatggcgccggacttgaaccgtttgacgatggagctgacaggctccacttcgttgatgggaacgcttgtccgaccctttgcttgaatttcccacatggaacgtagggtgacggggttactaatggcttcttggttcatttgttgtgcgtatttttgatattcctcgtaactgccagaacgcactgccttttggaactggtagattgattctgggttgtaaaggtgatgttcaccgtctgatttgaactggaaactgccaccggatggcaaatcgtcaatattatgagcatcataggctgcgcgatatttagccatgtattcgtcttcaatttggttgagggttagaccaccgattcgactaggggtaccagtgaaatactgatccaccacttcgcttgatagtccaacggcttcgaacaactgggcaccttgataaccggcaatggttgaaattcccattcggctcatgatcttgataatgccgttggtagcggccagtcgatagttgcctaatttggcttcatatccacgcgaaaccagtgtggcgtaagcgccataaggatgaatggccgtggcaccatagccaacgagacaggcaaaatgatgcagttcgcaggcttctgccgtatccaccacgatggatgcgtcggtacttttaccctgttgaaccagatagttgtgcagtccggaaactgccagcaagacgggaatggtcagctggtgttgttgagtagaacggtccgagagaatcagaatagatgcaccctgatcaatggcgttttcagctcgtttgaatagagcatccagggcatgaaataaccggttaggccgctcagtgagatcatatgataatcccaatttagtaacgttgaggcccggtagatccaacgcttcaattttggcgtaatcctgatcgcttaaaatgggactttcgatgcggactttgtgacagtttgccgctgtatcagtggtgatatcagcatcacgaccgagatagagggtcgtactgatgacgattttttcacggaggggatcaatcggtgggttggtcacctgtgcgaaagcctgtttaaaataggtgaagagattttcagatttatgcgagagaaccgccagtggtgaatcaaaacccatagcgaccacgggttcaccaccattttcagccattggaatcaacgcagtttcgatgacttcgtgagtgtagccattctgtagccagagccgttttaattcagtgtctgaaatggctgtttctgttttgacttctggtaagtttttcagcgaaattcggttagcagttagccattgttgatagggatgttcgttggcaaaagtttgcttgagttcatctgattggtaaatcttacctaagctggtatccaccaatatcatttgagcgggacctagaatcccctttttaacgatatcagttggcttaacgtccactacaccagactcagaagcaacgactaatacgcggtccttggttaaggtataacgcgatggccgcagtccgttacgatcaaggaaagcacccacttggatgccatcggtgaagcacagcgctgctggaccatcccaaggggccatgaaagtggcgttatattcgtcaaatgcgcgttgctgtttcggcatctgaacaccgctaccccaagcttctggcaccatcatcatgagtgcttttggaatcgagcgtccctgacggtaaaggtattccatgcagttttctagtttagcggagtcagaatcctcttcgtcgtaaatatcaatcccgtggctagtcatccaattttcggcgccctttaaggtgttaatttccccgttatgggctaagaaacggaagggttgagcacgcgcccaacttgggaaggtgttggttgagaaacgtgaatgaatgaggcaaatggcactttccatggcagggtcatgcaggtctggatagaagcgcccaacttgaaaggcgtgcaacatgcctttgtagacgatggtttggctggaaagtgaacaaatggctaatgactgatgttcgaaaacgtgttccaactgtcgtctaagggtgtaaagttggtcttcaaaaggacgaccggcggcgatatcagctggtcgttgcatgatgatctgaacaaatcctggcatagatttttgagcgccaggaccacagttttcgtaaacaaagggaacaagtcgggtccataataccgggaagccagcttgatcgatttgtgctgttactgctgataacatggcatcgcgtttttgaacttcgtggggcaagaaaagttgtgccacagcgtagtcgcctttatcaggcagcgtcagcttggcatcagccatctgctgacggaaaaatttatccggcattgccatgagaataccagcaccatcaccagtatctggctcagcaccagtaccgccgcggtgattcatacgctccagcattgtgagggctttttcaactaattggtggtctgcgtgaccgtcaatttgagtgataaagcccatcccacaggcagcgtgttcaaattgcggatcgtacattaaatgatgatcgtgattcagagttttcaaaaactgtcacctacttttaaaaagaaaggaagagtcaactatgtggtgcgaattattctaatgatattctaattttgataatctgacaatacttagaactaaataaatatttacttttttggggaattagtcgttttattcattttggaatattatagtttattaatgaatactctctatatttgctgttatatcagcaaatataatgacaaccgtgtaatatggtgaacgttgattaagcaactattatagataaattatcaaatttgtaattattaaatattcctaagaaaattactaaaaaaggcgccatcctgacgataaaatcaggatgacacctttcaataacactattcaattaatgatgagtaacgtaaatataaagtgtcgatttcgaataacctaagtcaaaatcaatgcctttcgaatgaatcgtactggccgttgtttgactgctatttttcttattggctttattttcgaaaccttttaataccttttgagtgttagcgccggtactgcccgttaatacggcaagttccgtcatgaaggttttggcagctgcctttgacttgagcgatgacgttggcaccatcagcgttgcaccgatgagttgaccattatcaacattcccacgaacggttgcgttggcagtcttcttcaggttgtaaaccccagtccgtgctttggcagtgatggtatcatcagcaacctgtttcttggccttagctaatgctggtgctaatgatgcctgagtttgtttcaacttagcaccttgcgcttgaagctgttgaccctgcttagctaatgaagccaaagttgcttgagccgaggtgtcgccagactttaatttagcctgagcagtttttgattcagcttgcagcttggcgctttgttgttgtaactgaacgccttgtttttgcagctgcatagccgttgcctgatcctttttagaaagggcagtggccatcaaggcttggttataagccgttttaaacttactatagctcatgatagcagggctcttcttaacaacggttgaagcgttgcgaccaccagcagtcagtttaacggtttgctggtatggtttagccggcagtgtaatggcgtaactgccatttagtactgactggtttttggtggagccattgttaatccggtacttaactgttttctgattactattgcccttaacgacggcggtcatcccgctaggagcataactcttatggtcgaccgatagtgagggtttgccacacgctgccagcgttaagctaagtagggcggctgataaaatcaaactaatttttctcataacgcgtcctcctaaccaaatgaaatgccatcagtgaattgactgttatacagatttgcatagaagccgttctttttgagcagcgcctcatgggtacccgtttcaacgattgaaccatggttcatgacgatgatgttatcggcattttgaatcgttgacagccggtgagcaaccacgaagctggtccgatccttaagcaggagtcccatggcatgctgaatctggacttcggttctggtatcgacggaactagttgcttcatccaagataagaatttcaggatcagcaacaaaggctctggcaatggtgaccaattgacgttgaccttgagaaatgttggacgcatcctcattcaggacagtgtcatagccatctggcagtctgcgaacgaattcatccacgtgggctgctttagcagcgttgatcacttggtcttcagtggcgtcttcacggccgtacttaatattatcaaaaatactgccagtgaagagccaagtatcttgaagtaccatggcaaagtgggaacggagatcttcacggtccatgttccgggtatcttgaccattcaatagaatagccccacccttaacatcgtagaagcgctccaacaagttaatgatggttgttttaccagcaccggttggcccaacgatggcgacttgttgtcctggcttgacggccagattgtagtctttcatcaagagctcgttgtcatcgtagccaaacttcacgtggtccatttccaatagattatcggtttgtttaaccggtgtgtcagtggaagtatccttcatttcttcttgatccagaacatcaaaaacccgttctgctgaagcaatggtggattgaatcgtgttcattaggttggctaactgtgaaattggttgtgagaattggttggtatattgcaggaaggcctgaacgttcccaagggtgatattaccattagcaactgaaataccaccaataatggcaacaaaaacgtaaccaatgttattcagaaacatcatcaaaggcatgatgataccagaaatgaattgggctttccaagcggattgatagtagaccttgttttgtttctcaaaggaatcaatggtgtccttttccttattaaaactcttcaaaacctgctgaccagagtagttctcttcaacttggtcgttcatgagacccaagctcttttgctgagtggcaaagaatcgctgtgacttcggtgccacgataccaacgatgatcaaactcagcggaatcgtaatcagcgcaatcagcgttaacttccagctgatggtgagcatcatccataaagtgccgataaacgtcacggttgaagtgaccgcttgcgtcaggctttgttgcaacgtgttagcgatgttatccatatcgttaaccgcacgactcataatgtcgccgttgctatgggtgtcgtaatagtgaattggcacgacacgcattttttccttcatccgacgacgaagtttgtagactgtcttttgggaaatccgggtcatgatccattgctgcagaaaactgaaaacagcagaagctagatacatgagaccaacaatgataatgatctgaatgattttatcgtagttaattgggaggtgagtcaagttaaagccagctttttgctgggattgacccttcataacgccagtaaaaatttcagttgtcgctttacccaaaattttaggggttcgaatttgaaagacgacgctggtaatggcgaaaatcaagaccaaaaccaatccgacaattcgatcagacatgtaacttaagagtcgacgagtcgttccccagaagttctttggcttttcaactaggccatgaccacgacctcggcctggtccaccaacatggacaggacgggtggggtgtttcgatttagaatcagccattattcagcctccccctctctgatctgtgacttaataatttcttgatagacttcgttagtctttctcaattcatcatgggtacctttaccgactaattgaccattatcgagaactaagatcaaatcggcgtcggccaccgttgcgattcgttgtgcaacgatgacggtgatactctgttgaatatgcttatcttggcgcaattcagcacggaggtcagcatcagtcttaaagtccaatgcggagaaggagtcatcgaagacgtagatggcagattgcttaaccaaggcacgagcaattgccaaccgttgtcgttgaccaccggagaagttgccaccaccttgttcaacgtacatatcaaggccgtcaggatcttcttcaacgaaatcgcgggcacgggcaatgtctagggcgtgccaaatttcgtcatcggtagcgtctggtttcccgtatttcatgttttctcttaatgaaccagtaaatagggtcgctttttgtggtactaaagaaacagcatcgcggagcttttcaggtgcaagctgagtaatatcgataccatctaatttaatctgacccttttcaaggtcataaaagcggggaatcaggttgatcaaggtcgatttaccggaaccggtaccaccaatgatggccactgtttggccactcttagcactaaaatcaatgtccgtcaaagcggatttttcagcgccaaagtaacggtaagaaacgtggtcgaattccagactatgttcagcttcagcaggtaattcctttggcttgtccgctaccttcatggtagatttcaagtcaaagacctgctgaatacgcttagcagatgcttgggcacgtggaataaagatcagtaccattgaaagcatcataaagctcattaaaatctgcatcgcatatgtcatgaaggcaattaaattaccaacttgcatcgcctgattaccgatcaaatgggcaccaaataaaataatggcgacgtttgtgccactcatgatcagtgtcatgacaggtagagcaagtgacagtagtgtgttaacgttaatggcattttgagtataatcaacgttggcatcttcaaagcggtcctgttcgaactgatcttgacggaacgcccgaataacccggacaccagtcaaaccttcacggaagattcggttgatgcggtcggttttggtttgcatggcttgaaacattggcatggcaaaccgcagcatgatacccataaagattgccagtagtggcaatgagactacaaacactaaggttagcgtatggtctttgctgtaggctaagaaactagccccaatcagcatgataggtgccataatcatcattcttaacatcataatggcgacgttttgaatttgaaccacatcgttagtagttcgtgtaattaatgaagaagtttcaatttgatcgtactcgtcagtagagagacccatcactttgcggtagatatcacttctcaagttttgcccaagcttttgtgacgttgtagcagctagaaaaacgttacaaatagcggcagcgatactgagtaatgaaaacccaaccatcttcataccgactttccagatatagctgatattacctgtcgcgaccccgttgttaacaatgtcagaggtcaaacttggcaggttcaggttagcaatcacctgaatggtcatgaatataatcgcaccgagaacggctagataggagacacgacccttggcaatttttagcattgcagaatctcctttcgtgtgtgtaaaacaaacatgtgcaacgaataattgtacacctatttgacaaaaaaacacgcaaaaataatttacattttgtcagatattaaatagaagttattcagggttgcagtcttgaacgtatgttcgtataatggatataaataaacgtgaagaggtgcctgataatgacggataaaaatgacgtggtgattcacttgcccaaatcggtagatattaacgagtttgcccatattttagaagctgcgtttgaagaacacggcattgaatcctatcaggtgagctatccggtgcacaaaaaataactaaacacactattatgctcatttaaatcttaaatcaagcttaaagagggtgtggcgagtctagattggcaaggggttcaatccagtttcttgactgaaataccattcagattttgttttttgctcaatacttttatcttgcttaatcgtgcgtcaaaactcagattcctgccatttaacgtaaacaaaacccactccgacaaagttcgccggaatgggttttgtttacgttaaattctggaatctaccgagttttgccacgcactctcccaaacgtgctcaaacaagcaaagagttgcatataagggctcaaaacaaaaatcctccaaaggttcaggggatttccgttttgagcccttatacttcactctttaaacgcttgttttcacactctatattatctttgccccgccggcatatcgtaaatcgcccgtggaccgccaatcagttttggccgtgacgttaagaacgttgtatgtgccgcgccaatttctttgaccgaagttttaactgggatttgtacccagcgaacgtgcatcccgatttgggtatcaccaatgtccatgccgccatccgctacgatacgttctacttcaacgggatctttgaaggctttataagcagccacttggccagcaccgccagcgtgaagctgaggaataacggaaacaatttcatagccgcgtcggtcagccacttcccgctcaagcaatagagcgcggttaatgtgttggcaaccttgaacagccaagttaaggtggtgtgccgttaaaattggcagtaacgtgttgatcaccgtatcaccaacgtcttgattggagttttgccccatccaagagcccattacctcgctagaactaaaaccaaggacaaataaaccgttttctggcaaagtcacttgttcaaagtattcattgagggcagttgttaatgaggtcttaatatcatccgaagtcatgatcgtgtattactcctttcaaaatccatatgtaaagttaccagtttatcataccttcatagacagggaattacaatcagcatatctcgggaattaactcattatcgggaagggcgatcgtaaatttcaccgaatgtggactaaccctattttgagcggtcattagagggaattctatggtacattattagtatcaaataattcttgaatgataagataattcttaggggatgcgggaaatggcagaggaacttaaatactgtccaaactgtggcgaggaagttgccgctacggatgaattttgtggaaaatgcgggtttaatttaaaagcttttcgaactggtcaaatacagccagaagcaacggcggttaaatctgaaacaacaagtgcttcacaaccaagagcgactgctaaagcgaaacgaacaatgggacgtaaaccgcgaaaacgctggccttgggtccttagtggtatcattgtcttactaatcgtttgttttatcggtgggtcttggtattacagtaagagcaatcaagcagagcggttggccacagaagttacctcaacggatgacgatgacattgcggatgccgtagtcgatgataacggtcagaaagtagacgacgatgcggttaagccacttcaggcactttacgaaagtaattctagtgcgagagataccattaaacaggcggttaaaaccatggatagcagtcagatgccgtttgagctggttaaagatgggcatcacttcctatttacgcgctatatgcttcaggcgaaatcgtttcgtttaacggtcaaaactaacgttaaagatgcgacagtcaccaataatggggactccgtttcagcaaaggcagttagtggcggttacacggtcgatgatctatttccaggccggtataatttgcaggttgctgggaatgtgtccggcagcagtcaaagtgtgacaaaggttttgccggcgattgatatttacaagcagttagataacacggtcagtctaaaagctaaagcccctcagacaactgctgctcaggcgccagcaccacaaaccaataacagtgatcagtccagtgatagcaacgatgacagtagcggttcaaccgattattcatacgatatttcacttcgtaacgacaatactgatgatgatattctcattggtgattggcgtagcaacgccggcacatgggagttcaacgatgacgggacatacgaaggggaagataccaacgataatgatttgagcggtacctgggaagtagtctatcataagggtaactactggaacattaagtatcatcatgatgatggtcaaacggatgttgaaccctatcgttatcaaaatggtcagttagtacagtgtcaaatgaaactgcactggcacgcggatgattaagtcattttaaaatagataagcaccgtcctgataaagcccattggaacggcgcttatctattttaggttctgggagctaccgagttacatcacactctcttgctattgtagttgtgaaataattcccgagtcgatataatcaagtcatgaagcatgttggcggtaaagacaggaggtgtaaatgttgcttgatttattgaatgcacaaacattgcaagttgcagacggatcgaatctgagctgggaggaagctatcactattgctgctcaacctttagtagatacgaatattattgatccagcctacgttgattcaatcattagtgttgttaaagaaaagggaccctatatgaacattggtccccagattgttttagcccatgcgcgtcctgatagttccgttcacggggttggtttatcgctcttaaaaacgaattccgctgttgattttgtggatgcgaaacatccggtaaagctatggtttgtcttaaccgctacggacagtcaaagccatcttggtgtgattcaacagttgatgacacttttaactgacaaagcggctgttcaaaaagtgctagaagctctttcagttggtcagattttaacgattctccagaaacttgattcttaatgttgtggtattgcgattatttacttatatataggaggaaaaagcatgaaaattcttgcagtgtgtcagagtgggttgggtaccagctttatggttcaaatgaatattcaggcgattttaaaggcggaaaaggtggatacgagtaacattcaggtgaatcatactgatgtgggtagtgccactcctgatgcagcggactatttcttcattgaatcaactttagctagcgcggtcggcagtttgccaaaagaccgagtcgttctgttaaagaccttgatcgataagcaggaaacaaagcagcatgttaacgatattctggataaagaagggatttcgtatactgctgagtaatcgtctctgaacggaggacatgatgcgatgaaagctatcttaaatttatttgttagtattgcttcacagccagctattttggtcgcgctgattgcgatgcttggcctttttcttcaaaagaagaagaccactgaagtcattcaaggaaccattaaaacgtttgctggtttcttagtcttaacgggtggtgcgggtatcttaagtaactccctgttgccatttgccaaaatgtttaagtttgctctgcatgttcagggggtggttcctagcaatgaagctgtggtggctatggcactggtaaaatacggcagtaccactgcgttgatcatgttaatgggtatgattgtaaacgttttattagcgcgatttacagccttcaagtacattttcttaacgggccaagccatgctgtatgtatcttgcatgactgccgttatcttggttagcgcacacttgggtacgggtcttaccacaattgtgttaggcggtatctttgaaggaactttacttacagttacgccagcgttaacacaaccatttatgcggcgaattactggtggtgatgaagtggccatggggcataccggtaacatcggctacgccacagccggattaatgggtaagtggtttggtgatccaaagaagagtacggaagacttaaatattcctaagagtctcggctttttacgtgattcaacggtttcaatcaccttattaatgggcattgtttatattgtattagctattattgctggccctggatttgttgagaaaaatcttagtgctggcaccaactatattatttatgccttagtccaagcaggaaccttcgctgctggtttcgttgtggttctgcaaggagtacggatgatcttagctgaaatcgtacctgcctttcagggaatcgcgcagaaactggtccctgattctaagcctgccttggatgtaccaattatctttccttacgcaccgaacgctgtgttattaggtttctttgtgagttttattgttgggacgctttccatgtttgtgatggttgctctcgggactaccgtgattattccgggagttgtggggcacttcttctgcggtgccgccgctgggatctacggtaattctactggtggtaggcgtggtgctgttattggtgctacggtgaatagcctgctgatcagctggttaccgctgttcatcctacccgttttgggtacgctgaaactgtccgcttcgacgtttgctgatactgactatctgattcctggaatcttgttaggaaatctgggaagttttggtcaagcaggtatcgttactgggattatcgtttttgttatttgcgttttgattgctagtcatattgtaacggttaagaatcgttcaaagaaatccgctgatggtggcgaaaattaaatcgtagaccgtgtgttatataattagattctaatccgaaattttaaggaatagaggtagctgatttgtcgacaaaaattaagggaattgcagcgagtgatggtattggtattgcgaaagcatatctgttagtgatgccggacctaagttttgataaggtgactatcactgatcctgatgctgaaattgatcgcttgcatcaggcactggatacctcagttgaagatttaaagacgattaaagaccgtgctgaaggccatttagatacagaagtgctaaccattttcgattcgcacatcgcgttattgactgatccggaaatgatcaaacaaattgaacagttgattcaaactcaaaaaatcaatgccgaacaagcattgaaacaggttactgatgacttcatcaatacgttagaagccatgactgaaaatcggtatatgcaggaacgggcaaccgatgtccgcgatgtcactaaacgaatattgagtcacttattaggtaaggcgctaccggatctagctgggattaattgtccagtagtcttggttgcccatgaggtaacaccttctgatacctcacagatggataaaaagtatgttaagggaattattactgacttaggtgggcgaacgagtcactcggctatcatgtcacgaacgctggaaatacctgccgtggttggcgctaccgatgctactgaaaaaattaaaaacggtgaaatgctcattttagatggcgagactggtgaagcgattagcaatccaagcgaaaccgaacttcaggactatcaacagcaagctcagcactttgaacttcaacgtcaagaatgggctaagctagttgacgcaccatctgtttcagcggatggcagaaaatttgagattgcctcaaatattgggacacctactgacatggcggatgttttaaaagttggcgcggatgcagtgggtctgtttcgttctgaatttctgtacatggatgatagccaattaccaaccgaagatgaacagtttgatgcttataaacgggttgttaaggtgatgaaaggtaaaccagtcgtcattcgaaccatggacattggtggcgataaacagttgagttatctacatttaccagaagaaatgaacccgtttctaggctatcgagctatccgaatctcactgcaacgacaggaaatatttcgaacgcaattacgggcgctgatccgtgcgtctaagttcggtcaactacgcatcatgtttccgatgattgcgacactggaagaatttagacaggcgaagaccatttttactgaagagaggcaaaagctgcaggcggatgatccagggattggtgatgacatcaagctgggcatcatgatcgaagtaccagcggctgccattttcgcggaagcctttgctaaggaagtggacttcttcagtattgggaccaacgacctgattcagtataccttcgcggcagacagagggaacgaatgtgtttcttatctctatcagccatataatcctgggttattaaagctgattaaacacgtcattgacgctgctcatcaagagggtaagattgctgccatgtgcggtgaaatggccggtgatgcggtggcgttaccactattgatggggatggggcttgatgaatattccatgagttccagctcgatcctcagaacccgcagcatgatgaaatcactggataccaccaaatgtgccgaactggtcgatcacgttttaaatagtgcgttgactaatgacgatactgagaagatggtgaaggcgtttcttaagtaagcactggacaataaagaagcactatttcgatgtttgtgtcggaatagtgcttctttatatcgctatcgtattgctttttgtgcttgttgaacgtcattaaactgacgcatcatccaggtcttatacgttgtattggacggctgtgattcagtcacccgaacgattgggacaccactatttttcgcaagtgcgagtaaattagtggtcattttgctaatttcttgcgtattcacaacgaaaaaggcaattttatggtgacgaatatcagcttgcatttgtcggatatctttaggtgacggatcagtgtcgttttgaacggcctgcgcgtagtgattgttattttggcgatagcccatttcagttaatgagtaatcgaaaacgggttcgctaacgtttacccgagcttgatgactgttctgccgaagctgtgccactttttgatctagtggtttcaacgaacggatataacgctgtgcgttgcgcttaaagtaagccttattttgcggttggcgcttcgcaaactggttagccagttcgttggctaattttggcatggttttcatgtcgtaccagatatgctcgttgtcaccatcatgcttattcataatgccttgagcaacgttcacctttgtagtccccgtattatccgcggataaccggttcatccaggtatcatagccgagaccgttataaataatgacatcggctttgctgacttgtttcgctgttttggtcgttggttcaaattcgtgtggttccatgctgggtttatcaatgatggaagtcaccgttcctttgttaccaaggacagctttcgcagtttcaccgtagaaatcaagcgatgcaaccacatggatttggtgcgaatgctgtggggcggttgcttttgacgtgcagccgactaacatcactgctgccagtgcaagggtcagtagtgtgccaagcggtcggatatagcgttttagcatcataatataaataggtgcctcctaagctaaatgataataattactattaatatagaataacacacttgcgccacagatgatatcccagttaattaacgatggagactcttaatcaaccggccaacgttttcggcaagaatggctaaattttgaggcccttcagcaatggctttatccaaagtgatgactcctggcgtgattgggaagatggcgtcaatagcgcttttatcatatagactatcgatgccggcaccgacgtttcccgccaacgcaataacgggtgcgtttggggcaaccgttttggtagcttgagcaacgccatatggtgttttgccgaatttagtttgaaaatcgatgccaccttcgccagtaaagacaaggtcagcgttttgagcacgctgttttaggtgtgaatactcaataacaatatcgattcccttttgcatttccgagtcagtgaaggccagcaacccagcaccaagcccacccgctgcaccagctcctgggtggtgagctaagtcgagctgcaagtcacgtttaatgatctcggcgtaatgctccaagttagcgtccaaggttttgaccatctcgggggttgcacctttctggggaccaaagacggcggatgccccattaggaccgactaagggattggtgacgtctgacgcaatcatgattttagtggctttaacagcaggattgatttgtgaaatatcaattcggtttaagcggtcaagctgaccaccgccaaaatcgagttcacgattattttgatctaatagatgaacacctaaggcctgtgccatgccagcaccaccatcgttagtagcgctaccgccaatacccaagataatttgcttgataccatgagtcgcagcgtcaattatcagttcgcccgtaccataagttgtggtgatcaggggattatgtgtctggctattcacgaattgaataccactagcggatgccatttcaatcacggctgtttgccggtcacccaagataccataccttgcttggacaggggaatttagtggccctgtcacttgtttttcaacgaagtggccgtgagtagcgtcaaccaatgattgaacggtaccttcaccgccatcagccattgggacttcttcaaaagcggcgtcagggaaaatcttttcaagtcccatcttcatggcgtcggccgcttctttagcagtcatgccacctttgaaagagtcgggtgcaagtatgaatttcattttcgtttcctcctgtagatgctgtagtcggaaaatgctccagtcactaggataccactagttaagagaaaaacagcctatctattagtcgatttcgactgatagataggctgtttgcaatcatatgttgatgactatcctaagattttaagacccgttgcttcaatatcagccgcgaaccccttaacggtattcatagtgatatcgtcgccagtttgaccagctttagcaactaatttgtcaataatggtcggtggtacggtaatgatatcaacgccgaactgttcagcctgcataatactgtagacttcccgggtacttgcccagagtaattccacatcactacggtccttggttaatgcaacacttttttcaacaaatggaattggatcaataccagcgtcagccacccggccaacgaagattgacacgatgcttggcgttcctggtacgatagcatcgacactttccttaacttgatcagcggtggcgatagcagtgacgtttactttaacgccatcagccgttaaatcatggattaagtcagtagttggttcaccggcagtcgtgcgaattggaattttcacgtaaacgtgaggaccaaggtcatggagcatcttggcttccttgagcatggtgtcgtagtcgttactaaacacttcgaatgaaatggcttcgtcaggaaaagtcgcgactgcttctttagcaaaggtgaggtaatccgttacacccgccttttttaacaggctagggttggttgtaaaaccagtgacaaagtcgtttttattgatggctttcatatcttctaaatctgcaccatcagagtaaatctttgttttaaacgttagattattcatgttattttctcctcataaaattaagcattggcaggctggttgctgaccgtttttaaataggttgctgccacattatcagcagtaaaaccgaactgtttcatgatagcgtctggattgcctgattcaccataacggttattaataccgacgattttaccttgcaaaccaacgtaatgttcccagccgtaggaggtgcccatttcaacggccactctgcgggtgacgctacttggcagcacttgttcacggtattcagctggctgtgcatcgaatagttcaaatgatggcagcgagacaactgaaacgtcgtggccggcttcttgaagctgtttttgagccgctatagctagttggacttcagagccagtagcaatcaagatgccttctggtgttgatcctttagcaggtgagaggacgtaaccgccacgttgtacgccttgagcagcgagttcttccgtacgcggtaacgtcggtagattttgtcgagtaagcaccagcatcgttggtgtttcagacgcggcgagcgcaatcttccaagcagcgattgcttcattggtgtctgctggccgaatcacgttgacgtttggcattgcccggaaactcattaactgttcaattggttcgtgggtggggccatcctcaccgacagcgattgaatcatgagtgaacacgaaggttgatggaattttttgaatggcggccaaccgaatggcggcccgcatgtaatctgagaaaacaaagaaggtgctggcgtaagcatgaacgccgccatgcaaggtcatgccgttaacagctgcagcttccgcaaattcacgcacaccgaaccaaacgtttttaccgagtcggtcagccggttcataggcgttagcggttttaacgttagttttatttgaagagaataagtcggcactgccaccccagaaactaggtaattgttcagaaattgcaccgatgattcgctggctggtatttcgaccagattctgattcaccaacgtggctaacgggaagcttcaaatcacacgaaactggtttgaagctctgtaagaactgagctgcaagttcaggatactcacctgaataatcatcaaatagtgtttgccattgcgcttcgctgacaataccgcgctgtttaacagtcgtgtcaaaattctgacgaacgtcatcgggaatgtcgaatggtttgtagtcccaaccgagtttttcacgagtagctgccatgttttcgtcgccaaggggcttaccatgcacgccgttggtaccagcgtttggtgcaccgaaaccgatggtggttttcacgtcaatcaaggtaggctggtcagcggtttgcttagcggtttcgattgctgcactgatttctgcaggatcgttaccattcgccacgtgaagaacctgccagttgtacgcttcaaagcgcttaggagtatcgtcagtgaacgccatgtcagtaggaccatctagcgaaacactgttatcatcatataagacaatcagtttgcccagcttaagatggccggcaagactagcggattcgtgagagatgccttccatgaggtcaccatcgccagcaatcgcgtaagtgtagtgatccataatgttaaacccgggtttattgtactgtgcggcaaggtgagattcagccattgccatccctactgccatgcctaagccttggcctaatggaccagtggttgcttcgacgccatccgtcacgccatattcagggtgaccgggcgttttgctgttaagttgacggaattgttttaaatcttcaatcgttaagttgaaacctgaaaggtgtaataaactgtacagcaaagcggaaccatgaccggcagataaaataaaccggtcgcgattgagccagtgcgaatcagttgggttaatgtttaaatgtttagtccatagagtgtacaccattggtgcgacaccaaggggtaatccaggatggccagaattggccttttctatcatatcaacacttaagaatcgaagtgcgttgattgatttttggtctaggttgttattttgcaaattaatcacgctcctatgcctatgaaatatacggtaactagtctgatatgtcaactatgataaaccaaatggtatagctgaaatatcgggctatttcaacagaattttcatcaaaattgatttgcttgaaagctcgccaaaataggcttctttaatcatcaaacggaatcaatatgctaatgatgaaaattacagggcattaagcgaaaattagaaatagttttcaatgtaaaattaattcaaggaaacagctgaattaatctttaggaaggtctgatctaccgaaaaattgatgaaagcaggttacatttaggaagtcggactgaaatctgggaaggatagtccgtgttttcatgaaagtttcagcatctcagtaatcgttaaaaggacattaaaaaataatttgaaaagtttaattaatagtaacatgagttaagtgaataaaaaaggaattttgggcttttttggcagaataaggtataaaacatgctatactcaacgtatattaactaggggcgcaaattgctgagacggccgcggaccgaaccctttgaacctgtgagctaaccctcgcgaaggaaagttaacgcgtattttgcgataaaactgccggtcagggtttctctggccggctttttcgattcggcagttttcgtcgcttgaggaggaattctattgtttacggatcaaattcatcaagcagcggcaccgttttggcaaaagagctttgaacatccctttattcatgaactgcaggacggtactttacccaaagacgtttttcggtattacctcattcaagatcggtattacctgagtgaatttggcaaactgcacgagttagtggcggaccaagttgatgatgctcatggcaaacagtttttattagagggggctcagggattgaaagacggcgaaattgccgttcgcgagggcttctttgaacaactgggaattacgccagcggaaattgctagcacgcccattgcgccaacggcttataactacgtcaatcatatgtacgcggaactttatcgcggaacgcctcaacaggctattgctggtttgctgccgtgctattggctctataatcagattggccagcagctcgttgccaagggatcaccagttgagctgtatcaacggtggattgaaacttatgatagtgacgattacaccgacagcgtggatcagatgattgatttaactaatcaagttgccgcacagtcggacgagactaccagagataaaatgaaaacggcttttgttcgcagcagtgcctatgaactggcattttggcaaatggccatggatcagcagaggtggcaagtgacggcctagacttttctcatcttctcttaattggtataatgctaaacaaacataagggaagatgtgatatacatatgaagattcgagaaattaaaccagcagatgatgcccaaatggccaaaattctgcggacgtcgttagaacaattgcatttgaatttacccgggacagcttattttgaccccttcgttgatcgtttaagtgaatggtatcagcaaacacccgctgctaaatacttcgtggcagtggcggatacggaccgagtggttggtggctgcggtgtgggtcccattgcgcctgaacaggggattgctgagttacagaaactttacgtggatcccgactaccggcatcatggaacggctagtcaattattaccggtttgttttgactatgccaaggcccattatcaggcgctgtatttggaaacttttgctgccatgaaacccgcgaatcagctgtatcaaaaagtcggcttcaaaccgttgcctcagccactttctcaatcggaacatagtgcctgcgatacttggtacatgaagtcgctgtaaaatttttgccgaaaaagtaaaatttaacatgcagttttcaccattttccgttatgataatcggtatggaaaatttaaaaagcggggtaatgaaatgatcaagatggtagcagtcgacatggatggcacttttttaaacgacgagcgtaagtatgataagcagttatttttgtcagtattcaaacaaatgaaagctcgtcatattcattttgttgctgctagcggttcacagtatcaacggttacggcatgagtttgctgaagttgctgatcaaatggactacatttcgcagaatggtgctatcgttcacagtggcaacgcacttcagcacatcgaagccattagtgatgaacaggtccatggcgtgattcagctgttaaagaaggcatttaagcctggactgatcgttcaagaagtcgtttctggtttgcacggcacctatgttaatcgcgacctggatccagagattttaaagatcgtgaagtattactatcgaccagtgattggcgttgataatctggctacgattgcgggtaaaaaggtgaaggatcaatttaccaaacttgcaattagtttcgcgccaggcaccaactttgattcagcttcggctaagttggctaaaattttaccggcaaaactcaccaatgaaacgtcaggttttaacacggatctagtgggatctgccaatgctaataaacggtcaggtattcggatcttacaggatcattaccaagttgctgatgatgagttaatgacttttggcgataacgaaaatgacttgagtatgctgactatgacaccgcatagttttgccatgaagaacgctgcggataagattcatcaggcagctgctcacgtgacagaattggataacaatcataacggtgttttggaaactttgaagatggcactttaacagagtaatatagcgaaatacaaacaagtcctttctcgataaaatcgggagaggacttgtttgtgtttaatggttactatgattttgactgactggaatcagacatggaaaaggtactctcgtcgcctagtaaaacggctaagtaatgatgtgcttgttcacgggtggtaggtttttccttcagaaaaatccattcaatcaaaattaaaatggttgcgctgcattgatctacgattagctcaactggaatatcaaatttaaggtctccaaagacctccagaaaaatctggtgtgccaaattacgcagatagttagtaaaactattaaccagactgcccgaaagctgattatgatgcaaaattcctgaaactaactcgctattattttcgaataaatcgtagaggcggtcaaaataggtgatgacaatttcactaggattgagttcttttgcttcgtcaatgcgaactttttcggccagcacgtaccaacaatagttcacaaggtcatatttatcgtcaaaataattatagaaagtcgctcgcggaaaatcacagaactcacagatttcgttgacgttaatttcttcaaagggtttcttggctagcagtcgtaacatggtctgcgagaatgcgcgaagggtgcgctgagcgccacgagtccgctttttagttaaatcgtatttcatgataagcctctaatctttgcattttatctattctgtctaaatttaagcgaaagtccatttttgtttattgaactccctttaagctgactttatcataatgtgtagaggttgtacaagtgtctaagtatagccaatagtctaaaaaaggggaagagattgatgcagcagtttttcaaaaagcacggtttggcattgatcgtgtggatcgtagtagtacttgttgccacgttgactatgccaaatgtgacgcaactcgtcaaaaaacacagttccgttgcattaccatcttcggtccaaagcgaagttgctaaaaccattgaccgtaaatcagaaaataatcgcagtgtgcgttcgctgatcgttgtttttaataagcaggatggtcaacttaacgctcaaaatgatcagcagatcaatcatgctatttcaaatatcaagagcgattcaaatttgaagattcttgatatgaccagtgccagtgataatgcgcaggctaaaaagcagctggcatccaaagatgggacgacccaacttgcgatggtcagtgtctctgaccatgagaaagtgtcgacccaagccaaacaattacgtagtcatctgaaaatccacggtttacgaacttatgtcaccggagccgatttactaaacgatgacttttcaactaccacacaagccggtttgaagaaaacggagattatcgcggcggttttcattttcatagtgctgattttggttttcagatcgatcatcataccgtttatttcattactgacagttggcgtttcctacttggtttctagtggaatcgtcatgaacttagcggataaattcaattttccactttctaatttcacccaaatcttcatggttgtggtgctgtttgggattggaactgattataatattttgctgtataaccgttttaaagaagaactggctaacggtttaggtgcggatgaggcggctacagtcgcccgtaagcatgctggacgaaccattttgtacagtgggtcatccgtctttattggattcttagttctagcactagccaagttttcgttctaccgttctgcagtcggcgtggccgttggggttctggtactgttgccggttttgctgacgttgaacatgttcttcatggcaacgttaggaaaaaccatgttttggccaagcaaggacttaacggcacacggcaagaatccgttttggcactttttgtccaagtcagctctgaatcataccgccattaccgtggtcattatggcagtgattattgcgccactgttactagttggtaatcaaaagctcaactttaacagcgctgacgaactgtctaacagcatcgaatcaaaggcgggctataatctgatcaacaagcattttcctgctggcatgtcaggtccgtcaactttttacattgaaagcagtcattcattgaacaaccagaaggatttggccgcaatcgatgatttaacgaactatctcaaggctgaaccaggggttaaacaagtcagttcagtaacccagccaggaggtaccaaaattaagcaattgtacctgaaagaccagttaggtcaattagttactgggcttaatcaagctaatcaagggttaaccaaagttcaagccggactaaaatcagctgatcagcaactggcagcggctaatagcagtggtaatactgctcagttgaaacaactcacaagcgggacaggtcagctgcagagtggtgcgcaacagcttaatcaaggcattgctgcgtatacagcaggcgttgggcaattgagcaatggtgctagtcaacttagtggcagtactgcggcactgacaagcagcatcggtcagctatccagtggcagtcaacaattaactcaaggactgaatcaaatgcaggcacaaacccgtcagctaccgatgattcaggcgggtaccggtcaattagctgccggttctgctcagctttctaatggtttgggtcaactgaacagtcagacttcgccatttgctagtggcgtcaaccagcttaacagcggtgccagtcagttagctcaacagggtaatgcattgaatgcaggtgcgaaatccgtagctaacggtagcactcaggtcaataccgggggacaacagttggcgactcaagtgggtcagttgcaagccaaaaccaaggcactgcagcaaggcctagtgtccgcaaataccgcacttggaaaaatcagtcagggtacgaccactgccagcagttatctgaagggactgcaaagttcttacgttggcaatgatttctacattcctaagtcaaccttaggcagttcaacctttaagccgtcgctagatgcgtttatgtcaagtaaccgcaagattgccaaaattaccattatcctaaatagtgatccaagcacgaccaaggcggctaatcagattcgcacgatctccagcgacaccaaggctagtttgaaacacggagctttgaaaaacgataaggtagctattggtggcgagtcttcacggaccgctgatctacaaagattgtctaacggtgattttatccggacagtagtcatcatgttgattggaatcgggattgccctgatattcgtgactcggtcattgattcagccgttaacgattattgcaacgttagtaaccacgtacgtgagcgcgttaacgctgacacgattattatcaaaagcgttattggctcaaaatctgctaacgtggaatacgccgttctttagcttcattatgattaccgcactgggtgtggattatagtattttcctgatgatgcggtatcgtgacgatgcagccaaaattccggatgttcgtcgccgaattttgaacgcatcggccattattggaacggtggtcatctcagccgcaattatcttaggtggcacctttgcggcactgataccatctaacgtattgacactgattcaagttgctatgaccgttattattggtctgattatcctcgtgattctgttaccaattaccatgtcggtcatggtcaaatggacttatccatatgtgactgacaagatgtatactaaagcgcattcgaagaatgagtaagtgaaagcaggctgggtcatgaggtcatattggtaagtatttgaattaatcttttagccaaaatacattctaaaatttactttggttcataacacctaaaaacgccatcccgacaagaacgaactgtcggaatggcgtttttaagtgttatattctggaatctaccgagttgagttatacctactattgaaacgtaatatccattggaattgcaccgattaatgattcgtgcacggtgcattttctaacaacttcatttaagaagaactggtggtcagaaggtgacaagttggtttccgcggtgatcttaatcgtcatgtgcgtcactttagaactgccgtcgctatatgtggtagtttcaccactgacatcaactttgaactttttaatggttaaattgtcttctgaattctcaatgtcacgtgctgtcacactcatgcaactaccaacagcgcccaataaatattgaacaggatttggtgcagcgtcggtgcccttggcaactaatggctcatcagccaagtaggtgtggccgccagtttgattcatgacttgtgtacccgctggccttagagttgaatgtacgatgtattttcccattaaaataacctccagatgtcatttaagattattgtatcacaggaaccctaaagacggtgttggttagagttcctgtcagaaaaaaatgactttccccgttgaagaggaaagtcattttttgaaataatatctagcccacgacacgaacttgaacggattgacgcccaaattgcatggcttcggagttagtcattgaaatatctagttgattagggttgctgtaagtaaaagtacccgtatcgttaaccacccggttttcggtatggccgtcttggaacttgatttcaagctgagttcccttaggataacggtctaaagcagcggctacaccggtaccagtaggaatagaagtcccttggccaccagctgcaacttgtggatcataagcggtggcaaccatggttgtccaaccactagtagcagttttagttgctgtttgttttggtttactgttggtgtttgaagtattttccgtcagtggcttgatccgtaaactcttatcagcttttacagctgaaggaagggttaacttttgatttggtaaaatcacagcttttgcggaaccgagtgagttagcgtcaacaatcgccttagtagtggtgttgttgttcttagcgatgctccaaaggctatcgcctgatttaacagtgtattctttagcggaagcagagatagtagcaaaaccgagaccgattaaagtaccgaacatgactaaactacgtgaaactattgattttggtaacataaaatgtatgaccaacctttcgatgttatgcttttaagcatagggattaaattaatgaaactataagttaagaattatttatccttgccacgagtattactataacatactaaatctgcttttcagtaacagaattactacattaaattcgaaaagggtcatgtatttgaaattttgtcatattcacgtaataaactgaaatatgaaagcgccatgtaacataaatgttacggccaattaataaataaattaaaaaatgaggataacagcgcccctgtttttagtataaaagtgggaagctagtgaaataatacgtgaaaataccggtcttctctggattagaaaagatcggtatttttgttaatatcgtgtatgaaatgttaaggaaatgttacaaaagtgctgatgcagccgtttcgtcaacggataagccgttgtatagaaaggggtttcgtgtaaaaagtgagtactcagctgcatgagttttttgccaagatcgcagttggtcaaccgaaattggcagtgggatggttgaatgatcgtggtttaaattcaagacaaagagtagttggtgcgaagcgtaagtgaggttttcactgatcaaatctagataagcttgtgcaagtttttgatttaagccgctcaatgcaactggttttaattcgtttaattgtgtctgaaaggctgaaatttgtgattttgaaagtggatcggtaaggattgcgtcacgcgttgcatcatatagttgtcggtattttgccacttgttcgttcataaaaaagacctccgttttacaaaaaagacagtaaaaaaaccgcaaaagtattttacttttgcttaaagagagtttagaatgattgttgtagataagaataattctaaagaggaaagaaggttgatacacatgaaaaagaagcaaactcttgcgcaacgtattaatatcatgcgtgcagccgtaatgggtgccaacgatggtatcgtgtcagttgccggtatcgttattggtgtcgccggtgctaccaccagcaactttgctatctttatttctggtatttcaggaatgctggccggtacggtgtctatggcgatgggcgaatatgtctcagtcaatacgcaaaaggatgcgcagcggcgagcagtcatgaatcagaagaaagcattggcagataattacgacgacgagttcaatttcgtcaagcaaaagtacgttgatgatggcattacaccagaactcgctgaacaggcgactcatgaaatgatgagtcaggattcattagtgacaaccgtgcgtgaacgttatggctttgacgttggtgaatacacgagcccatatgcagcagcgattgcctcgatgatctcgtttcctattggctccattttaccactcttagcgatcaccatgttaccgtcagcgattagaatttggggtacgtttttggcggtcattatagcgctggcaatcaccggttttagtgctgccaccttgggggatgctaaacgtggcaacggaatggtcagaaacattgtgtctggcgtgttgacgatggtggttacctatgccattggcacgctaattggtcatatttagggaggggctttaaatgagtgaagtactgattaaacaaaaaaagaaaaagcccacccaaacgatggatgaaaagttaaacaccttacgtgcgggtgtgcttggttctaatgatggtatcctcaccgtggttggtgtgctgtttagtgttgccgtagcaacccctaatcaattcactatctttatcgcgggtctgtcagacttgctagcctgtgctttttccatggcgtctggcgaatatgcttcagttagtactcaaaaggatactgaagaatcaacggttcgaacggaaaaacggttactgaagacggactaccaagccgaacttcaagcggtgatcaatcactatactgaccgtggtgtgactgaggaaacggcgactaagattgccaatgaattaatggctaaaaagccgttggaaacggtggttaatgtgaagtatgatctaacgctaaaccactacatgagtccgtggaacgccgcgttttcatctctattttctgcagcagcgggtggtgtttttccactgttagcgatgacattatcaccggtatcgattcaatggccagtcactattttagcggtctgtgtttcggtcggtattaccgggtttcttagcgctaagctaggtaatggtttagtcaaaacagctattattcgtaatattattgtgggcattctcacgatgattattcactatagtgttgggttgatgttgaaataactactattaaaagtaaagaaaaatcacgttcaggtgacttaatctcctggacgtgattttttaatggattatgatttttgattgggcttactataacctggcgctgtaaaacgaggttcagtacgacccgcatcggcttctttgttgattgccaactgtgcaacttggtttaggtagttaaatgggtagtcaaaatttggttggaacagcatatcgacaaatgcgagatcatcaattgtattgttgttttggatggcaactgaaacggcatttgcggattgcgtaatatcgtgcttgctgagcaattgagcacctaaaatgcggcggcttcctttatcgtaaaccagcacaatggtcagtggatcagtagacggcatatagcctggacgccaagtgccatcaaaagtaacactgtcggcatcgataccacgcttgagtgcatgtgtcagcgtcagaccggtagttgctagggcgtggtcgtagagactcaatgcggaactggcctgggtgccaatgtaagggtgagtatgaccgaagatgttgtgtgcgaccaacattccctggcgaatagcaacactggcgagtggtgtatacgctggcgtccccgttggattaaaacggaccatgcagcaatcacccgcagcgtaaatatctggattggatgtttgcagatagcggttggttaaaaacgaaccgtgacgctcaacgtcaacttgactcgataggagagaagtattgggagtgaatccggtgctgaccaacgcaatatcggtcttaaaatcgccttgattggtctcaattgtaatttggtcactagctttagtgctggtaaacgcgctgacttcagtttccaagtgaacagccacatggtgatcttgcagttgttgtactgcccagttagacatggtaccgtctacgtaattattcaatacctgcgaacgggcttgaaataaggatacttgatgtcctgtctcagaaagggcttctgcaaattcaacacccgcatagccagcaccaataatggcgatattatggtactttttagcagctttgtaaattgtttgtgcctgctgatagtttttacacagtaatacccgagtgttatcgataccgtacagagggggtactttaacggatgagccagttgtcataattaatttgtcataagtatcgttaaagacctcgccagtttccatgttggcaacttgaatcgtgtgtgtgttggcgtcgactttaagaacatcatgcttgtcgtgtacggtagcgcccatgtcccgcagttcttgaggtgaagaatagaacatatcttcaagtttcttaaccttaccttcaaggtagagagaaataccacaagataggaaggagaaattatcagtacgttcgtaaattgtgagatcagtttccgggtgattttttaaaatctctgttgctgcgaccgtgccagcatgtgtacaaccaataataatgactttcatacgtacaaaccctcatttcgtatacaaattagtgaatacaatcagaatttttgcgaatcgataaaaaagtatcatataaatgatataatcaagtttgaaattaatgttaggggaggaaatgttcttgtacaggtactttatccagccacaattgaataaatttaccaattcactggttggctacgaaatgttaattcgtaagtacgatgacgaacattggcgcctaccacaaaattttgctgcgattccggtagatgagcaaatcgggttactcaagaagactgcccatcggatcggtttaaaagtcggttcgatttcgtttaacctaaatcggcgtcaattcattgatccacatatggaagaagctttaattgacgttcaacgcgaaatttttccagttaaactgattatagaggttactgaagaagaaagcgaccaacttgttcccgaagataagctgctcgtgagtgctaaacgctacacagcaagtggggtgcaactcagcttagatgatgttggcagtggttgtaacacctatgaacacattaagctcctgctcccatatgctaatgaaattaagtttgcgatgcagaattttcgcaatgcaaacctagaatttaaaattgttgaacagctccgattctggaaaaagattgccaatcagtaccatattaggttggttgttgaaggaactgaaactgctaaggaagatcagttacttgatgatttaaacttaccttatcgtcaaggttacttttatggtaaacctcatcttgtaaaattggaataggttaatttttaaaacaatatggtactctaagagacagttactagcgaagatttgctagtggctgttttgttatataggttaacaattacccaattgataaggataaagtaattaaagtaaatcaaatttcaaaattaggttgatttatcaaacaaactaatttaaaataaaaactgatttatcaagtaatcagtaagaaatggtatatcgagttatacataaacattttctaatacaacgaagggaccttcatcatatgaaaacacctgttagagtgaatagtatgactaagaaacaactgcgccaatttgagtgcaacaacgagaaatgctggttgcatgtcggacttaccacaataacgttgatgacaggatttacactgagcatgataaatgctagtgcgcaatcggcttcggctgatactgtcccagcagcacagacagctacggccaatacggcgagtgattcggtaaacgatacgtcaaagcaggatggcactcaaccaacaagtaacgatacggatactgaaaaaactgaagcggttacagcaagtaagctgtcgacagaaccggctgttacggctagttccgctggggctcaaaagagtgctgaaactcaacagagtagtttaaaagaaacaaaagcaactgcttcagtggcagatacttctaatagttccgcggtttccacagcttcgaagatgacattcaaagcggctagcaaatcaattagtaatgatgcaactgacgaggcagcgactgctaaaggcgcggtcagtaatcttacagataaagacagtcaagccgtacagacggtaacgtcaattgataatgatacctttttgaaaagtcttggcattgatgttgatagtttaaatgcgaatagcgttttgaaattggcgtctttgttccacatttttgctaatgatgccagtctaaacgcggatacaaatggtaatttggcagttggcgttttgcatcactccaatgattttggcacccttgaggaatcggctaatttaactgagggagacatagattatattcagcaattagccgataatttacaaggtaacgcttttaggaatacgacgtttaatcacgttgtctttggtaaagatgtcaaaataaccactgatgaggataatcgggtcttagttaatggcgttcctattgaaaatttaaagccagaagatgtttaccaagatgctgatggaagtacctatattgattttgaaaaagtttttgatgaactgattcaaaattccactcagttctcaagccaatctgattctgcaggggttaaaaaaaacttttccgatcaaaataatcggtatgttgacgtgaccaatgcgacgccaacggataatattatttatgttaatgttccgtttagtgtccttaatgccgctaatcctatttccattaagggaattagtagtgatactaacggaccaaccattgtgattaacgtaactgatattcctgatgggactcaaaatatttcgactcaagttcagctggagtatggcagctctactagtagtttgaataatagtaattcacatagtgagcctaatcatgttttgtggaacctcggaattgaagatcagacctttaactttgttagcggtcggtttatgggtagtattttagcccctgaagctactattcaagctggcgtcaatattgatggcaatattgtagccgataccgtcaatataacaggcggggaaacccatcgatgggatattcaccctaatccgccgacaacaccagggcagccgaccacaccgccggatcaaccaacagttccggatcagccgacaacgccgccagatcaaccaacgataccggaccagccaacaacaccgccggatcaaccgacgataccggaccagccgacaacgccgccggatcaaccaacggttccggaccagccaacaacgccgccggatcaaccgacagttccggaccagccaacaacgccgccggatcaaccaacgataccggatcagccgacgactcccccaagtcaaccgacagttccggatcagccaacaacaccgccggatcaaccgacgataccggaccagccgacaacaccgccggatcagccaacagttccggaccagccaacaacgccggatgagccacaaccagatcaacccacaacgccagatgaaccacaaccggatcaaccaacgacaccagatcagcctgaaccaggtcaggcaataaccactggtgttaatgaatacggcaaagcgcatcggcgacctaacatcgtatattcgatgcaggatagtgaagtagttccggtatcggccaaagtgaataagattcgcacagtttctctcaaaggttcagtgaaggccaaggcaaaggttcctgaaagcaaagagatcttaccgcaattaggtgatagatcagatatttctgtttcggttttgggttacttcttacttgctttgggaagcttgactagctggttaagcttcagaagaaaaagaaaaaattagacacatgaatagttaagttttagtcaggtacccccaaaagatttttaccttttactttggcaaattacaagtttaatccgaacaagcccggaatctttcaatggcagtctgttgatgatgtatttttaatggtcgttgattaattagttcaagtgctgctaggatctcatcagtcgttacttggctaaaattgggtctttttcggggaagaaccagcgtaaccgtctattaaatattcattggcaacctcgctcccatggtgaatatggatggcaaaaataaactttgatctgataatcctgtttttaaggcctgatattggcaaaatctttaccatgatcaaacgtaatggattttacttggggaccgaaggccccataaacttgccaaggcggttgttttagagccttagccggtttctattaggggctttgatggcccatagaagtcggtcttacgttctacgaatgtaaccagacatgatctggactcacttcgactagaaagcaccgtatctacttcccaatgaccaaagctaaccgttgattaacagttgttggccgtttttcgatggaatcccacttgtaaattccacgattttcgctcctcggtgctggcggacattccgttgggtagatcagtcaatttgaaggggagccagccacgattaagccaatataaattgacgcagtgctcaagttataagcggtcgcaatggtttctggtgaccggttaatcgtaagtgattggtaattaagtcgctaatgctgccgccagcaatcgaacgacgaccgcaattccgcttttgcgatctgcatcttgctgagctaattctggatctaaggtttacccggtccaactcatagctaatcgtactttggtgcgacgcctaaggcgtcagccattacttggtaagatttattcccctcattgaccattgtggctagtgcgccacgttgaaaacgtgataaagtagatgtacccaaagtaatcactccctatattggttggaattagctactaccattgtaagtgattgctttgggctttttaatttctgttcggattaattatagaatttgcctttgattaaaatagttactatccattcaagcattcctctccgaatgcataaaaaataaccgagaagatcaaaatgatcagttctcggttatttttgtgcattgatacgcggtctaatcgctgtgttctgcattagcttttataaaagtaaataaatcttaaaaaaagttgattaatcaaataaactaatctaaaataaacattaccttaagaattaatcgtacatagtgaacggtatttaaagaagaaactatcatacataaccggtgcatctattttcttcagtcatctttgatcataatgaagggatatacaatataatggaaaaaactaatcgaaaagatagcaagataagggaacaagtgcgtcgttttgagtgtaatagtggaaaatattggttacacatgggccttaccactgttacgatgatgacaggatttgtgctcagtacaaaggttgctaatgcccagacgagtgttgcttcaacagtgcaaatatctcaggctaagggaaaaaaatcgagtaaaacggctaataacatgtcagaacaagatacaactcagcaaaaaggcgatgaaacggcaggggctagtaatgatgctgaaagcgtaacgtcaacgccgtcagattccagtgacaattctactttgaatcaaaaggatggttcgaatgcgtcagatacgactaatcctgctaataatgtttctgaaatttctgaaacagacgaccaagaaactgaagcaacggtgagtagtcaggtagaaaccagcaaagattcaattgtaaccacagcttcagcggattcagttagtaatacgccaacgccgacaaataatgatgatcaatcagcgatttataatgatgatgctttgaagactaagaatattgatgttaacaagctaactagtaataacgttttgaagttagcttctttattccatatttttgctaatcaagccagtttatcttcggatactcgtggtaacttagccgttggtattttaaatcaagcaaacaactttggaactcgagatcaggcagcaacgaatttaactagtgaagatattgattatatccaacaagtcttaaacggacagcaaataccgactaacgcctttagtgatcccagtggtaatcgagtggtattcggtcaagactttaccataaccaccgattctagcggtagagctgtagtaaatgatcagcggattgatagttcagccaatggtaatgatacggttgacaaagatgctgatggaaaagtttatattgatttcgccaaggtttttagtgaactcattcaaaactcaaatgaattctcagatgaagcgcaatctactggtgtggatgaagaacttaaggatgaaaataatcgctctattaatgtagctaatgcaactgcatctaacggtgttgtctacgttgacttgccgttcgagtatcttagtgatcaacgacagattacgattaaaggcgttagcagcagtaacgatgggccaacaattattatcaacttgaccgatattccgactggggatgccccacaaactgtttcaagtcaagttcatctgcaatatgatcagagtactaataatgtgcaggacaatgacctgcttagtaaacctaaccatgttctatggaacttcggaacaggaaactctgattctagcagtacttctggcacaagcaatgcaacgtttaatattggtaattcgttttatggtagtattcttgcgcctaacgccacgattaatgtcactgctagtagtttttacggcaacattgcggctaatgtggttaacattgcgggtgggacatctcacaggtgggatattcaatcgcaagcgggaaagacggacgtttcgcaagtagaatatggtttgccagatggcattcaagtgaagagtgaagtaccaacgacgaatgttccgcatattgaatataaattgccagatggcattcaagtgaagagcgaagtgccaacaacggatgttccgcatattgaatataagttagcagacggcattcaggtaaagagtgaagtgccaacaacgggtgttccgcatattgaatataagttagcagacggtattcaggtaaaaagcgaagtgccaacgacggatgttccgcatattgaatataaattgccagatggcattcaggtaaagagtgaagtgccaacaacgggtgttccgcatattgaatataaattagcagacggcattcaggtaaagagtgaagtaccaacgacgaatgttccgcatattgaatataaattgccagatggcatccaagtgaagagcgaagtgccaacaacggatgttccgcatattgaatataagttagcagacggcattcaggtaaagagtgaagtgccaacgacggatgttccgcatattgaatataaattgccagatggcattcaagtgaagagtgaagtgccaacaacggatgttccgcatattgaatataagttagcagacggtattcaggtaaaaagcgaagtgccaacaacggatgttccgcatattgaatataagttagcagacggtattcaggtaaagagcgaagtgccaacgacagacgttccgcatattgaatataaattagcagatggcatccaagtgaagggtgaagtgccaacgacagacgttccgcatattgaatataaattagcagacggcattcaggtaaagagtgaagtgccaacaacggatgttccacatattgaatataaattgccagatggcatccaagtgaagagtgaagtgccgacaacggacgttccacacgttgagtataaattgccggagggcatccaagtaaagagtgaagtgccaacgacagacgttccgcatattgaatataaattagcagacggcattcaggtaaagagtgaagtgccaacaacggatgttccacatattgaatataaattgccagatggcatccaagtgaagagtgaagtgccgacaacggacgttccacacgttgagtataaattgccggagggcatccaagtaaagagtgaagtgccgacaacagacgttccgcatattgaatataaattgccagatggcattcaggtaaagagtgaagtgccaacgacagacgttccgcacgttgaatataaattgccagatggcattcaggtaaagagtgaagtgccaacaacgggtgttccgcacgttgagtataaattgccggagggcattcaagtaaaaagtgaagtgccaacaacgggcgttccccatgttgaatacaagttagcggatggtattcaagtttacacaaaagctgtcgtaggtcctagcctatcgtacacgtatgcgcagggtgaagttgccgatggtattgctgcatattttaaagacgcagtatcaacggacgttccttatacgtatgcacaaggtgaagtagctgacggacttgcagtatatacagagggcgaatcaccaagtgtaggtgttccgtataccacattaccagctacaccaggtgacgaggggaatccatcagtgccagaacaacctacgacgccttctcaacctgaagaaagccaagtcattaccactggtgttgacgaagatcagacgccagcagatccccaaccagatcaacaaattcagccgataatacctgatcagccggaatcaaatcaaacaatcactactggtgtcgatgaaggccagacacctgaaattgttaaggcacatcaacagcctaaactgacgtatttaacttctgaaactgcatccgctgagtcacaaacgaatgaaaaaaagggaagcgccacttcagctaaagttaatcaaattcggacaatttcgcttaaggggtcaattaaagcacaaccccaagtgcctgaaagtaaggcagcaactttaccacaatcaagtgatgaaccaggaacgcctatttcagttctgggctacttcatgcttgctgtagaaagtttgattggctggataggttttagtagaagacggtaaaattaaacatctatttaaacatgctactgtaaacacaaaaataaccgagaagatcatgaagttgatcatttctcggttattttttagttactttacttaaatgtttttaactttcccatgaaatttaacgaagtacaagatcgtcataattgccaagaagatgacacctacgatgatggatactcgtgtttcagggttaaagaacatgaagatcaatgtaacgaataagaatgccagtgtaatgtagtttgaccacggtgaaagcggcattttgaacggatgttttgccatagaatccttgtgctgctttctaaattcaagttggctgatcaagataacaatccaaggaatcatccctggcaggacactggagctatataccataacgaaaatattgtcagcatctttaaagaagtatggtgccacaaagtccagcacgacccctaagaaaatcccaaatgaaatggcgatgacggaataaaatggtacgccatgccggttcaattttaagaaacgcttaggcaactgaccattatttgccagagtatatgacatccggctggcactgtagatacctgagttagaaccggacagcgcagcggtaatcacaacgaaattaataatcgaagccgctgcagtaataccaattttagcaaatgtttcaacgaatggtgaaccaacgttgctcaattcgttccaaggataaatacttaaaataacgaaaatagcaccaatatagaagatcaggattctgaagacagttgaccgaatggccttaaccagtgtctgttgtggattttcagcttcaccggctgtgacaccgatcaattcaattccttgataagaagctaacacgattgataatgcaaagataaagcctttaaagccaccggtgaagaagccgtgagtccaaatgttggaaatgccgatcggatgcatgtgattgccaaagccaaagataatcagaccgagtccaacaacaatcattaagacaatggtgacaactttgatcagggcaaaccagaattccagttcaccaaaggctttcactgaaatcaggttagccaagcataggaaggtgatggcaacaacgccgggtatccaagctggcaatccgggccaccagaacttaaagtatccaccaatcgcaatcatttcactcatacccacgatcacaaattggaagatattactccaagcagttaaataaccagccaggggactgatatattcagtggcaaactttgaaaatgatccggtatctggatcaacgtaaagcatttcccctaacgcccgcataatgagatataggaaaatcccagcaatggcataggcaatcaatacagatgggccggtccacttaatggttgacgtggaacccatgaagagtccaacaccaatcgttccacccagcgcaatcatctgcatctgacgcgcacttaattttcgtttcataatttctaatccctttcacataaagataaggttccccttgaaattaaaactaatattcaactttaaaggtaacgtccaccttcgacgtcacaatgtcatggaagatattagctctaccccatcaactattattagttttgtatgagaataatgttacacgaagttgggagtaagtgcaaattaaatcctggtgatgaatataattgcgcaaaatttacttgaaatggtgatatttggttggcgttgataatatatattcagcgtcaatcaaaagaaaccgaaaagttgtagaataggaagaaacaacggataaaggggtacattatgatcgaacaacatcaactatggcgggatttaaactgggtttcagtggatgagcctgatacccatgattttaatcagttgagggatacctaccaaattaagaaaaagtacatcggctatatgcgagatattcgcgagcgagcaagatttgattacgatccggaaacgggttgcagtttgttgatctttcggtcagttaatcagggtgaaaagggttcggatggtggcgaatttttagaaaccgtcccgttttgtatcattattaaggaccaaaatctgatcacggtcactcatcccagaaatacgtacgtcactgattcgctgaaagaagttattgatgatattaagagtgaggaacaaaagccggttgatagcttgatgactattgcctttaaattgatttttaaactgaatgaagattatttagaccgcattgatgatatgaataaggctcgtgaatctttagaaacctttcaaagacggccaagtaataaacagattacccagttatccaacttggataaacggctggtatacttgaagaccgctgcaaataataacgtgattgcaattcgtcaggttcaagtgatgtcggatgcggatgacgatcctttaagtttatcgaatactgaagtgcagcacctaaaggatttgcgggttgaagttgagcagagccgtgaaatggctaatattgcagcggaaattgctgaacaggttgttagcagttacagtaacatcctggataacagtattaacaacacaatgagactgttaacagtctggtcgctggcgttagcgattccgccaatcgtttccggtttctggggacagaacatgccactacctttggctaaggagccttggagttggctgctttcagtggcgatttctgttattccaatcgggttattactgtggtacttaaagaaaaatcacgatatttaatttgattttcccttgacggatgagaaaacagggtatatattaaaaacacgttaacaaatgatgagaaaaagcaaatgcgatgataaggagagtagttattggtaaaggctaagtgagccccgtaaagtgcgaaggggtgtccaaaccaatgatgaaagtagcctttgagcaatggatgcgaaattatgagtgttcatggtgtatccgccttactggatcagcgtatcgtcccgggaccgtacgtgagaggtgtctatctgtaaagatggcataaattaaggtggtacagcgcacaagcgcccttgatcaagtgatgaacttggtcgagggcgctttttcttgttaaataaaaaattggagtgtgattttaatgaaattcgcaatgatcggtgcaggtgcaatgggtttacgttatgggattttattacaagaggctggtaatgatgttacgtttattgatacttggcagccaaatattgataagatccgcgaacaaggtggtgcatacgtttctcgtgaccataaagatcgccatcttgttcctataaaattggaaacgcctgaaagctaccacggcgatcccgacattctgattttcttcacgaagcaaatgcaacttgcagattttctgaaacgttgcgaacacttctttaacgatcgccaatatgcctttacctgcatgaatgggatgggtcatattgaaaaacttcagcagtacttcgcagatgataagatcattgctggtaccgcactgattgcgactgttcttaatggccctggcgacgttgacttcatgggtaagcgtggtgccggtaagatgaacatggcaaacctaaccgagaagcctgatgagatgactcaccgactctttgatgaactcgaaaaagctcagatgcacccaacgttgaccaccaacttcaagggtaccttgatgactaaagttattttcaactcagttatcaacacactgtgcaccatgtttgaaattccaatgggtgagcttggtaactttgaaaaagcctatgaccttggtcgtcagctgattgatgaagcttatgatatttgtgaacgtgatgggatcacactggtttcaagtcgtgaagaagaaatgcatgcgctggacattaacacccggatcgacatgccattgcattacccatccatgtatcaagatatgattcatgatcggccaactgaagttgattatattaatggctatattgctaaactgggtcgtgaacataactatgaagctaaaacccatatcttcctaactaacttggttcacttggccgaatatcaccgggcaaatgagaagaaagcgcgtgatgctgctaaagcagaagcgatgcaagctaaaaccactcaaagtgcatagattccaagcggatgaatcgtataaacgtcagccatccgctgaagcgtttcaaacaaaatctgtttttgtttgagcgtgccggagatttcgatgtaaaaagagtagatgccgatcttttgtcgggttggcatggacatgatagtcactaggtttaaatgagttttcgcaaaataggataaaatctggtaaagaaccccaacttcttcagttggcggtgtaataaaaagtgcagatttgaatgaggcagtttcatcttcggccggctgtgttgggctttccaacattgccggctgttttttgaagataatgaaacgggtgttattatccgtttggtcggcaacgttcgccagtttgaacggaaaatctgtctcttcaagctgagactgcggcatgatggcagcgtcacctagttgaccatctcgtaatttttcaacggagatcatgttgctagaagtggtgatgatctgtgcgtttggtaattgtgccagtaatttttggcattggccctcagttttgaattggacgtaaatccgcttaatttcgcttaaatggttaactttacccgctaggccaaagttaactgggacggtcacttcaccaatttcggtaatatcagcaacttgcaagcgctgcaacgttgccagcacgaagccatccagttggttttctaatggtaacaagcccaaaccatctggggtaacagcctggtaaacctgatcaaaggtatcgtgataatcaagttcaatattatcgatggggtgtaagctgagatatttttgggcagctgcatcagcaaaagtgccagccggaccaagcacagagaatttcattttggagcctccgaagtctttttctttgattatagcttaaagtgatggtaaaacgaataaagattgtgtgcaacttaattgtgatttggcctcatatatgcgaaaatgaaggcatagaaaaagggggaattgcgaaatgactactcttcaaatgagccaggctgttcaagaacgactcaagaagcatatgggtgatagcgaccagttgattttagattttgatgacggcgttggtgcttactctaaggtgggcgtttgctcgctggacgtcagttttcggtttttagtggttaacccacaaaacgttgatgctatttacgataagtcgattactagtcctttgggtcccgtactgattaaaggttatgcagataactacttaaatgaagcaccggaacttaatatgaataagtttggcctcatcacccttaagacagcggctggtatcattgatactaatgttgaaattttagatcatccagagattgttgagacggcaaaataaacagtgttcaaataacaaaaacgtgttcaaacaagcaaagagttgcaaataaggcacagccaacagaaatccaagaccgggattcccgttggctgtgccttattctccactctttaaacgcttgttttcacactctaaacatttaacactttatccaagaagttctgcaatctcggatcctttggatgattgaagatttcatcaggtgtgccttgttcttgaatattgccatcatcaacgaagacaacgcgatcagccacttctttagcgaagcccatttcgtgcgtcacaacgatcatggtcataccttgagtagcaagttgtttcataacacccaaaacgtcaccgaccatttcggggtccagagcggatgttggttcgtcaaatagcatgacgtttggattcatcgctaaggcacgggcaatggcgacacgttgttgctgcccacctgagagggattgaacggtagcatcgtatttagattccaaaccaactcttgccaatagttccttagcttgtttggcagcttcttccttagtcgcttttcccagttcaacgggtgctagcatgatgttttcgctgacggataaattgctgaataagttaaagtgttggaacaccatcccgatattttcacggactttgttaatatccgtttttggatctgcgatatccgtgtcatcaatgacgatggaaccactagttggtgcttctaatcggttcaaatttcttaagaaggtacttttcccagaaccagaagggccgatgaccacaaccacttcgttatcgtgaacttccagattaataccttttagaacttggttatcaccgaagtttttaattaaattggtgacttttactttgattttttcgttcatagccgcactctcctttgtacccagttagatagccacgttaatagggtaatgacgatgaggtaaataatggcgacaatcgcccatactttgaacccttcaaggttacgggcaatgatgatcttcccagtttgggtcaattcaatgatgccaatgatcgataggattgaagtatccttcaacgtgatgatgaattggttaataaatgaaggtatcatgatccggatgccttgaggaaggataacacgccgcatggctttaccaaacggcagtcctaagcttcgtgctgcttccatttgcccatcatcaacggcattgataccccctttaacaaaggcggcgatataggcaccttcgttgaacatcaaggtaatgataccagctataaaggcgggaatcttttgaccagtcaaacttggaatcccagtataaatgaagagggctaaaactagtagtggtaatccacggaaaatgtaaattaaagtagttgaaatgccgttgcagaatttacttggtacgacacccagtaaaccaacgatgacaccgaacaacgttgcgaagaagatggcaacaatggttaaccaaacggtttgttcaaacccacttaacagtgcgcctttattttgtttgattaaaccaagaaaggttcgatcagaagttgtgtcggaactgcccttagcaccaaggtaatgtctagtgattcgagcgtattcgccgttagcctttaaatcagctaggccattgttaaacattcgtggaagcttttggttgtgtcctttcttaacagcaaaaccataaggaccgctcaacgctggcttagtgtagattttcagcttagtcccttgccgaatggcatatttcataaccggtgaatcttcgaaggtagctgctgaattaccggttaaaacatcctgatacatatcgttggattcatcaaaggtcacaattttaaaaccgtactttttatgaatgctctgtgcgtattgcgcgccagaagtccccgttttaacggcgactcgcttaccacgtaattgttttaagctggtaaccttaccgtttggtttggctgccatgacaacaccggacatgaagtaagcctttgaaaaatcgaaagttgcttcacgttctttggtaattgacatacccgcaatcacaccatccatctggcctgactgaacactttgcacggcggcattaaagctggttggcttgatgttgactttaaagccttgatccttagcgatagcgtgcagtaagtcaatatcaataccaacgtatttgttatgactattggcaaattcaaatggtgggaaagtagaatcagttgctatctgataggtggtttctgcttttgcgggtgtggtactaaagttcagcaccgcaaacagagagagtaaggcgattaaaccaccaacgattcttataaagctacgtttcatattattcctcctcaagttatgtaataaaatctaacatctgattatgagaatatcatagcgctaaaataagagaatgttaatagtttttctgaaaataaattgaacattttgaaaaataattcatttttgacattgactcattcaaaaatagtttgactgtaaacgttgatttaaaagcgtttgtttactgagcaacgtttactaggatatccttaatatctataaatattcttctttgcacatttattcactaaattaatttagatatttatgaaacgagtttcttattttcatctagattatctaatcattatctaatattgcttccaatgatacagctacttaagttattttttctaacatataaagtatgattgctattttttgatactcaccagaaacgctcaataaaacactaattcacctgagtttgcaaccgtatcttaattgtgctttaattaatttttaataggacttttattcggtccgaatatttaaaacaaaacactacatatgagttgatgaggaggaatttggtttgaagtttgaagaatccaaagtattgcaacatttacccaaacaattttttgcgaatttagtcgctaaggttaatgccaaagcagcatctggtgctgacgtgattaatctggggcaaggtaacccagatcagcccacacctgagttcattgtgaaggcgatgcaggaagcaacggctgatccagaagaccataagtattccttatttcgtggaatgcctcggttaaagcaggcggctgctgacttctataaacgcgagtacggcgtcgatcttgaccctgaaaaagaagttgcgattcttggtggttctaagattgggttagttgaattaccctttgcgttgttaaaccctggtgatacgatgctgttgccagatccaggttatcctgactacctttcaggtgtggctttggcacaagttaaacttgaattaatgtcgttatcgcctgaaaagcagtacttgccggattatcagcagctagatcctaaagtggttgagcaggctaaattgatgtatctcaactatcctaataacccaactggagctgtggccacacctgagttctatgaggataccgtgaagtttgctaaagaacatcacattggtgtcgttcaagactttgcgtatggcgcaattggctttgatggtaaacggccagtcagttttttgcagacgccaggcgccaaagaagtcggtattgaaacttacacgttatctaagtcgtataacatggcgggttggcgtgttggttttgcggtggggaacccagacatgattgaagccatcaacttgattcaagatcatctctttgtctctcttttcccagcgattcaagatgctgcggtagcggcgttagacagtgatcagtcgtcagtgaaatcattggttgcactttatcaaaagcgtcgtgatgacttttatgctgctgctcgtaaaattggctgggaaccatatccatcaggtggtgccttctacgcttggatgccggtgccaaaagggtacacaagcgaagaattcgcggatctgctgttagataaagcagcggtggcagtagcaccaggtaccggctttggtaagagcggtgaaggatttgttcgtgtgggcttactgattgatgagccgaagttcacggaagcttgcgaacgaatcgggaaattaaatctgttttagtgaatagcaactgagtttttcgttctagcatacaaataagcgtcatcctgacaaatatcagggtggcgcttatttgcatattgaatggtgggatattttgaaccacaaaaaaaacggtgcctctggccatcattgccagcacagcatcgttttttaatccccaataattagtttcgataaacttttctataatactcccctataatagaaggttttttcaaatgattaacggtctacatgtagtagaacagcgcccatacccttatcaaaggtggctttccagtcacccttagtcagtgattctggtagtaggaaggttccgcttgaaacccgttggcctgccttcattggcatcccttgttcgtctagtttcttaactagccattgtagtgagttaagtgggttacctagaacttctgaagcttgaccatctttaagcttcttgccatcgtggaagagttcacaggtgacgttagcgagatcgtctggtttgtcaaagagtttgtccgtgtcgttttcttcgccgaataccacatagccaccaacagctgcgtcagccatgaccatgtacttagataggcttgggaaccagtcgctgaaccgtgaatctgggacttctacagctggcgctacagttgttttatggaaaagatcttcaagtgaatcgttcgctgaaagatcttctttagccgtgaacatcatttcaacttctgccaatggatccataacttcgtcggctttaacattgtgaggtgactttacgaagtgactcttaacttgagccccgtatagtggactgtctgaatcaaacatgtcttgagtttgcttactagttagtgaaaccttgtaaccgccaacttcttcttttttgtcttctgtaagtcgacgttgtacgcgataggcagcgtcttcgctgtctgcgtatccagtgtagtcagcttcttttagtggcttacggctggtgtatgcatcaaataaatcctgtgctaatttagcttctttttctgataatgattgtttgcttaatacttgttcactcatgggcgagacctccaaaatttatgtttaatatgtgatagataaaaactatgtgctgatatgatatgtgatggtgctatatgctgacacgatatgttgtgaaactatgtgtaacctgatgcttcaatatgtgttgagaaatctaataaaacttatgtgtgacccgccctaattcggtgggttcaatgagaaattgcacttcattcgcgcttaaaaaacggttaatatgtgtaatctgaatgtcgctatcatctgagctcttaatgccaacttccaattgtcctcaccacctttaatgtctgtttttttaaatttagaaaacgaaaagcgtcctcgatcgcaatctggttgcgattaaggacgctttcacgtggtaccaccttagtttataacttcattactgaaattacctctcacgtacagcattaactgcgatacgtttggcacgataatgggtgcacccaatgtgttctactacggtctagccggttcggcacacagctcggagatgatcatcgcgtccattcgtcattgccttgcaccagccggcaactctctatatccgaaatggagttgatgtttctcgtcaacgcctttcatctaaatttaatgattggtatcaatctacacccaggattgaaccatgtcaacactaaaatgtgaaaaagatgagagataaacgtgaaagcccatgagtctctaatgattgagacgacaagaaaaatttaagaaaatctggataagcgtttgataaacacgtattggacagtatggtatactttgtacacattcagaataactactgttaatgaactaactaataaataaagcggggataaaactgtgaaactatcaaaatttctttttgtgacaacgattgggttagcagcaggtttactagccctttactatagacgagataagacggttcaagcaccagctaaaaagccgaacaccaaaatatttgacgacttttctgccattgatttaggtgaatttactgatcacttaactctagctgcggctgataagacggctttggtacttgaacaaagtgagagcgagtacgttaatgagggaagtttaaccacgccggtatttgatttacctcaatttaaaaacttggttgcctcttggaacgccttaacgccggaaggaaccgcggttcaagtcgaagctcggattaatcagggtgagcgctggtcagcttggcatagttggggtcgctggtcgaccaaggtgttaagcgccagtgtcaaacaggatagggaagattcccttgccggtatcgatacggatacgttaacggttaaaaatggcgttggaactaaggcacagttacgggttcatttgtactctgaaaatccgcagcagacaccagtgcttaaattggtggcggccagtgtgatgccggttcaccatgatttaatggttgatgaacatgcagtatcaatcgataaggtgattgcgacaccagcgtattcccaagagattcgggatcctaaactggcaccaggtatctgcagtccaaccacgatttccatggcccttaaccgccaaaatgctgatattttgcctgaagaattagcgttgcataatttagatgtcacatatgatggctttggtaactggtcgttcagtaccgcggcggcgggtagcatgggttaccgggcgtacactgcttataccagtcttgatggacttcgtcggcaaatttcagcgggttatccggttggcgtcagtgtacagtacaccaacgatccggataacggtgagttaccttatgttgagaacgctattggcagcacatacggtcacttattactggtcacgggctttacccaattgaacggtgtggactacgttgccgttaacgattcttttgcggacagtaatgaagatgccaaacgactttatcggcttgaacagtttagtgaggcctggcattcacgagtggcgtacatcattggtggtaactatcacggttacgaacgcttaatgcagcctagccgagagtcggttaagcttgttgctaatgatgagcggaccgcttttacactacgtcaggatggtgaaacagttgccattacaccgaaaatggttgaacaggctgatccgtttgaccaacagacagtgacgattgcttataccgttgatgacggcgggcagtttgataccaccgcacagcagcattttgattatgctgatgcggatgaagaagggcgaatcaagctggatttagcagcgattaagcaggcacatcccagcgcaactaccgtaacggtttatgtaatcagaatggtggcaccgacgttagtaggaactgtttcattggcggattcacatgactgagtttcgtcctgcactggtaagtaactatacacacgctaaacgaccagttgatgtaagaatacattacatcgtgattcacgccactgaattaagttattcagacacgattgctcgttttcaaagcgccaaccaggttagtgcgcacgttgtaattcgccaagcggatggtcatcgcactgaaatggtggcaccggaaaacgtggcttggcatgcgggcaactgggatatgaactgtcggtcgcttggaattgagcaagaagcgtacattgaggatccagcaacctacaccgaaacaatgatgaatgcattagccgaccagattcaggagtggtcggcgtgctaccatgttccgttagaccgtgcccatcttcttggacatgataacgttgctgcacctactcgcgaaaaagcggttgagatgcaccatgatcccggctggtattttgattgggaaaacttgtttcaacgacttggcattaatccggcaactgttcagcctgtaaaagtcgatcaaggaatcaggattaccagcaactatgtggatttataccagcagcccacgcttaaaagcaaagtgattggcaacaaaacagacccttcttcatatcgagcaagttatggtgaggagtttgtttgtattgcccagcaaggtgattggattgctatttattttagtggtcaaaaagcctggttaaagcaatcttacgtcgctggtgtgcagcaaccgattttaaagattggggatgaatcggtagcattatacggttcgacccagcctggtgcaccagcgatcggtgagttattacccggagagcaatacgtgatttcggatcaggtaacggggttaaaaagcagcgatgcgatgggacgtttggtcaccgagaataccaacgatgtgttccagcagatctggtataaccatcggattggctatgtaaaggcaaatcaaaaataattttttgatttgtgagccttgtactggcgcggtttttaatcactttaaattaaaactaaatgtaaatatcatttgacttttatggcaaagagaaataaattggaaatcgttgaaagcagttaacgcaaattaaataacaaacgtgatgacaagaaacatcataaccgtgatcaaactagagagtcttcagtaggtggaatggagacatgagtgtggctatgactatcatcttcgagcggccggggccaagttaaaactgagtccaggctgggaggcgcccattaaagcgccggtctatcgctatttgtatagccgtagattgagaggcttagcgtgtgaacgttgagcaatgataggtggtaccgcggaaacgccctatggagattagttctctgtagggcgtttttgttatttaatgcgtcttaacaaataatatttattgaggtgatttggatgcagcaagggagtcgaattgtaacgttggataatgggtttcatttgttcacccgcacagtaggtcaggggaatgttaatctgctgtgtgtgcatggtgggccaggtggcactcacgaggagtttgaggattttgccgaccatcttaaagcgcaccatgtgagagtttccatgtatgatcagttggggtcgttttattcagaccagcctgactatacgcagcctgagaatcgaaaatacctgacgattgattattatttgtcagagttagaggaggtcagaaaaaagcttgggttggatcaattttacttgttaggtcattcgtggggtggcttattagcacaggagtacgcgcttcattatccggaacacttaaagggtttggtcattatgagtatgatcgataacctagatgaatacatagttaacgtgaatcgcgaacgtgaagaaacactgacaccaaggcaagttcggtacatgaaggaagttgaaacggacaagcgctttgatgacccaaagtaccgtgaattagttgatgttttgaaccggaattttgctatgcgtcatcctgaaaatggttttcgtcacaacgttgagacaatggcgacaccagtttataactatttccaaggtgacaatgaatttgtgatggttggcaagctgaccgagtgggatcgccgagcggatacacataagattaaaacacccacattacttacgtttggtgatcacgatactatgccgttagatgcagcagaacggatgcaccgggaaatgcagaattcacggttagtttatacaccggatgctgggcattgccacagcaccgacaatcccaaagccttttttcacacattaggagaatttctggatgacgtggaaacacataaatttaaagtagtacaagaagcagggggacatacatatgcggaaaaataaagttttattaggcagtttagcgttagcgttatcagtgactttggcagcttgctccagtgcagccggcaaggccggagacagcagtgcaagtagcagtaccgataaaatttcattgatgcaaaataccgacttggtgtcgttggataattcaaattatgctgacctcaccatgtggaacgttttggaaaatagttttgaaggtttgtaccgtcaggatagcaacaataaagtggcgcctgggattgcagaatcggtggttaagccaactaacgacggcaaaacttacaccttccatctgcgaccaaacgccaagtggagtaacggtgatgatgtcacagctgaagatttcgttaagtcttggcaacggtcagtatctgacaagtcgaagtccggctacaactacatcttctctggtatccagaatgctgatcaaatcagtaatggtaagatgtcgccgactaagttaggtgctaaagcggtgaattcccatacactacaggtaaacttggaacacccaatgccttacttcagcaagatgatgattttgcctgccttcttcccacaagattcaaaagtcgttcagaagtatggcagtaagtacggtaccaattctgaccgtgtagtttccgatggccccttcaaggtaactggctggactggaaccaacgataattggaagctgttacgtaacccgaactactatgatcccaaggcagttcatctaaaagaaatcgacatgcaattggttaaggatgctaacacagcacacaacttgtttgctaaagggcaactggatgatgccacaatcactggggttactgctcaaggtatgcaaaaggataaggatctgcaacacgttcaaaaagccggtacttattatctacgtttgaacaacaaggccggcaaaccgtttaacaatcagaagctccgtcaggccgtttccttggctgttgaccggaaccatttgacgaaggacgttttggcggatggctcaaagcctgcttatacttacgttgcaagaggtttagcaactgatccaacaacgggtaaggattttgcaactgaaatgacaccaaaggaaacgtataacgttgctaaggctaaagaactctggaagcaaggtttacaggaagctcatttaaagggcacggttaatttgacccttgttggccttgacgatacttcggataagaacgtttctcagtatgtgcagggaacgttgaagcaaaacttaggcaacgtcaaggtcagcaccgaaaacttaccttcgaaagctgctaacggtaaggaaacagctggttcatttgattttgatcaaacgttgtggttggctgactttggggatccagaaaacttcttctcaatcttgacgaaggataatccgcaaaattacgcgcactatcaagatccgcagttcaacgcagccatgaaggacgctacaacttccaatgctgctaacgaaggggcttactggaaggatatgagaaccgcccaaagtcgtttgaacgaaaacatgccagtggtacctttgtactcaatggttgaaagtcacttggtcaatcctaagttaaagggtattgaatatcacccagttggtgagaatgattacacgagagcttacttagagaaatagaaatataagaaaatggtaactatctgtagcgatagttgccatttttatgttattagtaaatttatgcagaaaataaaccccttgaattaagggttgtaagggattacattcacgaattatacattcatattctgcatatatacagtaagaatgccggaaactaaacaattacacggattttactagttttcataaatattaattgtttaagattgaagaattttcatattttccccataaattattaactttactcaggtaaactaaacctatacaaagaagagtgaatgcatatgatatacattcaccccaagaaatgagggaaatcctatggcatcacaagctcacaaaatcaacggtgtttcacttactgccatggttgtaacgacagcgattggctccggtatttttgcattgagcagtgatcttgctgtcgctgcatccccaggggcagcgatgatatcctgggcgatcgttgggttcggaattttaatgttagcgtcctgtttaaataatttattgaataaacgttctgacttagaaggtattttttcgtatggtaaagcgggttttggctctttcgttgggtttatcagcggatggggctactggatgtcggcctggttaggcaacgtggcgtttgctactgtatttatgagtacgttagggtactttttccccgtctttcagcgaggtaatagtcccatatcgattttggtagccagtgtacttgcttggtcactgacacttttggttaatcatgggattgaaagtgcggctttgatgaacaccatcataacggtctgcaaattaattcccatcttaacgtttatcattgtggcgattattctgtttaatggtcacattttcacggctcagttttggggtaacttcagaggaacctttactcttggtgctattgccccgcaaattcgtagtagtttaatgattatgatgtgggtctttgttgggattgaaggagcaaccgtgttagcttctcgggctaaaagtcgtaaaattgcgggtcggtcgacgttaatcggtgtgagttgcttactgctgatttacgttttggcatcaatcctgccgtatggttatctttcccgtgcagagttagtcaccatgaagcagcccgctatggtctatatttttgaagaaatggttggccagtggggcggtagttttatcagtattggtctcttgatttcgattctaggcgcttggctgtcttggaccatgttaccagccgaaactctaggcatgatggcggaacagggattactgcccaagcggtttgctaaaaagaataagcatggcgtgcctaccttggccctgatgaccaccgcctgcatggtgcaagggttcatgattatcctcatttttgctgagaaggcctatgagtttgcgtacagtttgtgtactgcttcaatcgtggtgtgctacattatcgtggcggcatatcaggtcaagtattcttggcagaaccgcagtaccaagggtaaccggctgcagatgtggatcggtatcgctgcactcacatttcagttggtggggatcaccttgtctggcctgcagtatctgtttatctgcttagtggtttatgtgccgggaataattctctacgccttaactttgaaaactaatactgggcactacttgaaccggttggagtggtcagcatcgattttgattttcagtggtgcggtgattaccgttgccatgatgttaatgggcagactttcactgtaagcttaatatctatccactctgttaattcagatagtctttaaataaatgaaataaaaataaattgtttggttaacctaaataatgcttgttttctagtccatgaatgttatagttaattcagagaaacagaattactcgtggcaatagactaggagggcattatgctgacagaagacgattttgaagcagaagaaatgagttatcaacggctgttattggctgtggacgatgacgatgatgagtcatcgcgtaaggcgtttaactatgcctgcacgttggcccggacgtttgatatcaccctgggaattgtgtcggtgatggagacaggtgacatgaacatttatcaatcattgtcaccagacattattaagtcgcgtagagatgatatttatcatgatctaaatacgtacgtgggcaaagcaagagcgtttggcgtaagggaagtcaaaccattgatcggtgaagggaaaccggagcgggtcattttggaggaaattattccggacttcaagccagatttggttctgttggggtcgcataggcggcggggtcatttaagaattggccatgtggcaggtgcgattatgagagaagcagaagtgtcgacgattattgtaaaatagagtgcggaagcaaggcgtttagatagcggagtgtaagtcaagcccctcataaatccatgggtctgggatttgtgaggggcttgacttacatgcagctgtctgccttgctgtagcacgttttggcaatgtaaaaataaagagccataaatccatgggtcttggatttgtgaggggcttgacttacatgcagctgtctgccttgctgtagcacgttttggcaatctaaaagtaacgagccgtaaatccatgggtctgggatttgtgaggggcgtggcttacgtgcaagtctctgatttcttaactgaaatacaatttaaaatttactttagttcaatactttaatctagcctaaaatggctccacaactcagattccggccatttaacaccaaaaatacgcatcccgacaaaattcgtcggaatgcgtatttttgtgttaaattctggaatctaccgagttatgtcacactctctcgcatttcacttaacgttagtattttcaatacgcgccaacagcttctggttatcattcattcgagcgaaggctttagcatcattcaacagatcagtgatcgtatcactatccttgccctcagcaatggcgttttgagcacgacggaaacagatgcgtgctgaataataagtgacgtgattattcgcgcaaatttcatagccatactgtaataatgaatcactggttttgtagtctttgacgtgggcaaaatactcagcggtataaaagaccatgttcagcgcacgccaaatggctttattatcggtcaacggcagggtgtgtaacccttcaaagaccttctgaaagtaaaattcacttttctgattctcattattatgtccgtaggcgataccacttccagtataagccagttgagtaaaaatcgtactatggctatcatccaaatcgttaagaatcaagttgaagtagtacagggtatcagcaattggtttttccagtaacgctgataaatagcctttcacaaagtaatactgcatctgaccatgaagtgacagattttcaaaatcaacctgatcgaggtcatcgttagcactatcgtattcactcgtaatcagtttatattcagcttgatccagtagctggttagcttctgactgagccggcggattaactggaaaaacgtcatcaagtgttaaatttaaacgggcacagagctgcgtcaagatgcgaatcgcaggtgccttaccggaattttcaaatttacttagcgtcgcttgcgtacaaatgccatcacagagttcagcctgtgatagatccatcgctttacgcgctttgataaagcgttcaatattcatgattgatcatctcatatctagtatttgaattatattataacagattattatatgactgtcgtttggtcataaatcgagtttagaaatgaaacttttattgtaaacgctaacaattattaaaaagaaaattaagccgaatctgttcatctatttttagtgcttattattcaaaaataaatgtatattagcattaaaaatgtagataatatacataatttaggctttttttgataaattcaataaaaaatattgcatttttcaaatgatgcgcctatagtaagacgcatacgaaataacaacaaaaaattttgtgaggtgaaaccaatggacgttgcgatagtaggcgttaccggctacagcggcacagtgctttacacgttgctcgctaagcacccggcaatcgaccaaattaatttatatggacatcaagatgaagggaaagatggtgaggtccgctatctcgatgaattgattccgggttttcatggacaacacatcaagattcaaaagtttgatccgcaaaagatcatggcggacaatgcagcggtcttctttgcaacttccgctggggtttcaagtcaactcgctagtgactttatcgatactgattttccagtcattgatttgtctggcgattatcgtttaccagatccggcagagtatgagaagtggtatcacaaaccagctgcatcagctgaacatttgcaaaaagcaacttacagtctagctgatttttatcaatcggggaccaattacattgctaacccaggctgttacgcaaccgcaacgctcctaggtttagctcccatggttcaaagtgatttgattgatccagataccatcgtggtggatgccaaatcaggcacatccggtgctggcaagaagctaacagcaatcacccacttcacggcgactaacgataacttgcagctttatggattgaacacccacaaacacattccagaaatcgtcgctcaactcaaaaagtggaacggatccgttaacgcgattcagttcagtaccacgctgttaccacttaccacaggtttgatggcaagtatctatgccaaagttaaaccgggtgttgatcaggaaaaactgatggcggctttcaaccaagattacgcagattcgaattttgttcacgtcttggacggaacaacaccggatctaaaagaagtcgttggcacaaacaactgtgatatcggtgttgtctacaatccgattactcagaccgtaatggtgatcagcgttattgataatttaatgaagggtgccgctggtcaggcggttcaaaacttcaatcacttgtttaatttaactgaaacgacagggctgccaaccttaccagcctttgtttaaaaccaaaattgagaatgagaaagaagaacgcgtatgataaaaaccgatgaagtgactttaacaaatttccagtggcccacaggatactataacgatggcattgagatggggcttggtgtgagtgacaaactagactttggctaccttgtttctgaagtaccagccagtgctgccggtacatacaccaccaataaatttcaggcggcaccaaccaaactcaccaagaatacgattaaccaagatcatcaactgcaagccgttgttatgaatagcgcctgtgctaactcgtgtacgggtaagcaaggtgaacagaatgctctgactgaacagaaattgatgagcgaaaaattaggcatcgatttaaacttagtcggtgtggcttccacgggattaattggcgcccaattaccaatggataaggtaacggcgggaattgaaaaattaagcccgcatcacgatgacaacgtgacaaaggctgttatgaccactgacaaaaagcctaagcaggcctgcgttcaaattaaaatgggtggcaaaacggtcactatcaccggtttcgcaaaagggtcaggaatgattcatcctaagatggcaacgatgctgggctttgtgacaaccgatgctggtatcgatggtgaactcctgcaacagaccttaagtcaaaacgttgacacgacgtttaatcaaatcactgttgatggcgacacttctaccaacgacatggttgtggtcatggcgaacggtatggctggcgcacctaagttggccagtaccgatgatgctgacttttcaattttccaagctggcctgcatttggttttgcaagaattagccaagcagattgctgcagacggtgaaggtgccactaagctggtggaatgcaacgttgagggtgctttcaatgaccttgaaggccaggaagtcgccaaggcaatcgttggttccaatctggtaaaggccgctatctttgggcaagatcctaactggggccggatcatctctaccattgggatgaccaacgcccacgtggatatcgaacacgtggatattgaagtcaacggtattaaaatggttgaagatagtttgggtttaccctttgaccagcaggcagcaagtgatagtatgggggctaacaaagtcgttattgacgttaacttacacgttggttcagcttcaggccaagcttggggttgtgatttaacttataattacgtcaaaatcaatgccagttatcatacttaaaagggagtgcgaatcgtgaatcttatcattgttaaaattggcggcaacgccatttcaaaactgaacagcgacttcttcgagcagttgcgtcaatggcgtcaagccggtaaaaaagtgttattgattcacggtggcggtccgcaaatctctaagttgtcagcgaaattgaatattcccaccgttaagaaaaacggtatccgggttacggatgaagaaactttatcgctaacaaaaatggtgttgttaggcaatacccaacccgcattattgatgcggttggctcacgaaggcttggctgcgattggtttgaatgcttctgaccagcaattactgacgggaacgtatgtcgatcaagctaaatacggtgcggtaggcagcattactggcgtaaatgaactggccctttctaagattctgagtggtcaaatcggtgtcttagcaccgcttgccctcactcgagatggcgaatggctgaacgtgaacgctgatacggcggctgcggatgttgcgcgggttttaaaagccagccagctttatttgctgacggacgttcccggcgttttaaaaaatggtaaagtcatttctgcgatgattccgcaagacctaccacaactaattgaagacaaagtgattacagatgggatgcaaccgaaactctcagcagcggttgaagccgttcatgctggggttcacgcggtatgcatcacggatcaattaacccatcctggaacaactttaaaaatggaggtaaccgattgaaatgagtatgacacacgtatttccaacttatgaccggttttcgtttgaaccgatttctggcaatggcgtcgttattacagatgatcagggccaagactacttagatttcacttcaggtatcggcgtttgcaactttggctatcaaaacactaagattcaaaacgctgtgaacgtgcaacttactaaaatatggcatatttctaacctctatcaaaaccacttgcaagaagccgttgctgaactcttagttggcgacgaagataagttagtcttctttgctaattctggtacggaggccaatgaagctgccctaaagctggctcgtaaagcaacggggaaatcaaagatactgtcattcaaccattcatttcatggtcggacgtatggttcaatgtctatgactggcaatgaccacattaaagaagggtttgcgccattggtcccagacattagttttgcggactacaacgacatgagttctttggatgccattacggatgatttagctgcagtgattcttgaagtgattcaaggtgaaggtggcgtcatcgttggtgaccaagattggttgcacgcggttcaggataaatgccagaaaacgaacactttattcattgtggatgaagtgcaaactggtgtcggccggactggctacaagtttgcctatcaaggggttggcttggatcccgatattgtgacttcggctaaagccttggctaacgggttgcccgtgggtgccatgattggtaaagctaaactgggatcagcttttggtccaggtactcacggttcaacctttgccggcaacccgctaacaatggccgctgcacaagctgttttgactcaactaacgccagcttttttggaaaaagttcaggataaagcaggtgctgtttgggctgaactggaccgctttgataacttaaaagtcgttaaatcagtcagtggtcgaggtttgatgattggcattcatttgacggatgatctagctgtcaacgacgttattaaagcgctacacaaaaaaggactgctgacactttcagcagtcggtaacacgttacgtttgttaccaccattagtgatgagtaagaatgatttgttgagtggtctgcatacgatttatcagacacttgaagagaaataaatcaaacaaaataagcctgctttttcagccattgacggcgaaatagcaggcttattttatttggtttaaaaagagttaatcaaaagaaattttatgaatcccgtggccaaagacttccgcttcgttaaaggtgacagcatagacgttcatgttgtcacgtgctttttgatcaaagactgagaagctggcgtactttttgtccatggtgacgaacagttcatcacgccgttcgttgaccatcttggtatcagcaccagtgactcttaccgtgctggaatcttcaactgaaagtggtgtggttgtaaatgaaacgtgcgggttagccacaatttccttaaccttatcgtcatcttttgccgttgcaatgtacacggtgttttcggattcttcggggaaatataaaaagttaacggtccggacattaggcgtgtggccggccaatgattcggtggctaaagccaagttcatggcgttttctaaaacgtaagtgtaggtttctttggtggtcataatagtttcctccttgaagtttgcttagtctattatatctcttttacgataatcagccatcttataattgacaagatctattaactcaagtacactgtgtttgaaattatattatatgacgtataatattataggaggtaaacggtatggccatacaagtcagttctgaattattagatggcagcgtgctggcgattttggcgcagcaagactactacggttacgcgctgacgcaacgggttcagcaagccatcacggtatctgagtccactatgtacccagtactgcggcggctgaagaaaaacggttggctaacgacttatgatgagccatatcagggtcgtaatcggcgttattatcagatcacggcggatggaaaagcgcgtttggcaacaattcaaaaagagtggcaagactttaagttaggtatcgattcaatgttaggggatgaaaataatcatggataaatacatcgcggagtttaaagcttatctcaatcagctgagtgaagacgaattggacgaagttgtgaacttttacgcggaatacttagcggatggtgggtttgagacgtacgaagccgctgttgctgagctaggctcaccacgtcagttagcgcgaaaagttctggctgattactcgattcggttattggattcccctgaagaagagggtcagactatgagtgggcgagcagcccattcacgccgtcaagttcgcacgatttggctaattctgttggccattttgtccacacccctaacgattcccatcgccattgctgtgctggcaactttgtttggtgtgatggtcggggctgcagcaattatttttgccatcatcgtgacgatcgttgctttagccgtcgccggaatagttgtacttggcgttggaattggtattatcggtcagtcgtttacaaccgggttagtgtatatcggtggcgggttagtggttatcggactcttcatcgcgttgattccggcgttcaactggttgattcgtggggcaatccacgtgaccttatccttcagtcgctggttgtatggcaagttaacctctcgcaaccgggcagaaaaggagcgtgaccaaaaatgaaaaagactttctttactggactcatcatcttgattattggcggtatcatgctggcaattggtatcggaaagggcggcgttaagtcggtttactgggataacgggttaaagactgacgaaaaaatcacccaaactcgtgaaattaaccgggttgataccgttaagattgatgccgacgtctacggccccgtttcgattcaacgtggcaaaagtgacggtgcatggtaataaaagtgatcaaattaaaaccagcgtcataggaaatgaactgaccatttcaagtggtgctaaaacgcacgttatgctgggggactttaatacgaatatgggctcaccaaagattgaagtgacggtaccaaagaaaacgcagatcaaaactatcgataatcgtagagaaatgagtttaaccgttgctgatttagccattgaaaattttaaaaataccagcaatggggatttaaatctttccaatgtgactatttcgaaatccttggtgttaccgcatgaaacttatggcgataccaacatggataatgtcacttataataaaggtttgaaccttaattctgctggcgatgtgacgattcgtaacagtcagtttgatcaggccgacagccgggttcgctcaagcgatggtgatgtgatgttgagcaataaccactggcagaatttaacggtgactagcgctcaagggaatcttaatcttgaagatcaagacgttaacaatacgctgacggcagactccagtaatggtgatgtaacggctcgaatcatgccacgaaatggcacagcaattcacgccagcagttctaatggcgatacgtccatttatggaaagagtcagaataattacggcaaggctaaatcaaatggtcaaaccttccaactgaattcgtcgaatggtgatgtgacggtaacaaggtagataatcaaaaaaggggtttccagtggatgactggaaactcctttttaaatgttgcagattagttctgggggacgattttaatatcagtcccgttttccttaacaaccaagtagagtactttagtatgctcatcatccatgtagcccagattgaccgcgggataaccatcgattttttcaattccttgaaaacggtcaatcatggattgtctcaatagtttcatcgtttcgcgatgttccgatgcccgctttacggcagcggctaaagtgaaaccttctttaataaaactgttgatcatgaagacccggatgagcatgtcatatgaatattttcggttctgcccattcactttttcactctcaatgaagcctttttgttcccagtatctcaattgactctgtgatacaccggtagcggctgccacatcaccgataccaaggtgccagtttactttttgactaaaagctttaaatgcatcgtgttcctcagtgtccaaaaaaattcctcttttccctatttacttaatgtaacggttttctttcctattagaataggattctagttgttagatttagtaatatattcatccgatttcataatgactagtatatataatcaaataaatttgtcaagatagttgacaaatacctttcaagttattatagtagttgtcagtcgtttaaaagtaaacacaaaaagaaaagaaggttttaattagtgggtaacgcagtcgacacaaaggggaaatcctataacagagggttattgatcattgttttattggtcggtactttctttacggtcctcaatcaaactattttatctacagcatttccgaccttaatgaacgcgttcaacgtttcaaccgcgaccgttcagtggttaactaccggatttatgctggtcaacgggattatgatcccaatcagtgcttggttaagtacgcgttttaataccaagtggttatacattgttgcaatgacgattttcttcgctggcacgttggtcgcttacacggcaccaacgtctaactttggcattctgttaacaggtcgtttgcttcaaggtgttggtgttggtgtaaccatgccactcctgcaaactattatgttgtcagtcttcccgccagaaaagcgtgggactgccatgggacttgccggtatcgttatcggtgtggcacctgccattggcccaacactttctggatgggttattgatagcttcacctggcgtgatttattcggaatgacattaccattcctagctttagttattattggtagtctcttctttatgcatccagttctggaaacgaaaaaggaaggcatcgatgtgctttcagttatcctgtcaacaattgggttcggtagtgttctctacggcttctcatcagttggtaacgatggctggggcagtacaacggttatcgcttcattgattatcggtgtgattttcgttggcttattcgtttggcgtcaactgaagatggatgatcctttcttggaaatgcgagtttatcgttcaaagccattcatgatttcggcaatcttgagttcaatctcaatgatggccatggttggtgttgaaatggtcattcctttgtacctgcaaattgttaaaggtatgtcagccttccattcaggattaacactgttatttggtgctgttatgatggccatcatgagtccaattacgggccgtgcggttgaccgttatggtgctaagcgcctgtctatcatgggtatgacgctcttaacattgggttcaattccattcatctttattaccaaggacacaccaactgcctacatcatcattctttatgcagttcggatgttcggtatctcaatggctatgatgcctgcaactactgttggtatgaacgctttaccagtgaacttgatcggtcatgggactgccgtgaacaacacgcaacgtcaaattgccagttcagtgggtactgccatcttgatcagtatcttgactaacgttactaatgacaatatgccaagtaagcacttgttgaagactgatccattagtatacaaagatcatgccattaacgctactttaaatggttatcacgcagcctttattgctgcagcagtcttctgtctcttagctgtgatcaccgccctcttcatgaagaaccgtggtaatgctagtgattacgttgaaaaaaatgggggtgaaagcaaatgatcttaattttacttggactctttgccgttttagctttcgttttcttcatctatattgaaaacaatgctgtcagtattactttaacgattttgtcccttctaggattggttgtttccagcgtttgcgctgttaaaaactggcaagatcattacggcttggaacaatatacaacgactacgacgaagaatatctattccgtcagtcctaacaagcagatgtcaatgattctttaccagccaattggctcaaagaacaatcatcaagtctacatttacaagaacagtgaaaatgctaagaagccagttcatactcaggctaatagcgataccaagaataagttaactcggatcaatggcaccactcagatgacgaccacggttacccgttggcgttataagaataatgctgccaaattctggtttgccttcactggcgaaaaccacaagttcgttaagcggacgaacaagatcgaagttaacaagaactggcttgtgctctcagttgctcagtctaaagctcttcagaaacaaatgaagaacaagacttatcaagcacagctccagcaacaaggtaaggccttcgtgatgaagggaatgcaagctgccatgatgaagaacccaaccatgtctaaagctgatcaggctaaactgcaaaagcaattgacaggtgagttccaagcacaggctgtccaaaagttgatcgaacagattcagaagtaaagcacgttcagctaagtaaactgtttaaacgctaattaaaattcaaacggccattctttcagtgaagagaatggccgtttttttgtatacttatttatagtaagaaaccataactttctgtagtgacggagctgatggaacgtgttcaatcacaccctatttttcaaccaaaaattagtcgaaaatcttgtaaattaggctttaattaaagttatttctgttgtagtatatggctgtataagataaagtgttgtttttgcttcttttttgttaatatctcattattgagggggaaatattatgggaaaaggctcaaaaaacttatctaagaataatcgtaagttagctttagaaaaccaatcaacgctactacattatcgaatgtataaggcaggaagaatgtggctttttgctggggttgctacatttacattaagtgctggcttacttgggctgacatcaactcaagcatcagctaaaacggctgatacaacaccaacgtcacagcaacagccagctgtaacgggggatgatactggtaatggtaattcgacaactttaaggacaactgcacctgtaccatcggccacagaacaatcaaccgacaaggcagctacgccaacttcagatacaacgcaaccgaccgacaagacagccatgccagctccagatacaacgcaaccagctgacaaggcagctacgccagctccagatacaacacaaccggctgacaagacagctacgccagcttcagatgcaacgcaaccagctgataaaacagctacgccagctttggatacaacgcaaccagctaaaaaggcgactaatccagcagcgaatatagcgcaaccagctgacaaggcagttacgccagcagcacctgttgcacaggaacaatcgcaagcgtctgtaaagccggacaatggcagctcaactgatgctcaatttaagacacttgttgatgcaacatcaattgatccacaaagcgacgattcaagtactcctgatactactgctaaagcacctactaacactgttacattaccaggcggtggtagctttaccactaactcagatggcacgtttacctttgttgatccaaatggtaacaagtacaacattaagtcaagccaggctactacagaccaaactgggcaacctactgtaactgataaagatactaatggcgatggtattgcagatacctggaatattattaatactgttccaagtaataccgacgatacaactgggcctgcaaaagctgatactacattaccagatgataaaactggtcctgcaagcgctgatattacattaccagctggtaaggatggcaagactcatataattacttttaacaggaatcctgacaatactgaaactcttaagaccgatgatggtgaaataaccgttaaaactggtgacacgggttccttatcaaatggtggagcttacactgttcttcctgatggttcattaagtatcactaacccagatggcagtaacatagttgttaatccatataacaactcaaatgatacgaagaatactgctggctctactaccaacatcactaacattactaacatcactaacaatgctgaccctaccgacaatggtaatgctaatgctaaggacactgatggcgatggtctcccagacagttttgaaactatcctagatactaactcaggcagtaaagataccgatggcgacggtgatactgatctgcaagaaattttgaatggcacgaaccctaaggatcctaattcaaacttgaagtcgttggagaatggcggtaaggatgcttctactggtacgtcaaccaccacgactatcacaaccattaacaatcttccaggtcaaaatggggatgttaaagctaccaagaattctgatggctcagtaaccctcgtattcccagatggttcaaagcaaacagttaaacctggcgattcgaccacgcctgatgcaaatggtggttacttcaaggtaaactcagacggaacgattacctttaataatggtaagggcaacacctacacgattgaccctaacaagggaacgactactaacccaattaccgttaatgttccagggcaaggtggcggcgctcaagccactaagaatcctgatggttcgattatcttcacgttcccagatggctcaaagcaaactgttcaaccaggtgcctcaaccaagcctgatgcaaatggtggtgtcttcactgtaaatccaaatggcaccattaccgttaatgatggtaagggtggcagttacaccttctatccagacggtagtcaagggacaccaactcaaccagatagtaaagatacggtcgtcatccttcctggtaaggatggaataatgtccactgtgactgttgaaaagacgccaagtggcgctgttattcttcatatgccaaatggttctactaaggtggttcaaccaggtgacactggtacattaccagatggtactaggtacgttattaacaaggatggctcaattacattcaccacgccagatggtaagactgatactgtaaatcctgataatggtacgacgcacacaacgtctaccacaaacacaactacgaccactaacaatgacggtggtgatagtgaaactaatagtaataacacgacaacatacaattactactactacggttcagagggcccatcatcggcaactgtcactgtaccaggtgacaccgatggcaagaattcaacggttacttacactaagaatccaggtgggacattatcaatcacggtcgatgacaagactactccggttaagaccggtgataagggtactttaccaaatggcgatgcctacaccgttcttcccgatggctcattgagcatcactgcgcctgacaataagacctttgtgattaaccctggtaacgctaatggtgaatcaaccaatggtgggaccacgaactacacgaccatcaacaactactacggtaaagatggctccgcaagcacgattatcaccttaccagctggtaaagatggcactacgccaactattacctacactaagaatccagatggcacatacacgattgtattaccagatggttcaaaggatgttaaaacaggagacactggtgccttgccaaacggtgggacatacacggtcaacaaagatggctcattgacgattactaacccagatggttccaagacaactgttaacccagttgatggtgcaacttcatctaatggtctagttatcaataacaatatcaataactactatggtaaggatggtgcaacgagcacgaccattaccttacctggtaaagatgatgcaactacaacgtttacctacacgaagaatccagatggcacatacacgattgattcttcagacggttcgaaggatgttaaacctagtgatactggtaaattaccaaacggcagttcatacattgttaacaaagatggttcattgacaatcaccaatcctgatggttctcaatttactgtcaaccctgctaacagttcatccactaccaacgatggtgctactgacaacaccactaacattactaacaactactatggctcaaatgggccatcgacggctaccatcacattgccagcaggcagtgatgggaacgcttcaacgatcacttacacgaagaacccagacggcacctacaccattgtcttaccagatggttcgaaggatgttcagccaggtgatagtggtaaattaccaaacggcagttcgtacgttgttaacaaagatggttcgctgacaattaccaatccagatggttccaagacaactgtcaacccagctaatgattcaacgactaataatggcggtacgactaacaactacaactactactatggttcaaatggtccgtcgacagctaccatcacattgcctgcaggcagtgatgggaacacttcaacgatcacttacacgaagaacccagacggcacctacaccattgtcttaccagatggttcgaaggatgttcaaccaggtgatagtggtaagttaccaaacggtggttcatacgttgttaacaaagatggttcgttgacaattaccaatccggatggttccacgacaactgtcaatcctggtaatggttccacggctaacaactacaacaccaacaactactatggtggcagcacgacggttaccttacctggtaaagatggcggtgcaacgacaaatatcacctacaccaagaacccagatggtacttacaccattgtcttaccagatggctcgaaggatgttcaaccaggtgatactggtaagttaccaagcggtggctcgtacactgtcaacaaggacggttcattgacaatcaccaatccagatggttctacgtttacggttaacccaggtgggagctcatcaacaactaataatggcggtacgactaataactactactatggttcaaatggtccatccacggctactatcaccttaccggcaggcagtgatgggaacacttcaacgatcacttacaccaagaacccagatggtacttacaccattgtcttaccagacggctcgaaggatgttcagccaggtgacagtggtaagttgccaaacggtggttcatacgttgtaaataaagatggttcgttaacaattaccaatccagatggttctgagacaactgtcaacccaggtaatgattcaacgactaataatggtggtacgactaacatctacaactactatggttcaaatggtccatccatggctaccatcacattgccagctggcagtgatggcaagacctcaacgatcacttacacgaagaacccagatggtacttacacaatcgtattaccagacggttcgaagaatgttcaaccaggcgatagtggtaagttaccaaacggtagttcatatgttgtaaacaaagatggttcgttgacaatcaccaaccctgatggttctaagacaactgtcaaccctggtaatggttcaactattaacaactactactatggcggcagcactacggttaccttgcctggtaaagatggtgatgcaactaccaatatcacctacacaaaggatccagatggcacttacacaattgtcttaccagacggctccaaggatgttcaaccaggcgacactggtcagttaccaaatggcagttcatacacggttaacaaagatggttcgttgacaattaccaacccagatggatctaagttcacagttaatccaggtggtagtacttcaaccactaacaatggtggtacgaccaataactatacgactaataactatggcttaaatggttcaacgggagcaacaatcactatcccaggtggtgatgatggttcaacgactacgacaatcacttacaccaagaatcctgatggctcgtatactttgacgacgccaaatggttcaacaactgtaacaccagggaacactggtactttgccaaatggtgatacctacactgttcttcctgatggctcgttaagtatcactacgcctgataagaagacatttgtggttaacccaggtactccaagtgataataagggtggtaacaattactacactactaacacctactactatggtttaggtggggaaacgacacctataactgtaccaggtggtaatgatggtaagaatacaacaacggtgacctacattaacaatggcgatggcacgtacacgttgacgacgccaaatggttcaactactgttaagccaagtcaaactggtactttaccaaatggtgatacctacgttattaactcggatggttcgttgaatattactaatcctaacgatcctaatggcggtacgactgttgttaaccctggtggtaaaacaactgagaacggtgataaaggtgacgttacggttaatgtaacagttaatgaaaatggtactcctgcaacttccgtaagcgttccgaatggtagctacactatcaatgagaacggcaatggcacttataacattactggtccagacggtcaaacaactgagaaccttaaaactggttccgagggtactttatctggcaaaggtggcagctacgaaattgacaataataagattgttattactgaaccaaatggctcaaagttgactatcaatgttgttaataacgacaagaccactacgcctactggtagtgatactactgacaagaccactacacctactggtagcgacactacagacaagaccactacgcctactggtagcgacactacagacaagaccactacgcctactggtagtaacactaccgacaagaccactacacctactggtggtgacactaccgacaagaacacgactacaaccacaactccgcaagatggtactgcgactaacggtgccaacaatggtacggataacaactttgaacagggtggtgctgtagctggtgacactaatggtactggcaacagtacgtctcaaggtggtgctgtagctggcggtaatgctggtacatctgcaactacgaatgctgaaggtggtacagctactgaaggtacatctgcagctatgaataccgaaaatggcacagctactaatggtcaaaataatagttcagcagcagataaaagtcagttgccacagactagtgaaaatcaagctcaaggtgtggcagcacttggattcataggtttaatcgctgcactgtctagtttagctgcagcaaagaagcgtcgtgaagatctttaataattaggttacgttattttcgtttaaatctcgtatacgtagcctgcgataatccctccctgatcatcagatgaaatacaacaattcatctgatagtcagggagggatttttacgtgtaaacggaatataatcatacgtgaaatttgaatagcacttaatctttcaaaatgaatatttctctgttatattatattacatggctgatatgataggattaaggagacaatctaaaactgaatatagtgaatatacattaagcttatggaataatatgtatttttaatttgattttaatctcaatttaatttagaatggggcttaaatgcttaaacggataggaggttatgatgatgcttacttaccagattttaccggcgggtgataaggcagttaacgtcacctttgaacgacaagtcagtgtgacgatcaatcagcagattgcccagttgcagcaacgcttaacacagttgggtgtggatgggataaccggctttttaccagcgtttcgaacgctaacggtgttttacgaacccgcgcaaattagtcttcagcagttaaaggctactattaatacagccatgctggacggtcatcaaaatacggtttctacggttaaacgggtgcacattccggtttgctatgatacggattttggaccagatctggctaacgtggcaacgcgagctcatctgacctctaaagcagttatcgagcgccacagccaaccggattatttgatctatatgctgggcttcttgccagggtttgcctatttgggcggacttgacccgcagattgcaacgccccggctagcaacgccacgacttaaaattgccccgggttcagtgggtattgcgggggaacagaccggcatgtaccccattgaatcaccaggcggctggcagatcattggccggaccccgctacgattgtttcaaccggaaagtgatcagccattctattatcaaacgggcgactacattcatttcgatgtgatttctcgagcgaaatatgaccaaattgcgtctcatttagcagactatcacgtacgggttgaaccggtaccagaagcggaggtggaacaacatggcgcttaagatacaagctggcggtttactaactactgtgcaggatcaaggccgggtcgctacccaaagcagtggcttttcggtttcaggtgtgatggattttgatgctgctaatgttgccaatctgttagtgggtaatcccatagacgctgcggtgcttgaaagcagtcttcaagggccgactttaacctttacgcaggccagtcactttgcggtgacgggagcaactgcgaaaatgacgttgaatgaccagccgattgaagcttatcggcaatattacgcgcggcgtggcgaccaattagcaatcggtcattacacggctggtcgatttggctatttagccgtgtatggcgggattcaagtaccagtaatcatggggagccgttcaacgagtttgaaatatcagctcggcgggtaccacggccgacagttgcaagctggtgacagtttaacgactatccgagatgccgtggatcagccgcagtttcaacgagcaacggcatatccgtattctcagcaggatactaccaccattcgagtgacaccaggtccgcaatacaatgacttttcagcccaaactcggcaacagctgacgcatcaaacttttgagatcagtcagcagtccgaccgcatgggtgcgcgtctgaagggacaggcactagatgtaaccaagattactgagatgctgtcggaagggacggtattaggcggtgttcaggtaccacgggatggtcagccaatcgtgctgttagcggatcgtcaaactaccggcggttaccccgttatcgccgtggtggcacgtgtggatctgccgaaactggttcagctgacacctggccagcaagtccagttccagtggtttgacttagctaagagtcaaacactttaccggcaaaactatggcagtagcgcggctattaaggctgctcaccagttccagactcaggttcgacttgaacgggaaccagcagagcgaatagcaacactcttcacttcgtaatttgaaagaaggatgaaaattggaaacttcagaaatgcaagccattatgcagttgatggctgaaaatggtatcagtaagctgaagtatcagcaaaaagacgaaacattggaattaaccagagaatctgcgacaccagcggttcagcccgttgccaatacgtcagtccaaccggcgcaggctaatactgccgcatcaacagcccaaacaatcaacgctaagtttgtcggtaccttttacacctcaggcacccccgatgatgacccattcgttaaagtgggtgacaccgtaaaagccgggcagacagtggcggtgattgaagcgatgaagatgatgaacaacgtggttgcgccacaggatggccggattacaaaagtgctggcagccaacgaagatttagtggaatttgatcagccactctttgaatttgaaagcttatagggggtggcaaagtggaaaaagtgctgattgctaatcgtggtgaaatcgccgtgagaatcattcgtgcctgccaagaattgggcttgagcacggtagcagtctattcaactgctgataaggatgcgttgcacgtcaaattagctgatgaagctgtttgtatcggctcagccagtccaattaagagttatctcaatattgataatttgctgggtgctgcccagattactggagcggatgccgttcaccccggatacggttttttgtcagaaaatgccgaatttgctgaacgctgtttgaaagctggtttgacctttatcgggccgagaccagaaacaatcagtctgttaggtgataaggaacgtgcgcgagaaacgttgaaagcggtgggcgtgcccgtcacgccaggtagtgatggtaaaatcaccactttggccgaagcgcgaacggatgctgaaaagatcggctacccggtcatggtgaaagctgttgctggcggtggcggtaaaggtatgcggctgattcaaacaccagaccagttagaagaactgtttactctagcacaaaatgaagctgcccaagcctttggcagtaacgaaatgtacctggagaaatttattgaccgaccaagacacatcgaagttcaggtgttaggacttaaagatggtactggtgtggcggtgggtgagcgagattgctcactgcagattcaccaccaaaaagtgattgaagaggcacccagcagcattgatcctgccacgcgcgacaaaatgctttcggtatctaagcgggccgttgaagagttgcattacacgggtgcaggaacgcttgaattcctctatgccggtcccaatcaattttactttatggaaatgaatactcgaatccaagtggaacatcccattaccgaattaacttccggctgggatttggttaaggcacagttattgattgctgacgggaaggtgccatcagcggcgcctaccgccaacggttacgctatcgagtgtcgaatcaacgctagcagtgctggtcaaataaccggcctgcacttgcccggtggcaatggtatccgggttgataccgcgctgtatcaagggtataaggtaccgccgaactacgatgccatgattgctaagatcatcagttatggaccagatcggcagaccgccgttcaaaagatgctggtggcgatcaatgaaacggtgatcacaggaattgagactaatctagatttcttaaaccgattactgcgaaccaaccagttccagcaaaatcagtttgacattgagtttatcgagcgagagttattgccgcagtctgattcacagtagaatttacaagggaggatattatatgacacaagttgatttaaattgtgatctgggtgagagtttcggccgttatacgctgggactcgatgatcaagtgattccctacattacatcggcaaacattgcctgtggttttcatgcaggagatccggaagtgatgcagcatacggttgatttagctgttgccagccacgttcagttgggcgcccatccagggttgccagacctgcaaggatttgggcgccggccaatgaaaattgcgcctaaagctgccaaggctgacgtgaagtatcaaattggggcgcttgaagcctttgcgccaacccatcgattgcaccacgtgaaaccccatggcgcgttatataacatggcggctaagaactacgagttagcctatcaaatttgtgaggggattaaagaagttgatcctcagttgatgctggttgggttagctaacagtgagttgattcgcgcagctaaggccgtgggcattccttacgaacaggaagtctttgccgatcgcgcttatgaagcggatggcagtctcgtttcccggcaaaaagagggtgcagtcattgaagacagtgacattgctgttaaacgaaccatcaagatgctgaaagaacaccaagtgactaccattgatggtcaggtcatcagcattcagccggatacgatctgcgttcatggtgacggggttaaagcgttagccttcgtgaagcaaattcaccaagcactgactgctgaaggaatcgatgttgttgccgcacaagtcaaatagttgttactaccgggattgagaaggagtatagatcaatgaaagaaacctcacaatcaacgccaacaccgacgccagttaccgagaaaaaacgttctaaattcagtgttgccatgggtgccgcctttatgatggccatggccgccgtgggtcctggctttttgacccagaccgcggcctttacgggtcagatgggtgccaactttggttttgctattttactgtgtattattgccgatatcgttgttcaattaaatatttggcgcattattattgtttccggcaagcgggcacaagtgcttgcgaacgaagtcgtgccaggcttaggctatgtcttaacggcgctgattgttatcggtggtttctgttttaacattggtaatattggtggcgcggggctaggcctcaacgtgctgtttggcattgaacccaaatatggtgcgctgattgctgccgctgctgcgattatcgtgtttgtggtaaaaaacgccatgacggtggtcgatcgaactgtgcaggtattagctgtcatcaaaattctaatattaatctatattctgtcagtaaccacggtaccagtggcaaccgccatttcacacacctttatgccgacccaaatcaacttctattccatcgtcaccattgttggtgggaccgttggcggttatatttcgttttcaggcggtcaccgactgctggaaggcggtgtaaagggccgggaaaatatcaagtatgtcaatgaaggtgcgctaacgggtattggggtggcatctgccattcgaatcatgctgttcttagctggtttggctgtagtcgttgctggtcatacactgaacccagctaaccctgcagcttctattttccaaattgctgccggtaattttgggtataaattcttcggtttgctgttgttagcagctgggatgacttcaacgctggggtcaacctttacgtcgatttcgtttttgaactattctcagaataaagaatcatgggtcaataagtatcattcagctctgatcattacgttcattctggcttcaaccctgattttctactttgtgggtaatccagctaaagtgctgattattgtgggggcattgaacggcatgattttgccgattgcactggcaattctgctagttgcagcggttaagaagagtatcatggggaattacaagcatcccaagtggttattggttaccgggtggatcgttgtggccttcatggcctacgctgcggttcagtcattcgcatcaatcaagttatagtcgaactaactgatagttaaatataaaataatctaaaattagtgctgatatcagtcgattttcgtcgattaatatcagcactaattttagattttttgtcgttttataggtttgaatgcgattttctacccctaactctctgaaatgacagtattttgatgaattccttccatgttttttaagcgatctttaaaaaagcctgtaaaaattctcatataacggggttaattatctagtaaattttgctaatgtaagggtgtgcaaagcacaacgttgtacttgcttaatttctttaaagttttgtggaatttatggaggaggaattattatgggaagaggttcaaaaaatttatcaaaggggaaccggaagctagctctcatgcatgagtctgagtcgctacactaccggatgtataaggccggtcgtacctggctttttgctggtatcgccaccttttcattaggtgctgtattactgggaacacaagtgcaggcggctgctgcggaagatccaacacagacgactgcaccggcgacaacaccggctgctgatacaactgcaccaacaacgggtgattctgccggggctgcacaaggtgctaccacgcaggaacaaccagcacaaccggctgcggatgctaatacggcggcgccgacgactggtgacactacaggtaatacacaagcaacaccagaaactggcgatacaacgacaccaacaactgatagtgctggaactactggtcaatcaggaacagcggatgatgctacagcaccagttgcaaagcctggtcacgttgtaaagacgagctcaacacagctgggtgtcgttaccggtaatgaaggtaacaatgtgaaggcaccagctggtgcaactgacgatccagatacctcaggggctgttattaagacgaacttattcggtaatgggttatcaaacgcatcggacaacactgcaactgctcaacttggaccagatgctgtgaacaaagctaatgcagaaaatgctcctaagtcagatggtacaggaacatatgggcatatctatgacggagagactgttccaggtaaggacgaaattttaaaccctacagggaatacgctcaaacacgccagtgacaaagttgacggcttgaatgatgtgtttgatcaaaacattcaggatgaaaaagtacctgttgacaaaattactatcgatcaaattagcgatcaaggcgcaattagttccgatagtcaaaaccctcaaaataacgctgtacgtggtgctacgatttacagcgaatcagaaagttcagggattgatttctcagtagttggtgacggtcaaaatggtgttaacattggtattcctgacaacttaagcacgttaaaagtcgggacttggcaagttatggatcagacggccgttggtatcgttattaaaaacaaaattactggcgaacaattccaagttgttgattctgattatggtaccgaagggccatacaaagacacatacgctattggcaaagatgttgacggtaaagctgtttatgtggcggttgttaacggtggtattatgcagaaagttgccgctgctgtgacaaatgccatttctggaattagtggctttgcaggtggcatcggtaaaagcttaattggtaatggtaattcattaattaccgacaacatcaaggatatcgttaacaacccagctaatttgttaaatccactgggtgacgcagccgctttatcagatgttaataacctggtaagtcgtctgggtgccacagtaagtggtggtgagaatggtgttggtgtaagtgatatcattgctactttagttgacctgacaggactacttggagttgacacaacagatttccaagctgcctataatggacaaattgatcaagttaatgaccgtattgatcaattgaaccagtacggtgatcagttaatgaaggatggtgtttcagtagtaggcctcgctgatgccactatcaagcaggataatggtcatagttatattgaagtgttatccggtaaagatttgacaacagcacgtgcagttaccaacatgttcaagtcttatattgaaggctggtcacaaggaattgcagatgctcttgactctgtatttactggggaacaaccaattgtccaaactgatgcacaaaacgatccacataatctttatcgcttcaatggtcagaagcctcaggacattttaactcaagagattaaggatactgacggcattggtggttctcttgctaacttcgtggaacctattatcacagctgcactaaatgctctttcaggtattaacaacagtattgttcaaccaatcatcacaaatcttaacacgtggattaccaattctttaggtacagtcatttctgatgccattgatggagccgttggtggtgaaacacagacggttgctgttccagttaactggactgatccgaagttcgttgatgaagcgaatggacaaagtgctaaaccaggtcaatttgtggctgaaacatttgacacaaagtcaaaagtttataatgtgacaagcacaagtacaactacaattgcttatcaaaacgttgataaaacgcagttggtacaattgattgctgatcacaaaggtgacggtgtaatcccaaccgatgttcaaaacttggctgatgccgttaataatgatgtaaacgcttctcaatacgacgtcgatcaagccgttattaaaatgggtggctacattaagacaactaccaatattgcagatattaatttagcagaattggctgtaccagctggccaaactaaggaagattatctggcagcccaagcctcaaaggtgctaactggtactcctttagctgatgccacaactgaagaagccgctgctctcaaggctgcgattgatgaaattgcgccaactttaactgccaacgactttacaattactggtaatgcaactgacggctttggctataccttaagcaaggatggtgttgatgcaataaactccgcacttgcaaaagatggtggagattttaaacttgttgatcaaccatctggtttaattaaaactgcaaatgatgcaactagccaaattgcatacaaggtacagccttccgctgatggtacgacaggtctgccaacaacgactgcaaaggatcttactggcacagccgatgcttcaattaagatcagtgctttaccagacggtactttgccggaaaccgttgacgtaactactccaaatgctgatggtagtaagacaacaatcacttatactgttccaaaggacggaacaattacggttccaaataaagcaggacaaaccgtatacgttaaatatgttgctggtgaaccaattattacggatgtgcctgaaggcagtatcgaatacaaactacaagctgcaaacaaagacggcaaaactgtattagctgacacggatcagtcgaatacgcctgtagcaacaacaggtaaagttggtgacaatgcggacctcactaagctgccaggaacatttactgttacagttgatgatggtacaaacacaacagtaaccacatatgctcctgtttcaggatttactcacaaacttgtggatactgacaaaggccaagtaatcttagttccttatgatgtttcaggtaaaccaacggttacaccagatgataagactaatccagatgacagtaccaaaggttggactcttaccaagaatgataatggtacctacacattaacagatgataaaggacagtcagtaatcatctatcctaaaggtgatggcagtattggttctggtgaaaacggttcaggacaaccaattattatccaaatcaccaataacaatgatggttctgatggttctggctcgaacggttctggttcaactggcaccgacaccacaggcactggatcaaatggtgctaccttaatcgtattacctggtcaatcaactggtactaaagtcgctaagaatcctgatggttcattaaccttcacgttccctaacggcgataccgaaacggttcaaccaggtgataacgacgacaagactaatccagctggcggtacctacaaggtcaacccagatgggacgattacctttactaaccctgatggttcaacctacacgattgatcctaacaacaaggctagtggcactactcaaccaggtagtacgattactaacatcacgttaccaggtaaagatggtactgatggtaagaatgcacctgatcaaactgtattagttgagaagactccttctggtgacattgtgctccacttcccagatggtacgactcaaacagttcaaccaggtggtactggtaagactccaggcggctcaacatttgttgttaacccggatgggacgattacctttactaacccagacggttctactaccacgattgatccaagcaagggaacaacaacaccaatcgttattaacactggctcgcaagctggcaataatggtgatactgatggtgatggtattcctgacagctttgaaaaagagattggcactaacgccgacaagactgatagtgataacgatggcgacaccgacttccaagaagtcttaaaccacactgatccattggatccaaactctaacttgaagtcattggaaaatggcggtaaagacggttctactggtccttcaactagtacgacgactaacaccacaaccattaataatgttccaggtcaagacggcggtgttaaagcaactaagaatcctgatggttcaattaccttcacattcccagatggctcaacccaaaatgttaaacctggtgaatcaactaagcctgacgcaaatggcggttccttcaaggtaaacccagacggcacgatcacctttactgatggtaatggtaacagttacacgattgaccctaacaagggcacaaccactaacccaattaccgttaatgtgccaggtcaagacggtgggactcaagcaactaagaaccctgatggctcaattaccttcacgttcccagatggctcgactcaaactgttcaacctggtggtgatgcaactaagcctgatgcaaatggtacaacctttaaggtaaatcctgacgggacaattaccgttactgataaggatggcaacagttacacctttgatcctaacaatggtcaagggacaccaacccaaccaggtagcaagtctacagttgttgttcttcctggtaaagatggtgcaactaatgttgtgactgctgaaaagacaccaaatggcgatattattctccacttaccagacggttctacccagacagttgaaccaggtaagggtggcacattgccagatgggactaagtacacttataacccagatggtacgttcacatttactacaccagatggtaagaccactactattgatcctgaaaagggtacaagtgatttaactacctctacaagtactagcacgactaccaacaacaatggcggtacgactaataacacgaccaacaactactacggtacagatggtcctgcaagtgccactattaagttgccggctggcaaggatggtaattcttacacgatcacttacaccaagaatcctgatggtactgaaactatcacgactcctgatggtaatactaagactgttaaaccgggcgctactggtactttaccaaacggtgggacttacacagtgcttcctgatggttcattaagtatcactaacccagatggcaccacaacagttgtcaaccctggtggcggtacaaatggttcaactaccaacaacaatggtggtagcacgacgccaactgacactaacaatggcaacggtactgataccgatggtgatggtgttcctgatggcctcgaaggtaaattagggaccaacgcagataacaaggatactgatggcgatggcgacaccgatttgcaagaattgatgaacggcactaaccctaaggatccagcatctaacttggcatcattgaagaacggtggttcaactaccaacaacaatggtggcaacccaattaccatcaacatgccaggtcaaaacggtgggactactgcagtcaagaatcctgatggttcaatcaccttcaccttcccagacggctctactcaaactgttaaaccaggtgataatgacaccaagactaacccagctggcggtaccttcaaggttaacccagatggcacggttacctttactgataaggatgggaacagctacactcttgatcctaacaagaacaatggtgcaactacccaaccaggcagcaaagacacggttgttgtccttcctggtaaggacggtacaacttcaactgtaacggttgaaaagggcactgatggaacaatcaccttgcacttgccagatggctcaactagaactgttaaaccaggtgactcaggtaccttgccagatggcactcagtacaaagttaacgacgatggcacgatcacctttactaaccctaatggtggctcatcaaccattgatcctaacaagggtgctacaaacaacggcggtaccaacgggacaaatggtacgaacgggactaacggaaccaatggtacaaatggtatcaatggaactaatggtacgaacggcaccaacggaaccaatggtgttaacggctcaaacggtacagtcacagtttctatcccaggtcaaactggtggtacaactgtcactaagaaccctgacggctcatacacgattaccttcccagatggcagtcaagatgttgttaaaccaggtgataacagtactaagactaatccagaaggcggcagcttcgttgttaaccctgatggtacaatcaccttcaccgataagaacggtaagaactacaccttcgacccaagcaagattggtggccaaccaactgctgatgacagtaaagcaactgttgtggtcatccctagtcaggacggtaagaacacgattctgaccgttgaaaagacgactggtggtcaaacattgcttcacttcccagatggttcttctacacctgttaaacctggtgatactggtaaagttcctggcactgataccacctacaaggttaatgaagatggtacaatcaccttcactaacccagatggttcatcaacaaccattgatcctaatgccggtaagacgaacgttgtcaatgtaacgccaaatggtggtaacggcgataacggtggtacgacaactccaggcaacactaacggagctggtacaccaatcaccatcaacttgccgggtcaaaacggtgcaactactgtcactaagaaccctgatggctcattcaccttcaacttcccagatggcagcaaggaaactgttaaaccaggtgacaactcatctaagactaacccagcaggcggcaccttcgtggttaaccctgatggtacgattaccttcactggcaaagatggcaagacttacaccattgacccaagcaagatcggtggccaaccaaccgacagcgactcaaagagcactgttgtggtaatccctggtcaagacggtaaagatgggacacctggtaaagcgacaatcttaactgttgagaagacaccaaacggcgacacactcatccacttcccagatggcacgactcaaactgttaaaccgggcgatggtgacaagttaccaaatggcggctcatgggttgtaaatcctgatggtacgattaccttcactaacccagatggcagcaagacgactatcaatcctaatgatggtactaagggtcctatcaacactgatcctaagactggaactgacggcaccaatggtacgaatggtaccaacggcactaacggcactaacggttcaaccgtagtctttgtaccaaacaaggatggtaatggcggtaccatggttacccttactaagcaaccaaacggtgatgttacagttactactccagatggcggcagtcaaacgctcaaacctggtgaaactggtaccttaccaaatggtggtaaagcaactgttaacccagatggctccgtaaccatcactaatcctgatggttcacacttcacagttgttccaaatggtggtaatggtggtaatggtggtacgactaataacaccactaacaacattaccaacaactatggttcagatggttcgaccagcaccacggtaacattaccagctggtaacgatggtaatggtggcgttacgatcacctacaccaagaaccctgatggctcaactaccttgaccactccagacggtgacaagacggttaaaccaggcgacacaggcaccttaccaaatggtagcccatacgttgttaaccctgatggttcattgacgatcactaacccagatggtagcaagacgaccatcttcccaggtggtacgactaacctcggtggcggtacaaccaacaacgatggtgtaaccaacaattactactatggtaatggcactgatgttaacggtaaattaccagatggttctaagatgaacttaacgaagaaccctgatggtacgctgacaatcaccttcccagatggttctcaacagactgtcactgttccaaataatggtgagaccggtgacaagggtaccttaccaaatggtgatacttggacagttaacccagatggtactgttacgattacctctaaagatggtaagactaagactatcttgaacgtcaaccaagacaagactccaactggtcctactaccgggcctgatggcagtcagactccagatggtccttcaactggtatcaacacaacgccaactactgatccaggcactgccgtaacgactccaggtaacgacaatgctggaaacaatggtggtagcgatactactggtacctcaactggtgctggtgaaggtactgctactgaaggcgctggcgacaacggtactgcaactggtactggcgaaggcactgccactgcaggaaacgctgaaggcggtacagcaactgcccaaggtacttctgcaggtacagcaacaactgccgaaggcgcaaccgctgctggtcaagctaatggtaacaagcaagctgctgacaagagtgcattacctcaaactgatgaaaaccaggcacagggtgttgcagcacttggcttcctaggcgtacttgcttcactgcttggcttggcaggagcaaagaaacgtcgtaaagacatttagtaacatgatgtagttatcttccgtttaaatttctccctcaaaattttaaacgacgaagccccgcatacgtcgatggcgtatgcggggctttttgtttggttcaaacgaaatgagagaattcgaaaagcaccgcgttctggttttgtagaacgcggtgcttttgttggcttactttatctgcacaattaatcttcagacttaagtgactgagcaacttctcgcattgctgcgatgctcttactgatgacggtgattaaatcatctactgctgactgtggctgagtggttaaccaatctgtaatcgcacaaattaagccgccagacgcaaacccgactgcagctcgatattttgcattagacgaatcgatctgttcagcatctaatacatagtagataaagagtgcgttgatttgcttgaaagcctgaatgtcttcgccacggtcggtgagagcctctaatagttctgaatgattaacgacgaaggtaacgatttgcgttgctaggggcgtaaaatcgttgtcctcatcacgtggataaaacttgtcaaatatccttgcaaactgattaacggtatcagtcaccactgaatcatagagatcataaacgtccttaaaatgaatataaaaagttccccgaccaatatcgctttccctagcaagttctgcaacagtgatcttgtcaattggtttatcgtgcaatagtttgacaaacaccttttttaactgacgctgggtctttaacgttcgacgatctggctgattactctgcttagaaaccacattatgtccccctctaagtcgagctatcatcctgtttccccctcaatgattaatgaacaatctcagtggatacgtctattaatgaacttaatctgcataattgagcattgtacactaatcttatctacattatattatttttaaagagaaaaacaacaattatgtcgtaagcgccttcttagttgaatattaagtgtttttacacagtgttgggagacactatgtagcggtaactgcgggggttacttggttatctaatggggggataggtttatggattatttagcttttttggagaagaatgaacgcactaaattgggtattttaggggtattggctgaaaatgcgcggcaagatgttgaggtcaaacagatcatcgaccaagtatcgataacacgctataagttcaaccaactcattgacgaattaattcaagatttagggagtattcagcaaaaagattgtcaactcactgtcaaagataatcttgtcgtttgtgacggtattgattattcaatctgtcagcagttgcaactgatttacttgaaacaatcaccgcggtttcaggtgtttgaatttgagtatctcaatcagcagactcagtcacgccagaagttcctgctggatcattttatgagtcaatcgaaatactatgcactgcggactcaagttgaaaatgtgctggataataaagcggtgacgcaagctcggccaataggtggcagcctgcacccagaacttgtcgaacgggccaaaatttctaatatttattatcatttctttaacgggattgaagacccgtttcctgaactagagagtcaaacttcacggttttgtaatttcttatccatgacctttggtatttcgctgacacccagcgaacggttgaagttgaagatgtttgtccagattcaaataaaacgattggttggtcggcatttcttaaatatccgacacatggcaacgttagaacgggatacacgactaccgtttttaaaaaattattacctcgaaaacgtaccgcacagtggtgaatcagacattgattcagaaatctgttacctgttcttatttttacgcagtcagcggattatggcttccgtgccagttaaattctgccagcaattgcagcagcaatataatagcggcagcaagcattttgaacgggtcttagcagaaacaccggtgatcaatcaggccaaattcaccggtgaagaccagcaaaagactgctcagcacatcgcccagttaacggtgtggctgatgatgtttaactactttgatttcaccgaagtcattgcgtctgatcagtctcatatggccatggattttccagcactctcgattttgggtaagcaactggtggaagaggctattagagtttttgatctccaactttgtgacgaatgccgtgctaagttgctcaagtcctacgttaaaattttgattgcggacgtgcctagtagcttggcgcgggacaacgtgaccatttgtgttgattttgttcagagcattgtgccgatggattattttgctaaattattggtggctaatcttggtgcaggcattgtgctgaccaatcagttaagtagcgatgttgatgtgtttctctccgatatttatgtggccagcattcatgatatcccacaggtgacgttgctggatccgctaaagacatcgagctgggagaagttgcgacaaacggttgccgacgttaagcaaactaaattggagggctttttggcagcgagttaagactagtatgtgaagcaatgaaaacacttgacttattacagtaaactcgctttaattagagttaagaatttaaattgaataaacattgtggtctggggtgctagtgatagctgagagatacccaaataacctgatgcagttcgtactgccgtagggagcgccatgttagtcgacagactaccagtccatttgagaaccattcaagtgggcttttttatttgctgagcgaccagtcacagtgttggcttggaggaagaaacatgcaagcaacaacgattatcaagaacggtttgatcgtcacgccaacgggtgtggcgaacggtgatttagcgattaaggatggtaagattgcggctattggtgagttatctgaggatgccgcggaagtgattgacgctcaaggccaactggttttacccgggatggtggacgctcacgtgcacattaatgaaccgggacgcagcgactgggaagattaccatactggcagccaagcactggcagctggtggtactacaagtatggtggtgatgccgttaaatgcattaccggctcgaacgaccgcagctgaatttacacgtcatcgtgccatcgctgagggtaaatcatacattgattttgcactgtatggtggtttagtacccggtaatcaagcgaatattggcccaatggcggatgctggtgcagctggctttaaagcgtttatggcaacgactggtagcgatgagcccggtgattttcataacgtggatgattatgatttgtaccggggtatgcaagccatcgctaaaaccgggttacggctatcgttacatgcggaaaatgctattttgactgatcgactggcaacggatgaaatcgctcatcagcacacggatattcaagcctatattgattcacgcccacccatggttgaagtagaagcagttagacgggcattgtatctggctaagcaaactggttgtaagctacattttgttcacctttcaaccggagaagccgttcgggaagtttatcaagcacaaacagaggggcaggatgtgacttgcgaaacctgcgtacattatttgacgttaaatacggatgattttaagcagattggtcccttagcgaagtgttcaccagtgttgcggacacctgaggttcaagctgatttatggcgtgaagtccaggcgggacatgttaacgcggtgacttcagaccattcaccggcacccgctgagatgaaggcgaaccccaacaacaatattttcgaagtttggggtggcattagcggtgctcagaataacttggatgtcttttacgacgttgcagttaagtcagggcgactaaacttgcagcagtttgtccagttaaccgctgcgggaccagctcaattatttggtctgaaagataagggacaactgagcgttggcgctgacgcagatattgtattcttggatcctaatcaaagctacacgttgcggccagaagacctgtattacaagaacccaatttcggcttacgtgggccgtcagattaattgtcgagtcaccagaacattgctacgcggtaaaaccatttttgaactagggaaaggtttcgatgagcaacctactggacaatttttgcataatcagcacgtgatgggggttgcaaaatgacaccaccaactgcggttcaacagtctaaccggacagtagctgaagacttaaagccaattgccgataatcagcgtaaagtgggtatcttcgcgtatatggccatgtggctgggcgatggatttaacattggcaacatcacgctaggttcatccatcgtggtggccggtgtagcaaccatgaatttactgcagaccatgatggcagccggtatcgcaattgtgatcatcacgttaattttcaccctgaatgaccggtttgggtaccgcactggcgcgccatacgtgattcaattacgactgtcgtttggggtcaaaggtgctaaaatcgccagtttgttccgtggcattccagccattgtgtggtttggttttcaatcctggacgggtgcgttagcgctgaaccaaattggcatgacgctgtttggattcaccgccaatcacacgtttgcctgcttcttgttcctacagatgctccaagtggtcatgacgttatggggattccggtccattaagttagtcacgggatcgattgccaccgtggtgatgattgccatgttaggtgtttttctgctcctagtgacgcagcatcaagccgtgattcagcagcgattggttcgaccatcggggacgtggggattgccatttttcggttttatcgtggcgttcttaggtaactacacggccatctttgaatcagcggccgactactcccgtgaattaaaaccgaatctcagcgatcagcgtcgtggcttgctgtacctgataccaattgggttagcatacggcatgaccattgtgacgggggcgatgctagcggtggtcacgggaattgctagtccggtaacggcgatggcacatctactgaataatggctgggtgacagtggtgatttccttcttcattgtgttaggcacgattactactaacacggtagctaacattatgccgccaacttacatgctgacctcattgttaaaaatgccacagcagttagccaccacgattgtgggtattttggcgattgccacctgtccgtgggtcttagttcaggacagttcagcgcagggtttggcgttatttatccacctatattcgattttcctagggccaatgacggcgattattttgcttgaatactatctacaccgtcatcagcacgttgacctttcagccttatatgacgccagaaaacaaccggattttacgtggcgcgctcctttggcgctgtttcttggagcgatatcagcagccttgatcgttaatttatcgtggtttattgggttcttcattggaggactgatgtattggaaattaggtgtgagtaaaaaagtttaaagataaaaaaagcagatttcctaaattttaggaaatctgctttttggttgtgtcccagttattctgcactgtgaactttgccagtaaactgcgtcacgtcaatgcgaatcacaccaacgtgcgctaagtctttcgctgaaatttcacccggcatttcacgcccaacttcatgttttaagatagcgcgtaaggcatgttctttttcggttgggtcagaaaccaaggtggctttcccagtgcctaaaacgctgcggtagaaataactgaagttgcttaacggggattcatttttgggtgtgtccagactggaatcagcgataatgctgaaggaaacgtctggattagcggcaattaagccacgctttttacccgtggatgcgccatggatgtagaggatcaagtgatggtcattaaattcatagccatagttagtcggcacaacgtagggtgctggaaaatctaaaatacccaagtcgatgactcgagcttgatcaataatctctaatttagttgcttcatcggtaacttcacgatcagtacgtctcatattcaagccttcaattcattattagttaatttgattatagaataggcggtatcattcgtatagctatagtgagtaaaatacgaaagttaattaagaaaaagatgagtgggttgacaattatctctaatgagtttatcatcaattgcatgatatgaaaaaacgattagaagatgagtagtactcctaaccttaatcagagagctgcgggtggtgagatgcagtaaggggcgagtgtgaagatggtcttcgataaagcagggtattcgagcgagagtaagaatatcatgggtgtgcccattacagcacgggggtatcaaaaggtacccggtgaggaagtctgtgtgagcggacttcaaattaaggtggtaacacgagaaatcgtccttatcttcgcacttgtgcgggggtgggggcgatttttttgtgaaggtgcggagccaggcggttagagactggagcctaaggggctggcaacaaaaaccccgaacttgggttttagttgtcagtcacttaggtgcaagtctctgcctggaggagcccgattaggctacataacagtaagaccactaactacgaaaaataaaatcaaaaattttcatcaaatccagaagggagagtgaccaacaatgccacaaattacttatctacattgcaataaaatttccaccgcaagttacctacttggcgatggcattgatggccaggtcatgtgcctgtcaatcagctattaacccacttgagatgaaatgatgattgaataaaaggagattttaaattatgacaacaacaattattggatatccacgtattggtagtcaccgtgaattaaagtttgccgttcaaaagtattttaaaaaggaaattagcgcagaagagttagctcaaaccgctgctgatttacggaagcaaaactgggataccattagcggtgctggtattgatcagctggtttcaaacgacttttcatactacgacactacgttagatactgctaatttattaaacatcgtgccaaagcgttataaggatttaaacctgtcatcactagatgaatactttgcccaagctcgtggttaccaaggcgataagggcgacgttaccgcgttgagcatgaagaaatggttcaacaccaactatcactaccttgtaccagaatttgacgacgatacggatgttaagctggttggcactaagatttttgacgaatatcaagaagccaaggatcaaggttaccaaactcgtccagtcgtccttggaccatacagtctattacgtttgagtgcttttgaaggcaaccgacaagatactgattttaccagcgcgttggttagcgcatacgaaggtatctttgaaaaattagctgacttgggtgctgactggattcagttagacgaaccgcaattagttaaggatcaatctgaagctgatttggaactcttcaccgatctctataaaccattattgagcaataagcatgggttaaaggtcttggcacaaacttacttcggtgatgtgcgtgacagttatgatctattaacctcattggacttcgatggtcttggcctcgatttccacgaaggtgacgagagcctgaacttgattgaatcaaagggcttccctgaagataaagtgctatacgctggcgttatcaatggtaagaacatctggaaagctaactacgatcaacggctggacctgctccacaagctgcctaagaccaacattgtgctaagcacctcgtgttcgttgctgcacgtgccatacacgttggaaaatgaacctcaattagatgataaatataagaagtacttgtcatttgctaaggaaaaattaactgaattaactgatttggaccacattctgggtggctcaggcgacgatgccttaaaggctaacgaagcgctgtttgctaagcctcgttatgaagaaaaccaagctattatcgacaaagttgcttcattaaaggaaagtgacttccaccgtgaaccatcatttgaagaacgggccgcaatccaaaagaaggaatttgatttaccagaattaccaaccacaacgattgggtcattcccacaaactcgtgaagtccgtcgtaaccgtgctaagtacaagcgtggcgaaatcaccaaggaacagtacgatcaattcaaccgcgataagatcaaggaatgtgtcgaattccaagaaaagattggtttggatgtactagtacatggtgaatacgaacgtaacgacatggttgaatacttcggtgaaaagctggacggcttcctatttaccagcaatgcttgggttcaatcatacggtacccggggtgttaagccaccaatcatctggggtgacgttaaccggactgccccaatcactgttgcggaatcagtttacgcacaaagcttaactgataagccagtgaaaggaatgctgactggcccagtaacgattctgaactggtcattcccccgtgaggatatttctaagaaggaaagcacgttgcagattgctttggctattcaagcagaagcacttgatctggaaaagaacggcatcaagattattcaaatcgatgaaccagctttacgtgaaaaattaccattgagaaaatcagactggtacagccgttacctcgattgggcaattccagccttccgtctggttggtagcaaggttcaaccaaccacgcagattcacacccacatgtgctacagtgaattcggcgatatcattgacgccattgacgctatggatgctgatgttatttcatttgaagcatcacgtgctgatttaacgttgctggatacgctccagaagacacactttaagacccacgttggtcctggtgtttacgatattcactcaccacggattccatctgaagacgaagttgccggaaccattcacaagattttgaagaaggtaccattgcagaatgtttggatcaacccagattgtggactgaagacacggggaacaacagaaaccacagctagtctggaaaacgtcgttgctgcaactcagcaggttcgcaaggaactcgcacatgaaggtcgttgattgtttcaaagaacgtcccgtgatctcgttcgaaatatttccaccgcgaccgaatgctagcgaaaaatcgattgagcggttctatgataaccttgatgtgttggcgagtttaaagccggcttacatcagtgtgacgtatggtgcaggtggcagcgacaataagtctggcacactggacttgtgccgttacatcaagcagcattatgggattgaagtagtcccacatattccaggtatcaattttacaacgtcagcagtgaaatcgtacttggatgagctaaagggttctaatattgaaaacgtcttggccctgagaggcgatctaccagaagatggtcagataaagggcgatttccaatatgctagtgatttagtcactgaaatcaaacgtgacggtgacttcaacgtgctgggtgcgtgttatcctgacgtacacccagaggctaaagatagcgtagatgatattaaaaacttgaagtgtaaggttgacgctggtgtttcacagctgattacccagctcttcttcgaaaatgaacactattatcagtttttggaacgctgcgaattagcagacattgacgttccggtgcaagccgggatcatgtcagtggtcaatgaacgccaaatcaaacgcatggcaaccatgaatggtgttgggttgccgcaaaaattccttagaatgatgaatcattatcaggataacccggtggcgatgagggatgcaggaacggcctatgcgatagaccagattgtggacttattgtcggagggggtggatggtgtacatctatataccatggataatcccgttgtgactaagaggatttgtggggcgattgagacgttgatttaggtgcgaagcgaggcggttagagactggagcgtaaggggcttctgacgtaaaccccgaacttgggtttatgtcggaagccccttacgtgcaagtctctgccgagcggagcccgattaggctaggtaaactaaaagagcgaacttggaatttgtgccggaagtgacttacatgcagctctctgccgagtggagcctgattaggctaggtaaaactaaaagagcaaatacaccaaacgccatataactaaatagcatttcaaaaggcatcactatccagcgaggtagtgatgtcttttttagtcagttagttacaagccagtaattgataagtataaattttgttatataatattagtacgtataaattaaataaaggagcgtccgtatgtctgaaaacattgaatttgatcgcatgatgaacagcgaaatctatcatcaaacacctgaattattcgaaatgcgaatgaaggcgcgagacttattgttcgagtataaccgcttaaactaccgggatttagagaaccgtaaacgaattttgaaggaattactcggccaagttggcgaaaattatctcattgaattgccctttcacacagattatggatttaacgtgaaattaggtgataattttttcgcgaataataatttaacgttacttgatccggcatcaatcgagatcggcaatgatgttttaattgcctccaacgttggcatttacacggcaggccatgccttagatcctgaattgcgactcaggacgggtgccgaatatgccattcccgttaaaattggtaataacgtttggatcggcgccggtgtgacggtttgcccaggggttactattggtgataacagcgtgattggcgcaggttcagtggtcactaagtcaattccaagcgattcactggcctatggtaatccagctcacgtggtacgtcagtttgacgagcgcgataaaaaatactactttaagcagcggcaagtcacacaggaatatctggataaattagcgaatggtgaaactttccatcggtaggaagatgcctgcaaacttgatttaattaagtcctaaacaaatgaacggcactgactctatctgagtttggtgccgtttcttttgagttaaaaggttgccgaccacttacaaatggtgtacactatcataagtggtcaaccacatattaatcaactaacattaaaggggacaattaaatgtcaaaagtattagtaatcaaagcgcacccattcgatggtgacaaatcacggacaatcaaaacattagacacttttctagaaacttataaagccaaaaatcccgacgacgagattgaaaccttagatctcttcgctactaacttcccagaacttgatggtggtatgatggctgcctggggtcaattagccaacggcacagccttcactgacttaccagctgacgttcaaaaaggcatgggtcagttcaacgacgccttggcgcagttcaaggctgctgacaagttgatcgttgctaacccaatgtggaacttatccattcctgctcaattgaagtcttggatcgatgctatcaccgttgttggtgaaaccttccgttacaccgcaaccggtcacattgccttggttcctggcaagccatttgttcatattcaggctgccggtggcaaatatgagggcaaagatttaggcactcaatacgtgcaagctgcattggaatatcttggtgctaaacggtttgctaagatcggtgttgaagggatggatcatttcccagatcaagctgatcaaatcgtggcagcagcacaagaagaagccaaagaagttgcaaataaattctagaccaggcaaattctataattaatccgaacagaaattaaaaagcccaaagcaatcacttacaatggtagtagctaattccaaccaatatagggagtgattactttgggtacatctactttatcacgtttttcaaacgtggcgcactagcacaactggtcaaatgaggggaataaatcttaccaagtaatggctgacgccttagcggtcgccaaagctacgattagctatgagttggaccggttaaaccttatgatccagattagctcagcaagatgcagatccaaaaggcggaattgcggtcgtcgttcgatgctgacggcagcattagcgactttaattaccaatcacttacgattaacctggtcaccagaaaccttgcggccgccgttataacttgagcactgcgtcaatttatattggcttaatcgtggctggctcccttcaaattgactgatctacccaatcggaatgtccgccagcaccgagtgagcgaaaatcgtgggaaatttacaatgggacttcccatcgaacaacggccacaactgttatcaacggttagctttggtcattgggaagtagatacggtgctttctctagttcgaagtgagtcacgatcatgtctgttacattcgtagaacgtaagaccccgacttctatgggccatcaaagccctaatagaacggcttaggctctaaacaccgcctttggcaagtttatggggccttcggtccccaagtaaaatccattactgtgatcatggtaaagagtttgccaattatcagtctagaacagattaatcagatcaaagtttattttttgccatccatattcaccatgggagcgaggttccaatgaatattttaatagacggttacgctggtttcttcccgaaaaagaccaatttttaagccaagtaacgactgatgagatcctagcagcacttgaactaattaatcaacgaccattaaaaatacatcatcaacagactgccattgaaagattccgggcttgttcagattaaacttgtaatttgccaccaaataaaaaaccattccggtgagggatggttttttatttggtttcaatttttagcaaattatcacaaatcttatctgccactttaacaaaaacagcctgttcttcgggtgaaaggccttgaatcgactgttcctcaatggtgtgacaaatagcttcaactttgttcgctaatttcaagcctgacggagtaagttgcaccagtgtcactcgcctgtctgttgacgatttacaggtttcagctaattgtgcgttcacgaggcgtcgaacggatttagctaccgtagagtgatccacttgcatgatttcagcaagtgcattttgcgcctgttgtccattgtgagcgagtgtaatcaagatggtgtcctgacctggatataaccctagggcgcggatgccctttgcaatcagtgcttcgtggttgttaacgatacgtaaagctgacgcaccgactggataatcatcaaaaacaagcatggcaattcccccctctgtgttatacgttgccgaccacaaaagtgtaccaaattatgccgtgtatttcaattaataattctctgcttggaaagtaaattttaatgattgattacccactgattaatgagtaaatctacttgcttcgtgtcgttcatatccgaacgtgcgccactgaaggagagtacaatgctttgcagtgcaggtgccaagaatactttagcacccgtttcggggtcaaagtcgatcagttcatgattggcctgacggtaggcaagaaaatcggccaatttatccgttaagacactatattcctcgtcggtgatgtcttttagagcagggtataattcgtcttgaaaataaatgtcggcttgccagaggtatagattagggacaaacatgtccacgaacccctgattaatgatatgaagggcatcaacgattggggtttctttcagcgtatcgattttatcgcccagtgccacaaattctggtgtgacgtcgagttccatcaaggtctggatcaggttgactttaccatctggaaaatagtgatagaaggtagtgcgagttttattcgcatgctttgtgatgtcattcacggtagttgcagcgtaacccttagttttaaataattgacgtgcgctgttgatcagtgcctctttagtggcatcatagtaggcttgacgtttgcttgcgattgggaatcatcgtcctttctttaaaatcattagtactaatataacacgtttagtcgtttttttcttttttcgttgacactgtgttgacaaaacattgtgaaagaattattatatatttaatttaaaacgctttctcgttttggatggttaactaaaaactaaaggatctgattgaatgctgttagtaacgtgtgccaatggccaagtcggtcatcgaatcgtaccatacttgattgaaaagggtcaggatgtccgtgtcatggatattaacccaaaagttgaagactataaaaaaatcggtgctaaagaagctatcgtgggtaatggtactgacgaagcaactatggataaagccatgaagggcatcgatgcggtcgtttatctgccaccgctgtttacgtatcaggaagctaagatggggaagatggcgattgatgctgccatcaaagctggcgttaagcaattcatcgatatttcagtgttgttcccacttttggacaataacctgcaacaccggatgaagactgaagttgaaaaatacttgatgtaccgtggctgggaaagtcacatgctgtggacggtgcttcaacctgctggctatcaccataacttatacgttaagccgttctacgaaagtggtgaactaccaagttattcaccgttagaccaagtcatttccatggttgatgctcgtgatgaagccgacgttgtcttaaaggtattagctgatccagaaggctacgacaaaggcgtctttgcgttagctaacgaaaagttctctctacgccaggttgctgcattaatgagtgaagttactggtaaagaaatcaaaccagtctttgtacccaaagataagttacgggattactggccaaattacttcttgggctcagacagttatgcggaagaagccttctggcacatttacgatagtaaccagcgttgggactgggatggtaattttaaagaacttaactggttgctggatggcaagactcgttcactgcggtcgtactttgaagaagaagctaaaaaagctggtattccagtacacaagcaaaactaaacttgaaagggagcaatcattatgacccaaaaaattgtgactttaattactggtgctgaaaaagggctcggtttactcactgctaaagctttaagcaaggagggccaagctattgtgatcggtgccttggatgaggatgccgctaagaaagccgttgctgagattacagctgatggtggtgaagccagttacgttaatttagacgtgactaaccatgatcaagttaaggcagccggtcaatacgttgcagataagtatggttatttgaccatcttaatcaacaacgccggtatcgtgactgatgggcaacacacaccagtagacgtgccgatggatgcgctacgtaaagaattcgatgttaacttctttggttcagtcgacgtgagccaaacaatggtaccgttgttgaagaaggctgaaaacgcccaaatcattaatttgtccagcaacatgggctcattaggattagcaacggatacaagcttcccgttctataacttctactcaatgggatacggtgcttcaaaagctgccgttaactttgaaacgatttgcttcagcaaggcgctcaaagacgatggcattccagtcaattcagtcaaccctggattctctgatacggcctttggcggacgtgatacgaacgatccgaaacctgcaggcatgcaaactgccgaagaaggggcagcacaagtcatcaagatggctactcgcagtccacagacggatagtgctacgttcagtgaaaacgctgggatcgtaccgtggtaatttgaatgtaaataaaagaactagtatttggcggtttgcctgtactagttcttttttgaagcggcaaattacaagtttaatctgaacaagcccggaatctttcaatggcagtctgttgatgatgtatttttaatggtcgttgattaattagttcaagtgctgctaggatctcatcagtcgttactttggctaaaattggtctttttcgggaagaaccagcgtaaccgtctattaaaatattcattggaacctcgctcccatggtgaatatggatggcaaaaataaactttgatctgataatcctgttctaaggcctgataattggcaaactctttaccatgatcaacagtaatgattttacttggaccgaaggccccctaaacttgccaaaggcggtgtttagagccttagccgttctattaggggctttgatggcccatagaagtcgggtcttacgttctacgaatgtaaccgacatgatcgtgactcacttcgctagaaagcaccgtatctacttcccaatgaccaaaagctaaccgttgattaacagttgttggccgttgttcgatggaagtcccacttgtaaatttcccacgattttcgctcactcggtgctggcggacattccgattgggtagatcagtcaatttgaaggggagccagccacgattaagccaattataaattgacgcagtgctcaagttataagcggccgcaatggtttctggtgaccaggttaatcgtaagtgattggtattaaagtcgctaatctgctgccgtcacacgaacgacgaccgcaattccgccttttgcgatctgctcttctgagctaattctggatcataaggtttacccggtccaactcatagcatcgtagctttggcgacgcctaaggcgtcagccattacttggtaagatttatcccctcattgaccagttgtgctagtgcgcacgttggaaaacgtgataaagtagatgtacccaaagtaatcactccctatattggttggaattagctactaccattgtaagtgattgctttgggctttttaatttctgttcggattaattatagaatttgccaagctataaaagttattggaaacttcgcggattatttattcattaaccaagcatccattttagtatacaaagcggttaccatttctggttgatcaacacctggcaggtcttgaccaacttgataccctttttgattcagtacgtaagccaggcaagcgtaacttgatcgatattgttttaaatctgcgggatctaaagcgacatcagtagttggaactacgggaatcaaactgtcagcttcatagacacaggtcataaagttaatcagccattctccgttgatcttttgaacttcatagacgattttagcatctgaattcaagttgaacttaattccttgaatgtcttgttctgccaaaatggtggcctgcatgatagcaatcgcccggtcaccattcatccagacttgggtgttgtaaatgcggtgagcagcgcgactggtactggtcattttagcagattcatcgacgaatttatcagcgtttcccgtgtaccaggaaatgtcgatggatgcgtgatcgctataagttttcttcatttcgtcccacaagctgttatcccggcaaaagcgttcaaattgtaccaactcaatgatatttgccttgtctacgacttcttcagctgtaaatggtttgttcttggatagtaataacatcgtgtagcctccagtggtttgtcagtatttcaccgtcaatagtgaagtctgtttgtaaagtaacttaacaacactaatgcattatataataattgtcaatatcagctttaaacggtatcttttttaatttgtagacaataagcacccccgctcgaatataagcgggggtgcttaatgctaactagtttgggcaattattcctcaaacttcccagtatcttcatttaataaactgctaatatcgtggatttggtcataacgataggtgctgtcgtactggtgggtgtctttatcgtaggccttaacctgcaaaacatccgtgtgcggccagctaaccacgtaagtataatcgtcgtaatcaaagccatattgatccgcaatggcatcgataccggcttgctcgtcgccatggtattcttcttcaaagtgaccgtaattgctgttacttggcgttgagtcgctagaatcactactgctatcactattatcgttagtgtcagcgtcttgagtcgcggcatcggtactgtcaccactgtcaggcgttgatagatcgaccttaatgttcttagactgggtcgaaaccagattcttcgtcactgatttgccatctgcggtagaaccggtgctggagagtttgaaggtgtatcgtccaggaaacagcgggccagctttgtatgaataatgatcgttgctggcagtggcaacgtttaatccatttaggctaatcgtcgcttgatcaacatttgtttgaacggttgggtacatggcaactacttccagtttgtaggctgggaagaacagcagatggtggcccttagtaaccagtttaaacgtgccatcactggtttggtcgttattcaccaaactggacttcatatctgctagataacgcttgtctgagtttaagtagttcatgaaggggccaatagacttggagttgatctccaaactaggatcggtagtggtcatgtatttaacggtggcatcggcattgttgtcgtgcatggcggtgatcatctggtcaacctgcttggacttgctgtatttactgctaccgtaaagataagtcccagctaaaatcaggacgattaaaacgattaggctgatccaaactttcttttttccggatcctttttgccgattcttacggcgttttggcgttgcagtggtcatggttggttttcgtttgggcttaggtttgggtttaaccggttctggttccggtttaaatgacgctgattcaggttcaattggctcaggttcggacttagtgggctggggttcaggttgaactggtggaaccggagttggctcagactgatacgaagacgtttcattattattgatttcattgttgttgggtgtttcgccagtgctggtcatttccggttttaaccggtgaccgcagttttgacagaacacatcatcgggactaactggcgccccgcaatttggacacgttgacatatgactcacctctgagatttaaattgattgaagatgtaacgataagcattaggtaaagcccggttccagtacggccagttgtgattgccaaagtggtcgacttgataagtgggtttgatttgatgctgttgcagctgtttgacaaataaattgacgtcagcaatgggaacggtggtatccagcgcagtggtttcaatgtagaaatgagctggcgacctttcttgtgctaagtaggtcggtaaatagcgactaggctgagcttgctcgaaaaccttttggctgaaagcaccattaattttgaaggcgtccacctgcgaattagtttgaacggttggcggcactttttgccaaatggctggtgaaattaaggcatcgacagaaaagaggtgcgggtgccggaaggttaatcgagcagcaccatacccgcccatggagatgccaccaatggcacgttgtctttggccagccagctgataggttttggttgtttgaggaatgagatcatctaccacagcgttttccatcttctcttgagtggtatttaaatagaaggaattaccaccatcgggaaaaataacgaccgctggtaaatgtttttccgtgactaattgattcaaataacgttttgaatgggcctgagtagtgagattagtttcgtccccatacagaccatgtagcatgtaaataactggaaaatgggtgccttgttccttgagtcgctgataattccgtggtaaatacacgcgataatgccagtttcggtgcaactgtgagctataaatcacgcgcgagagcacttggcttggtgctggtgctgctctgacctgttttttagcagcacgttgactggttttactgactgttttagtcatctgttgttttgaatgctgaccggtttgcttttctggtggatttaacgaatgcaccaccccgcctaggattaccccaataatgaccacggcgaaaacgatgaccgtccaaagatgttttttcatgacgaagccccctgctaacttgtcaagaacggaattttaatattaagataatcttacataaatactgagagtgtgacaaggctaggtttgagtgaatattgcagacaaatgtctgataattaggtgaaaacgctttattgtagatggtcaataactgataacatttaacttagaaattttttctctatgaacacagcctgataagttacagaatattaaatatgtattataattatcaacaaaatgaacgattctgattcgataactacacttgacggcgattttattgagtcacgaatgggggcaagatttcaatatgactaaacagcaaaagaaaatgttgaacgaagtgtctgccgaccgaaaacaacgctacaaaatgtataaaagtggcggtatttggacgtttgcaagtatgtttctggtgttaggcgttctctggtcaggacccgcggttaaggttaaggctgatacaaccgctaaaactgccgttgcaaaacggtatacggctgggttagatagtcagcccgcatctgccagtggcagcgatggcacagcaaacgggacagacaatcaaactactgatccagcgacaacaccagctgctgctccagctacggatgctccagcccccacggatgtttcaacaaatgctactactaatataggaacaaatacggctgccaaaagtgacaataatgaagcaaccacgacaccaacaccagctgctcaaagtccagtggcgcctgctcccgctactgaaccagccgatacaactgccagtcaaccaaccacagccagcaccagcaatcaaattaccaccgccaacttaaacggcactaatccagctaatttgaatgctgacggcagtatttcaacggctgataagacgaatgtatctttgtcaggtgctagcgatattcaggataattttaaagcagaacaaatcgttaaagatgcaactggcaagattaccgcatcagacatcaccgacactatcaaagatggcggtgtgacgttggtacctaaaaaccaatcaaatacagctggtacgttagtcttcaagaatcagatcgataccagtcagccctttaccattaacgcaaagtttaccactgaaaatgaatcggcggatggcagtagcagtgatggcggtggactcgggtttattttgcaacccgttgatccacaagacgctggcgttgggccaggcagtgatccttcaacagatattggtattgatggtcagccgaacacaacttttattggccgtgacgggtataaatcacctgagcagcagtatggtgatacacagtggaatcagatgacggtgcgtcaaacagatagtactggacaattaacaaaagatacaccgacatggacttcagcagcaaactcggcattaggtttggggtggattggtcaacatgtttctcaaactgaatatggtactctgacttggacacccaagaccggtgttatcaatcacagcgtgtccggaacattaacatacaccacttttgtggatgagcaaagaacacagcaaattcaaacgttcacagctggtggggattcttcaaactggcttggtaatctgatattcgggacaaaaccattggttaccctgaatcagtcagtttcaattgccgcgtttggggcagtcggtgacgttagtggtgatggcagcaatgagagaacggtgacgattgaaaacgtcgccggtaaaagtgcctttactgctaaagttaacaccatgccggtccagatcaattaccttgatcaagatggcaatacgcttcagacatcggatatcaccaacgttaatgttggtgatacccttagcatcggtccagtaaccgatttgagcactgatacgtttgcgccacgggtgattaatggctatcagttcgttaaagccgtaactagtgaaggaaccaattcactgtcggttaccaataacgtattgaacgcgtcaactcaaaacaatcaaatcaataacattaatgtttattatactaaccaagtgaattacacgattcagccagtggatgctcaggggcaaagtatcgccggtttggcaccgcagcaaatgacctcaaccattggtcagcaagttgcgacaccggtacaagctgggtataccgctactagcgccagcatcatcgcacccgatagtgatggcagcgtggtgaacgtcatttatacagcgaataaagggactttaacggttacttatgatggcctgccaacgccaccagcagcggtcagtgtggttggcacggtgggaagtagctacaatatcgaaacgcctaccattgctgggtatactgccaacttggcatcggtccaagggacttatgttgatggtgaaaccacgctaaccgtgcattatacggcaagcgataatagttatcaggtgactcctgtggatagtactggtaaagtcattagtacattgccacagagtaccggaacctccaaaacgggcacgagtatcaatgtgccaacgtatgccggctatactttggctacagatcaaaccataccaacgactcaagctggtgttaggagctatcagctacgttatgtagccaacagttatcaagtcacagttagctatacggggttgccggatgacctggcacaaagtacgagtacagttaccgggactacgggagaagaatatcaaattagctcacccgttattgcgggttataccgctgatcagtcgctcattacgggtatttttgggccagatgatgcagcaaacggtaacttcactgttcattatgctgctgacactaaggactacaaaattcaaccggttgatgctaatggcaatccgattaccaccttgacacctcagcaatttgatggtaatacgggtgccccaatcgtttatccaacctatgatggctatacgttgcaggaaagtggtggcactatccctgctgtatcggataccatgccaacgattaacgttaaatatactgccaacccttctacggtcaccgttaattttgctggtctgccgaccgagttacccgcgataacgcaaacgggtgtaacggatgatacctatcagatcaatgcgccattcattgccggatatacacctgataacagtattttaaccggcacgtacagtaatcaagggcacttagaccagaccatcacttatactgcgaacgacaatagttataccatcaccccagttgatgaaaacggtgacgttattaatggcttggggcaaaccagcggcactgcaaaaacggatgaagtgattacgccgccagattataccaaggaaggctatcaacttgtcccagggcaaccaatcttggtaacgaagcctgggggcaataattatcaagttgaatatgtctctaatattgagaccataaccgttaactataacttgcctaaaggacagacgctgcaggcgcatgtcgaaacaggtaaaattggtgacgcttacaatattgtatcgccgaccattacgggttatacgcctgatataccagtcgtcactggcacgtatgtgaatcaggatcagacttttaacgtgacctattcaccgattaccgtgaccgtcacgattcagcatactgggttggactcagctacagctagcgctttcccggcacaaaccatctctggtcaatatggcgatcaatttaaggtggatgcagcaaacattccaggttatacgccagatttggcgacaatcagcggcgttttttcggcggataatgatgctaatatgtatgtcattacgtatactggcaagcctgccatggtaacgattaactatactggcgctaatgccacgcttcttcagtcagtaaatttaactggtgtagtgggtggcacatacacacaagcgtcaccagatttagacggtttcacagcagatcaggccgttattcagggtgtgtttacagcggataatgcgactgattctacaactaacacgccaatcacggtgggctatcatcgtaatagctcgttaacggaataccgattagttcctgttgatgtaaatggtaatccaatcactggtgtaataggtatcgatacgatagatagttttgccacaccaggaaccacgattgacgcacctgattatagtagtttagggtacgttacctcacaagaaccaattgttatttctactgaggccaccgttgatgctgtgcaaacagttccgattacgtatcaaaaacaggttacttataccctgcaagcggtagatgccaataatcagccaatcgcaaacttaccaattactaccgctaccggtatcgtggggccaacaaaaacgccgcctaccgttgctggctataacgcagtcaacaatacttatacggtgcttgatacagcaaccaccaacgataacccaattcagattcagtacacgcccaaagacgttgctgttacggtgataccagtcgatggtaacggcaacccaattactgatttggctcccattacagtgaatcaggctggcggtacgcagctagacgaatctacgctgccgcaacctggttaccaagttgacgatcataatgctgtgacgattccaatcagtgatacgggcgttacagtagccatgacttatcttaaaaaagtcacccttggattgaacggcagtgatagccagatttattcaaatagcgcgcaatcaatcgatccctctgagtatgacgttacgttgccggatggcagccgatacccactgaaagcgagtgatgttgaactcattggcgcagatttagccgttacaaaaacggttcaaaacgttggcacctatcaagttcgcttgaccgaaacggggaaggcggcgattgctaatgccttatcacaaaacaacgttgtttcctttgatgacacacaaacggggaagtttatcattacgcctgaaacattgaataccgcgccagcaaatacagcattagtaccggttaatgcgactgacccttcgcagaatcctcagttagcgactgcgattgtgattcagggcagtactaaaacctatgataataacccggcaacggatgccactagttttaaagttctggcgccaagcaaatttgcagacttcacgattcctaagttagaagttactgatttcaataccagtgcaatcaggcaggacgctgggaactatgaggtgactctaagtgccagtgggctgcaaaaactgcaggctgcgaataccaactatttttttgatgctagcaatgtgcaaaatggtttgtttgtgattacaccagtgccgattacgattacggcaccaagtgtaaccactgaatatacgggtgaaccagtatccgtgcctcagggagcggtgactactgattccggtgcgttcacagccaccccaagttacacgatttcggtggatggcgatgctcaaaacgtcggaatttatgccacaacggttcagcttactgcaggggctaacacaaactatcagattacgaccgtggctggcaacattgtggtcacgcccaataccaaagcaacggttacggtaaatggcggcagtaaagtttacgatggcacaacaaacgttgataccagtaagttcatagtgaacctatctggcggattagtagcaccaacatggaccgttgacgattttaatttaagggagatcaccagcgcaaatgtcggtgactatccagtaacgttgagtgccaagggcctatcagatttacaagcggagaatcctaattacacgtttgcacctaacaatgtggttgcgggaaacttcacaattacaaaagctcctgctaccattaaagtgttaaataagacacaaacgtattctgaccaggcaattacagctgctgacattccgtttacgattactggtgtggttaatggcgaaattttgaactactcattatctggtctggaagccaacacgaaaaatgttggtgatcatgtgattgcggtaaacgtagtcgctggtgataatcctaattacgacgtgacgacacaaagcggaacgttgacggtcacccaagccagcttgccagctggtagcgtcagagttaatggtggcaccaaagtatacgatggtaaggccaccagtgactttagtcagtacggtgtggcgttaagtggtgagttaaaagcaccaacatggaccgctgccgattttagtttaccgactaatattactgatgccactgatgttgggacttatacgatcagcttgagtggtaaaggtgtgagtgacttgcaagccgctaacttgaattacagcgtgacacctaaagacgtgactgctggtatctttattattacaccagcaccgattacggttacggcgccgacgctttccaaatcatatgatggtcaaacctataccggagaggattaccggccgatcgtagacggggtacccgctaatggtgaacggccaagctttacgttgccagacgtcagtggagataccaacgttggtacttatacgctcgatgcaacggccgttcagaacactgaaaattatgaggttaaatacattgctggttccttgaaaattacgccaaatacgacgactaccgtgaacgttactggtgtctctaaggtatatgacggattgggaaccacctactccgttgaactgcctactggtgtgaaggcgccagcgagctggacggctgatgattttaaggtgccaaaggatgcggttaatgctggcagccacacggttactttgagcgataaggggatcactgatcttcaagcagttaacagcaattacaagttcaccagtgccaatgttaaagctggcagcttcacaattacgaaggcggcacttacggcaactgttcacaatgtcactaaagtttatgatggccagggcttttcacctgatctggcatccttagtgacggtaacgggcttacctaagaacggggtcactgtcaacctttcagttaacgatttgagtcaggatactcatgtaggatcatatgacgtgatactgacggctacggataatccaaactatgatattcagatgactaacgggacattgacgattacacccaagcccatcgttaacgctatttccattagtcatgctgagaagacttacgataatgatgcgactcatgtaccggtcttcacattaatagggccgacggatgcagccgattatccaagtttgacattaccagtattggcagctaatgattttgatactattgctgccaagagtcaggatgttggttcttatgcagtgacgctaacagccagtggccgtcagaagcttaagagtgctaatgccaactatgacatcacggctgaaagtattcagccggggacattaacgattacacctcaagcagtgacgattgctgggccaacgttaagcaaaacctacgacggtcagccatacactggcgctgacttgaaagcgacagttaccggtgtgccagcgttagcaaccagtgataaagcacccgtttatcaaatggctgatatgagtaatattacggatgcgggggattatgtgattgcggttatcgctgataatacagtaggcgctaaccggaattacgcgatgacgttaactaatggtgcattaaccattaataaagccgcggtaaccatcagcgcgccgcagggattgaccaaggtgtacgacggcagtggttacaccgtttcaaataacgctggaaccgtgactggccaaccagtgaatggggaccaggttaagtatcatttatcatcactaactgatgcagtggacgcgggtacgtatactttgaacgttattgcggatgataacccgaactatgcggtgagcgtcgtgccaagtaccttcaccgtgacgaagaatgatcaggcaactgtaacgctaggtacggctagcaaagtctacgataacgatcctgcgacgacaccaatattcaccgtcgcgttgcccgcaggtgtgtcagcgccaaaatggatggctgatgattttgaattatcatcaaacagtcaaaatgtggggtcgtatgctgttcaactgagcacaaagggacttcaagacctgaatgctgctaacgccaactacagtttcacggcaactaacattaccgctggcagtttcaacatcaccccagcaacgcttaatgccggcagtgttgtcgtacaggatcaatcaaagacttatgatggtacagcgaccactgatccgacacagtacactgtaagcctgagtcagcaactgactgcgccgacttggacggctgatgattttgatttaagcgggattaccagtcagaatgttggcagttatgaagttaaattaagtgctaagggcttggttgatttacaagctgccaatccaaactacaagttgacatctgcagatgttactagtggtcatttagtcattactccagcaaccattacggttacagcaccgaccatttctaaagtttatgatggtcaggcgtacaccggtaacgtcagtttgacgctgacgggtgtgccaactgctggtgagcagccgagcttcaccatgacggatattagtgacgctaaaaatgcaggtacgtatagactaactgcacttaatggacaaaatcttgataattatacggttaacgttattgatggtgcattgaccataacaccagctccgattcaaatcactgcaccaacgctgaagaaggaatatgatggtagtccttatgctggctcagtaacaccagtgattgctgggttacctagtcagggtgttgctcccgtctactcgatgacagcgttgggtgacgatactaacgctggtatttacacgattgcggttaacacgccagcagatgagaatccgaactacgcaatttccactacggccggacagctgacgattacgccgatgacccctcaattccggtttgtggttgacgcaatttatcagagcctcgggcaacaatcgggtacgattacaacagatacaggagtgaaaattaatcagcctaagtggacaccggatgactttgttcgtgttgatatggggaatggtacctacactgtgaccctgagtgaacaaggattgaaggcacttcaggatgctaatccaaacctcgcaattagttcggctgatattacgcctagtcaaccgctgccaattgagacaccggctacgaataccacgccaactgatttgccaaccattgaggttaatcagccagcgttagagccggtagcttatcggattgaagtgacgagtattaccaataacgcgaagacctttaaccaagagtttaataagacgaaggagctagctggttcagcaccagagctggttgtatcgggtcagcaaggttcaaaccctagtcagcaggttgttaagcgtccaggcaagactgatactaagccaagcttacaggatggtaatcagacaactaatcggagcaaccatcaacggaaagtttcggttaccattcgtcggactgatcgaggtacgaaacgaaacgcagtgactcaatcaacgcagaacgtgaaagacaagaaccaatcaagcgcacagaatgaattaccgcaaaccagcgaaagtcagtcatcatggcttgctgcattaggggcaatgctcatgagtttattgggagcgttaggatttaagaaacgaaggactcgtcgataatttataaaaagatgatatgtattttttggaaaatatgtttaccagctacaaatatgttttttcaatgcagaatatttaccgttaatttttttaaacttgaatttttcttaataacaggtttacattgttgtacttacgttgtacaatgtgcgtcacgtgtcatttttaaggaaatgtgttatttaaaaaattaattagtgagggagaacaccaacatgaaaaaacatactttaggagcacttttattaggattagcaacagtaggcgtcttagggacgacaacggcttttgctgatgatgcaacgactggtaattcaaccacagcagacagcaaacagagtgcaacgacaactggtaacatcagttttagtggcggtactttgagtttgtataatgttacagattcagcagtgcttggcaaggaaggtctcaaagttagtgacgtttatacaaatggtattcaacaagccagtgctccgctcactgcatcggttgatgactttttgggagacggtaaagactggagcctgaagttagctcagagtggctggaaagccggcagtgatggttcagctgcaacggctactacgttagatactggtacactaactgtgacacctgataagggcgcaaaacaaacccttactactgcccctgtagaatatggtaaaggttcaactggaacagtgacacttccaggtacgcttaatttcgatttgcgtgcaggaactgctgttcagaccgggagctatacaaatacgctaacttggacattggatgattctgtaacagctaccgcaaattaggataaattatgacaagaaaacgatttttagagagtttagttgcctttgtgatgatgaccatgttgatgatcattccggtcacggtccatgctgctagcagcggattttcagtgcagccgattacttcgaaagcgcaacgagataaatccgagtcgtattttgacgttatcgtgaagcccaatcaatcaactgatttgaaagtcaaattggtcaaccgcactaaacaagcgattcaggttaaagtggccgttcactccggagaaaccaatgataatgggatggttgattatagtggcctgcaaaaaaggacaacacacttcgatatgatttatcccagtatttaaagggaccgaaaaaggtgacggtgccagctaatagccagcaaatttatacggcgaagttgaccatgcctgaaaatcagttaccggggttaatggctggaggattcacatttagtccaatgaactattcgacagccacgaaaaagagtgccaagttgtcgattactaaccggttcagttatggcatcgcggtcgtgacgcgtaatcagaatcgaacatggcagccacagcttaagataggccaagctactgttactcagcagcaagctaagaacgcaatagcagtaccaatgcataacgtgaaagctacctttttaaatcagctgaaggttaatgtaacggcaactaataagcgaacgcacaaagtatataaaagagcagctgatgcgatgcagatggcacccaattcacattttacttaccaggttaagttaccgaataacgtggcagcggggcgctatcttgtgagcacaacggcgtactacgttaaagatcaaactggtcagtatactgattcaacaggaacacactacaagtacaaaaccactaacacgtctgatgtgatagtgacggctaagcagagtaaagatttacagcagcgggcaaaacaagcacgcgggggaacaccctggttcatttatgcgattattgctttggtggtcgttttattgatcatcatcggcactttggttacacttttaattaagaagagatcgaaaaaataatctatagggggcgagcaatgatgagattgagaaagatgatcttcagttcattgttggccctttttgtgttttttttgattggcggaggtcagtctgttaaagcggctagttatgatgataatacgttggaatcttacgggattccggatgctgtcgttcaggtaatcatgagtaatagtatgtatgcggatggtaaatcgccgacacaggagggacaggaccccaccaagtttacggtcggagatgttacaaagctgcaaatcgtcagtctggctaatcggatgggctcttatcaatcaagagccgatagtagggttgccgattgggttgcaaacggcgcagctaataatgtatatgatattagtcctaatgtgtatgcacaaaataccgaagacaaggttacgggagatagtggcagtttggcaaacaaagcactggtctttaatgggcatacgctagataatcattacgctccatcgtttaatatgttgatgcaaatcattgcttcggcaaacaatgcgacaacggttgatttaacaggtgtgacttcagaggtgaaggataccactttggctcagtcactgatcagtttgttccagacaacccgcttatcgtcgcttaacacactattactgggcgatgacaatttaacggactttaagttttacatgatggggcagacggtgatggacgtcaccgatgcacagaatgtgacatccttagatctgtcaaataatgggaccagtcaagtggcctggggacaaaacttcccaatcatgcgtcaacttgacgatctcgacttagctggtaatcaagtggcaacaatcagtgatacgttgaacaatatgctgcagtcaattgttaaacatgccggaactactgatatgagttcaagtagcttgcagatgagcgactggaatacgttgcagaatattattgcggtgctcaatgcgactgaaggtgacattaagctcagcgataagtctgtcaacgatattgttaactcacaaccacaagcattgaatgatggggcagttgcagctgttttcaaccaactaaataccgactcaattcagaaattattgtctagtaacaatagtcttagtgagcagaccaaaactgctttaaccaataagttaagcggtaaggacgatagtggcggaactggtggcacatcaacggctggaaataacgtggcggtgtccggtaaccttgattttggaaccaactctctcagtgatttagattcgaccttccaggaaaatggtagcttagattttacagctacccttttgccaggtagtaagctgactgctacgatggcctcatggacagggcaagatggtagctttttttggggaatcattacacttcctaacaacggcatctttaatggtgacataaacctaaacaataccaattcgcctgttttgtctgaaaataaaggcaacgctcccgttactttgacacagcacacgttaacgggaataacgcttaacattcctgaagatcagcagactaggattcgggctacaagctataaaacaacgattacttggcatgttaatgccgaccaatcagctaatcaaaattagtgctatttagtgaatgaaaataggttacttaaattaaaactatcaggtaaaagtggtcttatgcttttacctgatagtttttttgaaatgaaacggtaatgaagaagactcaaaccctaagcaatggtattggaagcgcaagcaaacttaatggtttgaagtgtattattaaaaagagttcctaaacgtgctaaaaagacgtgctatttattacacaggtggtatgataagattcaaataagaaaatagttaacgctcaaataagcaactagcttgaagatgcaaaattaacttaagggagatgagttaattttttcgtttttgactagtgtcctatttgaatacggcaaaatactatcggtaataagggtcgttggaacaaattataatgtgcaatcaaacgattatcgttgtgatttgtaataactagctttattaagtcagcaagtgggggtacatgaggtacatgactaaacggcaaagagcgttattaaatgacgcaacgatacagcacaaagagcattataaaatgtataaaagtggtagtgcatggacttttgcctgcatctttttgatgtctggtcttttttgggcagcaccaacggttacggcgaaggcagcgggtacagcaattaatacaacaaattcttctacgactggtacgagcaatcagtcgtctgcggatggttctagcagtcagcaaaacattactactggtactaccaatggagcgaccactaaaggtgggaccgtacaaacaccaaccactggtgctacgggtacaactcaggctacgccaactgttaaagctgcagcggcaacgccaagtccaatgacgccgccggtttccactcctgctgcaacgcccacaacaccacagataacaacggctagtttaaatgggaccaatccggctaatttgaatgcggatgggactatttctaaagctgataaaacggatgtgaccacttcgtctgttcaagctgtgaaagataattttaaagcggaacagattactaagactgatagtaaagtcggaaaacctgtcgacgtttcggatactatcagcaatggcggggtgacactagtacctgcaagtaccagtaatgtcgctggtacgttagttttcaagaaccaaatcgatactagtcaggcgttcacttttaatgctacttttacttctcaagcagaccatggtggtggtggtattggctttattttgcaaccagttgatccgcaagatgctggtgttggtgaaggtagtgatccatctgccgatattggtatttacggtcaacccaatacgacatttattggccgtgatggctatgttgacacttcggatagttctgtaagagcggatactgactggactaatttaacgattcggcaaacggatggtaaaggtcttttaacggttacaacaccaacctggtcaaacagttcaactcctgccaagccctcccaaattactgtccctctgacggaatatgcaacattaaaatgggtaccacttcctggtgttgtgaaccataaagtgtcagggactttaacttatacgacctattcagatgctgcgcggaccaaacaagttcaaacactttcgactacttcatcaacttatattccaacaactaaaatcagttcgataaccttaaatcagtcagtttcgattgctgcttttggtgctgttggtaatcttaataagggtacaaaccagcggactgttcaggttgctagtcctgctgacaaaggtggaactgcaacccaaggtggtttcacagccaaagttaacaccatgcccatcaagattacttacgttgaccaagaggactctaaggaactacacgctgcggatacgacgaatgttaacgttggggacagtttgacaattgcaccaacaaccgatttaagcacgaacactttcgcgccaagaccgattgatggttatcggtttgttaaagcagttgctagcgatggttcgaacgccattacggttacgaacagcgtgttaaacgccttaacttcaaaccctaacgtcaacaacatcacggtttattatacgaatcaagtgtcttacacaattcagccagtgaacgctcaggggcagagtatcgctggattagcaccaactcagggtaccggcacaattggcaattcaattgcgacaccagcctatactggctatactgctgggacgccttccatcaaactttctaacactgatggcagtattgtaccggttacttatacagccaatcaggggagtatatcggttagctatgtaggacttccagcaaatttgacgcccgctaatggcacctttaatggaccggtaggcagtacttatgagattgattcaccaacaattgctggctatacatcggaccaagctgcaatttcaggcacagtttctaaaacgggtgatacgtcatttacggtgacatacacagcaagtaataatagttatcaaatcattcctgtggatgctagtggtaaagtgattgctgccttaacggccatgactgaaaccagcttaactggttcgaagattgttacgccaacctatgctggttacacgcttgattctgctcaaacattgccaatgacacagtctggcgtgttgagctatcaagtgaagtacaatgccacgccatacacggtgacagtaacctacactgggctgcccactgcgcttaagtcagggactgcaagtggcgcaattggtacggtttatcagattaattcgccaattgttgctggctacacgccaaagcaaacggctgttactggtaccttctcgaaagatgattctatccaagtaacttataccgcggatacccaggtatacaaagttcaggctgtcgacgctagtggtgtaccgattgccactttggttccggtacaatatagtggtaaaacgggtgataccattacttatccgttttatacaggctatacggctaagaaaaatggtgaaaaagtgcccgctgtatcgaagccgacaccatcgattaacgtcgaatatgatgctaatccttcaactttgacagtgacttataaaggtttaccttctggagataccagtaaggttattaccggtgtgacagatggtatttaccaagtggtcacgcctaccgtagctggttacactccagataaagctatcgtaactggtacctatagcaattcaggcaacagtacgcaaaccgtaacttatacggctaacaataatagttacacagttacgccagttgatacggatggtaatcctatcgctggattgagtacgactagtgaaacgacgccaacaaatgcgaaaattaccatacctgattatagtaatcaagggtatgaaccaattgctggtcagacacaagtgacacaacctggtgtgactaattatcaagttaaatattcagctgaaaaacaaactgttaatgtcacatatgatgggctaccaacggatcagacgcctcaaagccagactgggacattgggtgagacatataattttgtttcacctacgattattggttatacgcctgataatgctgtcatcaatggcacctacactaaaggcggaaacaccgactttacagttacttacgcagcaaatccagagacagttacgattactgcagctgggttggatccaactactgctgctgagtatcctgttcaaacggtaccgggcaaattcggtgaaacatttactgtaaacgcaccgacaattcccggttatacgccagataaaacaaagattaccggaacgtatagcgcggatagttctaataatatgtatgttgtgacttatactggtcagccagcttccgtgaccattaactatactggtgcaagtaagaaccctgcatctgttactttaacggggatcgttggcgggtcgtattctcaattaacgccttcagtaaccaactacacacccaatcaagcaacggttgctgggatgtttacagcgactgatttaactagcaaaaaggtgacaatcacggtgaaatattcaccaagtaaggatgcctatacaattaaaccggttgatgctgcagaggattctatttcaggattgaattcaacactggttgtagctgtaaacggcaaaattacattgcctgattatagcagtcagggatacgttcacgtggttacgaatactcaagggcagtatgtagttgccggtcaatccgacaatattattactgcacctgcaagtaatcaggatccaatcccagaaacctatcaaaaacaagtttcatacacgatgttacctgtggggactaatggagaagctatcaacaccttagcgtcagttaccgcagttggacttgtcggtcaagagatcataccacctgttgaaccgggttatgaattagtggatagttctacaaaacatacagtacaagacactgactcagccgaaattattgacattgaatatcaaactaagccagtgacggtgacagttgttccagttgatggcaatggacaagctattaatggtctccaaaccacggtggttacggatgatggcaagacgcctagtggtgggacgagttttactgtatcagcgccaacctatgaggatgagggctatcagcctgccttatctgacactttaaatattacagtaccaatttcagataatgagtatatggttcaagtaccttatttaaagatgttcacgactgggttaactggtactgagagtgaaacctataatggtgcaactcaaataattgatcctgatgactatacagtaaagttgcctgatggaacgaattatagtttgacagtaaacgaccttcagttagtatccgatgatgcctctaatcctgttgatagcaccagcacaggtgcaacggatgctggcagttataaggttgagttaacagcatcagctaaacaagcaattcaaaattcgctatctaaaaattatgcagtaacgattgatgatagtaccgatacgttcacaatcacaaaggcagcattaacacagccagtagctaatacagctaaagttcctgttaatgttgctagtccagataagaatccgcagttggcaacttcgattgtggttcaaggtgcatctaaggtatacgacggtgatgcttcaaaagatccgaaaacctttaatgtgcttgtgcctagtcagtataaggactttaagctttctactttagatgctagcgattttgattttagttcgattaatcaggatgctggtagttatcaagtcacgttgaataatcaaggaattcaagcgctgcaagcagataatccaaattatcaatttgatgctgctgatgtgcagaatggattgtttgttattacaaaagcaccagctgcgattacagttagtgatagcgccaaggtatatgatggcactacgaatgtgggtgctacacagattgaagtgactagtccagagagtgtgaccattccgactttgaccactgacgactttgatttaagcgggatcacgagtgccaacgttggtagctatgcggtaacgctgaaccaagctgggattgaagcactgcaaggtgcaaataagaactacacaattacgagcagtaatgtggcagccggtaatctgacgattacgccggatacaactgccacggtacagattagtaatggtaccaaggtttatgacggtaccacgaacgtggataccgcgcagtttaaggtgaccggtccagagggtgtgaccgttccgactttgaccactgacgattttgatttaagcgggatcacaagtgccaatgttggtagcaactatgcagtaacgctgaaccaagctgggattgaagcactgcaaggtgcaaataagaactacacaattacgagcagtaatgtggcagccggtaatctgacgattacgccggatacaactgccacggtacagattagtaatggtaccaaggtttatgacggtaccacgaacgtggataccgcgcagtttaaggtgactggtccagagggtgtgaccgttccaactttgacggctgacgattttgatttaagtgggatcacgagtgccaatgttggtagcaactatgcagtaacgctgaaccaagctgggattgaagcactgcaaggtgcaaataagaactacacaattacgagcagtaatgtggcagccggtaatctgacgattactccagacacaactgccacggtacagattagtaatggtaccaaggtttatgacggtaccacgaacgtggataccgcgcagtttaaggtgactggtccagagggtgtgaccgttccaactttgacggctgacgattttgatttaagcggaatcacaagtgccaacgttggtagctatgcggtaacgctgaaccaagctgggattgatgcactgcaaggtgcgaatacgaactacacaattacgagcaacaatgtgaccgttggtaagttaaccattacaccgaatacgcaggcaacagttcaggttcaggacagtgctaaattctacgatgggaccacgcaagcggatacgacgcagttcaacgttaaactttccactggcttagtggcaccaaagtggcaagctgaagacttcaatctgagtgggatcacgagtgccaatgtcggtagttcggtgattaaattgagtgatactgggctgcagaagctacaaaaagctaacccgaattacacaattgaaagtgccaacgtgaccgatggtcagttccacatcacagcggcgccagtaacgatcatcgcgccaactttgacgaagagttatgacggtcagagctatactggtagcgataatcaagcaaaaattgtcggtcagcaagcggctaaattgaattacagtctgactgatctgagtcaggatacaaacgtacaaaccgacggttacgccatcacagtgcagttgggtgacaatcctaactataatgtgaagacggttgccggtaagttaaccattacaccgaatacgcaggcaacagttcaggttcaagacagtactaaattctacgatgggaccacgcaagcggacacgacgcagttcaacgttaaactttccactggcttagtggcaccaaagtggcaagctgaagacttcaatctgagtgggatcacgagtgccaatgtcggtagttcggtgattaaattgagtgatactgggctgcagaagctacaaaaagctaacccgaattacacaattgaaagtgccaacgtgaccgatggtcagttccacatcacagcggtaccagtaacgatcatcgcgccaactttgacgaagagctatgacggccagagctatactggcaacgataatcaagcaaaaattgtcggtcagcaagcggctaaattgaactacagtctgactgatctgagtcaggatacaaacgtacaaaccgacggttacgccatcacagtgcagttgggtgacaatcctaactataatgtgaagacggttgtcggtaagttaaccattacaccgaatacgcaggcaacagttcaggttcaggacagtactaaattctacgatgggaccacgcaagcagatacgacgcagttcaacgttaagctttccactggcttagtggcaccaaagtggcaagctgaagactttgatctgagtgggatcacgagtgccaatgtcggcagttattcaatcggtttaagtcaacaagggctgcagaagctacagcaagctaacccgaattacacgcttgaaagtgccaacgtgaccgatggtcagttccacatcacagcagcgccagtaacgatcatcgcgccaactttgacgaagagttatgacggtcagagctatactggtagcgataatcaagcaaaaattgtcggtctgccagccaatccgcaaacggctaaattgaattacagtctgactgatctgagtcaggatacaaacgtacaaaccgacggttatgccatcacagtgcagttgggtgacaatcctaactataatgtgaagacggttgccggtaagttaaccattacaccgaatacgcaggcaacagttcaggttcaagacagtactaaattctacgatgggaccacgcaagcggatacgacgcagttcaacgttaaactttccactggcttagtggcgccaaagtggcaagctgaagacttcaatctgagtgggatcacgagtgccaatgtcggtagttcggtgattaaattgagtgatactgggctgcagaagctacaaaaagctaacccgaattacacgcttgaaagtgccaacgtgaccgatggtcagttccacatcacagcagcgccagtaacgatcatcgcgccaactttgacgaagagctatgacggccagagctatactggtagcgataatcaagcaaaaattgtcggtcagcaagcggctaaattgaattacagtctgactgatctgagtcaggatacaaacgtacaaaccgacggttatgccatcacagtgcagttgggtgacaatcccaactataatgtgaagac

SEQ ID NO: 712 - DNA, 83274 bp, Unknown
  Metagenome-assembled genome
catcataattgagagtttgatcctggctcaggacgaacgactggcggcgtgcctaatacatgcaagtcgaacgcatcccgctaattgaagtgtgcttgcactgattttcatcattggatgaagtgcgaactggtgagtaacaccggggtaacctgcccgaagcagggataacacttggaaacaggtgctgaatacgtataacaactgaaaccgctgttccagtttgaaagatggtttcggctatcacacttctggatggacccgggcgtattagctgttagttggtcggagtatggttcaccaaggcaatgatacgtagcccacctgatagggtaatcgccacaattgggcactgagacacggcccaaactcctatcgggaggcagcagtagggaaatcttccacaatggacgaaagtctgatggatgcaacgccgcgtgagtgaagaaggtgttcggctcgtaaaacactctgtgtttgagagaacgacactctgtagagtaactgttcagtgttgttgacggtatttaaccaaaagccacggctaactacggtgccagcgccgctgtaatacgtagggtggcaagcgttgtccggatttattgggcgtaaagcgagcgcaggcggttttcttaagtctgagtgaaagccttcggctaaccggagaatgctcaggaaactgggagactgagtgcagaaaggacagtggaactcacatgtgagcgtgaaatcgtagtaatatggaagaacacctggcgaagtgcgctgtctgtctgtacctggataccccggctgatggctcgaaagcatgggtacgaacaggatgtagatccctggttaggtccatatctgccgtaaaatccgtatgaagtactctggtgttgagggttgtccttcgcccttcagtgccgtctactaacgcattagtcttcctgcctgggagtacgaccgcaatggttgaaactcaaagaattgacggggccccgcacaacggtggaagcagtggttttagatgtcgaagctacgcgaagaaccttaccgagaggtctgacatactgtgctaacctacagatgagggcgttcccctttcggggacgcagatacaggtggtgcatggctgtcgtcagctcgttgtcgtgagatgtttgtgtaattccgccacacggagcgcaacccttatttggtcagttgcccagcatttagttggtgcacaaatctgggcgagactgccgtgacaaaccaggatgaaggttgggatagagtcaatcatcatgccccttatgaccctgggtctacaacacgtgctacatagatggatggtacacaactgagtcgcaaacccgcgccagggcaagctaatctcttaaaaaaagcattcccagttctgatcgacatgatggctgcaactacgcactgcacgaagtcggaatcgctagtaatcgcggatcagcatgccgcggtgaatacgttccctggcgcttgctaacacgaagccagtgcccgtcacaccaatgagatttttgcaacacccaaagtcggtttcggtaacccttgtggagccaaccgcctaatgttgggccaattgaatttagggtgagcgctaacaaggtagccggagtagcaacctgctgctgatcacctcctttacgaagatactacgaacctgcacatgaacaaaactttgtttagtttcgagaggtctactctcaactagatataacgctttaattgggccctatagctcagctggttagagcgcacgtcctgataagcgtgagggtcgatggttcgagtccatttagagccactcaaaaactttgtttgttagggaatttagtcagagggagagccctgctttgcaagcaggagggtcagcggtttgagggttgagcgatccgtcattctccattgatttccgtaaatggaatcaaaaatttggttgctttgaaaactagatatatcaattttctttatagttaattaatttcattaattaagccgagaacaaccgcgtattttgtgagtgttttattagtaaagtttatttacgtattcgcgtaatactcaattaataccgtcccgtagtggatgaggtttagtaaaagggcgcctggtgaatgcctattggcactaggagccgatgaagaccgggactaacaccggatatcttcggggacgctgcagtagcgagctttgatcccggagatgttccgaatggggaacccaacatcttagtcgatgattaatgcttatggaatgacatactcagtattggcgagctggggaacgaaacactctaagtaccccagtagaaaagcaattagcgcatccatagatgacggcgagcgcaaggtggcgtaaaagccccaaaccaggagcttggctttctgggtttaggacggaacatttgagttaccaaagtaacagaatagtccgaacggtttggagaagacacgtgccatagcggtgatagccccagtcagacgaaatttttccctcaggtttcaggacctgagatacggccagacactgaaacccgttcggaattccgggggacgtcatctcccaaggctaatactgcccagtgaccgcgctagtgaaccatacccggtgaggtaaggtgaaaagcacccccggaaggggagtgaaatagtttcctgaaaccatgtgcctacattagttggagcccgttaatggtgacagcgtgtgcctttgtgaaatgaaccggcgagttacttaaatgcaagtttagatgaaatcggaagccgtagcgaaagcgagtcctgaaacgggcgtttcgtatgttgatgtagacccgaaaccaggtgacctaaacccttttcgggtgaaggtgtccgtaaaacgcactggaggcccgaacccgtgtaacgttgaaacaagtgctggatgaaggtgtgggtagctgtgaaattcccaacgaactgggatagctggttctcctccgatagcttagggctttgcctcggaaaggacgtggaggtagagactgtttttggactaggtgccctccggttactgaatgcagataaactcccgaatgcatagatttaatatccgggagtcagacggtgagtgataaatccatcgctaaaggggaacagccccgacccaccattaaggtccctaagtgtatcctaagtggaaaaggcgtggagttgcataacagctaggatgttggccagaagcagccaccattttgaagagtgcgtaatagctgccacttagccgaagtgattctgcgccgaaaatgtaccgggctaaggctaccaccgaaattgtggatcgaccaataggtcgcgtgatagtagaagtcgttctaagggcgtgaagcgatcgtaggactagtggagcgcttagaagtgagaatgccggtttattagcgaaagatcatgtgagaatctgatcccccgaatgactaaggtttcctcctgggtaatgctcgtcctcccaggtttttgtccgacctaagtcgagccgcaaggccgtagacagatggccaaccggtttgatattcctgtactagtaagtatgttgagcgatggagggaccagaaggctaagccgtgcgcacgttggataatgtgcttcaagcgcagtcggttgttagttaaatgctttcaaaccgtgtagacaagctttgattggaccgaatttaagtaggggaagtggctgatgtcacgctctgccgagaaaagcttctagtgagtatcttactacaccctaccgcaaacgcgagacaacaggtagtcgaagaagagaatcctcagtgattttgtgactcattaatattactagcgaaattgacttcgcaaattacatttgatatcaaccgaaattgatataccctgcacatttgtgaaacaaaactttgttcagttttcaaaggtctacattgattgctcattgcctttcgacaactattaaatcatatcatgttggcttgtatcttgtcaacgttttttataacttatttgaatagatattcaaatgtgtttgttgtcgcagacgttatctctttgacaacgataactactataccagctatctaaagcaaggtcaacacccaaatgcaacttttttaaaaaatcgcctatgttttgtctaaacaccgtttaaaggctgattttttcaattaaaaacgcctacctgattaattcactgactttttctcaactatgaggctttgatcttcctaaccgaaaactctaactgcatttatatagaaaacttcaatctatatattggcatctacccgcttcaataatgactagctaagcccagttacgcacgagaatacgtaaaagaaaaggcctgaccacgagcatcattatactcgcagtcaaaccatttttctaatctattatctcaattaagtctactattcttctggacgcattgttgggaacaataatacatcccgaattgattcagcatccgtcaacaacatgactaaccgatcaattccaatgccgagtcccccagtaggcggcataccgtattccaaagcttcaataaagtcttcatcgataccctcagcttcatcattaccttcagcacgttccttaacctgtgcctcaaatcgctgacgctgatcgattggatcattaagttcagtaaaggcgttcgcaaattcattgccaacaatatagagctcaaatcgattagtaaagcgtgggtcgtctgggttcttcttagctaacggcgaaatttcaacaggatgaccgtacacaaatgttggctgatccagttttggctgtaccagttcctcaaagaatgcattaataatatgaccaactgcccagtagtcttcatagtgaataccatggtcatcagctaatttacgggcttcttcgacactcatttttggccaaaagtccacgccggtatattgcttgattgcatctaccatgtggattcgtgcaaagtccttcttcaaatcaatctcgttgccttgataagtaatcacaccatcatctgtcactgctttagcagctgccttaataatgccttcagtttcgttcatcacatcgtgaaaatcgaagtaggcaacataagtttcaagcatggtgaattcaggattatgccgagtgtccattccttcattccggaaaacacgtccaatctcgtagacacgctccatacccccgacaatcaggcgcttcaagtgcaattccaacgcaattcgcaggtataaatcaatgtctaacgcgttatggtgcgtaataaatggccgtgcattagcaccaccagcctgattatgcaaaacgggtgtttcaacttccagaaaatcattgccatctaaataactacgaatagcagtgatgattttactccgcttcttaaaccggtcaaagctctccggattagaaatcaaatccaaataacgttgacgataaatttgttccttgttctgcaaaccatgaaacttatctggtaatggccgcaaagcttttgaaaggaacgttaatttagtagcccgaatggtcagttcgcccatatcagtcttgatgatgtcaccttcgataccaaggtgatccccaatatcagaacgcttgaaaatgtgatagacttcgtcgcctagaatatctttacggacgtaaatctgcattttaccggtgcggtcttgtaaatcagcaaaaccaactttacccttaccacgtttagaaaccatccgacccgcaatgatcgcagtcttatgcaaatcattgagttcgtccttatcatcgtcaccgaattcctcatgcaattgagctgctaagtaggttctttcgaatcgatgaccaaaaggatcaattccttcttcacgtagttcgttcatcttctcgcgacgaactcgtagttggtcattcatttctttatcttttccagccacactaatacctccatcttataataactagtccgctattaattttgacaaccctcaataaaaaaagcaagctcttttgcctgcttttttcaaattatcgcccattaacgggtaatgctgctaatttttctaaaaacgcatcgaaaatatcgttcatttcctgttctgactcagcactgttcaacgccgccttagtccgagcagaatgtgaaatcccctttaagtaatatgccgcttgtccacggaattcacgaggacccacatattcacctttcaattcaactaaccggtgtaaatgttccttagctgtctgaatcttcttttccggggttggttccggtaataactcgccggttgctaaataatgctcagtttggcgcagcatccaaggattacccattgcagcacggccaatcatcacggcgtcagcaccagtatgatccaacatccgcttagcatcctctgctgatctaacgtcaccattacccataaatggaatggttaattgatcggcaacttcctttaaaatatcccagtcagcgtgcccttgatacaattgcttccgagtccggccgtgcatcgccaaagctgaagccccagcacgttcagctgccaaagcattctctacggcatagatatgcttgtcatcccagccagttctcatcttaaccgtcaccggtttcttaactgcatcagtgacataagacaccatttcataaaccttattaggatccagcaaccattttgcaccagcatcggtcttaacgactttattcactggacaacccatgttgatgtcaatgatatcagcggccgtattttgatcaacaaactttgcagcttgcactaaggtttccttagtaccaccaaaaatctggatactcattgggtgctcgctggcatcaacaaacatcatatccaaggttttttgattatgatacataatgccacggtccgagatcatttcacagaccacaagtcctgcaccaaattctttacaaatgacccgaaaagctgagttagttaccccagccatgggtgcgacaacgacttgatttgctattttaacgtcgccaatttgccattccatatgctcacctctaaaattttactctctaacttaatttctgcgttagctatcatagcacattctagtaacgactggctactaacaacaggttaattacattgttgctaaaattgctttcaattcatcttcactaaattcatacttgttcttacaaaaatggcagacggtttcagcatggtggtcttcattaataatttgttccaactgctttttagaaatacttgccaatgccttgctaaactgtgcttttgaacagtcacacttaaatgaaaccggcatcttatccagaattttgacgttttcttcgccaaataacaagttcaacatatcctctggtttttgcccatcaagtagcagttcagaaaccattgggacttcctttagccgcttttcaagatgactaatcgcttcatccttggcaccaggcatgacttgtactaggaagccaccagcaaccttgatactattgtcatcattaacaaagactgacacaccaacagctgaaggaatctgttcggactgtgccaaataataagtaaagtcgtcaccaatttcaccagaagccaatggtacttgcccggtatacggcttgtccaacccaagatccttcgtcactgaaagtgaaccttcaacaccaacagctttcgccacatcgattttatgaaacttgttgagtggcaaattcacgtgaggattctgtaaataacctttaacagtcccgttagcattcccatcaacaacgataccgccgactggaccgccaccgttgatccgcacagttaaagtatcatccccctttaagactgaagatgacagcattaaagtggcaatgagagtcctgccaagggcagcagaagcagcggaccaggtatcgtgtcgttgctgagcttcgcgaactaattcggttgcatcgacggcataagcgcggaattgaccgtcgtcaacaacgcttttaagtaaataatctgacatagtgtcctcctaaaagaatttctagagtagtataacacaaggtgcgaaagctggcgtttagaaagtggagtgcaagtagacaatggcggaaatcccgatcctggatttctgacgttgtttgcttgcatgcagctttctgccagctggagcctaattagaacaaggtgcggaagctgacgattagagagcggagtgtaaggtgctttcggcaaaaatcccgaacttggatttatgtcggaagtgacttacatgtagctctctgtcagttggagcccaattaagctacgttaaattaaccagctaaatacacatcaaattcatcccattttaacctcacaaaaaagcgcaagcccacggcctgcgcttttcatcaactctaatcctcaccatcatccgaatgatcagattgatcatcagcatgctgttggttagaatcacccttatcagaattagtctgagctgggttttgatcactatctgaatcagactgaggagcatctgaagtttcagtagcgtcttctttgttttcattctttgccagaatcttagcttgacgttctgcttcacgccgttcaagttcacgtttagattgttcaaaggtggcagccttctcacttggaaattcactgtcattctttttatctggcatttgaccagtgttatagagactgagaatttgcttttcatccaacgtttcatacttcaacagtgcttcagcaatgattttatgctgttcacgatgttctgaaagaatctttcgagcagtttcgtgagcttcattggtcaaacgacgaacttcttcatcaatggctgcagcagtcgcctgtgaataagatggtgcttgtccataagcagctgcttcttggctgttagcactctctaaggcaaccgtcccaagcttctcactcatcccatactgggtaaccattgcacgggcaatttgagttgcctgttcaaagtcgtttgaagcgccagacgattcagaatggaagatcagctcttcagctgtccgaccacccatcaggcctgccatttgttccttggcgtcccgcttgctcatgagcatttgatcctcacgaggaagcatgatagcgtatccgccagcacggccacgaggaacgatggtaaccttatggacgacccgtgcgtcgtttaagactaacccaacgatagtatgcccggcttcatgataagcaacggtttcccgttccttcttgctgataacccgattacgcttagctggtccagcaatgacacggtcttcagcttcatcaatatcagaagcatcgatttgcgtcttgttgcgacgagcagctaacaacgcaccttcgttcagcaggttttccagatcagcaccaacaaatcctggggtttgcttagcgatttcctttaaatcaacatcattagccaaaggtttattgcgtgaatgaaccttcaaaatagcttcacgtccgttgacatctggacgaccaactaggatcttccggtcgaaacgacctggacgaagcaacgctggatccaaaacatcagaacggttagtggcagccataacgataacaccttcgttaccagtaaaaccatccatttcaaccagtaactggttaagggtttgttcacgttcatcgtgaccgccacccataccagcaccacgttgacgaccaacggcatcgatttcatcaatgaagatgatggaaggcgcgttcttcttagcttgatcgaacaagtcacgaacacggctagcaccaaccccgacgaacatttcaacgaaatcagaaccggagattgagtagaacggcacaccagcttcaccggcaaccgctttagcaagtaaggttttaccagtaccaggaggcccctctagtaacacaccagatgggatccgggcgcctaacgaaacgaacttgcgcggatctttcaggaactcgacaacttcgaccagttcctgcttttcttcttcttcaccagcaacatcagtaaagcgaactttattttctttactgtcagttggtttcgctttggatttaccaaagttcatgactttgccattcccgccaccttggccggcctgacccatcatcatgtagaagaagaaaatgaacgcgagaagaggcaatacgtaaactagtaagtttacccagaagccactggactcttcaggcttggtattcatcttgacgttatgatccctagcataacgcgttacttcactgacactggagttgttttgcaacatggcagtgctgaagtttgtaaccttagagctggtgttgccaccaagggtaaaaccagtctgggtcttagccttttgcgcttttcgatactcaccggtaactttgtagacgccaccagatggttgaacggaaaagttcttaacgttgttatcttttagttgttggatgaactcgcttgattgaatatcttgggattgcgagcttgagttatttccttgaaagaagtaaataacacccatgaccaacaagaagatcacaatgtagaaaagactatttcgaaaaagcccatttcttcgattgttcatttagtgcctccttacttcgattccctgtttattgggaacgaaactgagggacgattccccccgttgataaaaattatactatcacatttgaccttatttgactaatgttttattcggaaatttgaccttttttgaccaatcttttaattagcgtaaacttccggttttaaaaccccaacgtaaggtagatttcggtaatattcaacgtaatcaagtccatagccgactaagaactcatttggcacattaaaaccaacgtaatcagccttcgcttcaactactcgaccttcaggcttatccaagagcgtgcagacttttaaagatttaggattccgttcagataaccgttcccgtaaatatgccaacgtccggccgctatctaaaatatcttcgatcactactacgtctcgaccgctaatatcagtatcaatatcgtgaactaatgttatctctccggttgaagcggtaccaccatgataactggacacatcaataaaatcgatgtctgcgagaaaatcaagttctcgtaacagatccgtcatgaaaaaaataacaccctttaatactccgatgaacagcggttttttacccgcgtaatctctggtaatgtcagctcccaaacgttggcaagcagctttgatgtcatcttggctgtataaaacacgctcgatatcgttattcattaattttgctcctctagtcagattgttttaaaaccagttcgtagttaggttcagttaaatcacgcgtgctgcgctgcacccctatcagccacaagacttcgcccgtggccgtcacaactaccagttgctgtgaccgttttgagcggggtactttatggtcaatcaaaatgcgtcgaacggtcttatggccgccaccgataaggttaatgcggtcatccggcaaggcctgcctaattgataacggcagttcattcggcttcaattcaagcgtcatgtgacattttttcaaatgttcggttgttcgggctggttcaagacgcgcttgtaacccccgtgataactgaacccactggttagatattaccacaattttatctgctggtttgtgattttggggaacttttaatactgatttaattgaaaaacgatcataggctttttcgaagacctgggaatgtgccaaattcacttcaccatttggcttttcgtcattatttagcagctgagtggcttcctcaacatacgaggtcgtgatgggcaggtctgccaacttaaaaaccgcctttaaaactgcctgctggtgaatcaacgctaactttcgccaccgcataacactatacgtgccatcatcaagatcactgcgtacctcctgcaatagttcctgggttcgttcatcggccaactgaatagttgccgtcaactgtgatgtatacgcctgaacgtgctcgagaaaggcgggattttcctgcttaagtaacggaattaactgatgtctaacacgattacgaaaaacatcatccacttgatttgtttcatcctcataccaggttaagtgtgactgctctgcataatttttaatctgggccttgctgaaagccagtaacggtctgattaatttaccagtttcaaagggttgttcaggcagaatacctcgcaattgcatcagttgaccgccacgaacgagtttcatcagtaccgtttcagcctgatcatccgcatggtgagctgtcagcaaacaactcgcatgatatcgctgcatcagctcagcaaaaaaatcgtagcgaaagcgtcgggcagccgcctccacccctgtctgtgggtggtttgcaactggccattgcgctatttctaactgaatgtggcgctgatggcagtaatccatcatgaattgctcctcaatctcactttgttgacgcaatttatgattaacatgagcaaccactaatttcggtcgtacattgactggtaactgctgcattaaagtaagaagtaccatcgagtcaaccccagccgatactgctactatgacagtttgattcgagtcaaaccagttagcctgaataactatcgacttaaactgttttacaatatccatcttgtattcctcatcaattaaaaaaagaagcatcccttacaaaacggctgctttgcaaacggacgcttcagttcaattgttgtctgataaattagctacgacggccaccgcggccaccacgtttcccttcagtgttacgcttgagggttgctagtcggtcttcactttccttcagaaagccagacattaaatcatcgaaactctccttatggttcgaattcgagtggttgttatttcgggagtgtccaccaccgttgttgctattacgataatgaccgttgccaccaccgtggtaattgttgttattttcatgatgctcgtgattattatgatgttcatgttctgaacggtgttccgagtggccttcaggtttatcctgtgccttgcgaattgataatgcaatcttaccgtcatcaccaatattcaaaactttcaccgtcacttcgtcgccaatgctcaaaacatcatgaatatcttttacgaaaccatctgagacttcgctgatgtggactaatccagttttatgatcacctaaatcaatgaacgcaccaaaatttgtgatgcctgaaactttaccagcaactttttctccaacctcgattgccataaacaagaatttcctccttaaatttgtattaatagtatagcacatttcttgtcaaacaagtctgaacatggcacgggtttttaatcaaaatctcatttcagtgtaaaaaatgaagctgcccccaagctcacacttgaaaccagcttcaccgcaatcccaatacaacttttttacctcgccgtcacgtcatttgctttgtcgttaggcagactgtaaatcgtctcccctgccttagcgaaataatacttcgagcgaatgagattttctaaataatccttgttattcaagagtttgacatgttcattcagattctgatgggtctgtttcacccgtgcaagtttttgctgctgacgtgtaatttggacgttagtctggctcattatatttttagcgtgcacaatttgcacacctaaaaagagaaaggcaagacagaaaatgccaataatcatcagtgcgcgtttcttacgtttcttactcagcaccaccttatgcgtactcttcttaacttctcttgtgtactgattatcaagctgtgtaacgttcgatcgtgtcaccatcttaacgccccccacgtcaatatccttataagtgaagtatatcaacgatattatgggttgtctatgagatttaaagcggattcacggaatgtcacagaactgtaatagtatttgtacgaaaccgctcagtcaaagtgcaaaatgtaacgacctctgatgtggtttactcgttacggtaatctttttcgtaatcttcactaactatcttgaacatgttttctgcatcttgtttcttagtcgtttccagtagctgcagaacctgaacagttaacgttttattaccgaatttaatcaccaaaatatcgttgggggcaacatccgtagatgatttagccacccgatcattaattgtaatccgaccctgatcggcaatttctttggcaacagtgcgccgtttgataattcgggaaacttttaagaatttatctaatctcattgtgaacctccgtgtttattttttaagccaacgtagccagcggtcagcttggggaagcagcagccactcacgtaacgttagtagttttaattttaaagcgagcaacataaaaaccagtacgcctactaaaacacctagtcccgaattaacgagtgccgtcattcgcggtgaccaggtggcagttaatagactgccaagtggcataacaactcttactgccagtaacatgatgattgaaatcaggatcaattttagtaaaaagccctgtttaaaagccatcagccgttctttacgcaactgctgcatcaaaaagccggccatacatagtaaggcaaaaacggttatccaactagctccaattgcaccgaacctaacaactgcccactggttaaaactaattttaaccagtaagccaatgactagtcctgcaattgtcactacaaactgattcagactttgtaaaatactgttatcgatcatgatcaaagttgcaaaaataatgcttaaaacgtataccgacagcatcccatttccctgctgattaccgaataacaaaacgtttacttcaggcattaaagcaatcaaccctattgcagcggcagtcgcaatcgtcacactcattctaatcacggtatttgcctgccgggcaaactgctgacgcgatccatgattgagtgattctgttagcgatggcagtaacgaggaggaaaatgaagtggcgaccactaatcctaattgcactaagggctgtccacggtcatatacccctttaattgatttagcaaggagcggtggcagcccctgaatcataaggcctcgcataacggtaaatgagtcaactagttgcaataacaccatcattgaggcaaataagctaatcgtgccgccttcaatcagcagccgttttgctagatgaccataactttgggcagcgggctgatacgctaatctaaacaccttcacttgatgatggcgaacataaaacagcattaccagcgtagcaaagattgccgcaataggcgcactgctcatcgcccacgctcccatccggtaaacgttccattgatgcctcatagcccaataagctacaaacaggatcacggccactcggacggcctgctcgaccagttgagaaagtgcagtgggtcgcatatcgtattcaccttgaaaatagcctcggctaatcgctaaaaacggtgaaaataaaaacatccaactcaccgaccgaataatcggtgccaaaccaggatcgcccattgcactggcaatcggtaacgaaaatgcctgtaagcccaaaaataaaatcagtgaaaagccagccaaaatcataaagatccgtgagaccagcgttagtttagcctcagccgtttcgttttcagccactaactttgaaataaacattggtaagccgctgagtgcaaaagtcattccgataccatagatcggatagatttgctgatagacgtaaaagcccgtatttccaaccatgttttggaaaggaacccgataaactgcactcaaaattttggcaatcagcgatgctaccgaaagtaataaagcaccttgcatcaccgtcttcattgttttacgttgcatagtccacctattttgtcgttgttttaacagccatgtcacttaacgctttaacaaactggtttaattcagccatccagttctgcgctgtcatctttggctgaatcactaatttaaccactaacttgtcatttgaaagtccaaccgttgctttgagcttcgtgttggataatgccttgaagacgtcttcaccgctaaaacggtccgttcctttcacggagaagaccacttcgatttgatctttaatgcgatgaattttttcaattaacgcttcatcagcctgaatcttcacttgactaatcgccaacagattagtgacttcggtcggatattcaccaaaacggtcaatcaaatcattttgcacttcagtgatatcctcaggactttcaatttgccggattcgcttatacatttcgattttttgctgctgatctgcaatgtaagtatcaggcaaataagcttccaacccaagctccacagtagtatccgtctttggtttagcctttttaccctgctttttggaaacagcatccgtcagcatttgggtgtataaatcatacccaactgagtcaataaagccactctgctgtttacccagcaggtttcctgccccacgaatagacaaatctcgcatggcaattttaaaaccagaccctaactcagtaaaatccttaatagcttcaagccttttctcactaacttccgtcaagactttgttaggttgatacataaagtaggcgtatgccacccggttacttcggccgattcgccctcgtagctgatacagctgcgaaagtcccatgtgatcggcatcttccacaaataacgtgtttgcgtttggaatatccatacccgtttcgataatcgtagtggtaactaagacgtcatactcaccacgaatgaaatcgtataaaatgccttccaactgtgcttcggtcatttgtccgtgaatgtaggcaacctccgcatcgggaactaacgctttaatctgactcacggtttcctcaatgtcaccaacccgattatgcaggtaaaagacttgaccaccacgttgcaattcacgccgaatgccgtcttgaatcgcgccggcattttgctccataacgtaggtttgaattgggaaccggttagcgggtggtgtttcaatgaccgaaagatcccgcacgccaagcatcgacatgtgcaacgtccgaggaatcggtgtcgctgtcagcgttaaaacatccacctgagatttcatctgtttaagcttttctttatgcttaacgccaaaacgctgctcttcatccaccaataacaatcccagatcgttaaacttcacgtctttcgacaagagtcgatgagtccccacaacaatatcaacactgccatcttccaggccatgaataatttgatgaacttctttggttgtctggaaacgggataaaatggcaacgttgaccggaaaaccttcaaagcgattggtcatcgtatcatagtgttgctgcgctaggatcgttgtcgggacaagaaaggccacttgtttcccagcttcgatggccttgaaagcagctcgcaaggccacctcagtcttaccgtagcccacatcgcccacaagtagccggtccataggcttggccttctccatatcatgcttaatttcttcgatactacgcaattggtcaggcgtttctgaatacgggaactgattatcgaattcctcttgataagtgtcatcgcgaggaaaagcataacccttttctgaatcacgtttggcgtaaagttcaatcagatcatccgcaatatcttcaattttggcagcgacctttttcttggttttggcccaatcggagccgcccaatttgttgatatgtggtttcttgtcttctgaagaaacgtacttctgaattaagtttaactgcgttactggaataaacagcttggcatcgttttgataggcaatggtcatgtaatcctgatgaacaccatcaacttccagtgtctgcatgccttcaaagcgaccaatcccgtgattgacgtgaaccacgtaatcgccaggcttcagatccgtataactcttcaaccgctctgcattttgcatggtttgccggcgacgatgatgtttcgtcacctgcttgaacatctctgcttcagtaatcacaactaacttagcatccggcaattcaaatccagtctgactggacgctgggataatttgaacaacaccaggctgaatatcactggccttagtcatcacggcgttaatgccgaagtcatcaagtgtttgtgagactttattgagccgttcttcgtcagccatcatcatgacaacggtttgcttcgacgcttgccaacggttaatttcctgcttcaaaagcggcatttgaccaaagaactgctgcatggcacgcgtcttgatttcaatcagttgatcaaagcgcatgttccccatccccttttgaaaaagagcaaagaaaacttcagcatggtgatcacgcttcagcacgtcttgaaagtgtaaaccaaactgctggtcactgaaaatctgatgcgcactcaatttatcaacgatccaattagcctcatccgtttccaattgcttattggtatcacgcaatcttggataatcatcaatcagtaataacccgttatcacctaaatagtctaagagattagttttgccaaaaaagtcattagcgaatagtcttaactcggcagaaacatcccccttagttaaggattcaatcaagggggtaatgctattagtaagttgctcactatcttcatcagacagttttttctgctctttagttaatttcttatttagtccatcagcagccgtctgccgttcctctggtgtcatcaacatatcagtaacgggatgaatcgtgacggcgtcaatgttttctacgcttcgttgcgtactggcatcaaagtagcgtaacgaatcaatctcagtatcaaataagtctactcgaacgggatattccgtatctaacgggtaaatatcaataatcgaaccgcgaatagcaaaatcgcccggtgcatcaactaatttttgccgagtgtaccccatccgttgcagccgggcagctaaggcttctagatcaacctcaccgccagtctttaacggtatttgtgcctgactgaatagctttggatcaggtagctgtcgccgcaatcctgaaactgatgtcacaatgacagccggcttagcttgtgttaatgcgctgagtgcctgaattcgctgactctgaaaatcaggagaactagtggctatctctgcagctagcagttcttcaactggaaattcaaataattgatcatccgtcagctgaccactcaattcatccgtcagctgatcagcgtgatacatggtgtcagtcacaaaaatcatggggcgctgttctttttgcatcaaagtctgaatcaacaatgaccgcgccgatccagcgatacccgttaacaattcccggccttgctgatcaaagccagccacgaattgctgatattgcggcatatttgcaaaaaaatctgcaagttgcactaagcttcactcctttactagttatactgattcatcaaatcgggaatcgtttcaccatcaacccaatcaaatagtgctgcaactgcatgttccgcagcaacgttaaacgtggcacgctgttcttcggtaaactttccaagcacgtagttgaccaccgtactcttttgcggatgctgaataccaaccttgattcggttaaattccgtggttcccaaagcagcaataatgctcttaatcccattatgtccgccagcagaaccctttggtctaattctaattcttcctaagggcatatccatatcatcatgaacaacgatcaaatcatcgatgtccagcttgtaaaagcgcataagtgcgccaactgcccggcctgactcgttcataaaggtagtgggttcaaccagcatcaccttttcgccgttcacttgaccagttgccagcttagcctccatctttcggctagtaaattgcaaaccggctttttgcgcaaactgttccacaaccatgaaaccagtgttgtgtcgcgtttgcttatattgcggaccgatattaccaagcccaacgatcattttcattattaaatacgctccctattgttgttatcattttttacattaaaccatgcaaaatagctgaacggtagtttcaaccgttcagcgtaaaagattcttacgaactctaagtacaaatatcaagtcaaagtatagcatacgtcactggtttatgcatatcatcttgttccaatctcagtaataacacctttcgaatacatcagtgaacaagtcagacgttgacttatcaaattcagcctgtccattagcttgtgcagtcgatttttaaatgatggcctattccaatattaataaggattacctgaaatatcagctttcacaaagtgacattatgaaagttatatttcagagcatcaattattggtaagcgcttaccatttcatgataaactgtccctgttaaagattaactattttgaaagaggtgggtaaattgtcaaaatcgcatcaaaaagttgtcctagttggggacggtgctgtaggatcagcttatgcatttgcaatgatgcaacaaggacttgcggaggagttagtgatcgtcgatgtcattaaggaacgcactcacggcgacgcattagatctagaggatgcccaagcattcacatcacctaaaacggtttattctggtgaatacagtgatgcaaaggatgctgacttagtagtgatcacggccggtgcaccacaaaagcctggtgaaacccggttagacttagttgataagaacttaaagatattgagttcaatcgtcaaaccaattgtcgattctggttttaatgggatctttctagtcgcagctaaccccgtggatattttaacttacgcgacctggaaattctccggcttccctaagaatcgtgtaatcggatcaggcacttcattagacacatctcggttacgtgtggcattgggcaagaaactgaatttagatccccgcagtattgatgcctacattctaggtgaacacggtgatactgaatttgctgcatacgatgaagccactattggttcaaaaccacttcgtcaaattgcaaaggaaaatggtattaccgacgcagatcttgacgaaatcgaggatcaaaccatgcataaggcatacgaaatcattaacgccaagggagctacctactatggtgttgcgactagcctgatgcggatcacaagagcaatcttccgtgatgagaatgctatcttgccagttggggcagccttgaatggcgaatatggccttgatgacatcttcattggtacaccaggaatcattaacgcaactggcttagctggtgtgattgaagtaccactaagtgaagcggaacaagcgaagatgaaagcgtcagcagatactttaaagaaagttacaaaagatggtttagcggcactaaacggctgatagttagtcaaggtttactgtatcaagactagtaccttctacttaggaggtacttttttagtgaagaaaaattgagttttactcgaatatgccttatccttatagatgaccataaggaggatcagaacatgacacatcgatcacgttgggtctccgcgggtttaactgtaatcgcgattcttgcaattggttacggttggcgaacggcccattataatagccactttttgagtgacacccaaatcggtggcattcgagtaggtggccagactgctgaacaagcagcccagactttaaaaacgaaactgtctaatcaaacttatacagttgaagaacattcaaaaacactggctcaattcacttcgcgtgaagctggtgttaaggcctattcgacaactcaacttaaacagctgattgccaagcaaaatgcctatagctggccagtacacacctttagtgcttcagccgacgatcaaaggctcagcgctagtgcaatggatgatgcggatttaaccgcgttagccaataagattgttcaagttgctggcaccaatcggacggcgactcataacgctaagctggtgtataaaggtcatcaatttaccattgaaaaaccagtttacggtactgagatttcccaagcttccgttaagacagccctcactaaagcgattgaaactcatgaatcaacgattaatttaaaacaagcttacgtgaagccaaccgtcttaactaacagtaaatcactcgttagtgcgaaaacgaaggccgaaaaattagccaagaataagattacctatcggatcacaaatcattcgatacaggttcccagtgacacaattgccagttggctaaccaccaagaacggtcaagtgacaacttcaaatgctcagatcaccaagtatttaactaaactaagctatcaatacggtacgattcataaaacccgtcactttaaagctcatgatggtaaaaccgttaaggtgcctgccggtttgtacggctggagtattaaagttgcctctgaaacaccgattctttcaaaggcagtgctggcaggtaaaccagtgacccgcacaccagttatccaaggtactggctaccacaaggatggttctgatctcggcagtacttatattgaagtttccaaacctgctcagcatatgtgggtatataaaaatggcaaggtgattatttcgactgatgtcgttacgggtaaacccgtttctggcacaacgccatctggtgtctgggacgtttggagcaagcaacgcaacgccgtcttacgcggtaagaacgacgatggttccaattacgcgtcacccgtgaagtattggatgccaattgatgatacaggtgttggtattcatgattcaccgtggcaaccacgctatggcggtgattggtatctcacacatggctcacatggctgtgtcaataccccaccatccgttgttggtaaggtttatgctgcggtaccattgcacacaccagttgttatctactaactaatccaattatctaatcaagcgtctgagtgtgtgacaaaactcggtagattccagaatttaagtaaataatgcctattccgcacaaatcgcggagtaggcattatttacgttaaatggcaggaatctgagttttggcgcatgattaattaggcaatattgacgcatcgaaccaaaggacaggcatcctaatttttgctgaaaaattgattgaaatgcttgccaatatagacttatggcacaacctcgggcgctttatttaggttaaagccaaataaccatctgatagccgtttttaattctaagcctacgctaagatttttcgaattctaatttgactaaacagcgattattccccaataaacccctattcagttgtttctcaggtgatttttatgttatgatatttctagtttattagagagttctaattattaggaggttacacccaatgttgttgaagtccttgatcaagcctaaagagcgactagtgactgtccaggaaaatgtcactttagaggaagctcttaagatacttgaagattccggttatcgctgtgtgccaattttagatgaaaccgggacgattttccggggtaacatctacaagatgcatatctatcggcataagtcacgtggtggtgatatgaaactgccagtgacaactttattaaaaaatgccactaaatttatcaaaatcgatgccgctttcttcaacgtctttttctcgattaaagatcttccgtatattgcggtgcttgatgcggaaaataaattttacggtatcctgacgcatactcggctaatggatatgctctcccaatcgtggaacgtcaacattggttcttacgttgttaccgttgtttcgccaggtacgcgtggtgacttggtaggtatcgccaaaattattaccaagtacactagcatcgccagtgtgatcagcctcgacgctcgggatggcgaattagttcaccgcatcatgttcaccttaccagctgacgttgatcaaacaaagcttgatcgcattgttcgtgccttggaacgaaaagatttcaaagtacccgaaattgaaaatttaaatcatgaaatctgattttaagtaacaccactaagttaagatttcagctaaataacaagacagcgaccgattccctgaataccttgggaatcggtcgctgtcttgttattttttaaagctaatcgaatgatacttcattttggcactatgtaattttccaagaaattaagcgcgtttgtgctgcttataatcactctttttatttaacccgatgctgacctctagagcgtgatcaacttgttgcatggtaacctcatctagctgtgccacatgatcttttagtcgttgcttatcaatcgtacgaatttgctccaataaaatcaccgaatctttttcgataccagtatgatgagctttaattggcacgtgggtcggcattttgggtttagaaattcgcgctgttatggcggccacaattacggtaggactgtagtgattaccaatattattctgaacaattaatactggcctgacgccaccttgttccgatccaactacaggcgacaaatcggcataataaatatcgccgcgtttgatctcatcatttgccatctcttcatccccttgttcattcgccaccactagctatgatcctccaacaataaccgagtgacttacttttgtatccggtgatcaaagactccgtcataactaccaaatcagttgaaggccgtaacctgagaagctagaatctaggctcctatcccaaatagtttaaaattaataaccatacgctatacctagtatgctataacttctcatgatagattcctattctccgtgactcattcttataattctaccattgccaccaataaaaaagaaccccttgcccggttttggtcgggcaaaaggttagtttgagttttagttaatataagtgcgctttaaacgctgagtaaaaccgcaagcaatttcgtaatggatagttccacaataatcggccacatcctgtaaactgatcgttttaccatggtcttctccaaccaccgttaccaccgttccaaccggaaattgacgtggtaatcgaatcatcagctgatccatgcacacccgaccaataatttcgcaaaactcaccgttaaccagcacatggaaaccctgcaagcgccgttcataaccatcagcatagccaattggcaaggttgccacccactcatcttcttgtgcagtgtacgtagcgccatagctcacagaataccctttgagcaattttttaacaaacaccattttggtcttaagactcatggcaggttgcaatggaaatggtacggttaactctgtaccggagggattcaagccatacgctgctaccccgtaacgaatcatattgccgttacaagcatcatgccaaagactggtagcagaattagagacatggacgtacttggggcggtatggcagaactgccataaatgcttcccaacgatcaatctgatgttgaaaatacgctgtatcggctgcatctgccttggaaaaatgggtaaagatcccttcaaaattaaattgtggcttctgatcaaggtactgaacggcttgacgcaactcttcaggatgctgaaaaccgatccgccccattcccgtatccagtgcgagatgaatggctaaacgatgctcttcaatcaaatagcggctcgcttcttctaaccagtcgattgaccccaccgtggcagaaatatgatgactggccatcaaatctgcatattgcggctcagtaatacctaacactaagataggtaagttaaacccagcctctcgcaacgttagtgcctcatctaagatagccacgcaaaaaccggttgcaccggccttttctgctattttagcaacctgaacaagtccgtgaccgtaaccgtccgccttaacgacctgaaaaagttcaacgccaggcttcaaccgcgatttctcggtagcaatattatgatagatggccgactgatcaataattaactgagtgggccgatgaacaccaattgtcattctgctgagtctccttctagcaagacttgtgtcattactaattcacgagtatgtgatattgaaacaaagcccttaccgttaaaaggatgctttaccagttcaggttttcccgtttcatcatctaaaatttcgatatcttgaaacgaaactgcatggccaataccagttccaaaagctttactgtatgcttccttagcggaccagcgaccagccagaaactccgcactgtgtttcgcatttagggtttgataaaccgctacttcattaggtgtcagcacctttttaacaaaccgttcttggtcagctatctcacgaatacggttaatttcttcaatatctactccaattccgtatatcaagctagggcctcactttcacactgatttcgtctttttaattttaccacagtcaaccaatcgattaacatgacacctactcacgcttagttgacgctttttcactccctaatttttaattttctcatttaatgatgactaaaaaaaatcctccagctcacagactgaaggatccttttgaaattaaatattagtcttttttacggatcgtaaaaccgtgtttgttgccaccgttgttcttacggtcgcgacgatcacggctaccaccatgatcacggtggtccttgctagaaccagaaccgtagcgacgatgactgtcattactcttaccgtagtgacggttattgccaccacgaccatggccaccaccatgaccgccacgataattccgactaccgccgccacccttgtgacgaggcaatggacgttccggagtaatcttaacgggaacttggtttgagttatctttggttaagtcgttcaaaagtgcagcaactaagtcaacggcttcgtactgatcaaggagctttgaagcaacatcagcatacttatcggtatcagtcttttcgactaatcccttaaccgtttcttcagcagccgttaactgaccgctgaaggcttcggcttccgaaggtggcttcaatggcagcatccgcaccttagttaacttttcaatctcacgaagatagtccatttcgtttggtgtaacaaaggttaacgacacaccatggtgcccggcacggccagtacgaccgacacgatgcacgtaactatctggatcttgaggaatatcgtagttaaagacatgagtcacatcttcaacgtcgatcccacgagcagcaacatcagttgccactaagatatcaagcttaccatgcttaaaccggttcaagatttgagaccgactcttttgagtcaagtcaccatgaataccggcagcattgtaaccacgggcttcaagaccacgggtgatttcatcaacccgacgctttgttcgagtaaagacgatacttagatcaggtgcttgaacatcaaacatccgagtcattacatcaaacttttcgtagtccttagcacggacatagtattgttcaattaagtcagtcgttaattctttagccttgatcttaacgtggtgtggttcgtgcataaactgcacaccaacccgtttgatctctggtggcatcgttgctgaaaacagcattgtttgccggctatctggggtttgcttaataatagattcaatatcatctaagaatcccatgtttaacatctcatcggcttcatctaagaccagcatcttaacgtggtctaacttcaccgtccggcggttcatatgatcgagtaaacgaccaggtgtgccgactaagacttggggatggttcttcaagctgttaatttgacgacggatatcagcaccaccgtaaacaacctgaaccttcgcatgctcttcatgacccagttggaaaatctgttcctgagtctggattgccaattcacgagttggtgaaatgaccagcgcttgaatgttgggatcatcacgatcaatgttttgcaaaataggtaatgcgaaggccgcagtcttcccagtccctgtttgtgcttgtccaataacgtctttaccttccaataccattggaatggtttctgcttgaatgggggttgcttcctcataaccgttacgttcaacggccttgagtaaaggcttggttaacccgagttctgaaaacttcaaataaatgtcctcctaataggcttttacaaaggaaataagactatgagaaatccgtctcgtatggtgcgtcttattccccattttacaagtgttagttcgaaaaaaatacaactagagtatcatacatcacacaactaggaaaagcaacaattaatatttttatcactcactaagttgcagacttttagtcattatttgtttgcaatgcagccaaaacattctctagatgaatgccatggctacccttgatcaaaacaatatcttcaggttgaatgtcagcattcaactgagtgattagttgcgcctgttcatccgtagcatacaaatggagatgagcgacttcaaacttgtcctgcaacgcatcatagagagccttcatatgtggtccgaccaaatagacgtcctgcactaaagtcggatcaaaaacagttgcaagtccagcatgtaacccatctgactgctcacctagttccagcatgtcccctagcacaacccgccgtttaccaatagttgcgactttagaaaaagcagccatcacttctttaacagcggtaggattggaattataaacatcactcaaaattcgttctcccgcagtaccactaacccactctgcacggttttcagttaaatttaaatttccgaaggctttagccgatgcttgtggtgaaatccggtacaatttggcaacacttagcgccgccagtgcattgttgacgttataatcgccaatcatcggaaccgtcattttttgttctggccactcactcgcagtgaaggtcgtctgagtatcagttgcatcaacatttaaagcatacatatcattggttttttggcggccaaaggtacgctgccgctgtgacacttttttggcccgctcaactaatagtggctcatcaccatcataaataaacgtgccatctgcttttaagccgtgcgtaatttccatttttgcatcagcaatcttgtcacgggtaccaaaaaactcaatgtgtgcttcgccaatcatggtgataatagcaacatccggctcaaccaaacggcttaagaaatcaagctgacccggacgatccatgcccatctcaatcacgagcacctcggtattaggttccatcgacaggatggtaaccggcaccccaatttcattattgaaattatccatggttttagtcacgttaaattgggcagaaaggatggccgccaccatatctttagtcgttgttttaccgtttgaaccagtcactgccacaactttagggttgattttaagtaagtaatgctgactaagggattgtaacgcagtcaacggatcatcaacaaccagtactggcaagtccgcgggtgcttcaccatggtccgctttccaaagtgttgctacggcaccgttttttagtgcgctttgaacaaactcatgaccgtctcgctccccttccaaaggtacgaataacgcaccgttagaaaggtgacgactgtcaaatgcgacactggaaacctcaatttcattccaagcactagtatcattttgagcagaaaccgcacttgcgatttcaccaagctgcatcttcattgaaaacaatctcctatttttgtctcgttttttttgcacaccgagtattataccacgactgggcgttaaaaagcggcgacatgtcaagctgcaaacttgactgactccgctttataaatccgtttcgttttctgaaaaaggaacttcatccgtaatttcaattccccactgtttttgctcaacgtcatagctaagcgtcccaacttgtcgggtcgtttcgtagacatccatccggtcatgccaccaattctggcgttctggatgctcctgcagacgtataggaatcaagtatcgccggcgacgttccaccgcctgatcaaacgcaaaaaccaagccctccgaaaaagctgtttgtactttttggataatttcttttggcacttcactgactgaaaatggccggttaaacatcatccagcgattactgtgcaataatcttaaatgacgcttcaatgaaatatccaaaatgtgctcaaaagttgccatcttacgataataaactttaacaaaacccgtggtggtccccagataagcatatgcattttgaagcttggaataaagtggcaggtggtaatgagttcccatatgcgccatgtacagtagttcagcaatttcactgggcatcattaaatcaagatcatcactctcatgataatccagccacatcttgggcgaatttgtctttgacaagatgaactcacgcactgagttttgaccagttaccgtttgaaaccgcgtgtggctattgacttgattcccctcaagtttaccgtcgatcaaaacaattcgctgaggaacagctgacatgccattcacaaaatcagccgaggtaatcccgtatgatatcacaagattattcacctgttcccagttaatatagataaaattcccttgcatcacttttcccacgctctctcacattatagacacttttattgtactacgaaacattactaaaaaggatgttaaacgtttaatctcattaaatttattactgatctctcctacgcttgacgttccggccattatcaaataacatgggggaaattactcaaaaggagtctgaatcatgaccaacgtactttttgtctgtttaggcaatatctgccgttcacctatggcagaagccattttcaaagatttggttttaaaagctggcctccagaatcaaatccaagtggattcgtgtgcaaccagcagtgaagaggaaggtcatcagccacaccccggtgcccaaaaggtaatggccgctcatggattggattacagctacatgcactctcggccaattacccggcaagattttgactgggcggattacattattacaatggatggtcaaaatgtctttaatctcaaccaaatggcacctgctgaagatcgccataaaattcatctctgcttagatattctccctgataaacaggggcaggaaattccagatccttggtacactcaccgatttgagtatacgtatcaagtcttaatgtctgcactaccagcttggttagataaaattaaagcggctaactgattggtgtcgtagtcaaaattctgttttaatccaaacaataaatggggttgtgccataagtctatattggtaaatatgtcaatccatttttcagtaaaaattagtgatgcctgtcctttggttcaatgcgttaatattatctaatcatgcgccaaaactcagattcttgccatttaacttgaataacccccatcccgacaaagtacgtcggaatgggggttattcaagttaaattctagaatctaccgagtttcgtcacacactcttggatacatcgtaaatgtcgtctcacagactgcttcacttgtcacactatttattattgaacttcgccgcaaattccttttggaccttcacaggcgtatctgacagctttgcagtatgcgttaatctcccacgaatcattaatcggcgcgcaccagttgcgtcacacgtcaccaatgtaatgatattagacttcgtttggttgaccacgtcaatacgtgtggcagcaataaactcccgtcgataaaccttaaacgtataaactttcttcatgtctgtggtgtaaatcgtatcacctacccgcgtcttaaagtacaacggcgaaaaaaggatatcttttcgtaccatatggtgacctgctaacggatagttaccgtcacccatcttttgatctgaccgcatggtccccgcagctaaagcaagggtcgtgttagcaactcctttagcaatcggcaagtgaataccggactttggcactaaaatctgaccaactggcagaatcttttgcgaattcattcgtgcgttcgccaccgttgagaaattcaaggatttagcatttctaaaattaaaattagcctgctttttgtcgttattagcagctgatttggccgttattttcggttgatacgaactcaccagataatttttaatttgctggttaaaaattaatcccagcgaaatgagtaaaagtatcaccaaaccaattctgtacagccattttgtaaattggctatgtcctttattcttcatttgatctccccactatccctattagatcaaccatgtaagcggtctaataattttaacacttaattggtataccttggttatgcacccaaaacgtgctactcttaatgttactgctatattttacccgattgaagaatgatttaaaagaaagaagattgatattcattgactgaaccagaacctgccaccgtcaagcccaaacgtcccatctggcggcgcaacttattcgtcttgtggtttggtacctttatggctggactcgcctttagcgaaatcatgccgtttttatccctttatgtggatacattaggtaacttcaccaaagatcaacttaatctatactccggtatcacgttctccgcaacctatttggttacagccgtagctagtccaatgtggggacgattagctgatcgaaaaggccgtaaactgatgctattacgagcttcacttggaatggccgttgttatgggactaatgggcgctgtcacgagcgtttgggaattgatggccctacgttttattcaaggaattttttctggttatattagtaacgccaacgcgttaatggcaactcaggcacctaaaagcaagagtggtcaggcgctcggtactttatcaacgggttacgttgccggatcgcttttcggtcccctcgttggtggtgttttagctgaaattttctcctatcgtgtcaccttcttcattaccggtgcacttttattatccgtctttttcgtgagttactttttcgttacggaatcattcactcccgttaaaaaggaaaacatgctgtcgagcaaagaggtactgggtgtggtccatcacccaagattaattttgggaatgttcattactaccctcatcattcaggcttccaacatgtctatctcaccaattttgtcactgtacgtcagagaaatcatgcctaagggatctgctatcacgctgtttagtggcatcgttgctgctatcccaggggtcgccacactttttgcagcccctcagttgggccgtttaggtgatcgaattggtactgaactgatcttgtcgattggctttatctttgccatcttggtctacctgccaatggccttcgttaccaacgtctggcaactaatgtttttgagattccttattggtatttctaacgctaccatgttaccagccgtccaaacaattttgtcaaaaaataccccgccagaggttactggccgggtcttcagttggaaccagtctttccaagcaatcggcagtgtgctgggaccaatgattggttcaatcgtttccacggtgttcgactactcgggcgtcttcatctcaacctcggttctggtcctgttaaacttcctgctagtttggcataatacggctagtttgaggagaaaacatttgaatagctagagtgcgaaggcaagcgattagatagctggagcacgttttggcaatgtaacagcaacgagcacaaaattcccgaacttggatttatggattagtcggtttgcatgcagttccctgcttgcctgaacacgtttacgcaatctaaaaatcaagcgtcacgtccaatcacaactattggatgtggcgcttttattagcaacaaaattcaacgatacataaaagtgttgcaaatccacgagcttgcgacagttgattaaaattaatcattttccctgaccgcttttttaatcacatccataatctgattggcaagatgcgttggctggcggtcactgcggtatctcaaggtcaaccatacatggggcaattgtgcgtctaaaatgtgcaatggcaccactgtatccggtaattttattaggtctgctagaaaaccaagcgccacgttggatgctacagcatctaatacaacatgtgcattatcgctttcaaacagcacctgaggctcttgtcgtgcatatagccgcgcaaaaattttatggttcaagaaattagcactcttggtgactattggaaatcccaacgtgtccttaacggtaaccgaacgttgacgaaccagtggatgattcacacttgcgagtaactgaaaatgaattggtaccaatagatcttctactgggttttcttcacgctctacttcgccagtgataatcgcatctacttccccaactgccaatttctgatccagaaccagtgaaccagcttccacgaaacgtacatgctgaaataagccattggcctgcaatgctgaaacaatttttagcagataccgctcaccaatcgttggttcaattcctatcaataatgaatccgcggtcattcgagcaatgactgcccggttacgctcccagaccgtcaaaatttcttcggcagtctggcttaattgccgtcctgctggcgttaactgcacaccgttagtatgtggattacgaatcaaaagttcagtattaaagtaccgttcaagccgcttaacggattgcgtgatagttggctgactcactgaaaaattctttgcaacttgagtaaaactcaatacttggttcaattggtggaaatacgccagatctttaaaattcataagcacctcataaataaatattatagtattgctctctttgactataataccactgaaatgatagagtaatccgcatcacttataagtgaaattaatagtgaaacctggtcatacatatgaaatcaatcacttattggcaccgaaatctcatggtcctttggatgggcgcatttatgtctgaaggcgcaatatcattaattgttccaatcttacctctgttcctaaaaagccttggcaactacactccaagtcaactcagtctgctttctggcagcatcttcgccgtcacctttctcatcaaagcggtcgtttcacctctgtggggaaagctttctgatcgtgttggacataaaccaatgcttttgcgagccgctgggggattaagcttctgttgtttcatgattgctattgcaccaaacgtgtggctgattatccttgcacgtgccattcaaggtattttttctggttacatcaataacgccgaatccatgattgctacagaagcacccaaagaacataaaggttgggctttaggcacactggcaactggcgatacagcgggattactttgcggcccaatcattggtggcgcattagcaaccttcgttggattccggggtaccttcttcattgccgcactgttgatgcttgccgtatttggtctaagttggaagctagtgacggaaacctttgaacccgtccctgcttctgaaaaaatggggatccgtgatacgctttcggcacagccacatatcaagctactactattaatctttgttctaactttaatcgtgcaagccactaacaatgcggttaacccaattttaagcctatatctggacgatctgttgccgtcagcccctcacttaccgcttatttctggaattgtggcagccctaccaggcattgccaccgttttatcagcgggctacctaggacgtttgggtgatatgcacggtcaacgcaaactgttgattggtggtctcgcccttggaacgctcatctacatccctcaaatcttcgtgaccaacatctgggggcttggcagtctacgctttattactggcctttcaattgctgcattactgccagcattacaagctatattgacgcaaaatacacaaccggcagcactggggcgaatctttagttataatcaaacgtttcaagcattaggcaacgtgtgtggcgcgatgatcagtgctgggattgccagtgcattcggttacgttcaggttttcaccgcggtctgtgtgatggaagctctcggtttattgctagcgtggagattgaaatgctagagtgtgaaggcaagtctttgcttgcctgaacacgtttacgcaacctaaaaatcaagcgtcacgtccaatcacaactattggatgtggcgcttttattacctcaaataaaaaaaccactcaccctaatcaaggtaagtggctcactaattaatgttagtcgttttttaaaccgtacttcttgttgaaacgatccacagcaccatctgcttgggcaaacttttgcttaccagtgtagaaaggatgtgagtcagaagaaatttcaacacgaatcaatggataagtgttgccatcttcccagtcgactgtttcttcagaagttgcagttgaacctgacaaaaacttgtagccggtacttgagtcttggaataccacttggtggtaatctggatgaattccttttttcataattgtttcgctcctttgccctgaatcatgtactgaaacagagattgattgttatcgtcaacctaaatagaatatcataagaattggtctaattcaagtcactcttataattcttctactcgatcactatcttcaattctaacgtcagccttcaatgcagtcagtttttccacaatgctgccatagccacgcaaaatattgtccgcactagtaatggtcgttgtgccctctgccattaaagcagcaatcatcaacgaagctccagcgcgaatttctcccgcatccacagttgcaccggttaaatgatcggtgtggtccaccacaatcatatccttttcaggacgaattttagctcccattttcttcaactcagggacgtgtttcaatcgttgcggataaatcgtatcaacaataatactgctccccttcgccattagtaacagcggcgtaataggttgctgaagatctgttgcaaatccaggaaacggcatggttttaacttcgattgcctttaaatctttggacgggccaacgtaagcagagtcttcaccgatttgtaaatcaacgcccatttcgatcagctttgccgtaaatgactccaaatgttcaggaataatattgtggatttccacaccgtctcccatcgcagcagccatcgctaaaaaggtacctgcttcgatacgatcaggaataatcgtgtgaacattggtggcacgtaaaacgggaacgccctcgattcgaatgacatccgtaccagcaccacgaacatgagcacccatattatttaaaaaagttgcaatgtcaataatttcaggttctttagccgcattttcaatagttgttagtccgtttgctttaacagctgccaaaatcgtgttgatcgttgcaccaacggaaacgacatccaagaaaatccgagcgccatgcaaaccatcttcacccgtggtgattcgaactgtcccatgatcatcttcgacttctgcacctagcgctttaaacgctttgatgtgttggtcaatgggtcgcggtccaatgttatcgccacctggaaaagtcagtattgcacgaccaaatcgtccaagcaatgcgcccataaaataataggaagcccttaaacttttaatggctttactcggcattggcgcttcgacgatttcagtggggtcgattgataaaacgccatcctcaaatctagagtgcacattcatggactccaaaatcagcatcaggttatgaacatctagaatatctggtaccatatcaaatttaactggtgtatctgccaggattgccgctggaattagtgcgaccgtactatttttagcaccaccgatgttgacgctgcctgacaggcgctgtccaccgtggattatcatttttttcatgacataatttccctctactataaaatcgtgcttcgatgcagtcctaacttatcataaataatgaacagttaaaatacaatagtttaacgtcgattccattaaattgtaatatttgagacaccaatatacctaaaaatcatcccaaataacggacaattgtccaactagacgaaaaaagtcgcatgatcttagtgaccacgcgacttttaacatgctcaaatttagttctcgttgtgctgttgatttgctgctgcaacgaagttcttaaataatccttctgggcggtttggccgtgaaaggaactctggatggtattgagctgccacgaagaatttattacttggtaattcaataacttcaactaaatgatcatcaggtgaagtaccagagaagactaggccctttttactcatttcatcacggtaagcattgttaaattcgtaacggtgacggtgacgttctgagatttcaggtttgttatcatatgcagccgcagtgactgtatttggctttagcttacatggataagcgcccagacgctgcgtaccacccatatcctcaacatcagtttggtcagccatcaaatcgatgactttatgcgtcgtatttggatccatttcagtcgagttagcatccgtataacccagtacatgacgtgcaaattcaacactagccatttgcatgcctaagcagattcctaagaatggcaagtcgttttcacgtgcatactgaatggcggtaatcataccttcgattcctcgatcgccgaaaccaccaggaaccagtaagccgtctgcatcctttagggtttctgccacgttttctggagtaaccttttcagcatcgatcatccgcagatcaatcttcgcatccagtgggtagccagcatgcttcaaagcttcagcaacagaaatataggcatcttgaagactaacgtattttccaaccaacgcaatcgtaatcgtgttctttaaattattgattttgttgatcatcgttgaccagtcagccatatcagcggcaggtgccttcacaccaaaatgatcaagaacaagctgatccatgctctgcttttgaagacgcagtggtacttcataaatggtatccacgtccattgattcaactacggcttctggcttcacgtcacagaacaaagcaattttatttcgcatagattcagtaattggtttttcagttctaacaactaaaatattaggctgaattcctaagcctcttaactcacgaacactatgttgcgttggtttcgtcttcatttcaccagcagcgtggagatatgggatcagtgtggtatggatgtagataacattctcatcgcccacttcagccttcatctgccgaattgcttctaggaatggttgagattcaatatcacccacggtcccgccaatttcagtaataacaatatcggcgtttgaagtttttcctgcccgcataatcttttctttaatcatgccggtaatatgcggaatcacttgaactgtcgcgcctaagtagtctccatgacgttccttttccaatacttctgaatagattttaccagtcgtgacgttagaatacttgttgaggtcattgtcaatgaaccgttcatagtgaccaagatccaaatcagtttcggtcccgtcatttgttacgaaaacttcaccatgttgatatgggctcatagtaccgggatcgacgttaatgtagggatcaaatttttggatagtcacatttaacccacggttcttaagcagacgtccaagagatgctgcaacaattcctttaccaagtgaagaaaccacaccgccagttacaaaaatatatttggtcattgtataactcctcgtagattaagtttagggaaaaacagtcgtaaaccaataaaaaactccctattcatcatgaatagggagcattattccgaacgttgaccttgcgattcctcgtaaggttcccaaaaaacataataacaagttgttacttttgcgtcaagtgctttcacttaagaaaaccaatttaccacatcgataacggttaaacaacaaaacaaaaaaactcagctacacgagctgagcaacaaaactatttacctgattcttcgtcgtcattatcgtcgtcgaagtcatcatcatcttcattaaattctgacaattgaccttcaataccatctggcatgctgtctgtatcgtcatcatcatcgccgtcgtcaatatccgctaaatcgttcttgtatttaccaagttctttagtgctatcgtcggcgtcatcatcgtcatcttcattgtagtcagcgtcaagatcgtcatcatcaacatcaacgtcatcttgatcttcaggatcgtcgtcatcgtaatcgataacgtcatcatcatccgctgaatcagctaagaaagcattcactttcttgtgctttttggtcttcggatgatcctcgtcctcttccgcaccaaccgtagcttcatcgattgattcgaaaggataccaggtccgcaaaccccagacgttatcacctaacgaaatgaaactgccatcaatattcaaatcggtatagaattgagaaagccgctcgcgaatttccttatctgaatcgcccaggtatgcctgaacctcattagctaagtcaacaaacgacatggcatccccacgttctgataaaatggcgtgagctacttcaatcatcgataattcgtttttattttggccttctaagacttttaattccaaactggtgcacgtcccttccacagtctacgaaccactatactcgattacactgtaaattgcaatctaatctcgtaatttcctaacaattgttcaccgacataaagtaggtagtcaatcgatgctgaaccaccaaacgggcgctgatgaaagcctacccgcaaccgcggtgttaccgtttcaactggtattaatccgtacggtgttcggtatgttgcccgaatccgtttacccgcactgaaatgcatccgtaatcgattggtcccattacgagtcaacgtcacgtcgccattaggtaaaaacttaatggttacgggtacattaccatcctcatcttcggagtccggctcttgataccgcaaataaatcgtctcaccaatttgaacaatctgaccctctacatcaagtgcataatcagaagattgaccatcttgtacggtatgagtcgttaagtgaatgccaactggaatgctggttgacaagtcatccattgcaacccttcctttccattttttagtacgctgtgttcattataacgcttttattcgagattttgcacgattaaactctaccataattcatcccaatcgtaccgttaaataacctagtttcacgcccccccaaataatggactagtccaaaattagtgacgtggctctttatttccgttataatgataaaagaattcttcttaaactaacgagggatattatggaaaaacaaacgttattttcatctttacaagtgattgatacacctctaaccagcgataataaactggcggcgtttggcatgaccaatgcgttacttgatctttgcggcgacaccgatcaagcgttactacatttttggacgctgccaccaacattgatccttggcttaaaggatcgtcatctgccagaacttcagaccgccttaaaaacggtcaccaataacggttatgattatttcatccgtaattccggcggtttggctgtggtcagcgatggcggtgtactgaacgtttcactgtttattccgcaaacaacttcacagcatttgtccgtgaacgatggttacgaactcatgaaacagttaattcagcagactttccctagtctcccaatcgaaagctatgaggttacccattcctattgcccaggggactatgatttgagtgttaacgggcagaaattcgctggcatttcacagcgtcgcagtacgaaagcgctagttgtcatggcttatatcagtatcttgggtgatcaagcttttcgcggttccctcgtgcgtgatttttacgataccggattagctaaccacactaatgaattgggtttccccgacgtttggcccgacaccatgaccaatattgcggatgccctgcaccagccactgacgatcgatgaagtaaagggtgccatactggcggcttatcagcagcaaggtgtgcaacttgattcaacaactctgatgacgagtacgcaatcaccggattttcaaaaagcttacaataaagaactcgccaagatgcaaaaaaaacagcttagcatttaattgaaggagagattgtttaatttggcatatcaagcagaacgattgcctcgtgaaaaggtctttcgcgatccagttcataactatatttacattcagcaccgaatcattttagatttgatcaacaccaaagaatttcagcgcttacgccgaattaagcagcttgggaccgcttcattagtcttccacggtgctgagcatacacggttcactcattcattgggtgtttacgaaatcacccggcagatttgtgataacttcaaacgtaattatcccacccaaaaaccgggtgacggactttgggacgataacgaacgactggtagcattgtgtgcggccctattgcacgatattggtcatggtccatacagccacactttcgaacacatttttcagactgatcatgaagccattacggtagcaattctcacatccccaaccactgaggtcaatcaggtgctccgtagtgtcagccctgaatttccagctcaagttgcatcagtcattcaaaaaacttatcctaatccgcaagttgttcaaatgatttccagtcaaattgatgcagaccggatggactatttgctgcgcgatgcttatcatactggcactaagtacggaacgtttgatttgactcgtattctaagagtcatgcggccgtacaaagacgggatttgctttgaaatcagcggcatgcacgccgtcgaagattacatcgttagccgcttccagatgtatcagcaaatttactttcacccggtatcccgttcaatggaagtcatcttaagtcatttactgaaacgggcaaaagaagactatgagtcggcggacaatagaaacgagtcagctgcgccgtacttgctgtaccccttcttcaaccacgaattcgatctggatgattacctcttgttggacgacggtaccctcaccacgtatttcgcccactggcggcaatctagcgatcccattctagcagatttagcacaccgcttcttggatcggaagccgttaaaatcagttaaatttgatgagcggactaaggaagaaattcctgaattacggcaactcattgaaaaagctggctttaactccctctactacacggatacgaataatagttacgatttaccttacgacgcttatgatcctaatatgaagaaaccgatgactcagattgaactcatgcagtccgatggtcaactcatcgaactttcaaccgtcagtgctttagtaagcgccattacggggaaattctctggcgaccagcgcttcttctttccaaaggaaatgttatcttcaaaagaagacaatatcgaactatttgatccggtttacaaagcttttcaggctcatttgcataacgactacatcatttaactattaaggagtttacacatggcaatcaaacttatcgcaattgatatcgacggtactttagtcaacgaccgtaagcaactcacacaacatacgattgacaccgtaacgaaagcgcggcaaaagggcatcaaagttgtcctgtgtactggccgcccgattacgggtgtttcacaatacctaaaaccgctagacattcagggtgacgacgaatacgttgttaccttcaatggcagtctggcgcaaaccatttcaggtaccccaatcgtcagtcataacatcactttagaagactatatcgatttagaggcagtagcacgcaaagctaacatccattttcacatggaaacgttagaccatatttacaccgccaatcgtgatatcagtccctacactgtggctgaggcctttctcgtacaaatgccaattcgcttcagaatgcctgaagaaatcacggatgatctgacgatttcaaagggcatgtttgttgatgatcctaaattactatcagcctttatcaaagattttcctgaggaattaaaggaacgtttctacgtggttcaaagcgaaccctacttctatgaagcgatgaataaacaggccagcaagggtaatgccattgctgaactggcaacaaaactaggctttgcttctgacgaagttatggcaatcggtgatcaaggcaatgacttgaccatggtgaagtttgccggtaccggtgtcgccatgggtaacgctattgacgaagtgaaagctaccgcgcaattcgtgactaaaacgaacgaagaagatggcgttgcttatgccattgaaaaatttgcgctctaagcattaaaccaaacaaagaaggctaacaaccagttatgatgactgcttgttggccttctttatctgtgtaaaccgattaaatggtcaaaataatactcaaaacgattaacccaattgcgttgattaaacaaaaccaggcgtatttatttaccacgattggggcgtttttcaaactggcaacttcatgtacagaaattttttcttcaggcaacgattcttcacccttgtgccgtcgtctgcgccaacccgcaaataaatggcccttttccaaaacgaaaaaagcagcaccaattaaaaagactaagccaatcatgaaccaaacatttgccaccacaatcaacggctgccacagtagtactaacagtccaatcgctacaataatgaccagtgtcagtagcgcccaacgatattgttttacctttttcaaattctctcacctattcaactattattgtgctctagcataattgagattgcgtgatggtgcaagcccttttagatgtgagactaaaacgcacccccaccagagtcgccgccaaagccaccggaatcaccgccactaaaaccaccagaaccgccgctatccgacgaaaaatcactactagaactatctacgctggccgttgtaaaagttgacgtaaacgccgtcccaaaatcagcacccgaataactgtcatccagatacatcgggtaatagctctggaagaatggcgttaattcagcagcactgaagttaaccgccatggcttttagtacccgcttagacagaccaaacgcagcggcatatggcagcatccgttcccacaaaatcaaatcccccacttgagaccggtcgaattcaccgatgtcatgcatcatgctgcggaagttacgaatttgacccgcagcgtcttcgcccgcctgagtgtagtgagaaacgtgccgcatatgcttgatcgctgcaatgacactgatgatgataaacgcaatactaatgatcacaccagcaacacgcagtaccggaaccgtgaagaacagtgccgctattaggccgacgattcccaaaatcatattgaaaataatcaagagccagcctttaacaccaacgtcatccgtccgatggttaaacagtcccagtgcgtccgtttcttcataacgggattctcgccaattgtcaaacctctccttcaagctcaagctatcaggatgtctccgtcgatagtcctcaatatcaattaacgtaaaggttcggttgggcttagtaccttcaccgatttgattaaataagaatgacaataacttgtcgttttgatgatcaacactaagcttagcggtctctgtaagccggtaggtcgccactgattcacgcaacatggatggcactttttcagcttgaatcaccacttcaccgttagcagccagctccattagccaagctgtaaatgccctggtatccggctcactctcggttaaaatactttgactagtcaccgctgaataattaggaatctcaaaactgtgaaccttgggcgttttcttcaccggcaagccgacgtggtttttgaaccaccgcaatgtctttagtaaattcaaaagtcctaagcctaacgccaccaccataatccccagcggaatcaactgggattggattcgcttaagattagcttgtttggccaatttagcttcttgtttacgaaccgctgctaaatgattcttgttggaagtccttgtattgacagatgttaatgacgttgggaagacaatatgactctcaacaaaggtttttgctggcacttcggcaaccttcatggtcactttgccagcccttttatcaacctgtgtatgcccgctaagcggaccatgagtccaggcctgtaattgcttgacgtttttcccaggtaattgaaccgtaatttgaacgtgtttcagtggaaccgtccatccgcgaccaatgattttccagttcaagtctgccgtgtcagcatagttgacgatcacgtgccgaagtcggtacttataaagataagtcacgctttcatcataggccgtgtggtaaaccttgatctgataaattttaccggaatcagaagtctcataggtattctgtaacccgggcgttttagcactggcgactgtcttaccatccttggttaaaatgtccacagtggggttcccaataatgccatcggtacccgcataatcctgtctgagaaacacaccatggtataaatcatcaaaatgatacttaattcgctgtgttactgccgcatcaccatttttttcaatgttaacgttgatgtggtagcgattaatactataacctgctgcaactgcctgactgcttccccatctccaaaataatgcagccaaaatcaccgtaaacagaaacatgattcgctttttcattttgacactccccctttaacctccccatcatgttatcaaactataatttatttgactacttaaattttgaagattaagttaaaagttcacaatcaaaagagccacccggcatttagcaaattactaaatgtctggtggctctttataccgttcacaatgatttaagaattactcacttcgtagtgccgttgctgcatctttcttagatgccattcgtgccggaatatgaccgcctagaatggtcagtacggtgctaacgataatcagaatgattgctgcccacaaactaagctgcgcaacgttgctgagattagttaagttcttgatcaccgaattaattgggaaggttgccagccaggcaatcacgattccaatcacccctgaagccacacctaagattgctgtttcagcatcaaagacccgggtaatgtcctttttacgagcacccaatgcttttagaacaccaatttccttagttcgctcaagcactgaggtgtaagtaatgatactgatcataatcatgctagtgactaacgaaatggcagcaaaggcaatcaacacgtaagtaatggcgttcatcaaaccacccgtcagtttagaaacggagccagccatatccgtataaatgattttatctgcctttgatttacccttgttataaccatccagatatttaagcactttatctttgttctggaaagtattcgggtaaatcataatgctggcaggcatcttagatccgcccaacgcgttgattacttggtctttagcggtactattatcaagcgtttggcccgtcaagacgtttcttgaacttgccttctgcgctttgacaattttagaatcagcattttgagcaaccatgctcttagtcaaccggtcactataaacgaagccaggtgccaaaatattctcttcgttagccgattttactcgtagtacgccaacaacgcgtaacgttttattactgctgttattgtacatcgactgataattgttgcttggcaaatacatacccattcgttgcgtgtagtaagtatcattattaactgctttaaacgttgtacccacaatctgattgaagttaactttttggttgtttttgacgttaaaccctaaattcttcaatgcgttaacgttggttgaattatccttgttaacaatcaagaccacgtcagttgatttacttggaaattgtccggccaatgccttgtaatgtttgtgcaagaagctaaccttgccagaattatcagttggataagaagaaactccaacgcccactgaacttgccatcatactggaaacgtctacaccattagctttcttctgatcttggttcgaaagctgaaccggttttaccttgccattgacgtctcgtaacagattcatgccagtagtataagtataaccaatgtttttcccatatttaggatttaattttttaacataatcaatgtatttttgagaaattttgttggtatgctgggctttatctgcctcactagtctcagcgatcactgccttatctttggaaaaatgctccttcttctggccaccattatcagcaccactctgtgacgatgccgtttgcgaaatcgtcacggggtactgcgccaacgtgttggattgggttttatcgatctgtttttgaaagccgttagaaagcgccagaacaaccgcgataccaataatcccaatacttgaagcaaacgccgtcaaaaaagtacggccttttttagttcgaatattggtgaaggatagctttaatgctgtccagtaagtcattttcgttttcttcaaggaaaacttttgattttcttccttctcatcgtatggatcactgtcggactgaatcttcccatccgcaaaacgaatgattcggtcagcgtactgatccgctaattcagggttatgcgttaccatcactactaaccgctctttagagaggtccttaatgattttcataatttcctgactggtttctgtatccaacgcacccgtgggctcatcgcaaagcagaatttccggatcattagcaattgcccgcgcaatggcaacccgttgcatctgcccaccggaaagttggttggtcttcttatacatatgttcttccaggccaacccgctttaaagcagttatagcacgttcctttttttccgcgccagaaacaccactcaaggtcatccctaattcaacgttatcaataattcccagatggccaattaaattgtagctttgaaaaataaatcccacggagttgttccggtatgcatcccaatctgacgctttaaactccttggtagacttacctttaatgactaagtcaccagaatcataaacgtccagcccgccaatattgtttagcaaggttgttttcccagagccgctggggcctaaaatggctacaaattcttgtttacggaaagccaccgaaacatcgtccagtgctttcgtagtggtatcaccaacgtggtaatatttttttaaatgtttaagttctagcaaatttagtacctccatcatgtaaagccgattatagcctacaattgataaatgtcaactgttgactaacattcaatattttattacaaggtatcaaatctttcatgttgccaaaatcaatatgttctaatattgcacatctttttagttcattatacatgcattgctattctaaatcctttgaaaatttgtgtacgtagtaaaaaacaggttctctgaaatgagagaacctgtctcgatgacgtttagttttgattgctattctttaccgtgaaaccggttatggaatagtggactaactgggcgattttcgtgaatccggataatggcgtcgccaatcagcggtccaacagaaatctgcttaattttatcaatttgtttttcttttggtaattggattgaatccgtcacaattaactgtttaatggctgaatttgaaattcgttcgattgcgggtcccgaaagaacaggatgagttgcactagcgtacacttcagttgcaccagcatccatcaaagcttgcgcacctagcgtaatcgtccctgctgtatcgatcatgtcatcaatcatgatggcacgcttgcctttaacgtcaccgataatgttcataatctcagcaacgttagctcttggccgtcgcttatcaataatggcgattggagccttcaaaaattcagccaaagcacgagcacgactaacaccaccatgatcaggagagactacaaccgcgttctccgcaataccatggttaataaagtagtctgccaataatggtgcgcccattaaatggtcgaccggaacatcaaagaaaccttgaatttgcgcagcatgcaaatctaaagctacgactcggctaataccagccttttccaacatatttgcaactaacttggcagtaatgggttcacgcgaccgggctttacggtcttgacgcgcataaccatagtacggaataaccacgttaattgttgccgcacttgcacgacgcaatgcgtctaccataatcaacagttccattaaattgtcgttgacaggagcggaagtcgattgaatcacgaaaacgtggcaaccacgaatactttcttcaatgttgatccggatctcaccatcactaaagcggtcaactgatgtttttccaagactaacaccaacttcatcagcaatacgctgagcaagtggtttgttggaatttaacgcaaagattttcaactttgggtcattatatttctctgacatgggatcctccaatggcttaattctacgtacattttacactaaataacaaattcagtacattatttttctggatcgtagggtaactttttgaaatatcccggtttattggtctgccgagaacgtgcaatggccatatcatactggttcacttcatcggtaatggttgagccagccgcaataaaggcgtgatcagcaaccgttaacggtgcaattaaattagagttactgccaataaaggcatcgtcaccaaccgttgtttcgtgcttgtgggcaccatcgtagttaacaaagacgaccccgcagcccacgttgatccgtttgcctaagtgtgcgttacctacataggttaaatgaccaactttagtaccttcatcgatagtggcttttttaacctcaacaaagttacctaagtgcacgttcttaccaatgtgtgagtctggacgtaaatgactcattggcccgatattgctgccatcttccatttcagaatcttccaaataagaagatgtcaccgtcacattatcatgtaaaaccgtatcatgcaactctgaatgtgcaccaatacgacaattatcaccgatgaccgtcttgcccttcaaaaggacgcctggttcaataatggtgtcagagccgatcttaatatcaacatcaatgtacgtgtcctctgggttaatcagcgtcacaccgttgttcatatgatattcattgattcgccgttgcatgactttagttgccttggctaacgcaacacgatcattgacccccatggattcttcaaaggaaggcatccggtaagcggccacaatatcgccctgttccttcaaaatctgaatcacatctgtcaggtaatactcgccctgtgcgttgtggttagaagtcttatggagcgctgcgaaaagtgccttattatcaaaaacatagacaccagtgttaatttcgttgatctcttgttcctgtttggtggcatccttttgttcgacaattttttcaacaataccaatatcgttacgaacgatacgaccataaccagttgggtctggcgcctgagacgttaaaatagtggcaaccgctttttttgcttcatgatactgaaacagtttttcaaatgtttcagcccgaaataacggcgtatcaccactaacaactaaggtcgttccgtcttgatcttttaacaagggttccgtctgcaaaacagcgtgacccgtaccaagctgttctttttgcagaacgtacttagttcggtcacccaaggtttcttcaacttgttcagcaccataacccaccactgtgacaatttgatccatgtgtgtcttttcaacttgtgtcaacacgtgatcaaccatcgaacggccgcaaacttgatgcaaaactttatacagctttgacttcattctagttcccttaccagcagcgagaataatcgtatttctagtactcatttagacaaactccttaacattattagtaaaactcttgatttaatgaaccttcaaacgcctaatcttgaaattgagttagtcgctccggcgtataaatttgttcagcaaaattcccggcagtgacatcaacgtgatcgttggtagcatgtattttaagcaacgaagtatacttcggtacctttctttcgccctcaaaagtgccttcagcaaaaacggcaacaccagcaaccttagcatcaaattctttaactaaggactgcatgccacccactgttccgccgcctttcatgaaatcatccacaattaagacgcgagaatctggcgttaggctacgttttgagagtgccattttttcgatccggctactagaaccagatacgtagtttacactaacggtggaaccttcagtaatctgtgagtcatgccgagcgataacaaatggcacgtttaagtaatccgaaatactttgagcaatcggaatacccttcgttgccaccgttaatacggtatcaatctcatctcccaaatactgagtagctaccagccgcccaacttgacgtaaaacgcttggtcggcccagcaagtctgacatgtacacataaccacccggtaagaagcgatcggcttcagacagtgattcaatcacgccatcaacaaactcagtggcttcttgctggggaatatacggaataaaccgtgcgccaccagctgcgccaggaacagtctctaataggccagtcccacgggctttcagtgtccgtttcaaaatcgtcaggtcttcgctgattgaagacttagctgaaccataacgttccgaaaaaaaggtcaacgacactaattgatgaggccgctctaataggtaccgggtcatatcaatcaaccggtcgcttcttcttactttcactttggtttcctccatgtcacttaacttcagatttaatattctcattctagcataaatgttcgggttttagggatggattctttgaatctcatgattttattaataagcccgcgaagtttagtcgttttacctgttttttaatcgtctagatatacggatactttagctgctttcgtatgcaatgaactgtgccatttaatacaaataatgggcttgtgacaaaagtctatatcgacaaggatttaatttaatttcttgactcacacacatcctaaaatttactttagttcattacttgaatatagccttaacctgttccacaactcagattccggccatataacaccaaacaacgccatcccgataaagcccatcggaatggcgttgcttggtgttatattctggaatctaccgagttatatcgcagctttctcatgctcgcattcgctgataaaccagtgcactgaaataaaaaatcacttcaatgactgcaataaagaaactcaccggccaattagtgacgtaactgaggtaaagccccaaccaaacaccgatcaacgagaacgctacagctacgctgatcatcatacccactgtatgagcaaaatacttggctgccgccgctggtaaagtcagcagaataaaaatcaataatgaaccaacaatttgggctgcaacactgacggaaaacgccaatagcaccaaaaagataaccgataaagttcgggtccatagcccttttacttgggcgccaatcggatcaaaggaatcaaattttaggtagcgataaatcaccataacgacaactagcaccgaaacagataagatcaccatctgaaccacgttagcacgactgatcccaatcacacttccaaataaaatgccggtagcataactagcgttgctgtcggccagtgaaaggaagaggattcctaacccaatggctagggccgaaattgccgtgatcgaattttcacgtcttgacgacttggcacccagttcaccgacgccgattgaactaatagtcgtaaacagcagcatgccatttaatggctgccagcccataaaaataccaaaagccgcaccagcaaagccaatttcagataaggtatgggttaaaaatgacatgttacgggcaatcacaaagacacccatgataccagagataatggcgatcagcgtgccggccatgtaggcgttttgcataaagggataactaagcattattcatctcgcctactttctcattggtcaaatccgaaatattaccagcttcatattggcctggactcaaaaacaagtaatgatccgcgtaacggcgcgctaatggaatatcgtgagtcacaaaaatcacggtcagttgctgattttcgttgatctgttttacaagatcaagtaattcagttttagccaccgggtccagactggcagttgattcatcaagaatcagcagactgggccgatcaaggagggcctgagccaaatacgctttctgtttttcgccacccgatgcttgacccaaaggcctgcgacgaatgttgaatagttttgtttcagttaagatttcggtcactctttgtcgctcttttgccgttaaccatggcacaccaattttagcaaaattcaagcccacgaaatcttgaatactaaggggatactccgcatcaatattacgaaattgcggcacataaccaaccggtacagcttgacgattaggcaaaaagtctaaagtcccgctggttggttttaactcctgtaaaatcaagcgcatgagtgtggtcttcccaaccccgttttcaccgacgatactcaaaaaatcaccacgtttcaaatcgtagttcaaattcttcagtacctgcttatcagggaaagcaaaggatagttgttttagttgtagtatagattcagtcataaaaactcctcaattaaaaaaagcacctaggtgctttttttatttactgcaaacagtaatgattactattttattgtaaaggtttctataaagaagtcaatctcttttagagatattgcgccaaaaagtcagctagcacttgctgataacgctctggatcatgcgcataggcctgaatatgctcggcgtgaggcacaatgtatgactgtttagggccccgaatggcatcatacaaaacttttgcatgcttcacgggtaccacttgatcatcctcaccatgaataatcagtactggcaccatcgcctgcttaagctgttcatccacccgttcttgactcaatctcgaaccagtacgccagcgtgacaaccaatcagcaattggcacaatgatgttagctggcaaatgataatcacgccgaagcgttgttttggccatctgatagattgaagcaaagcctgaatcagccaccacagcctttacgttctgcggtaagtgttctccggcagcagctagaaccgttgcagcgcccatgctgaatcccatgaggacaattttaacatcagtacctaactcaccgatcactttattgacccaacccagatagtcctttctgtccggccagccaaaaccgattcggtgaccgtcactttcaccctgtgcccgtgcatccggcatcaaaacattgaatccatgatcatgaaacaggcgtgcatacggaatcatctgttctcgagcgtgattgataccatgcgctagaataacgacccgctgacttttttgcgcagctggaatgtaactagcacgtaacgttagcccatccggtgtggcctgccgccattcttgaattggctgtttgagataccagacattatcggtagccgtattttctgccactgctttgtgatgtcccttttctttttccgagtcactgatgtgggtcataccatgataagctgcgacactaacggctacagctgctgttaagccagtcgctatcgttgcagcagaaattttaagccatttagacaaaataccatcactccttatagtgagcgtacaagatatgcttctggacagaagccgcgaatactgttaaacacgcgctgagcacgagactctttattaaaaactgaaaatacagttggccccgtgccactcatcaccgcggtctgcgcaccataccccttcatccgctctttgatctgctgaatttccgggtaacgacgaacagaaataggttctaacgcgttgcccatattagctactaattgctggtgatcaccagcagcaatggcggccagtacgccgtcaatattggggtgtgccagcacgtcataatcaatttgccgcagaatgctgggcgttgaaacactcacattgggtttcgctaaaacgatccaaaccggttttagcgctggctgcaaaacttcaacctgttctccaagcccggtgacatgagcggtcttgctatacacgcagtaagggacatccgaatcaactttcagacttaatttagctaattcagcaattggtaaattaaggtcccaaagttgatttaacgcccgtaaaacggcagctgcatcagaagaaccgccaccaagacccgccgctactggaatatttttttgaatcttaatatgagcaccatgcttaactttaaacgtccgctgaagcaaagatgctgcttgaaacgcaaggttgcgctgatcattaggcaaaaaaccggagttagaagacacaacgatctgccttgcaccggttgagcgaacttcaacgtagtctgcaaggtcgatggaggtcatcaccatgtcccactcgggtcgtccatcagcgtggcgaaacggtgtatcaaggccaaggttcactttggccgctgccttttccactactatcaaattttgatcacctacacttcagtcagaatcgtttccttataaaactactgctcccttaagttttgttattagagacattatactcgaaatgaacagagtgtggaagaggtgcattaaccccacaaaaactagataagtcaaaaagtcccaccagaaaattttctgatgagactcatgagcaattttaactgctattcaccgaaatacagtttagcaaattttacattaccatttgtataaacataagcattgctttctctttacccttcgtaactttaacatatgtgttttcccatttatcatgataaggtcttagtacttgcacttgcctgtgttgttacaccaaccacaatcgtcaaaaagaattttttcatgatgtttcccccactattaacctttccttctaataagcagttgtacttcgtaaaatttcaggcgtacggttggacattaacattccgtgaccactgttatcaaagatcaatgactcaaattcacggtgtgagttgaatttggtgtacttaaaatcactggcttttagtgagccattaccgttgagctttttagctggaaaactagtaatggaatcatcagcaactaggtaaaggcgaccattatgaccgttgtaccccatggcttgttcatgggtaccaggacgatgagcaaataattgtttagtcagacggaaatgaaccgtcttggagccaatcgtacccttatagactttcactttcgaacctgaaaccgtccagtaataagcgttaccgctgtgatcaaaagttaaatcatgaccgccaggaacattggcgccatgactcgacatatggaacgtaatggctttattaggcgttaacgaagacgtgctgattcgttgcaacgttgacgtacgtgtcgcactcatcgacgtatcgcgccacatataaagtgacttatgtttcttgtcgtaagctaaggattgaccgtgaccagtggtaaaaataccgccaactttcacagctgagctgcccgacttactatccatcaaagcctgctgcttagctaacgacatgcctttaagtttattcatatcatagcgggcaacaaaccccttattcgtcataccctttgtatagtgcggttgatagaccacgtagagatagtgaccgccatcataagcagcagattgcggattagtcatgtcatacttcgcactgcccttagcattatgcgtgtctgccagctgaaattcagttttcaacgtccatttttggttgccgccaacactagcgattgtattactgccaccgggatttttagcgaaagcgtaagcaccagcttttacaaaccccgttgccttattgtcaactgtccttaaactacccgaagaatactgtgtaatcgcgttactcttttgcgtatatgacgccgcgtttacggtaccagcaaatcccaacagcgccactgtcccagcaatggcacttgtcatcaaacctaaatgcttcattgaaaattccccccagaattatttttacactgtcctttttcacaaccaatcaattattttatcactatcgcaccagttgaatgaactgctcgaaagtcgtatacatttatataatatcacaaatttcatggcgtaattaatgataatataatccccccttaaaccacgatgaggtcaatactgttctccaaaaaagcacagtcaaatcgctgactgtgctaaaaattaacttggataatatatattaaatccgattctttttccgtaaaataaatttactgaagaacgccatcaaacttaatccaattaaagccagtaagttgcccccatttacttcagatgtttgcggtaaactattggcactcacatcggtagctttcgacaccttgtttgcttgcacagttgtacctgaaacttgtccgctcttatcagaaggtgaaatctgtggcgctttaactgaagattgcacaccttgtgaatggctattattttggttagcttctgctgatttcacttcagtattctgagtcgtcccattactattaggctgttgagtaggtgtcaccttttgcgatggactcgccaaagaatttgagtcttcctgagttggcaagcctgatgcattagtactcgttgaactggctgaactattttcctcgggttgcgtctgggcctgcgtctgaatcgtatttcttgctgccacttttgccggtgcctctttaaaagcctgaacaacttgtggccaaagaattgcactcttttcccacttagctaaattctgatttgccgtaaccaaactctgctttgcagcatccagtttagcctgagccacctttaattgatcagcggctgttgttgcttgcccttttactttatcataggcaacctgcgctgtattcacagcatcttgagctgctttaaccgcttgattagcatcagctaactgggtccctgcattttgcaaatcagtcaccttttgctgtagttcattgaccttgttactatcatcagtcaactgcttcttagctgtattcaaattttgctgagcggtggtcaaagcattctgagcagtatcggaattagctttagcttgctgtgccgcagtagttaacgttgccaattttgctttatcagcagtcaactgagcattggctgcgtctaaggctgcctgttttgtctgagcatcagcgcttagattggccaagtcggcagttgctttatctagagctttttggtcagtcgttaatttactcttggctgtgtttagtgcgtccgttgcggaactcagattggcagttgctttatcagctgcagtcttagctttggtgagggcatcagtagcggtagtttgtgcttgtttagcggctgttaaagcggattgtttttgagtcagagtagccttggttgaatcaagagtttcattttgtttactcaagttttgattttcggtatctaattgagtctgtacttcttggggatcaacactaattggagttgcatcaaactgagacgcatttttgataatcataggagtattagtaacaacgagaaaatgccaatttccacgattatcaacatcaacgcctaaatattgagggagtttctcattccacccccccgcgcctaaaagcgcctgagtatgttgccaattatttcccaacttattatcggcaaaaagcatatctttgacagaattaaaaatggtattttttagcgttgctatggtcgtacttgtattttctgtagaaggcgttgcagaagtaccataccattcagcacactcgtaataattgtccaaatcactcagaccatattttgaagcagctgctgtgattataccaacatcatgttcctgatcatgttcactacttgcatgacttgcagcctcattatcaaattttttatcatatcctgcaactacatctttagcaaatttcaacgaaccgggtgtaacggtcaaatctggattaccaattttttctctaacaggatttatcaagttagctgcaaatatcgacagttcctgctgctgttgtggagtaagatcagcagcattatcaaccactccaccagtgtcagtcgaatgatccacgtacaaaccagtaggattttgcgcaaccgcagctacaagttcagcatctttcgcattttcaatcatatccactgagtagtctggaacattaagtttattttcgtcaggtaattgtgactttaaattatcaattttagtttgtgcggcatcaactgcgtcttgtttcttggcaacgtccaattgtgcatttttctgatttgtttgggccatattgactgcaaaatcagcatcttttttagcctgatcagcaactgcaagatccgcatccgcctgagtttttgcagctgtggcgtcatccacctttttctgaccgtccgtgatcgtttgctgatcagtagtaactgtattttgggcatctgttttactcttacttaattcagctgaaccggtcccatctaatgctttctgggcatctgtaaccgcctgagtactaccgtcaactaccttttgttgatcagcaacagtttgattagccttactcatagcagctgtggcggtttgcgcattattttgagcatcctgttgcttcgtctgcgcattgcccactgcagtttgatcatcttttaccttctgctgagcagtggatacgtcatttttagcatcactaatagcctgaggagttgctgccgctactaggttagcggcagcatcttgcttctgctttgcagctgttaaatcagcgttcgctgtatcgagagcattcttatcagcactttcggtaacgcttacattattgctattagtcgttgcttggttaacttcattttgagctgaatcaacattactttgtgcatcactgacttgtttttgtgcttgaccaacttggccgtcaattaatgacgaagtagacgttgctgagcttgccgtatttatcgatgtcgattctggttctttagcttctgcattcactgaaacccctataattccagccatcgctgcagcagtagtgatcgcaccaatttttgtaccttttcccataataatttccccctcttgatattaacaatcacactaaactaagtttcattgcataccatgacttatcccacaaatctaacaatatctccgaaaaaagtgtcttaatagtgccacgtttctcacagaaccaaattccccctcttaggatatttttatgtactctgacaattcacagtcatatctaaccattatataaaattactcaaataggagtacacatttgtatattaccacataacggtgggttcgccactgtcagttacaatttcattgccttaattagcaaaaaaagtgttgctagacataacaatctaacaacacctttaattttagccaataaaaaaaggcctcaaaggcccatttttattgattatcatcctcatcgctatcgccaaagttaatctgaatattctgagtcagaatatctgtataactgtaagaaacacgttcgaatgaattttcatcttggtccagatccacaacgaaaacagcaggatatgtctctttaagaattccgtgtcgttccgttgtttttttacgccctgcctgggcgactaccataagttcctggccaatgtgtgttgacagccggtccttaatagttgctaaacttgttggcatgacctcaccccttgtgtgaaacattttatcatggtttcacagaaaagtcaaattataccacaaccacttatttacaacaagtattttgtcatgaaaaaacagattaaaatcctttcatgataggatttagcagacacgtgtcccgcttatcgaaaaagcgtctgttacggttaactcatcagcgtaccgaaaagtttttataacaaaccctcttcgtgcaacgcgtttgtgagttcaataaactgttcaatggttagtttctctgctctaatttgtggtgaaattctgaccttattcaagacgttcgtgatacggtctttaacatcctgatccttcccaaaaattgcgcaaagattattccaaaaactcttccggcgatgcatgaaactacctttaacaaactttgcaaatactttgtcatcaaaaggcgctggatcgaaaggtacccgcttcttcatagtgacaatggctgaatccacgttcggttgcggaataaacgctgtccgtggaacggtaaatgccacttgagcatccgtttgatactggaccgcaattgaaagtgaaccgtaagccttcgtgcctggaacagcaactagccgatccgccacttccttttgcatcatgaccgtgattgactcaaattgaatgccactttgtaacacgttcatcaaaatcggcgtggtaatgtagtatggcaaattagctaccagttttaacggtcgatcaggatcaaaattttccttgatcaactggggcaaattggctttcaaaatatcttggttaagaatcgtaatattatcgtactgggatagcgtttctcccaagattggtactagctgatcatcaatttcaaaagctaatacatgatggctgttttgagctaaaaactctgttagaccaccaataccaggaccaatttcaatcacattatccttctctgacagttcagctgcctggacaatgtgctccaaaatattaatgtcagtcaaaaagttttggccgagactcttctttacgtttaaaccatatcggttaataatcgcctgtgttcgtgccggacttgcaattaatggtgtactcattggcgttcactctcctcttggtcgatctgttcaatcgcatgccagaatgtctctgaactaatttggaacatcaaaagccgctttttgagctgcttaccgttcacataaccgattcgcaataactcacctagagcttcacgacgggctttagcttcagggaccccgactaatcgagccttgatcaaatctgcctgactgatctgttcaactgttgaatcaccctcagtatacacgtgagccaaggcttcacgtattgcttcggcgctggcatgttccacgcctaatgatccgcctgctttggtaggcaccccctcagctttgggtaagaaagcgtgcttagcgttaggcaccacttctgaaacgattttgcgaattttttcacccgaaaaatcaggatcagtgaaaatgataataccgcgtttttttgccacttcctcaatcaaatcaagggtttcttctggtacagcagagccacgggtttcaatcgtatctgctttaactgccttcgcaatttgcttagtatcgtctttaccttcaaccacgatgacttctttaatggttttcaatctaggactccttaatcttaaaaaatcggtgtgcgttctgccaggttgctgcggctatttcttctggtgttgtttggcgttccttagctatagcttctacggtataacgagtaaagcctggttcgttctgctcgccccggtgtggttcaggtgtcaggtacggtgcatccgtctcaaccatcatccggtcaaggggggtcgcccgaacagaatcatgaacttcgtgagcattcttaaagctggccactcccgaatacgaaatcatcatacccagatcaagaaacttcttcaaccattctggatcaccattaaaactgtgcataacaccaccagtatccttaatacccactgatttaatgatgttataggtatcctcaaaagcgtcccggttatgcaccacgattggcataccatggtccttggcgatttcaatttgccgtttaaatacttttcgttgcacatcctgcggtgaagaatcccagtgataatccagtccaatttccccaagagcaacgacccggtcctcttctaactgctgctctaaaactttttccttatcagcatcgtagaattttgagtcctccgggtgccagccaacagctgcgtgcaactggggatactcgtgagccagccgaaccgcctgtctgttcagttcggtatttgaacccacgatggtcattttcacaacgtctaaatctgctgcccgtgccagataacgcggaacatcatcgataaattcttcgctgttcaaatgggtatgtgaatcaaaaattttcataacaatatttctcctacattgaagcaaaaatccgaatattcaatgactgaaaattcggatttcgccttccgccacttgcgaaagtttagttactattcgactgttgacccgttagcaatactttcaggtaccgtaacgagctgaaccttcccattagcatcttcagaagacaaaagcatcccctgactgacttgaccacgcatcttccgaggtttcaagttagccacaataatcacttttttgcctaatagatcctttggttctggataatattctgcgataccagaaagaatctgacgatcatctgagtcaccggcatccaaacggaattgtaagagcttatcagcaccttgaaccttttgaacatcaataatttcggcaactttcaattcgattttttcgaaggcatcgaaacgaacttccttcttgtttgatttcaattcggtattttctgggttccaaacgcccgagttagcagcttctttagcggcttccatagcagcccggccctttttcttatccgacttagtcatctgagcagcaataaaggcaacttcttcatcagcatcacgccgagggaagattggtgtccctttttcaacaaccttgctgttcttaggtaaactgtccatcgtcaattctttcaagttaacgttgtcgtcaaactccaaacctaactgcgacaagatttgttttggtgcatgagtcatcactggactcaagaagtaagcgatgattcgtagactcgcagccaaatgcgccataacggcagccaatttgcgcttactgtcatcatcatcgttcttagccaaaatccacggttcagtctcgtcaatgtacttgttggtgcgagcaattaacttccaaacttctgccatagcatctgaaagatgtaagtcatccatcagtttgtggtagttagccatcgtcgtttcagccgtttcttccaaggaagcatcaaaatcagtgacgcctgattcaaaggctggaatgacaccatcttcgtatttgttgatcatggccacagtccggttcaacaaatttcctaaatcgttggccaaatcatagtttaaacggtcaacaaaatcttcaggagtgaacgtaccatcattaccgtaaggcatagcccgaatcaagtaataacggacagaatccaacccgtaacggtcaaccaaggtctctgggtaaataacgttacccttagacttagacatcttaccgtccttcatcagtaaccagttatggccgaaaacagtcttaggtaatggcagacccagcgcatgaagcataattggccagtaaatggtgtggaaacgcacaatttctttaccaaccatttgaacattagcaggccagaacttcttgaatagactgtcatcttcaccatcgtaaccaagtgccgtaatatagttggtcaacgcatcaagccaaacgtacacaacgtgcttaggattggatttaactggaatcccccaattaaaggtggttcgtgatacagcgaggtcttccaaaccaggcttgatgaagttattgatcatttcgttcatccggtttgcaggttggataaattctggatgttccttgtaataatttaacagccagtcagcatacttacccattttaaagaagtaagactcttctttaaccagttcaacttcgtgcccactaggagctttaccgccgatgaccttaccattgtcatcacgatagacttcagctagttgcgtttcagtgaagtattcttcatcgtcaactgaataccagccttcatattcgcccaagtagatgtcaccttggtcttgtaattgctggaacattttttgaacggctttttcatgatagtcatccgttgtccgaataaatttatcgtttgaaatttccagtgttttccagagtttcttgataccagcagccatttcatcaacgtagcttttaggatccgtaccaagttgctcagctttttcctcgatctttaaaccatgttcatcggttccagtcaagaaaaagacatcgtagccggtttcacgcttataacgcgctaaagcgtcacaagcaatcgtggtatatgagttaccaatgtgtaacttcccagatgggtagtagattggtgttgttatgtaatacgtaggtttggtttctgtcatgtttaaaaacaggcccctttcagtcaatttatttttgtaatcaatacatttttatttctagaaagtctccaacattatagcatatctgacccgttggagaaataactctcagtcatcaactgctagttttcgggccagagtctcatcattttacacagaactcaaaacaaactcatttgctgaggccctagcccttgccatgataaatgcagcaaatctcttaatgcaagcgcattaggcgcagcatcacggcccgaattattattgaaaataacgcaaacttcacggacttgcgtacttaattcagaaaccgttgctgcaaaggcggctagttcctcgtcactatacttataaagcgtccggacaccgcgccaatccttaccccgattgaaccagccctgttcgttgcgtccgtgcaaccgcattaaggctaaccgatcatcggctactttagcaacgaatggcacaccatcgtttaagcggtgcggctcgtccacgatcacgtgggtcatattaagacctgctaaataacgcattaagtcatcggttaacgcgggatcataccaactgggatcacgaaactccactgcgattggtaaatcggtcatctgatcacgaatctcaaatagccactgtaaattctcagttgttcgctgaaaaaagggtggaaactggaataacacggtttttaattgatgtgcgctaaccagtggccgaaccattctgcggtactcggtaaaggcctgctgacgctcctcatcactagcctcctccttgccataatcatgcttggtcatgagcttatttgccttcaagataaactgaaacttttctgggacttctttttgccagttagcaactgtattagcccttggaatcccataaaacggtgtgtctaactcaacgactggcaaaactgccgcgtattctggcagcgtcacatcccgttgcacattttgaattaaagccgggtgctctttccaagtcgttaaaccaattgtaatcatcaaaagcacctcactcattttttaactaactgctgtttacttttcttttttaaataccgatcaacgcggtgatccggcacgacccacggaatcagtgaaccaaaacagaggattgcagaagccggtggccagacaaacgctaagccaatgccaatcagaacaaccagcattgaataccaagacttgcgctgtcctttaccaaagaatttcgtaaacactgaatcgggttcatgcgcggctaatagggccttaactaaaacgtaaaaactgatattaaccgctaaaaaaccgattcccatggtcgcttcaggtgctgaatattccgtatggctgccagcccaatcagtagcaatcggcagcacactgatggtcagtaagaaaaaattgttagcccataatactgccccactgaccatctccgtaatttgaaacaggtgatgatgattattccaataaacggtgaccgtcagaaagcttagcagatagagaatcaacttataccgcagcggccataatgcactaaaagtcgtgccatccggttccgggatttccagtaccaaaatcgtaacgatgatggccatgacaccatccgtgaatgcttccaatcgcgatttactcattgttgaatccccctactaaacatatgtatgaccggcgaaccggtcgaattgttaatggttgtgctcataccttgagctgtccaaagaacttagcggcatcttcttgaaccatttcaaaattaaacgaaaatgacagtggttcattgttaatcacaataacaggtgccatgggattgcggtaatctaacaacccagcaaagggataaaccctcatggaagtccccgtgataacgatcaagtcagcgtttgccatcgcgttcactgcattagaaatattagcttcgtttaagccttcctcatacagcacaacgtctggccgtaactgaccgccgcagccttcatgaactgggctcttaagataatcgtgccaatccacttcttggtgacacctctggcagtacacccggtaaaggttaccgtgaaattccaccaggtacttagcgccggctttacgatacaagttatcgatgttttgggtcacaatggttgcacgatcctgttgcgtcaacgctgcctgtttttcgtgaatcacgttgggcttagcatccggtttatacaaattagtctttacatagtcgtaaaacacatccggctcttgagttaaacaggtgtgactgagataatactcggcgtttttatgatgggtatacagcccattatttgaacgataatctggtataccagagggcgttgaaacgccagcacccgtcaagaaaacgatgtgcttggattgttcaaacgcccgctgaatcgtttcatccattatcgaggcctccaatcaccaaaatttctaacgtaaaatatacggcatttctagtttcttaaatagttcctcaactgacagtgaataaatggctttataatactcgggattatcgttagctttagttggtgcggaaataacaaaggagttctgaccatccgcccggttaatgccaacgtacgcccggcgcttgctcttaatatcaaccatatcagaatgatatagctcaaacatttggcgaacttccaaccgtaattgacgcttagaaaccacgtttgaaatagtagcaaactcggtcatattgattggtggtaatccccagtctttcaactgctcatcaaaagccttaaataacttaaccacgttacgacgcaaggtaaatggtgaatccactggtttttcagtaatcagtgcatacagcttcttagcagctgcaaacgagattggatagtccttttccagttgatcattaaccgccttattctcatcaccataaaagaccagtgcatcggtcaaagtcagtaaccgcagagtcattttatcatcgactggggttggttctggcttgatagtggcatgaattcccttgaggtacatctgctcgatttcatcagtaatcaagccgtgcttacgctgttcgctaaccaccacaatgtgactaaccgtgtcatagagttcagttcccagcatcattaactgctgatctagctgttcttcaccagtggaaatggcaaagaaaatttgtggaaacccacgtagcgtcatcaataggtgtaaaagctcatgggatgccgtgtaatctggtgcggaaaggtcgctgatctgaaccataatattatccttgtcctgaacggcctgtgcctgatcatgacgaacataaccattttgcaacttgccgatgaactgtaattctacttttccgggaaaaattttattgaccgcatctaatagtgattgcgtctctgaattgatctcaacgttttgcatgatatctacgtctccttgttatttctaatttgactcaataattgtctcgcctgagcttcattaggatcatcagtattgcttaactgtttcgttaatactgacacttctgacggtgtagcgccaacggacatggccaaagaacgcatttgcattttcatatggccttgctgaataccgttagtaaccagagccttaagcgcagcgaagttttgtgcaagccctactgcggcaatcagcttcatcaagtcttccggtgaattaatcttcgccattttttggttaatcgctactaacggtaataccttagtggcaccaccaacaataccaataggtaatggcaatgtcagcgtgcctgtcaactggtcgtcttcaagctgccattgactcaaacctcgatactgtccatccgttaccgcataagcatgagtggcactttcgatagctcgccaatcattgcccattgcgacaactactgcatcgacaccgttcatgatccctttattatgggtgacagcacgcattgggtctagttgtgcgatacgactcgcttgggcaatacgcttgccaacttgctgagccttatccgcctgatcagccaattgcgagactggtactgatactgtagccgttgttaaactctgatcaccagcattggagagaatactaaacaaagtagtgtggtgcaatttattttgcacgacccccgcaatggcttccagcatcgtattcatcatattagcacccatagcggccttaacatccaccactaaatcaatggaaacgaacccttcgccgaggtcgcgagtccgaatcgacttcggcccaccgccacgcttaacgatggatggatgggcctgttttgctacttctagtaattcattttggtgtaaagcaatccaatcatcaatagaagcgtaaacttttacatcactaaggaccacttgtcccgttaacagccgagaatgcacagtggctgtgataccaccggcttttgccaactgcttggcaccattactagccgctgcgatgacgctaggttcttcagtgaccattgggacaacgtactcatgatcattgacacgaagattgactgctacgccctcaggtaattgatacgtcgtcaaataattttcaatcagtaacggtgcatctccctgcgttgcccgatgcttaaggatttgttgctccgcttcagacagccccagcgtttcagctaaaatagctaatcgctgttccggtgtccgcttgtaaaactgtgaaaacgtcgcttccatgttcacctatcccttactatcattaactatagtcgtgattgagatatgcgtgaataatgccctcgcgcacaccgctttccgaaaaaatcacccgatctgaatctaacatttgcagcaacagtactaatggcatgatgccaccaataataatatcggcccggtctggttcaagaccagaaatctgttgcctttgtgccttatctttacttaataacatgctaaataaccgaaaaacctctgaggtcgtcagctgatagccgtgaatctgctccacgtgcaagatctgttgttgccgtctactcatccgtgccagtgaccggttagccccacctaatagaatcaaaggcttcgtttgcgcttcatgcagccaccaaatgtctcgcagtcgttttcttaggaaaatggatgcgctaaagaagtccgctgcatcaaccttatcgtcgagattaaactgctctgaaaggttgactgcaccaaagggaatactgattagattactttctttaccggaagtaatattcaccatttccagactggcaccgccaacgtctagcatcaaggcatcttcgactcggagccgatgtttaacgcccagatagtcataataggcctcatcatcaccggataaaatgtctagtttgagcccgatttcgcgttcaacacgctcaagaaactcagcctggttgcttgcttgacgaacagccgctgttgtaatggccttaaccgttaaattaggcaggtctttgtaaatcgttttgaatttacgtaaagcatctagcgtccgttgaatagccgcatcttgaagttctttttcgtcacccattccttcggataaacgagaatcttccttatagcgcgcaacttctcggaaggtttgatccggccgaatttcattaatcgtcatccggactgaattagaacccaaatcaacgatcaccaaattatccatcaccgacatccccttctcgttatcagcttaagtttttttaaccgaagtagttaagacccattttctctacgacttcttttagggtctgattagcaacttgatttgctttttcgctaccgtctttcaaaatctggtaaacaccaggaatatcctgttcatactgtgcacgacgagctcgaattgggtccaacacagcttgtaaaacatcgtttaaataccgcttaattttaacatctccaagaccaccatgttgatattgtgccttcaaatctgcgactttttgcttatcatcgtcgaaaatatcgaggtaagtgaacaccgtgttgccttcaacgtggcctgggccttcaacgtgcacgtgagtaggatcagtatacatggacatgactttcttttgaacggtgtcagcatcatctgacaaataaatcgcgttgttcagtgacttactcatcttagcgtttccatccaagccaggaatccgaccttcgccttctggtgggaagtagccttctggttcaaccagaacttcaccgtaaatactgttgaagctacgaacaatttcacgggtttgttccaacattggttcttgatcttcgcctactggcaccgtagtagctttgaaagcagtaatatcggctgcttggctaacgggataaatgaagaagccggcaggtacactttggccgaactgcttttgcttgatttcagtttttaccgtaggattacgttccaaacgtgaaacagtcactaagttaaggtagtgcatcgttagttcacttaaagcaggaatttgtgattgcactaaaatagttgatttcttgggatcgatacccacagctaaataatccagagcaacctgaattaaactgttacggattttttctggatcacgggcgttatcagtcagcgcctgttggtcagcaatcataatgtaagattcgtagtcgccagaattttgtaatttgacccggttttgtaaggaacctacataatggccaatgtgaagcttacccgttggtctgtcaccagttaaaataatttttttattgctcattttcaatctccctttcaatttatgtacctattttctggtgcaataacacttaataaaaaagacgccccaattgcgtatgcaataggacgtcaaccgcggtaccacctaaatttgtgacgtaaagtcaccactctcaccgataaggaggcaccctaaaattcacgtatcagctccaaaatgatcattctgaccactttcagcaatcgtggtctctctgtcaacatgatctaaacgcactgacgaattctatctatataatggtatctattttaagcattttaccagtccttgtcaaagttggtttggcctgagtttttctaattgacacaaccacctaatcacactagaatggttcaagcacattaaacgaaagaggcggttttttggaatcacaggaacaaaaaattgaacagcagcgtgtcgattcggtgatcaatcaaattaccgcaaaaattaagtcagtctcactggagtacagtaaggctcatgccgaaatgaagttggtgcaggaaaactacagtgccaacacttcggttaactacgtggaagtcgatgaccgaattgaaacttctgccgaactgcagcaacaacgggccttagcttcccgactgattgaaaacgaacaaatcatttctagccagttaaacgtctataaagatttggagaagtcaccctacttcggtcggatcgatattcaggatcccgacgaagccgaacaggaaaaactctatattgggacagcttcatttactgatgacgacgctaactttttagtttacgactggcgagcacccatttcggctatttattacaacgggactttaggcgatgtcacctatgatactcccgcaggtaaacagcttactaagctgaccaaaaagcgccagtttttaatccaaaacggtaaaattgaatccatgtttgacactaacgaaaccgttggtgacgaaatgttgcaacacgttttgggacagcaaaacgatgaaaccatgcaaaacatcgtggccacgattcagcgtgaacaaaacgacatcatccgtgatactcgttctgatttactggtggttcaaggggttgcaggctcaggtaagacttctgctatcttacagcggattgctttcctgttatatcatagtcgccaggagctgcaggctgaccaaatcgtattattctcacccaacaagttatttagccactacatttccgacgtgttacctagtttaggcgagcggaatatgcgacaggtcactctagccgactttctcactcagcggcttcagggattaaacgtagaatctttatttgaccgctacgaaaaagaccttgagctaactaatgagcagcaagctctagtggactacaagtcctcttcacattacatgcatcaaatcgcggactattgtcaaaacctggcaccaactcattttaaatttaatcacatttattttgatggccggattttcttcaacaaaactgaaattgaaaaaatctatcaggacttaccgcacttacagccggcagaacgctttttaagaactaaaaacatcctgatcaaacaactgaagcgtcgaatcaaccaagaagctaaatcggactgggtggctgaaaaaatcgatcagctctccgatgaagaataccataatttattgggttcgaaacgacttcatgattttcaagaagtcgatgctgaaaccaattatattgctcgcaaaatcgtgactcgacgtttacggaaggtctatgatgccatctacaataactacttcttagacatttacagtcaatacgctgactttatggatactgttgccacaccagataatgtgtcagatgataccatggcggctagcaagcataacttcttacatgatatcgaatttcataaatgtgagttggtagatgctgcaccattactttatattcgtgacatcctcactggtggtgggcaaaaccatgctatgcagcacttgtttgtggatgaaatgcaggattactctattgcccaactacagtatttacatcacgcgtttcctaaggcgcacatgactttcttaggtgatgcagaacaggccctgttcaaagctgttcaaacacctgaagcattattagccagcctacgtgatgcctttaacgttcaccgaccacggctgttaaaattaaaccgttcctaccggtcaacattgccgatcacgacgtttgcgaaggcccttttaccagatggtgatcagattgaagcattcacccgacctggaagtttgccacgtttggtgattcgctatgatgctgaaagttgctacgatgcgttagagaatgaagtcaccagtctgcgtgccgacaacggtactgtggcaattttaactaaaaatttggagcaggcccatgctgtttatcaaaaattacatcatgaaactaacgatgtcacgttaatgacagacgccgatttatccttaccgaaaggaacgcttgtaatgccgatttatctggctaagggtttggaatttgatgcggtaatcgcttggaatgtttccgcgactaacttccctgatgaacggtttactggcaccctgtacaccattgcaacgcgagcaatgcaccaattaattttgatgagtattggccccgtttcaccgttgattgcttctgataaattgccaaaaacggtcctgcaaatcgaacatgaatttactaattaattttaactaggcaaattacaagtttaatccgaacaagcccggaatctttcaatggcagtctgttgatgatgtatttttaatggtcgttgattaattagttcaagtgctgctaggatctcatcagtcgttacttgttttggctaaaattggtctttttcgggaagaaaccagcgtaaccgtctattaaaatttcattggaacctcgctcatggggatattggatggcaaaaataaacttgatatagatacctgtctaaggcctgatattggcaaactctttaccatgatcaacactaatggattttacttgggaccgaaggcccccataaacttgccaaaggcggtgtgttagagccttagccgttctattaggggctttgatggcccatagaagtgggtttaagttcacgaatgtaaccagacatgatcgtgactcacttcgactagaaagcaccgtatctacttcccaatgacaaaagctaacacgtgattaacagtgtggcgttgttcgatggaagtcccattgtaaattcccacgatttcgctcactcggtgctggcggacattccgattgggtagatcagtcaatttgaaggggagccagccacgattaagcccattataaattgacgcagtgctaagttataagcggccgcaatggtttctggtgaccaggtaatcgtaagtgattggtaataaagtcgctaatgctgccgtcagcatcgaacgacgaccgcaattccgccttttgcgatctgcatcttgctgagctaattctggatcataaggtttaacccggtccaacatcatagctaatcgtagctttggcgacgcctaaggcgtcagccattacttggtagattattcccctcattgaccagtttggctagtgcgccacgtgaaaacgtgataaagtagatgtacccaaagtaatcactccctatattggttggaattagctactaccattgtaagtgattgctttgggctttttaatttctgttcggattaattatagaatttgccactagtaaacatcaaaaaaacaccgtcataatcagtcgcttctcgcgagattatgacggtgttttagcttaccctctatttattaacaggtgctaacgctttcttgttcggcttcaaagcctgtttaagcataaatggcgccaccatggtagctaaaataattactagtaccatttttgaataagtcgcattagataatagacctgattgcagcccaatttgcaccgtaatcatgcccatttcaccacgagaaatcatgcctgagccgatgacgtaactactatgccaactaaaaccggttaaccgcgcgcctaaaccacagcccaataacttcgtcaagcaagccaaaatagtcataacgacaattaagcccaacgactgtcctaagtagcgaaacgacatactcaaaccaataccgacaaaaaatagcgggataaacgcagcgtagccaattggttccatgtgggcttcgatgacttcccggtaaggcgtgtgtgcaaccgcaattcccgcaaaaaaggctccaactgccccactcaagccaacggcatctgccacccaagccatgcctaaacaaatcaccatagacatgatcgtcacactggaattcatgagcaatttttcgctgattcccatcagataaggtgcaatccagcgcaccactaaataagtaccgccgaaaaaagcgacttgctcaagtaaaataagggcgatgctagtatgctgcccactagtcttcaaaccctgagttcccattaaactgatcatcaccgataatagaattacacccacgatatcatccgctacagctgcgccaaggatggttgccccttctgaagtgtccaaagcgtgataatcccgtaataccgctactgatatggaaaccgatgttgcactaaaaataacacctatgtatgttgcttcaaaaacagaaaaatgaaaggcaactgctgcgctgcccataaacaccactggcataatgacaccgcaaagtgcgacaataatagctggcttaaaaaagcgcctcagcaaggtgagattactttccaggccaccaataaacatcagcataatcacaccaatatctgagaagaggttcaacaactgatttggctgcacccaattaaggattgccggtcccaccacaattcccactaagatttgaccgataacggacggaattcccattcgatttgagaagtgtccagcaaaggttgtcaaaactagcaggaaacataatgtccctataaaattcacactgaccaccccttgtagtaaaatagtgctgcatgaccaacactaaataaaatataacactaactggaagtgaaatcttgtacatgtttaagaattggcatcaagttggcaacattaagaaccacacaaaacaatatcaaggacccgttttttcagtcgaacaatgtgagattgatactccggatggcctttccgttgaaagagaccttatccacactgcaccaactatcactatcttggcgctaacagatgatcaacaagttgtgatgactagtgaatatcgagtggggattaatgctgaatcagtttccctgcccgctggtattattaatccaggggaatctcctgaagaggcagctaaacgtgaatttcaagaagaaactggctatctagcccggtcggttaaagtaatgaccactgtcacttcttctgaaggttttatggatcaaacagcagcacttatcttgcttcgctttgatccgtcaaaacgaacttctactcatttcgatagtgatgaattcgtttctactcaactgattgatttaactcaagttctgaaatggatcaaagccggaaaagtgaatactgctcaggctttagccgcagttggctattatcagctttatctctcaaattaaacggggaaaacaaaaaaacaacctgatgatttgatcatcaggttgtttttatttttacgctgtagagtatgtattttactcatgttaataccggaggtggggttcgaacccacacgtcctcaacggacactggattttgagtccagcgcgtctgccagttccgccactccggcataatctatttcgttactgcagcatatcgtatttgtacttgtaatacaagacatcagatttgctatcgggaagacaggattcgaacctgcgaccccctggtcccaaaccaggtgctctaccaagctgagctacttcccgatgtcgttttataaattgccaactatattagtatactactcagccctaattattactagcatatttttagcctaatttgtcgttattgaatttttttgaatttatcgaattaagaaaacattctccctgctgtagtatcttaaatttcttttgttgcactttatggactttgcttcactagcttcgtatccaaccttctatgtagtataatatgagttgccgctgtagctcagaaggtagagcacttccatggtaaggaagaggtcatcggttcaaatccgataagcggcttttgtttgattcatgctgtgatgctgtgttagttaaatagctgcagtcagcgttcacttaaagtgacttgcttggctgctttttatttccggcataaaaaagacagccatcgatttctcgatgactgtcttagtttgcgtggcaacgtcctacccttgcagggggcgatcccccaactactctcggcgtgctgaagcttaacttctgtgttcggcatgggaaccatgggaacaggtgtatccgcagggctatcgccaccacactattgagaactggtgctctcaaaactagacaatatcattttcttttaccgagaaacacccactactcgtggtaagtcctcgaaccgttagtactagtccgctcgtggcatcgctgcacttccacttctagcctatctaccttgatcatcttcaggggtcttactttccatatagggaatgggaaatcttcatcttgaggcgagttggtcgagtttcacacttagagctttcagcgttatcttcatccacacatagtaattcagcaaatgcgcctggcggcacaatgatacaccagcggtgtgtccatccggtcctcttcgtactaggaacaagctcctctcaaattcctacgcccgcgggacggatagggaccgaactgtctcacggacgttctgaaaaccagctcgcgtaccgctttaatggcgaacagcccaacccttgggacagactacagcccaaggatgcgatgagccgacatcgaggtgccaaacctccccggtcgatgtggaatcttgggttgggtttttgagataagcctgtctgttatccccagggagcttttatccgttgagcgacggcccttcatacggtaccgccggatcactaagacccgacttagtacctgctcgcctgttcgtctgcagttcaagctcgccttgtgcctttacactctacgaatgatttccaaccattctgagggaacctttggggcgcatccgttacttttggggaggggaccgccccagtcaaactacccacctgacacggtctcccgcacggcttagggcgcggggtttaggagtgttcacacaacaagggtcgtatcccaccagtgcctccaccgaaactagcgtttccggtttctacggctccggacctatcctgtcaagttgtgtcaaacacccaatatcaagaatatctatagttaaagctccatgggggtcttccgtcctgtcgggtacctgcatattcacagtacttttaatgtcaccgaggtctctcgttgagacagtgcttcagatcttacgcctttagtgcgggtcgcgaactacccgacaaggaatttcgcctaccttggaaccgttatagttacggccgccgtttactggcttcatttatgcggttcgccgaagctaactcatccactttaccttcagcaccgggcagcgcagccccctatacgtcatcttacgattttgcagaagagaagaaaacctgtgtttttgataaaaataaacagtcgcctgagcctcttacactgcggctgacacttgcgtgcagcaacccctctcccgaagtacggggtcattttgctagttccttaacgagagtgccactcgctaaccttaggattctctcctcgactacctgtgtcggttgcggtacgggtagtaaggatactcactagaaagctttctcggcagagtggacatcagccacttccctacttaaaattcggtcctcatcacagcttgtctaccccgggtgaaagcatttaaactaaaaacagattgctgcttgaacgcacatatccacagtgcgcacggcttagccttctgcgtccctccatcgatcaaacatatctactagtacaggaatatcaacctgttggccatcgtctacgccttgcgcctccgacttagggtcccgactaactgggaggacgaggccttccccaggaaaccttagtccttcggttggtggatcagattctcactgatctttcgctactctaccggcatttctcacttctagcgctccacagtcattacgatctagcttcacccgcccttcttacaaaaagaacgctctctatcaccgcgactattggtcgcatccacaatttcggtggtatccttagccccggtacattgtcggagccagaatcactcggctagtgagtattacgcactctttaaatggtggctgcttctgagccaacatcctagctgtctatgcaactccacgccttttccattaggatacactgattagggaccgtaattggtgggtctggctgttcccctttcgacgatggatcttatcactcaccgctgactccccggataataaattctatggcatcggagtttatatgaattcaggtaacccgtgacgggcccctagtcctccaaacagtgctctacctcacgcattctctttccgaggctagccctaagctatttcggagggagagaaaccagctatctccaattcgtttggaatttccgcttacccacacctcaatcccagtcacttttcaaacgtaccacgggttcgggcctccagtgcgttttaccgcacttcaccctggacatgggtaggtcactggttcgggtctacatcaaattactgaaacgcccccgttccgactcgctttcgatacggctccgactttaatcttaaccttgcatgttaacgtaactcgccggttcattatacaaaggcacgctgtcacccattacgggctccaaataatggaggcaaatggtttcaggaacttttcactccccctgtccgggtttgcttttcacctttcctcacggtactggttcccatcggtcactagggagtattagcacttgggagatggtcctcccggattccgaccaggtttaacgggtatggccgtatcaggatcctgaactgaggcaacaaatttcgtctacgggctatcacccgctctggccggtcttcccaaacagtcgactatatgttgctttgctaaactcaatgttcagtactacaacccaaggaagcaagttcctggtttggggctgtcccacttcgctcgccgagactatgggagggatcgcaaatgctttctcttcctgtgggtacttagatgtttcagttccccacgtgctgccaattattgctaatgtatcactaagcattaatcatcgactaagaggatgggtttccccattcggaaatctccggacaaagcttacgttacagctccccgaggcatatcggggttagtcccggatttcatcggctttcctagtgccaaggcattcaccatgcgccctttttaaacttaacctcatcacttacggacggatagataatggagtattacgcgagtaaataaaactttacaagtaaaaaaactcaaaaatacgcgtggttctcggcttaacctttaattaatgaaataattaatataaaagagaaaatagaacatgatattattctagtttttcaaagaaccaatttgagagtagacctctcaaaaaaactaaacaagttttgtctaatggaggtttccgtattagccttaagaaaggagggtgatccagccggcaggttccggtttctacactacggctaccttgttacgcttcaccctaatcatctgccccacattaggcggttggctcccgccgaggttaccgaaccgactttgggttgttgcaaactctcatcggtgtgtgacgggcggttggtgtgtacaaggcccgggaacgtattcaccgcgccatgtgatccgcgtattactagcgattccgacttcgtgcaggcggagttgcagcctgcagtccgaaacgagaagggctctttaagcgatgatagcttggccctcgctgggttgcgactcgttgtaccatcccattgtagcacgtgtgagccaggtcataagggggcagatgacttggacgtaatccccaccttcctccgtttgtcaccggcagtctcgcagagtgcccaactaaatgctggcaacgacaataagggtgcgctcttgcgggaccttaacccaacatctcacgacaccgagcttactacatccatttcaccacctttatcttcttccccgaattaacgaatctcttatgttagcaccagtatgtcaagacatggtaaggtttcttcggtagttcgaattaaaccaatgctccaccgcttgtgcgggcccccgtcaattccttgagttcaagccttgcggtcgactccccaggcggaatacttaatgcgttagctgcgggcactatgaagggccggaaaccccccaacacctgtattcatcggtttacggctatgga

SEQ ID NO: 713 - DNA, 16391 bp, Unknown
  Metagenome-assembled genome
gttaggaccaaaaagtccacctccagagagcatatgagacatgcgtcgaggcatgacctccatctcgatgatctgcgcaaatggcaggccatctgccaacctgcgagggcctatcggcttgcaagcgactccgctccacacagagagtaaacagccccaccggaagcgagctgacttgggagaagacaaagcgtggctacctgcaagcttgacatagacgacgtggtggcttgctcttgtataaataacgtcatgcgggccatataccactgagatagctatcatcctgcacggcgcatgacggcttggcaccccagcctgaaggaaggggcctgccgccgaccgctgtttggtcacacaggcatccatgacaagatgaatactcgcgaccccgttccgcaacatgagccccatcagaggcctgttgaagatgaggacgaggatagcgacaacgacaacatgcaagccacggatgcactttgtgaggagagcgggaaggcagaagaagtgctgcctgctccctgtcctgcgtcgattgacctactcggctagataacaacagcaaccaccggctagcaagtgcgacggcaataaggttcaggaatatcgtattgaagagttgactgaggcgcagacgacctgagactggcagactcgccgacgaatccggacgacgaagacatgaggcaatagccaacaaaagcaagaagggagctgccctgcctgctcagaaagacgggcatgatagccttcacgtgaggtcgcagtcgtaatgagggcatagccatgaatatggcagattgtcagctgagtgcaacatctcccatgtatgacctcgttgagctgtccggattatcgcgacttcctcggcctgtgttgcataggtccaccgctatgctgctccctcatcgtccgtcacttgccgtaagtcggtgccctaggcgaagaactcgcgcaggcaggcccgttgcgtagttctccacccgtcgagccttctcgccagggatggtggggggtcgcagaagtcctagaatctgcaccgcctccgatgggccttatgctgcacaatctgcatgcccggaactccttgccccccctgtccttcgtatctagcaagcagtgaacatagtatcagaaagatcgaaggacaacgaaaataaagaagagagaaataggaactggagatagatggggaccgtactgtaacagacggaccaaggatacactcattgcaaggagaggacagaaactcccgaatagaccctgtcggtgtttttttttttcgctcttttttttcgtagtaggcgagcacgagccaggcatcggaccccccggccaacccgacatacagcgcgtcagctcaatcccagtagccgaggacgcgacctcgcatcggcctctagccaaggatctacctccacccggaagtgagagatcatgatcgtgaaaatgagtatcgggcctctctgaagagagaagagggaggggatggggtgaggaaaaggaatgagcaagggcgggagaaagaaaagaaaaagattaaaagaacagaaaaaataaaaacagattacgaagaaacagagaaaaaaagacaaaagaaaggcgaatgcaacacaatgaccaacggaggagaagaagatacaaggaagagtagaagtgtgaagaaatgagaaatcgaaggtagaagagtagagaggcctgcagataaagcaacagaatgcccaaaattacagcagcttctaccagcatgaaggcgcatgaccccgtctaatcgtacggggaaaacagcgtgccctaagtacccatgcatgagagagtgcgcaccttaaccgtctgcgacagaagccgccagggtcggagaagccctcatcttcggcctagcactcctgtagcgcgcctcccgccctcctctgggcggagccatcagcccccatagcgcccgctgccccgcgccgttcctcttcaagctcgacaagcgcatggttttcgacctgtccctcacggtcaagagacaagacgagtgtaaggaagcaccatcgccagagccccaccccactaccattgcgtaattcatgccctgaattgcaaatggccgttttttttctttttttttgtttttgctatgcagtccctctcctgagggctcaagatggacgtagtggcacattccttccagcttccgacgttgacctagacaaccaacatcgtagccttccgggatgtgccacgcctgcattcggcgggccatcctgttgcactcagaatgctaatccgcctatccattcttcagagtcttgttctggtacaagtctcttgcagatggctgcacatgtgtaatgcttataatgactatcctgtcataaattgaatgcatagcagagcttccgtaagtctgtcccgtgtcatcggcctcgccttctgacacgtgccagatctccgtcggtcgagaatccacccatgagaagcacatacagatgctggcacatctagacttgtggcatctaagcgattcaatcgcttgatctcgtcattcggcggagggagcatccatgaagattgcaatggcaaacgatcatgcaggaacggacctcaagaaccagatcaaggagtggcttgaatcggaaggacatgaggtcgtggactttggcacctatgaccatgaatcatgcgacctctccgactttgtgcttcctgcagctctgagcgttgccaaaggcgagtgcgaccgcggcatcttcgtagacggcgtcggctatggctctgcaatgattgcaaacaagatgcgcggcatctttgcctgtgtctgccaggatccggtctgcgccgagctggcacggtagcacaacgatgcaaatgtcctctgcatcggcggcaagatcatcggccccgtgcttgccatggcaattgcaaagacctggatggcaacagagccactgacagcagagaagtatgtgcgccgccgcgacaaggtcgcaaagatcgacgaggaatacacccagccgctgaagtgatggagcaggctagctctcgatcccgaagaagcatcaatcttctcttgacatgaagaagccctgccgctctatgcggcactcatgcagcgggcagaagatgttcttccagaattcggtatccccgtccagaaggcacagatagcgctcttgaacaggcatgtattcgcatgcgtgccgcctcttgcagtccgtcgcatggcttggatgtcccagagttccatcacgctgacgttcggattggaccacccgctcgcatcggcgcgcatagccgccaaagcagaggcatatcccggcaggtggacacaccatcttggtcatatgcgatgcgccagagcttgacagcgagcttttttcctggctgcatgaggcatgcgagctcgctgcacgcaaacgacacggagcttaaggcggaagggacaggcagcctgctccatgctgtcacgcagctttactgcccatacggcgctgtgtaccggaaggcgctgttccgtcgttcgaagggcgacccctctgggcgcagcggacagctagcttccatacggagccttccggcacgattcgaggcagcttttacaggtagcaatgccgcccagggcggtctccctgagctcgaatggcagcgagtgtccgacactcctcagcgcatccaccgtctcgtcgaagaaggcggtcgaatggatgccggcaagtgcaagctcgcacgagacgagcgcattggcagcagccgaagcattgcgcttctggcagggctcctcgacaagtcctgcgaccggattgcagacgaggccaagcagattcgtgagcgcgatggcggctgctgccagacactgctggggagagcctccgagaagctgcgtcgctgcgcttgctgccatggcggaggcggtaccgatctctgcctggcatccgccttctgcaccggcaaccgtcgcattccttgtcacgatatagccgatagcagcagcattggccagagcatcccggagctcttcctgactgaaatctccagctttgttgagagcgtcaatcacgccgggaaggatgcctgccgagtccgcggtaggcgccgccacgatgcggcccatcgaggcattcgtctcgagcaccgccatggcataagctgcggctttcggaaagacgccgctgaatacctgatgcagcttgttcgagggatgagattctctgttgccagcgcacagctgcatcagggcatgggcttcgccgccgatgagtccgcccatcgtgtgcatgccatgctccagcggcgctctgacagactccctcatcacttggagtgcacggtcgagataggcgtaggtgccagacatatccttgccctgcatggcaagaagcagctcttcgcggtcgaggaatgcacgtccaaggctgatgttgcaggtgtaggcatgtgccagaatcgaggtgccatcctgatagtcgagcttcgggaagagctcctgtgcctcctcaggcgtatagcgcggcgtagcggcacccgctccttctgggagcgagaacgccgggatgaaccggatgcgcagcactctcggatctttaagcagcatctgctgtacctcgtcgggaatcgcgctgtccacttcgagcacgttgtaggcaaggccgcccttgcgttcccgcaggatcgtcgagttgccgatattgatcccggcatcacccaatgtcgatgccacaaatccgagaacgcccggcatatcctgctggtagatgatggcggcgctatactcccccgttatctcgacctttatcccatcgaccctggtcagccgtgctgcaccgccgcctatcgattcgccgcgtacgctcagcacttcgcctgcagcatcacgtacccagacatcgaccgtattgggatggcggggcttcgtcttggagtcgacctggaaatcgaacgagatgccctgtgcccgtgcaatctcgaacgaatcgcggatgcgcaggtcgtccggcctgaagcccagaaggcctgcaacgagagcacggtcggtaccgtggccgcgataggtatgggcaaacgagccatagagggtgaagcgcatctccttcggaggccgccccatcagttcatgtgccatgagcgcgatgcgcagcgctcctgccgtgtgggatgaagagggaccgaccatgatgggaccgataatgtcagaaagccccagtgtcttgctatggttcatttcaggcgtcctctcttgaaggcagcagcatctgcggaaagcctgcatgcaggctttcatggcaggtccctgcagagacattccagcggcatgtgcatgaacaggagttccgcttcgatgagtctgttgtatcaaaatcgaggtaccagagaacgagcgaaggggtatctgtaacaaaggagaagggaagcggaaacgcatccgggaagacgccccaagatgcttgctgcaggtccacatgttcccgctggatccaagaagcagagccgatgcttctgccgttttgtccggagatgctcatatacagcccctcaggataggcatatacagcagaatcccccggtcccaggtggccgggggattctgcagcccgttgcacagctgcctgccgagcatgtgcgaaagaggatcttctggttcagtccttgggctctcccgccagcgcatgcaggtcgtctttcgtgaactggacgaaggcgctatcccccacctggtactcatgcttgttcttgggattgaactccgtaaccttgatcaggtggctgccgcattcgacatggtagttctggtagttgcccatgaagcgggacagcacgaccttgcagggcagctgtccttcatcggcgatgtgagccgcttcgggacgcaggacgagcgtgatgttcgattccggcgccatatcctcgacgccgtctacaggaatctcgctcttctcgatctttgcaatgccggtatcgcctgtcttggatacgagcgtgccacgcaggaagttcgcctcgccgatgaagtctgccacgaactcgtccttcggacggtagtagatggtcttggggtctgccacctgatcgacaaggcccttcttcatcacgatgatacggtcgctgattgccatggcctcgctctggtcatgcgtgacatagatggccgtgatgccagcctcctgctggatgcggcggatctcggtacgcatatcgacgcggagctttgcatcgaggttcgagaggggctcatcgaagagcagcacgcccggctcgatgacaagggcacgggcaagggcgacacgctgctgctggccacctgagagctggttcgtcatgcggtcttccatgccctcgaggccgacgagcttcaagatgttcgtgaccttctgccttatggtctccttgtcgaacttgcggagcttcagtccataggcgacgttgtcgaagatgttgtagtgaggcaggagggcatagctctggaagaccatggcagtatcgcgcttgttcggcgtgagctcgttgatggcttcgtctcccagatagacctgtccctcatcagggctctcgaagcctgcaatcatgcgcaggatggtcgtcttgccgcagccagacggtccgagcagggtcacgaactctcccggctctatcgtgacgttcgcatcatgcacggcatagaaatccttgccggtcttcgggtccttgtagatcttggagaggtgctcgaggcgcacgcccttcttctgctttcccatggatcaggcctccttggaagtcttggcgctggtgccgaagcgcttggtgaaggcattcatcagcatgaccgcgccataggtgataaggatgaggatggtggagaaggcgcaggctgtgccgtactcgcccttgccggcgaactcgttgatctgcaccgtgatgaggaagaactgcggcgtcacaagcaggatgacggcgctgattgccgtgatggagcgcacgaacgtcgtcacaaggccgctcaggaaggaatccttgataaggggcagcgtgaccgtcatgaatacctggaagctgttcgctcccatgtcgtatgccgactcctcgatggacttgtcgatctggcgcaaggccgagatgccggaacgcgtgccggtcggaagcgatctcacgatgaagacgacgaccaggatggcagcagagccgtagaaccactgcatgacgccggtatggaagatgccgccagagaagccgcggatatagccgacgccgaggacggtgccaggaactgccatagcaagcatggagacagactcgatgaagccctttccatggaagtctctcttcaccaccagataggagatgatcatggagagcagggctgtgatcgggcttgcaatgagcgacagcaggaaggaatccctgaacgcctcgaggccatggtagcgcgtgaacacgagcgtgaaccacttgagcgtcagcgagtagtcgcggccccaggtcttgaagagcgcaccgagcgggacacaggcatacatgaccatgacgaagacagcgacaatgccgcagaagatggaaagcgggatgcgaaccgagttgtcggtgatgagcatgcggccgcgcgatgccttgccggtgagcgtcgaggtactcttcgcttcgagcacatacttctgcacgatgaacatgacaagcgtgatgcagaggagcacgactgccatggcagaggcaccctgcttatcgtaggctcccgtgatctgcaggtagatggtcgttgccagcgtgtcatacgatccgccgatgatcatggggttcgcgaagtcagcgatggattcgatgaaggtgacaaggaaggcattgccgaggcccggaaggatgagcggcagcgtgacgctcgtgaagaccttccaccgcgaggcgcccatgtcacgcgctgcctcctcgagggaaggatcgatgttcttgagcaggcccttgagcatcatgtagcagaccgggaagaacgtgagcgtctggacgacgaagatgccccagtagccatagacgttgttgtccggaatgcccagaagcccgcgcgtgatgatgcccgacttgccgaagagcaagatcatggagagcgagagcacgaagggcggagagacgacaggcaggatcgatacaacattgaagatccttgccatgaacttgctcttcagctcgacgtagacctcaacgtaggcaaagagcagaccgacgagcgaagagacgatcgagacgaggaatccgaccttcaatgtgttcgtgatggccgtctcgaaggaaggcatagcgagcacgcgctggaagacggaaagcgagatgccctggtcggtgataacagaatcgaccagaaggattgcaagcggatagaggatgaagagcgtcaggaacgcaatgagcacgatgatagtcgtcaccatgatggggtcggccatgagcttcttgcggtcgagtgcggtgccttgattttttgccatagacgtctccctcagggacgataaacagaaaggccgatgcagtcatgctgcaggcggcctttcctgctgcaggaaggggccggtgcctcgaggcgaacctctgcgccggcccctctcaggaattgccgccacagcagctttgtacgctgcgtctactcggtcttgaagcggtcatcgccgccgccgagggcattcatgacatcagcgacatactgctcggtatgctccttggcatcctcgaagttgtaatccatgacgttgtctggatcgaggccgtactcggtcgcgatctccggctgcgtcgcgtcgtcgatgacaaggaactggtaggagccgttctcctggccgaggtccacgcactcaggagagagcgcatactcgacccagagctttgcggcatcctcatgcttgcagcccttgaagatggccgtggcgcctacctcataggatgcgccggagctcgggatgacaaggccaacgttgtcgtagccctggtcgacaatctggtagatgccgtcgtgcagcatgccgaggccgattgtgcactcgccgatgccgatggacttggaaggaccggagcccgacttcgtgtactgcgcgatattcttgtcgaggttcacaaggtactggatgccatcatcgtggccgtacttctggatgaccgtgttgatgatgagctttgccgtgccggacgtattgtagttcgacgaccagatcagcccctgatacttcggatcgagaagatcgggatagtcctggggaggatcgagcttcagacggtcaagctcgtccttgttgtacatgaagccaaggatgcccttgtagatgccgtaccagtcatcgttcgtgctcttgaacttgtcgtcgatgagatggctggcgttgttggccttgtagacctcaagcaggcccttgcccgatgccacattgtaggggtccgtcgttccaccgaaccagacatcggcggaaggattgccgttctcctcctcgatctttgcctcgacctcgcccgtggagaggcgctggtagctcgtcttgatgccgaagagctcctcgaagtgggacgtcacagctgcaaggtattcctcctcgcaggagccgtagacgacgagctcgccgtcattcttgccggcatcgatcatgtcctggctggcaatcctgtcaagattgttggagcttgtgctcgatgaagagctggaaccagatcccgatcctccgcatcctgccatgccaagcgctgccgctcccactgccgctgcttcaaagaagttcctgcgtgtcagattcctcatgacgcaacacctttctcccgagcgatgactcccctgtctgcactgcgtttgcagtgtctttacagttatttgagtacaccttgcagatgggtacgcagaaatttcgacagacggctctgatattcatgtaaatgcatctctctgcaattcaccgaaaatgtgggtatctagcgtatatatgctgcaggtgttcctccagcgcaatcctcagcgaaacatacggaatctgtcccatttgccagagcctgcactgtgtctctaaggaatgggtaaggacacacaagacgtttatgctgcattgcggaatcaggaggatcgacgtgtcgaagctgcagggacttctttccatgcctgatggctcggcttgcttcttccatccacgcaaacgctggttctggcaggcacttgtcgtctcattctgcgcctgctgcctcatcggccactggctcgagtttccctactgctggatgacgaacagcctcttcggaatcgtcgactcggactatgcgctctatatcgatccctggttccatccctactggtgctacggcttcggggcgctgggcatgacattggtgctcgagccagcaaaggattggcttgtcagaaagtctggctcgaggaagaaggccatccctgtctcgttcatctgcgccgtctttctcgctatgctcatggagcttggcatcgggcttcttgtgaaccagcctgatgcgacagggcactacccttactgggacaactcgtatctgcccttcaatgtgggtggccaagcctggctcttcaacgatgtgttcatagcgcttgctgcaatggtctacctctggcttgccttcccgcttgtgtcgcatgcgttcatctggcttcagggcaggaaaatccgtagccacaatgcagccaacgtcttctttgcaatggcccttgcaatctttgcggcatgctgctttctttcctatacgattctggcgctctcataatcggggctctttcatgcctacgcagactgctccttaggtacccatgcttgtacatcctgcatgcatcaactcaatatcgtgaaacacatccactacgagccgaaaccagaaatgcaggcaaagtaccgctgacagctattccgttgccgcaggtgcagagccaagagcgcaagcttcttctgcacctctctttgcagcatctggatcgagatagcggccaggccccttgagatggagctcgccgaagatgccgctctcaaactcatagacgcgcggctggccggtcggtacattgacggagcggatatcgtcgtcagagagaccctcgatgaccttgatgagagagcggacgaccgagccatggatccggaagatgcaggcagagaagtcgagatcgtcggcttctatctcgtggacgagaagacgaatgcagtgacacgacgaagagacgacaagctggtagatagagccacacaaatccgctgcatgatatggggtcttcataccgcttggctatgatggaggaagacgtgggaaaggcggcagcatggcacagtcgaggctcataatcatgcggcacggagagagtgcctggacggaccttctgtcaacaggtttgcgggctgggtcgatgtgccgctgactgagcgtggatgcccaagccaaggaagctggcgtccctatgaaggaagccggatcgcaccggatgcggtcttcacgtcgcttctgagcgcgctcatcgtgagcgccgatatcgcacttgaagagctcggccgtctctggataccggtccttcggagctggaggctcaacgagcgccactacggagctttccagggccagacccgtcctgccatgcgtgcgaagtacggagacgagcttttgcagcctatcgcaggagcttgacgtgaggcctcctgcgatagacgaagattcccttggttccagggttgcgatcacgctatggaacagcatctgaggacgggcttggcggacccaatccggcaacgatcaggagcgaatgctgaaggatgtcatcgcccgactcgagccgttctggaagtcctatgtgacgccagctctgctcctgggacagacggtccttgtcgtacccccatggctcggtcgtgcgcgctcactcatctggacgagatagcggccagcccctgagatggagccaccgaagatgccgctctcgaactcaatagacgcgcggctggccggtcggtacattgacggagcggatatcgtcgtcagagaagaccctcgatgaccttgatgatgagcgcacaccgagcctgggtgcaacgacaagtgactgttgttccaggagcagaggtggcgtcacataggacttccagaacggctcgagtcgggcgatgacaccttcaggcattcgctccgatcgttgcccggattgggtccgccaaagcccatcctctgctgctgttccgtagcgtggatcgcaaaccctggaccaagggaatcttcgtctatcgcaggaggcctcacgtcgagctcctgcgatataaactactcgttaataaataggctgcaagagctcgttccgtacttcgcacgcatggcaggacgggtctggccctggaaggctccgtagtggcgctcgttgagcctccactccgaaggaccggtatatccgaaggccgacgctcttctagaagcgactatatcggcgctcacgatggatgcgctcagaagcgacgtgaagaccgcatccggtgcgatgccgcttccttcatgagacgccagcttccttggccggggcacgtccgcgctcagtcagcgctacatcgacccagcccgcaaccgtgttacagagggtccgtccaggcactctcttccggccgcatgatatgagcctcgactgtgccatgctgccgctttcccacgtcttcctccatcatagtcagcggtatgaagaccccatatcatgccaggatgttgtggagctctatctaccagcttgtcgtctctccgtcggtcactgcatcgtcttctcgtccagagtagaagccgacgatctcgacttctctgcctgcatctccggatgcaatttctcgaccacgaacgattcgacgagattgccctgttcatcggtggtctcccccttcgaaggaatgcggtaactcggaccggtacagacttgtccccgtcgatatcccgtgccgttcctgcgctttgcatagggttgcccttgcgtcggctccatccgaagagcctgtcttggtacgatgcaatgctcattcgagatagaggcgagcaacctgcatcctctgttcatgcccgcatacgtcccgtagtccgtcatgcctatatccgcagtctcgccggaaacatcctctcgctggcagaagtaggcatcgcatcatctgcatcatcacgggacgtatcgctccggcatggtaacctgctgcctcgtcgctgtcgtagtatctggcctcggcctccatttgttctccatgagaaggtggtccgcgtccgcacagtagtcccccccccccccagtcgtttctcgtccggatcgtatccaccagtcgacggcaatagtaaatcatcatagtcctggccggtatactctcttgcacatcctctgcaacatcccgctactttcccgtcatgcatgagggggcccatcgatcgccacctggatggcaaggcacagagcggtttgacagcacagcgccaagagctgccctcagcaccttcgatggcttgccgtttctctcgccgctagagcgggcctttgctaccgcggtcaagaaggatgccgaggacagcgatcgaagcggaggcagagaagccagcagccgctgcatagcctcagcgtagcttccaggccagcctctggttcagaccgtaagcatgccgctgaggcaaggctggggaaagcatggagagatgcgaggattgccaacaggatgattgccttggaattcggatgcacttgacactgccgaatgccgcctcggtgcctccactcccaagccaaacctggcttcaccttcatcagggaagcccttcgaaatttcctgtgcaggcactgcaggtaagcgcaacaaggcgtcatctgctgtctttccaccatcagggctgctcagcaaggaatagagatagcatagctgagctcgtccccttgagagagtgcgcatccacatgcgaaagcgcggcagcagccgcccgatcctcccggtcttcccacatcgcacgagccatgccagagaagctctgctgcgtttccttcgggttcttgccagaagcgccgtggtatagcttatgcaatgttcatggcgggagtgcaggagcaagcttccatagatacggcggcagagcagatgcagcagggagcatgaaatggccccagccgagagtttcaagctgccacacagagtgcaagcagcgcgccccaggcccgagaagcatctgaattgcgagatgaccacagggtcagcaaggacagcaagacggaaaggatgcgcgaaggccatatcgatgcaccccagccatcccgtgcagacgaaaggccagatcgtgggtcaccacgcatagctctcgggtaccgcacgctgaaatcgtagatatcgcgctcttcttccgaccaatgacacgtccatcagcttgccctgaaccttttggcaaccgctttcctcgatggccagctcgtccaccatcttgttcgagccacgcgcacacatcgtgcatgaaggggtctttcgatatcttcccattgacgccgcatatcctgccgtaacgaggtcctccttggattgagggcaggtgccttgtcgaagaattcgccgtggtgcagccttcctgcatacatcgatatctccctcgcgtagtcccatagaaccactgggcaacggcataaccttcatcctcatcctggcctagctgcggactctttcgcgacaaggcagccccagaccttcttggcggccctgcttctgacttttcagtcatctgccatcgggatttcctccagaattaatatttgctatcaaacgagtacgtatatcctgtgattttcggaaagttccttccccaagcatatcatcgagtagcatcaccctaccagagagaaaaggtcactcatgagcacgcacaggaccagcttgccgtcgcgccctcgtctcgcgcttgcgcgccaccatcaccgatgcatatggacgcagcacccggattcgttccccctgcggcaacccccttcccgatgtcatcatcgatccctcaacaacctatgcagagtctgacgatgctgccatcgcacaagactgacgcacgaacatccttgccttcgtcggacacgtgagcgaccaattgggctcaacgcgctcacgagcctgcagactgtcagcggatgagacgctgagccttttcacgcaggtccactccacgcctttcgccgcagagtgcaatccttctgctctcatcgcctcgacttagccgcgtgctccgtcaaccccgcttaagcaatcccttgcctagcatctgtctgaaaagccattggccctgatttgggccacggcagactgaagggggtctggcttctgtcagaccgcctcattcgttgttctgtctatgtaggcccgggagcctctagtcttctgcttcccctacttgcccatctcccggtcagaaacattggaccattgttcgcagcagctcctccgtatcgtcaagaggctcgatcgcaaaatgccgcccttgccgtaacttgtctactattcctcttctttttcctctgctctctcgcgctctcccttccacccgttctcccctctccttttttctcttcgtgtccttcgtcttttgtactccccatttctctctttctcgccgctccgttccctttcggccagagacaggccttcgaatcaaacctgagttagcgcctcatttcacctgttccatagaggacctcgcccagaggcttcattcattcacgccgcgccacaccagtgtttttcccaccagattcctcagtagcccacgacggatgtttcgcagatagtcggcttcttgattgcgatattgcgatgatacgtggtcgtgccgcgcggtcggtatagagatcgaccgctcgagtccctgtcaccacgcttcctctcacattcatattatctcctgcatctggatctcctgcctccgacccaccaatcctctccccccgaagaaaaaaaagaaaggctcctttcgtcccccgtcgttcccattggagctcgtccgtctgctggagtaggaagtcgcagaacgatcttctgctcgcggttcgtagccgcccggccgatgaagacgagtatcgacatcggcgaagctcggcgtgtcgggcgacatgaacctcccggacatctgccgtgatgccacgacacttcacatgcgttcttgagcccgaggaagaatttgcccgagtctccataaaggattcaggagctccggatatgagttgctatcgtgagcagggggtcgggccatcggtgtctcttcgttttctgactttgcccgacgcaataaagagggcatagaatgctggatatataagaagaaggagaggccacccacagttgctgccaaaaatccccagtcactctctttcctggtccctcttgttcccccgcctcctttcgagcctgcctttccgccagagcgcatgtatttgtgagctcgtaaga

SEQ ID NO: 714 - DNA, 3284 bp, Unknown
  Metagenome-assembled genome
ttcgttcggaataggttatactagacaaaagatcagctcctaaaagatgggtttgtggtaaacaccattttaaaggaagctgatcttttttgtccgaacagcgttcggattaattttacaatctaccatataataattttcaacatatacatcatatcgcttactcatcaactattctaagacagccaatgtttacgttgcttacgtggtacttcaattcttctagctttaattttatcgccgttcaacaaattccgagcgttggttgcaaaacgttcaggatatttcgaattcatttcatttaatacttcgtaggccttagtcatagcaaagccccgatttttcagcgtatgtgcatccgacgcgaccacctgcaccaaaccgcacttaacaaattcttttgcggttcgttggacttgttccccaaaagtgccaactaaactcgtggccgtaacctgtgccaagaccccatcctcggccaacttgtataatcgctgcggttcggcaataatttgagcattccgttcagggtgtgcaatgaccggggtaatcccctcacaagacaattgaaaaatcatctcatccaagtaacttggtaccatctcgtggggaagttctagcaataaatagtgtctaccggtatctatacccaacaaatcgtccactttttccatcaactgaccatttagatgtacctcttgaccaggaaaaatggttaacggaatatcatttacatctagctctgcttgaaatgcctcaaccgccgctgccacatcaccggcatgattgagatagtgccgatccatatgatgtggtgtcgctaaaatatagcgaattccgtcagctacagcctgctgtgccaattccaatgacgcttctaaggaaggtgaaccatcatcaatgcctggtaagatgtggcaatgtaagtcaactaaattatttatcttcatcgctatagtacccgtagccgctgttgtaaccatagtaaccatgatgagaaccatcacggacatcgttcaagacggcacctaaaatattagcttgcgattttttcaacgaattcacagcatcgcgaaccgctgctttttgtgccacaccctgccgaacaactagaactgtaccgtctactttatttgctaacagttgtgagtcagtcacgggtaagattggtggtgcatcaacgatcaccaaatccaatttacgcgttgctgaagttaaaaactcagtcattttgttactacccaatagttcggctgggttaggtggcttaggaccactcgtcatcacaaataggttgccgatgacgggatggattgcatcattcacgtcgtccatctgattggctaaccatgaacttaatcccttatggtttttaagcccgaacgtcttgtgaatcgttggtcgccgcaagtcagcatcgaccaataaaacttgcataccttctttggcatactccactgctaagttgccacttactgtcgacttaccttcaccaagcatggccgaggtcaccatcaaagttcgtagcttatgatcagtagccgcaaaattgatattggttcgaattgttttaatctgctcagtaatgaccgacatgggttcattaatcgtcgtgagattaattggggccgtagtcgttatattctgttctttacgtttaaacatctaacaccctcctaaactcgtttcatcgcttgtgacgatgttcgatcattatgcgtatgatagccaccattcagattcaaggcctgtttcttcattgaatggtgatgttgatggttaaccaagcctaaactagtcaatcctaattcatcagttaagaaatcggcgtcgtgaacgcggcgatcagtgagcatccgaatcgctgcataaacaaatcctagtaacaatcctgcaactaacccaaccaacatattaagaggttttttcggtgataccgcaccatttggcgtttcggctggagcaacaatcgtgacgttgttaactttaataatcttttgcacttggttcttaaaactacgagcaatctgattggcaattgtcgcactagcttttgcatcagtgtcagtaactgcaatcgagaaaacttgtgagttggtcgtacttgtcacactaacttcacttttcaatgtgttcagtgagcgctcaataccataacgctcacttaattgttgctgagttggttttaaaaccacttgtccagcaattaattccttgtaggtcgtaatcatctgaacgtcagcctgctgcccagcatactcagtagcggcattagtatctttacggttaaccaaaatctggacacttgattggtacttaggtgtaattacaaagaaggtcaaccctgcggcaactattaatcccgccactgtaaaactaacgattgtgagccagtatttacgaacaagccggataaaaaagccaaaacttactgtttgatccatcattcactctccaaaattaacaagattaaaacacgttttaactaacgctattaaatacaatctatcatcaaatataacatcacattggctgatttacaattggatgtaagctgattcctgagacaacttttaagagagcgtataatgaataaatcgtctctcaaaaggaaggaatttttacatgccaactcgttacgacaaagaattcaaacaaaacatcatcaacctcaacctatataaacaggcgaatcagccacccaactggccagagaatatggcattggctattcaaccgttcaaagtggatccaggccaggccaaaactcatccggtacatcgccagacgaaatttaaagcgatggaaaagcggctggcttcgcttcttgaggggaacgaaatcctaaaaacaagccctgggccattttttgatttaaaccagtggtcgagaaatcctgcttaagcaagttgggacgctgttcaaccttggttttggaagccgaagccgctttccatttattgacggtaacggagtggatatccagttccttcatgagccgggaatccgtcgtggactgcatcgaagctgcagtggttgaagttccagattcaattcatggtggatcttcataacaccgtatcgctgcttaaattccgcaaagatccgcagaatccgttgtttcaagtccgcatcttcggcccgcgttttgaaggtttgggatcgataacgataatactgagctctggaaccaccgaggattcggcacatcttagttacctggtgtgatggctttcttggtgaatgtaatcaaagatattggttacttctgcgcaaggaagcct

SEQ ID NO: 715 - DNA, 6475 bp, Unknown
  Metagenome-assembled genome
aacgtgataaagtagatgtacccaaagtaatcactccctatattggttggaattagctactaccattgtaagtgattgctttgggctttttaatttctgttcggattaattatagaatttgccatataaaataaaagagcaactatttttttgaactggctactcctaatatgaactaataactgactgtcagcagtgcctagatcagcgaacggtcgaaccgtcttttccttattaataacaataatagttcacgcgttgtgttagttgattcctagcttgatcattgtatgaacaagtaaatattgctctaatcgtaactgtaaggccgtcaatgatcttacgcggattcattcaatatcaaataactcatttagttgtgaaaaatttgtctcactctggcgccgttgtcgatttagtaatcgttggtaagccacgggctgcttcatgtttcgacgaaccggcgtccataaattaatcttctttttggcaagttcttgtttgagcttacgactaagataacctaaatctaccaatatttgatggctaggccataacgataataatgtttgtactgatttaatagcatgccaggaagcgggggtcacatcgtaagttaaaacaatgccattattagcgacctcgaggttacctttgaagctgtaataataaagtttcttagttgcgttataatcgatattggcggtttcgcgaaagactttagcacgatgatttctaataccctaacataagggcatcggtaaactatcaataatcgtgtaagctggtgttggacataaattacgtaataccccaaagcaaatccattgaagttcattggcagcataataacacttacgattaaagcgtgatcgttctggcaattatccgggtttaaaaatatttcgttttaaaaaccggtagtaaagtgaaccctctgagtggagtaaatccagactcagggggttttactatggttcagctaaaataaagcaacgagctttaagcagatatctccagggaacttcgcccctgttacttatgaaaaagtatgatatcaaaggaagtgcgacgatttatcagtggctcgctcaatttgaaatttttggcattcaaggattagagaattgtcgtaggaagacattttatgactattcctttaaaatcaaggttattaaatggcgacaaaaacatcatgcctcatatccagtaacggcaacccatttcaggttgaagcaaccgatgatggtttgggactgggaacgaagactgattgagggacatcttaagccatctaaaggacggtctttaaaaatgacagataaatctaaacaatctaagacattgaaacaacttcagggagaaaacgagcttttacgaatccgggtagcatacttggaaaaactcgaagccttggcacagaaaaaatctcaaaccaagaaaaagcccagctaatcactgagctaagacgtaaattcaatgttaaattagttgtggttttaaaagcagcacacatgtcgagtagtaattaccacgatgcatttcactgtaaatatcaatcaggctcatcaacgttagttgatgagattaaaagcgttcgtttggccaatcccgattacggttaccgaaccgtgactttagcgcttaaaaataagggaatcaacgttaatcacaaggcagtacttcgtattatgcgtgaaaataatctcctttgtcaggcattcaatcgtcgaacgaagaaatataactcttataaaggaactgttggtacagttgctcataaccgtttaaaccgtcgttttaaaatggatcgcccatttcaaaaaatcgttactgatgtaacggaggtccgttgggggaatcaaacaatcaacaaacgtgcatactttacagtttatattgacctttataacggagaaattattgaataggccattggacgtaaaccaacggtagccttcgtcacacacccccttgaacgattagtggcaagacgttcaggcttaccataccgtatgataattcattcggatcaggggttcagtatcagaactgtaggtacgtgaatattttgcgacaagctcgcgttttccaaagcatgagccgcaaggccacatgcctagataatgcggtagctgaaagtatctttcacattcttaaagttggcacggttcacaattatcaatacaagaactatgaagagctagaatccgccattataaactacgtagattattacaatcagcgtcgtatcaaaacaaaattggtcggtatgtccccggtaaaatatcgggaatataccagccaattagcagcttagaaatttactccaatttatgggggtcacttcatagaacctagttcggacggtcatttttaaatcaacttgtcaacaaagtaatgataacaataagacgtctgaaagcttgccttgattgacgttacggcggttttgaatttgctcgcggactaatcacaaattggttatgataaaattggtctaacataagacacactcctttgtttgcgctgcttgaagtgtagcttggttaggcattttttcacaactaaagtcttggttaattaactagcacaatgcgtataggtatatatatctgatgattgcaaatgcggtgggttatattgttataattatagtggaaataaatttaatatccattagaacagtctccaatctgattcggccaaataattcacagtcctaaaatctgtctcttcttagcatcaaagtcgtcttgggtaatcacgccgtcatcaagcagctgtttcaattcgtgcaactcatcaacttcacttgagccgatgttagtggggacaatattggctgagttagctgcttgttctttggccttccgctgttcttgataattttcccaacgttgaattggatcaatgatagtattgctatctcgtaagtcttcaatctcttgcacagtaagtgtcttttcaactagtacatccttcgggagggcagtgtagtcaacaccaattttctgtaagcaatcagtacagactttaccattttgaatgtgcactaactcatcacttttgtgcttgttattgcagacgtcacatctattagcttttacaatgaaataaacaattactattaacgcaatagtaataatggtgattatccctggcgtactagatacaactcgccagatgaatgagaagatacctttaacaaggtagtagagataagtcaggactgctgcgagaacaacgtagcgtgcagccttacccataagtttaaatgccccgactatgagcaagattaatagtagtaaccacatgttatttcccccttaattaaatcccaagaatttgtttcttttttgctgtgaattcttcttcagttaagataccatcatcaagaagtcccttgagtttgcgtagttgatcggcactgtcagtagcagagactggagttgcaggttcattaacgttgctattgttgttggcaataattgtatcaagatcatggcagaatctaagtaattcttgttgagtgatatggtaggcactgctatctgttttagtagtttcgttaagtaagactgcttccacgcgatggtcgcctttgaaataaagcacgacagagactttagaaacggcagcatacgatttattaccagaaaatgcgcctaatacagcaccagttggaccagcaattaaaccgccagctattgctcgagatagtccatgtttatcttcaatagtagtcccattttcaataggatcatatccttctaagtcactgtagtcatatagttggaatggttcatcagctaagttttccatgaaacttagcttaattaaaaattgtttgcgtttgtcactgagataaacttttccgatatgaccgttaccttcttttttgaaagtaatcagtaatttttcatattctgatttattgtcaaaaagcaattgtttggcatctatctgagtatgagagtcttgatgatttttgatatcttggacagttaaatatttgacagcggattgtgagctaaagttattttttaaaccaactcgagaagcacagtcgtcacaaattttcccatcagttaatttgaagccacctaataaacctatttcacgaccacaaaccgcacaggggtgtttgattttagtattagaatcctggtgagcagatacggttggtttgtttttcatatcatctaaatatttctttaaatctatctgggtattagtgtcttgataatttttgatatcttggacagttaaatattcgacggcagattgtgagctaaagttattttttaaaccaactcgagaagcacagtcgtcacaaattttcccatcagttaatttgaagccacctaataaacctatttcacgaccacaaaccgcacaggggtggtttgattttagtattagaatcctggtgagcagatacggttggtttgtttttcatatcatctaaatatttctttaaatctatctgggtattagtgtcttgataatttttgatatcttggacagttaaatattcgacggcagattgtgagctaaagttattttttaaaccaactcgagaagcacagtcgtcacaaatttttccatcagttaatttgaagccacctaataaacctatttcacgattacaaaccgcacaagggtgtttgattttagtgttagaatctttctgtgaaggctcagcaggtttgcttttcatatcgtctaaatactttgcgatgtctattttagtatgggagtcttgatagcttttaacatcatcaatagtcaaatctttggcgacggatatagactgcaggccagtttttaatccaatttgttctgagcagtcgacacacataatcccatcctttatgtcaagccgactagccatgagtccgattttctttccgcatatatcacattttttagccataattaaatccctccaaagttttatttcctaagtaaatatcttataaatctagtatttatcatacacagttaactaaaggatgaatgcaccttggctaattttaataccaagctcttgttcagcaacattatgaataaacagtgattagatccccagaatttgtttcttttttgctgcgaattcttcttcggttagaatgccatcgtccaggaggcttttaagtttacgtagctcatcggcactgttagtgggtgtagatagagtggtaggttcattattttcattttcgactaaaattttatccaatcgaacacagaatcgttgcattttttcttgttcatctcgatagtacatgctgtcgatttttgtttcagtggatatgtagtttaattgcttagagtagttgttattaaagtataaaactactgccatctttgaaactgcgtcataggacttgtttcctgaaaaagcacctaatacagcaccggtaggcccagcaactaagccaccgactatggaacgagacaaactatgattcttgttaatagtggtagggcttttaattgtcttgtaactagttaaatctgaaaatctgaaaaggcgatagtcttcaagaatagttttatcaatgaagatttgctttttaacaaaatctaaatagactttaccttttttgacaggttcatctgctttaatggcagccttaagttgatcgtatttatctttttcagcagagatatcttctttttttaaattttttcttgttttaacttatttttatactccgcccagcgcttttgtggatcaataatttggttgttagcttgtaagtctttaatttctttaacagtcaaaatttcttctatagacattgaaagcggtagctcaacgtaatccacaccaattttcttcatacaatcgtggcagactttaccatcaatcacaggaacggacttaaacatttttaatttgtttccacaaacatcatattttttactcatagtaacttcctccaaatttttattttcaaagtaaatatcttataaatctagtatttatcatacatagtcactaaagtatgaatgcgccttggttaattttaataccaagctcttgttcagcaacattacgaataaacaataaatgttttgattctaaattgtaactgttagcaaaatgcaagatattgaaatcttgtggttcaatgccggtttcactggggtaatgatttaacataatatagaatgcaccacgattagcccgtgattcaatttttgtattggaaaccatgctagtatctatgtaatggttcaaccgtaggatcaagcaaacaatgctgtaattcatgacattttacgaaagtaggtgatgtgtttttttcattgataaaaaaggtttgggtcaatggctatcagcaacggttgtaaaatgttggaaaataccgattagaaaatgtcggttttccaacatttttttacggtaaaataaacgcatctcaaatttggaggaactgaaatgcgtttagatgttgagcag

SEQ ID NO: 716 - DNA, 143618 bp, Unknown
  Metagenome-assembled genome
aaagatagctgtcctgacattactccataaaaccctgataacaaaaggttccaacaaactgggaaaaatctagaacccaatagaacatgttctgcagaaactgatatacaaagtgttttctgaatatttggcagtgttgctatgtgatttttttagattatgattgattttaactaaatctacgaataaatctcgtcaaaatcagttctgatattcgttttttactgaatatatcagctatgtttcgcattatattgtcggcaaaacataaacaagacaaaactaatcacaaacaaagggtcgttcaggccactaattggtaaacgacccttgttgttaaacgaatttttaactaataatcaattaaacttagcataccgcagtcttcaagtccttcaaccaacttacgaatttaagctcagattcggtcactgaatgtttcatttgttcctcgtcttcatggtatcgttaccgttgtgtctccatgaggtaaatcccaaatggcgtcgcgaatggctttcttcacgctccagtcaagaagcggtcattcatattgtaatccagaataacgtcttatctactgatcagccatattgaattcctccttacaaactacattgtaagtcccttatttctgagtggttaaatttttgcttaggcaaattctataattaatccgacagaattaaaaagcccaagcaatccactttacaatggagtagctaattccaaccattatagggagttattacttttggtacattctactttatcacgttcaacgtggcgcactagcacaactggtccatgggggataaatcttaccagttaatgctgaacgcctaggcgtcgccaagcttacgattagctatggtggaccgggttacaaccttatgatccaggaattagctcagcaagatgcagatcgcaaaggcggaattgcgtcgtcgttcgagctgacggcagcattagcgcctttaattacaatcacttactattaaaccggtcaccagaaaccattgcggcgcttatacttgatcactgcgtcaatttaataattggcttaatcgtggctggtctccccttcaatttgactgatcttacccaatcggaatgtctcgccagcaccgagtgagcgaaaatcgtggaatttgacaagtgggacttccatcgaacaacggccaacaactgtttatcagcgttagcttttgggtcattgggagtagtacggtgcttctagtcgaagtgatcacgatcatgtctggttacattcgtaaacgaagacccgacgtctatgggccatcaaagcccctaatagaacgctagggcttctaaacaccgcctttggcagtttatgggtgcctttcgtcccccaagtaaaatccattactgttatcatggtaaagagttttgccattatcagccttagaaaggatttatcagatcaaagtttattttttgcatccatattcaccatgggatcgaggttccaatgaatattttaatgacgtttacgctggtttcttcccgaaaaagaccaattttttagccagggagatcctagcagcacttgaactaattaatcaacgaccattaaaaatacatcatcaacagactgccattgaaagattccgggcttgttcggattaaacttgtaatttgccatataaaaactatcttcccaccaaaaagaagacgaccttaacctaataacgtattaaatttttaccattttattgaagaaaggtgatgacaacaagtccttcaaattctacccgcctaggtgaaatttaaggaggaaatataaatggcaagtattaataagaaaaatggtaaatggcaagtatgagtaagttactatgatgagttcggcaaacgtcactttaagaataagaatggttttagccgtaaagttgaagctgaagcgtgggccaatagtttagagttagacaaatttaataactccatcggtttagtagatacaactaccaccttctacgcctattactcacactggcttgaaacctataagtttggcaaattggctcagattaccgaacaggaatatcgttacactttgcgtcaaattagagaattacttggcaacattaaactcaactcaatgactcgaacccggtatcaacagttcttgaatgacttcacccatggcaatgtcgaacaacgcgccaaacgtcatttaacaggtgaccaaccttatcatagtaaagcatccgttcaaaaacttcacgggcacattcatgcagcagtgattgatgccgttgctgacggattaataaaatccgatttctgtactcatgctgaactgggtggtcataaaggtaaggatgctcaactcaaatttctagacgtcaaggatatgaaaatacttgctaatgaggtaaacaagaacatccgtttaacctccactggcaagtcgatgatatataccggcttaatgactggtatgcgtgtcgctgaagtgtccgctctaacatggtcggatattgactggaaaaccaagaccattcgtattaacaagtcctgggactatgtgtatgggcagaagttcaaacggactaaaactgagtccagtattcgtaaaatttctgtgaccgatgagttgttaaatcatttaaaacagctccgatcattacagattcaaaagaatctggataaccccgatcacatggtattcttaaataatcgtggtcgtattccaactcctggggcttgtgatttattgctaaagaactatcataccactcttgaaattaaacggattagcttccacggtctacgtcacacacatgcgagttccctgctttattgtggtgtcaaaatggagtatatttcaaaacgcttgggtcacaagaatagttcaatcacgcgtaatgtgtacgcccatctgctcactgaagatcaaaaacaggaagaatcacggactttaaatgcactggctaaatttagttaatgtgcattatgaagattgctgtatccgttgggacacaaggggcccagcaattaaaaaatcaccactgtggtgcactcaaagcatcccaaaaacagggtaaaaatcattagagtgcaccgacaagtgcaccaatatatcaatccagagcgttcctaagcgttttgaagcaaacaaaaaccccgctatctcaacgattttcggggtcaaagaaagttgttccttaatgatttaaggagagtacaggatttgaacctgcgcgccggtattagccggttcgccggatttcgagtccggtgcattaccactctgccaactctccatgtggtacttaataagtatagcataattagctttcagaacaaatatttattcagaattttccacaaaaattatccgtcagcccttgccaacggatacccaattacttctgttcacgtgcggcttgaccaaaaacaaagaacgaaccaagaatacccacgcatgatagtaaaaataaaatgccatagcacagtacatcccccactgtcactaaagtcttcggaaaaccggcagttgagacccatagaaaaatcacgcttaaccaaaaccaaaatgaacgataaaaccgaaccggtcgacgtatccgcatgacgctcccccctaactcgttattccaatgaaataaccgattggaataacgcctattataggcagtgcgcaattaagtacaagctctgaatactcaaatccaacgtttaagctacaattcgtaaccgattacgtttgttaagtgccaatccgattaatatgcccccttgcaacctcaatcacaacgagccagtttacgagcgataatcataaatcggtcttcaaacgtcgtgacgcgaccattaatggtcagtaaggattgtaactgatgtaatttgggaagcatccgtgccacgtcaaaattcggaaactcccatggaatcaccgtggcataatagacaattgcgccaatatccgtaaaactcagtgccgcgtaggcttgctcagcccgcagaatttcaaatcccgcagcctgcatttgagccattaccgtcaacaactgattgtcaggatacgccggttcgtaatgctcgtcaaagaatcgtgacaacgcataattattggtcgcaccaacttgctgagtcgcaaatcggccccccggctttaaaacttccgcaattcgcttcactggcatcgcaccatgactattcgttacaatatcaaatgtcgaatttggtacggccgtcaactgttcggcggcatctggatataatgttatcccctttttaaccaccgtttgcttcaacaactcaatatttggttgccacccctcagtcaccgcagtcagcgctggctgatggttaaaacgccccatcaattcaccaccgcccgtatcaatatccaaccatcgatcatcggcacttagatgctcacgaactagggcagcgtaatcccacggtaagtccgcagtctgccaccggccagccagatgactaaagtcccagccgtgcatggattgctgcgcttcttcaaaccaacttctttctaaagctgtcatattttgcctccttcgtttcctgtaaaccagaccactcatcaaagtctccgctggcctatttcaatacgaattatgctatgattacaatatctttaaaaggaggttcagtcaatgacacaattactggtcacgaccactgaaaatattccggggcacccctatgaagttatcggtgaagtctttgggttaaccactcaatctaagaatctggtccgtaacattggggcaggcttaaagggcctagttggcggcgaaatcaaggattacaccaagatgctcgaagagtcgcgcgatgtcgcggtcaatcggttgcgcgataatgcaagtgccatgggtgcggatgccgttgtgatgatgcggttcgacaccggctccattagtcaggatatgcaatcggttgccgcatatggtaccgcagttcgttttatcaccgaagatttgaccactgacaatgcttaatctgattcgagactaacgaaaccgcctgccggtaatctgggcaagcggttttttagcatggtggcagctgtttgtataacacaattataattttcgtcaccggcgaatgaacagacaaccaccacaagctaacagtaatcccatggccgtcaaataagccgcttctgggctcacgatattatccaacaagaccaatccaacactgccgattggaatcgaaatcgtcgccaatgaatttatgatgccgcctaagctcccaacgatactttgatcggccactttcaataaactcgccatcaatttaggatttgcttgtcccatacaaaatcccccaatcatcatgattgtaaccactacccaatagttttgccaaaacaacagattaataaataaaccctcaaacgccacgacggtagttaacatgacaccacgaaacgtccacctctgaaagtaacctgtatgtaacaaattccctgcaaccgagccaaatacgtcagcagtattcatcacaagaattgcgactccgaatgaaaatggtaactgcgtcgcccggtgaatcaggtataaattcaatagtgcatcgacgcttgcacccaccgcattcaagaacaagacgctccccaatagcgccaagacgttcatgtgcacccccgcttccattgcttgtcgtacttgtcgtagcagttgacgaaatgtcgacgtcacggtgacagttgcggaaggtaattttagcgtttcatacccagacagcagcaccagaccggcaatcaagaacgtgattgcattcaaatatcccgcgagacgataatcgcccgttgcggccaatagactgacacccaacgcttggcccatcgtctgcattaacactccgatgccttggttgatccctaaggcctcttcttgtaactcagacgcgactttagcttgtaataatggcattcggaggctgccactcaacatccccaacacgtctgagcacaaattgatgacaataataatcaacagcaacccgacctgtttttcagtaataagttgcgctaacacgagatataatgccgcttgaacaaatttcaaacctgctaaccacccccgcttattggtttgcgagtctgccaatcgaccagtaagcataccaaaaataccaggaagcacagtagccaccgaaactagtgaaaccatcaaatttgcttgtgcaaacgttcgcgcgtacgttaatagaataatgttaaataggctggtaccaattgtctcaaaaagatcagctactgttaacgtgacaaacgctcgattacggcctagatttttcataacgccacttccaatttaatattatttatcgtttaaataaatttaaatgataaagcaactttaatcgtttgatttctatttgtcaaatggttaagctagtattgaggtgaaaaacatgcccaaaaacacactggctcagtttgcaaagttaatggccgatcccaaggtggccgctatcttaaaggccaccaaatctaaaactggtttaacaactaagcaaatttcggcccaaactaaaattcccaacaatcagttgtactacaccatcaacaaaatgcaggatgccgacttattaaccatcgttaatcaagttcaggttaaaaatctaactgaaaacttctattccagtgcccacctctcccatgagacgccacaggaattggcagatcttgatggtctcgatactgatctgactgacatctccggcacgtggactcaagcccatgtccaacaagttttacaatggatcatgctattgaaccacgactttaccgaagcctaccaggaagagatgacccgcaagcaacctgacaagtcagccatttttttcagtaacgcgatcctaaacctttcagcggcaggcgagcaccagttgcgcttagatttgatcaaattgcttggcgatgctgaaaagaatgatcctgatcctcagtcaacggacaagcgtcaggttaaactactcattgaaaagtggcaataattagaatatgcaattgttagtctttttggcttggctaccaaagaatcactgactatccaagctaactaacgaccaaaacaagggttagcaaaaaagctccgaatgactaataaatcgtcattcggagcttttaatattggctttaaaattgcatcaagctcaacatatcataatctttaatcttatcgcggccgtgcaactctttgagttcgaccaagaaagccgtcccaaccacgttaccgcctaattcttcaaccatttgaatcgttgctgagatggtcccaccagttgctaataaatcatcagtaactagcacattttgtcccggcttaattgcatctttatgcaaataaagtgcagactgcccgtattccaaatcataagtcgctttgaccgtttcgcgtggtaacttacccttcttacgagcaggtgcaaaaccaacgcctaattcataggccactggacaacccacgataaagccgcgtgcttcaggcccgacaatcatatcaacatgtttatcacgcgcaaattgcacgatctgatcagtcgcttcacggtaagcttccccgtcagccatcagtggtgaaatatcgcgaaaaatgattccaggttcgggatagtccggaatactagccacatacttttttaaatctaatgccatttgttcttaacagctccttcaattcttaaccgcagcctggttcttcacccatacttggagcgctgcagatttactatataaaagcgtttcttcagcaacgatttgttgttcgcgcagctgataactaggggcgtgatgtaaatccgcttttgccggattcgaaacgccattcatgacaccatcatttattttaacaaatccgacctcaaaaaacacctgaatcatgaaaataagcaaatttcgttcaatatgcagatgcttggccactaatgttaattgatgatgaatatcaacatcatggtgcgctgcggtaaactggaaaagtttcgcaaactgcgcgcgatttggcattcccgttaaataaaccgattcttgccgatataagtagagcgtcagctgatcgagcgcaattgtgctgagtacctgggtcatatccgccagcgtgtcaggacaatcgacaatgaagaccgcttgattagccgtcacggcagtcagatccgttttcgtatcccccacccatacggcttgcgtttgggaacctaaatactgttcaacttttttcaacagacgctggtggaaaaagaggtaaacccccggtgcttgaaacaaatgggccgaaagatgttgcgtccgggcgtcgatcacctgggtccccgtcactgcaatatccttaaccatgatttggggctttgtctgaccgttccaagtattttcactcaactcacccactaacgtcacatcggtgggactcgcctgaatagccggcaaggcagtacccatcgaaaaaccgatagcatcaatcgtattggtgccatcacccagttgtaatttcaagtgttgctgatcactaccaatcgcgcgtgcttgcggaacagtcgttggaactaattcaaacaacggtgccgggttatccgttccaaagggggccaacgcttgaatatctgccagagttgccaaggttgcctcagctaatggtaacgtgccgtcaattggtaaactgacttgcgcattgtctgctaattgctgacccgccgccgcttccatcgcctctttaagcgttgctaactggtcggccatgacagttagtccaaccgccatatgatgaccgccaaaagccaccaatgactcccgaactgggtcgatcgcggcaaataaattatacgcttcgacgctccgaccactacctttgagccggccatcatcatcctcatttaacactagggttggtttgccagacgtttcgaccacgtggctcgcgacgattcccaaaacaccctcgtgccaaccatgcccggtaataactaaggtttggcgggcctcattttccggcgtctgtgcttgctcgattgcactggcactgattgtcttgaccaagccttggcgtttttcattcaattgattgacctgcttggccagcgcggtcgcccgctcatcgtccaaagttgtcaataattctacaccgctctgcgccgactgcagacggccaagtgcgtttagccgaggggcaataccaaacccgatattggtctcggtcaatttatcgggaatcaatccggcttcttgaatcagtgcggccaagcctgggcgggtcgtctgctgtaagaccttcaggccgagcgttaccaaagtccgattttcaccagttaagctgaccaaatcagcaaccgttccaatagcagccagatctaacagttcctcgggtacttcctcaagcagcgccgttgctactttaaacgccacaccggcaccagaaagaccaccaaatggataactgccctctggatgtcgtggatggacaatggcgtaagcgtgcggcaattcagtcggtaactcatgatgatcggtcaccacgacatcgatgccctgttcctgcacttgattgatgaccgcatttcccgcgacaccgttgtccaccgtcacaaacagcttcgttccagccgcaatcagccggtcaaaagcggcctgattaggaccataaccatccttgaaacgatctggaatatagtaattcacgttagcgccaatttggtccaacgtttcatacataattgacgtacttgttaaaccatctgcatcataatcaccgtaaatggtaatttgatccccggcaataatcgcctcttgaatgcggtcaacggctttttccatatcgtgcatgttcgttgggtccaacaatggttgttgatccgcgtgcaggaatggggcggcttcttccgccgtattaatgccccgcattattaataaccgggcaactaaaggggtcacgctggccgcctcagctaacttatcaacatcggcttcatcaacggccgttgttaaacgtggcacccactttttctttgccgctaacatggcatccttcctttcaacaacttacttatccgctggcgtggttggttgttctgccaccgctcgtttttgtttacctttattattcaaacgcaacgttaattgcttattttcggcagtcaacttatcaatcttagcctgggccgctgctaaagcttcactatgggctgtccgttccttagattcattgaccgtcgccatcagtactgcggtaatgacacctaagatcaacgtcaccacaatgaccaaaatcagtggccaatgaactgctgtaattccaaaattgattcgaactggttctacgtttaaaattgcaaaaataatcactactagtgcaatgactagtgcactcactaaccgccattgattcttcattaaattcatcccctatttaaaattaaaaaccgtccccgtcagccaatccccgagcttgggtgccagctgataacctaaattagctgcagacatcacccaaggccgattcagttcgcgccgttgatgcccgagtttgcttacaatcaattcagcaaacttaacggggttcaatgccagctggtcgacccggtctaaatagtgccccgtgggatccgcaattttgaaaaagtccgttttaatgggacccggattgaccgtcaatacgttgacatgagcatccttgagttctaagcgcaacgcattatcataagcaataatggccgccttactagccgcataaacggctgatttaggtgttgcgattttgccagccatcgaggcgatgttgacaatttcacctgcatgttgcttgaccatccgttgcgcagccagttggctaacatacatggttcccaatgtattgacgcgcaacattttcgccatcaccggcgcatccatggtgatcaccgtggtcatatcgccaaaaccggcagcgttaatgaccacatccaattgaccaaatagctcatcgatggtcgtaaagacgtgatcaacgtccgccacgtgacccacgtcacaagtaatcgccacggcctgcccttttgataacagacgacattgatcagcaacctgtgttagccgttctcgccgccgggctgctaagacgacattggctccctgactcgccacggctagggctagttgctcgcctagtccactagacgcgccagtaaccaaaacagttttacccactaagttcgtcatttacttgacctaacctttctcaggtaatggaatatcaattacatcaaagtcgcgaacgactttcgagtgactaaagactttctgtgcttgtttttgtagttccttactcaacttacccgtgtaccgagccgagatatgggtcaacaatagctgcttaacaccggcctgttgggccacctgggctgcttgggtactcgttgaatggtaatagttatgtgccaacttaccttcatcttttccgaacgtgctctcatgaactaaagcatccgcatcctgtgccaagctgaccgcgtgcggtgtccgccgagtatcaccgagaatcgtcaccgtccgccctttttgtggcgcagcgatgtaatcttgaccattaattgtccgaccatcaggcaacgtcaccgttttgccggcttttaattgaccatagacgggaccactcggaatgttcagggctttgagtcgatcggcttgtaattcacccgggtggtccgcttcttctacccggtaaccaaaacaagcgatccgatgatccagaggttcgcagcttactttgaacgtcgcatcttcaaaaaccgtctcagccttcgtgatttcatgaaacttcaatggatatgacaaatgggtgccagagacccgcaacgccgtttgaacgaagtcgcggacaccgactggcccataaatggtgagtggttcgtccccgccttgaaaagaacgcgagctcaataaccccggtaagccaaagatatgatcgccatgcagatgggtaataaatatttttgcaattttgcgtggttttaacgtcgtgcgtaaaatctggtgttgcgtcccttcgccgacatcgaacaaccagacttcatttcgctcatctaatagtcgtaatgctgtgctagtgacatttcgaaatttgcccggtgagccggcaccggtacctaaaaattctaattgcatatttttgttcgtcctatctatacagtctgctaactattttaccgaatctagcggcaatacacaattgttagcactgcaaagtcatggccggtcaacaccgtgcgctcaccgaccgcaattctacaaagcaagcgacgttgggcgactcctcacaattaacaggaagaacacgaacaacgctgctcattttattttaacatgtcaggctaaaattatcgcacttggtttcaagattccacgcgccaagactgcctgccaccggtgttatctataatcaaaaaatgcacttttccgggcaaactgactatgacgggttgtgaccgttttcattcaacccgtcatcgccggcaaatgaatcctcagtccatcttgcttaacccaattgattatcgtatacttgcttacaaatcgtctgaacaagaggtaaccgttatgcgactcatcgactttaacttatcaaccgctgatctacagcaaactttaccactgtattgggaactaacgactaatcaaatctggccaatccaaagtgttacgctcgtcgatcaccagctggttttagtagcttcaaaaagcgcgctcccgctgacactcgaccagttcaatgcgcggacgcgccaaatcgatggtcaaacgcagctctgtattcaaaccccaccgcgtccgcgccgattatttggctatcgcttaagccagcagcgcttactgtttggctgagcatctaatcgcacgtcaactcaaaaacagcgtcgttagttaaaattctaacggcgctgtttttggattgttcattattttatcactagtctacctaccagactgtcgtaacgacaatcatcaactaattatgtcgtcacaaaagtttagtccataaactggaaggagtagtccaagatttgaatcgtatcatcattcttggcaccagctgcacgtaaggcatcatcaacacccatcccacgtaattgccgagcaaagcgcattaaactttcttcatgatctaaattggtcatcttaaagagccgttctaacttatcaccagacaagacgaacaagcccggttctggattatcaatgctaaagtccgcatccgcttcagtcgtgtaatcacggtgcttcaagtcgtcaacacccttgattgggaattgtggcgtcgtatccaacaaatcagccgtcttggctaacaaggcttttagtccctgttgtgtaatcgacgataccggatagacggctggcgtgtttggcaacgtatcatccgtcgctaacttcgccttaaagtcttccagattagcttcggcatccggcatatccatcttagtcgccaccacgatttggggccgcttcaagagatcagggtcataactcgtcagctcgtgattaattttgtgataatcctcaaacggatcgttttcttctacaccactcatatcaatcagatgtaaaataacgcgcgtccgttcaatatgccgcaagaattgaatccctaagccgactccgttagctgcaccttcgatcaaaccaggtagatcagccataacaaagtcacgaccgtcatccaaacgaaccatcccgagattaggcactaaagttgtaaaatgataggccgcaatcttgggcttagcactcgtgaccactgaaagcagtgtcgacttgccgactgaaggaaaaccaaccagaccaacatcggccaagactttcaattccattcgaatcgtcaattcatcgccgggctcaccattttcagcaatttcaggagcagggttcttagcgctagcaaaatgaatatttccccgaccgccccggccacccttggcaaccactaaccgctgatctttattgacgatatcgccaattaactcaccagtttcagcatccgtcaccgttgtcccaagcggtactttaataattgtgtccttcgcggaacgacctgtcatctgcttaatcattccattgccaccagctgcggctttgaacttccgcgtataacgaaaatccatcagtgtccgtaatccttcgtcagcctgcaatacgacgcttccgccgcgaccaccatcaccgccagcgggaccaccattgggaacaaacttttcacggcggaaagcaaccatgccgttaccaccgttaccggcctttacatctacttttacttgatcaacaaacatgttcttttctcccgtttcttctatattattatctacgaaatccgatcgtgcgaaattagatacctgacctagtatacaaatcttcggccacttcgtcaaaagttccacgcctaattagacagatcatctttatttggatgctaatgacgatttgatgacagattttggattattttgacggtttttgaaggtttttgttgcattttgacgtttaaacaggtatattattatgcggagggatttgaaagtgcttacagaagaacgtcaacagtacattttaaatacgatccgtttcaagggcattattaaaatcaaggacatctgttctgaaactcgttgttccgagtccacggcgcgccgtgacctccaacagctagaagaacagggcgagttactccgcgtgcacggtggtgcgaagtatatgaactcactccaagaggaacccgcgatgaatgataaggtttcccgtaacgttaacgccaaggaccatatcgcgcagcaagccgttgcgaacattcaagttgatgacgtcatttatttggatgctgggacttcaaccctagccatgattcaccatttaaatccgagctacaacttacgtgtcgtgactaatggtgttgtccatgcttccgctttggcagacatgggcatccaaacctacctgcttggtggcaatttgaaaggcaccaccaaagccgtgattggtcccgaagccgttaaatcgttagaggaataccgattcaacaaagttttccttggtatcaacggtgtccacccaaaattcgggctcacaacgcccgaccccgatgaagcggtcgtcaaaaaaaccgcaattctacaaagtgaagaaagctttatcttagctgacaacactaagttcgaccacgtttcgtttgcgcgcgtcggtgatttatccagtgcaaccatcatcactgaccaactcacgccaagcgttgccgaacagtatcaaccattaactacgattcaggaggttcaatcatgatttataccattactgtcaatccatcaattgactacgtggtgcaactaccccaaatgaccctcggtagtgttaaccggttagcacacacggcgaaactccctggcggtaaaggcatcaatgtatcgcagattttgaacgacctagaccaacccaacaaggccctcggctttatcggtgggtttaccggcacgtttatcagtgatgctttaaaagccaagggcctagattgtcacttcacaccgattgccgatgacacccggatcaacgtgaagattcacgctgaagaagagaccgaattaaacggtgctggcccggacatcaccgccaaagaaatcgaagccttctacaccgaattagccaacttaacgccggatgacgtggtcgtcatgtctggtagtttagcgcctagtttaccagatagcttctactacgatattattcagaaggtcgaagctgctggtgctaattttgtcatcgacacgaccggtgaagctttgaagaaaactttacccagccaccccctcgttgtgaagcctaataaccacgaacttgctgattactaccacacgacgtttaatagccagactgatatcattgcagcgggccaacggatgctagctgaaggtgcacaacacgtgctgatttcaatggccggcgatggtggcctcctgatcaccaaggatgcggtctactttagtcccgcaccaaagggccaggtaatcaactcagttggtgccggtgattcaatgattggtggctttgtcggcacgttcgccaaaacacacgatgctgttgaaagcttccgctacggcttagcttgtggctccgcaaccgccttctcagaagacattgcgacccgcgccaagatcgatgaaattttgccactcattaacattgaaaaactcgctcactaaagaaaggactgttaactaaacatggatatccgcgatttattactaaaagatgtcatgatcatggacatgcacgccacgaccaaggacgaagcgattgatgagttagttcataaatatgccgaacaaggtatcatcaatgatgaggccctctacaagcaagacatcatcaaacgggaagccgaatcaactaccgggattggcgacgggattgctatgccccatgccaaagataaggctgttaaccgggcaaccgtgatgtttgctaagagtaaggccggcgttgacttcaacgcgttagatggtcaacccgttcatcttttcttcatgattgctgctcctgaaggtgccaacaacacccatttagccgccctcgccgccctctcaagcttattgattgatcctgaattggtcgctaaacttaagaatgcacagtcacctgaagaagttcaacaactcttcggtgacgcccaggctgctaaggaagaaaaagaagccaaagatgctgctgccaaggccgaaaaagaagccgcagctgccagcaccaccactgacgaaaaacgtccctatttagttggggttaccgcctgtccaaacggaatcgcccatacttacatggccgaagcagccttgatcaaagctggtgaagcggccggtgttgacatcaaaatcgaaacgaatggttctgaaggtgttaagcacttattgactgccgatgaaatcgctcgtgccgacggtgttgtaatcgccgctgacaaaaaggtcaagatggcccgttttgatggtaagcacctggttaaccgtcccgttactgacgggatcaacaaggccgatcaattagttcaagaagccttgagtggtaaagctcctgtctatcacgatgctgatggtggtgctgcggatgacgatgaaggtggcagcactaatggtagcgtttggggtgaagtttacaaagacctcatgaacgggatttcccacatgttgccattcgttgttggtggtgggatcttaatggccctctccttcattattgagcaattcgttggtagtaagagcttagcctttaccttcttcaaccaagctggtaacatggctttcgccttcatggtacctgttttagccggttacatcgccgaatcaattggtgatcgtcctgccttgatgcccgggttcgttggtgggttcatggccacggtatacactggcgcttacggtggtgtttacacggcctccattaccgccaatgctaagagtcccgctggtttcttaggtggtttagccgctggtttcttagccggttatattactgtttggatgaagaagtggaccaagaacatgccacaatccttagacgggatgaagccaatgctgatcttcccaattctgggcttattgattattgctgcgctaatgttcttcgttgttaacccaatcttctcagttatcaacgcctggattacccacttcctaaactcaatgggtactggtaatgccgttctcctcggtcttgtcctcggtggtatgatgtcgatcgatatgggtggtcctttcaacaaggccgcttacgtcttcgcaactggtgcctttaccgcaactggacatgggaacttaatggccgctgttatggctggtgggatggttccaccattggcaactgcgattgccactgccttctggccaaagaaatttacggatgacgaacgtaaagctggtatctctaactggttacttggtatttccttcattactgaaggtgccattccattcgccacagctgacccattgcacgttatcggttcaagtgtgattggtgctgccatcgccggtggcttaactcaactttggggcgttgccgtccctgctcctcatggtggcctctgggtctcattactcgccacgaatatctggggctacatcggtgccacaattatcggtgccgttatcgctggggttatccttggtctctggaaaccagctaaagcttctaaataatgtgatatctaaaaagacgatcaaattgatcgtctttttttgttttcaaaattaacgaatcagccgtctaaccccgcaataaaacgggtataatgaaagtaatatactgattatgttaacgagaatcgagacgagtttgatgaaactacgaaaatctatctttggcatcagctgtgtattattcggcatgatgctgctttccggttgccaaaaacaaactaaaatgaccctgccccctgtcagtcacaagaccttaacagcgatggtgatcagtgatgaccatgtcattgcgcccagcctgcatgataatggtaaggctttcacgcagtacgcggctaacgatgccggtgcagatttaaaatacagcgcgacgatttttcgcgcttttattgctaaggcgttaatcaccaagcctgacgttgtgctcatcagtggcgatattactaacaacggtgaaaaagccagtcacgagtacgttgccaagcagcttcgccgactgactgctaagcacatccgcgtctacgtcgtccccggtaatcacgacttgaacaaccctatcgcccgtcgcttcaaaggaaagcatcaatatagcaccgaggcgactagcccgacccagttcaagaagatctatcatcaggacggctacggccaagccagtgaaactgacccaagctcattgggatatttggtaaaacctagtaaacacacttggtttttgatgctaaactccgccatttataaaagtaattatcaacaaggtaattcaacggtcggtggtggcctgaccgatgggaccttacaatggcttactaaagtcggtaagcaagcaaaacaagcccatgcgactctcattcccgtcctacatcacaatacaatggaccacacggtgattcatcaggactatacaatcggttatgccgaagatgtccgtaaggcctttaccactgcgggtatcaagttatcgctcagcggccatattcatgctcaaaatatcaagtctaccaaagtcaagaaccagtcactgactgatattgccagtggcgccctgatactgggatctcactattacggtacgcttaagatcaaccagagtaacgggacggccacgtaccacgcgaccccgttaaacgtgagtgcttacatcaagcaccaccgtggtaataaagcaatgcgcgcctatcaaaagtacgatcatgacgtgttatatgcggctggctataacgcagcactgagtcagttatatgaggaccgtgacgaaacgcaactatcaagcgctaaagttaatcagctagcccgcggcatggcggccgccaatatcgcgctctttcggggcaccccagtcaaaaatagcgccgctattcaagcttggcaacaaatgccccacaatacaagtttgcgcggcttcgtgttagccaccaagaaactacacggcaacgtgacgtggtctgggtccgtacaataaccactttataaactaaagacgacagcgaattttcaggctgtcgtctttttgattagtcactacttatagctggtcagtcacaccggcaccaccctacttcgattcggctagattggttttcgcacacgtagcatttggttaacaatggtcattaaataatcacgcttgctaaatccgacgacggccgttatcaaaatcaatagataacggagtacaacactgtgatagcctcctaaaaatagaaagccaaccgccaaaaaagtgagcgtaatcagccccagtatcttgcgatcatatggaagcgtgccaagtttttcgcgacagattcgattcataaaccaataatgaacaaccgcatacatcacatagcaaattaatgttgtatatcccgccacctcgtatcctaaaattggaatcaaccaataatttagcgccacattcaatactgcgccaataacactggcaatcatgattaaagatgtccgttcataatagaactcaaactttgcaaataaatcaaaagcaaaaatgaaaaagacgctcattgcgattggtggaacgatccaggtcgccttagcatatgctcgtggtgcgaatatcgaaacgatttcgggcgcaaatgcaatcaatagcaggttgacaaccgcaattaaaactaaggcaccgtaagcaacacccgcaatatcggccacccgtcgatccttgattttttgatatatccacggactcagcgtttgcgacaatgcaacgttaaataagatcatgatttgtgaaagtgagtacgccaaactataaatgcccgcacttttcgtatttaccatgttcgcaatcataatccggtcagcactactcagaacgatttgtgaaagataatgtggggccaacgggatgttgaacattaatgcgtgacgccaaaaatggcgcgagaaaaacgttttgccacgatacatttgcacaaaaaacaagcccgtatagcctaccagttccactaatgctagccctaaaaatcgagccgtcactttatcattcgcatacacaacgagcaatacgcctactaacggtttggcgattgcaaccagcaaggtcaccatcaccaatgatttgtattgcaaggcaactcggcgctcaccagcccaaaaattaaaaactgacgaggtccataccattagaagcatcgccaacatctgcgtcgtcgttaaagaaaagacactattccaaaaatcacgaaagccaaggtaaactagtgtccatgctaataccaacacaaccgttaatccttgtaatgcagccgaatatcgacgtcgatcatggctgaatttgatgagaccttgagtataaacgccgtagcacagatttagtgagacgatgatcgtgacgatagtcagccaggagtacagcacattaaattgaccatactcggaagtagacattattctggtaaaaatgggcgttgcgattattgaaatgctcttttcaaaaaaagcacagactaagaaccaaagtgaggccttaacttgctttggcaaatgccgatatttatttctaatactgactaacataaattcctttctcataggtctgaactgagcatcacatcccctgcttactaataacaaatctcataagcaccgcacacgttcaatcacttggttgttgtcgataccggcgcccatttaccgaccaaatcgttcttaaacgtaaatagttgatcacatagtaacaattatctggggatgtcaccattgcgcggactaacgcagccagggcctgaccaagttttcgtttgcgcatactggccatcgccatcgtaaaatatttttgcccacgattaaacgtactttgggcacggacgtcatttattttgtctgttaacgccgacatcccgcggccgaaactgtctgctcccgtccgtttacgttccgcatacaattgttgaatatagcgcgataccagatacgttttccacgcgtcgctggtcatactattaccgcgtaaccgatagttcaacactcggcggttaattgacccgattttgaatccattagcaagcagccgcagccaaagatcatagtcctcagccgttggtaataaacggtaaccaccgacttgttggacggccgttttccgcattaaaacggtgggatgaataattgtcgaaccatagggcaggattttttgaattagtggttcagcctcgggaatggccgatttttccccgacaacctcatcctgttcatcaagataagtaatatttccggaaattaaatccaaatcgcgcgtttttaacgcctctaattccacttcgagccgattagtgacagaaatatcatccgcatccatccgcgcaatcaactcactacttgctagctcaatcgccttattgagactagcagccaggccgaggttttctggattgcacactagtttgatcatttccacacggaaatcgtaatccattaacaagtcttttaaatcactccgttctggattatccagtacgatcacaaactccctcggcaaataggtttgcttcaaaatcgagtcaaccgcttgctggacttgctcaggtcgttcattatatacactcataattacgctgattgccattttttctcctcaatcttcaattcagttgaaagtaaataccccaagaatattattgccgtcagtaccatgccgctgcgcgcaacctcacctttataatttgcgattagtagaactacgccaaaggctagaaagattttactatcacgaacaacctttccagactttttgtggcaagccgtcaacgaggctataatcgtaccgtacagtagcgccatgtaaatgatgccccccataaataagtcattaataaagccaatgtcggacgttccgaaccaaatattgttggcattgccaccatatacgcgaacgccataaccaaacacccaatctaaaagctgactcggaaacatcaagaacgagcccgtcagttgttcgtaattgccctgcttactaccttcaaagacgagtgcaaacgtatcttcgaagccactgacgatccaggtatacgtatcaggttggatggattgcaaaaacgctaaacccaatatgataaaggtcacactcaatatgataatcaacacaacttgaaacagcccacgaacactggacagcatccgtttgaccagcatcaaagcaaaaccaaaagccagcgtgatcaagccggttcggccgtttaatacgataataaagacacaaaatggtaggaaccaataatactttttgccatggttcattcccagatatatcgcaactagccccatcaaactatgatagattggagtaaaaaatgtgtaatcactgctgattccatacaaacgttcaccataaataaactgattctgaataataccagtggctgtttttgctaaaattgcagcgcgaatacccgaacttgccagcatgaccaaagcaaataagcattgaacgaccaccatccatagcatccaggtcaagaccgtttcgcttgtcacgttaaaatacttacgaagaacttctagccataacaccaaggcaacgacgttcaaaataatcacaatattttgaaacacccgggggtcatttcctgccaactttgccctgaacgcaaagtaaatcactgatagcatcacaccaatcacaaaaatgtgcagccgattaatagcaatcgataagtcctttggcgacaatagcaagacgcaaccaccagtaatccccggtgtaacaatcaggggcacataactactgctccaaaagttgggttggtaaatcaggtaaaatccggcaatcaatagtcctagttttaagaatggcccgccaatttgacgatttactgcagtcatcgttccattactccttcataaacttgctggattcgttggataaatcgcttttgttcataatcactaaaatcgaccgctgctattttagccttggttgcctgataaaatgggtcatccgagaagagacgtgtcagtactgctaataattcatcatcactcgtataaacgatgccgtttaccctcgcagccgtttgagagaggccaccaatacggggggcaaacggaatcgcacccaacaaagccgcctcgaccatggtcaacccaaacgcgtctgatttggacgtcgacagcacaacttttgcatgccgcatgtatttgtaagggttacttttaaaccctaaccaccgtatttgtggggtggctgcaatctgtttagcgatgtgtgcgctcaagctaccatcgccgacaatcccaatctttagttcagggatagcgtctaataatttatgcgcaattctcacaaatcttgcgggatctttaacatcttccaaccgtcccacgaataacaggtcaaatgcaatggttgtgctggcagtagccagttggcatatccgtgaactgtcgattccattgggaataatcgccgtattggttaaatgtttgtggaagcgatacgattctttggcccaatctgaaacatataagactcgtgagctcttgttgccaatatattgaaacgccaaacttttccagttcacactagtctgccatatcggggcttgatggatatgggtgataattggcacatggtgaaaaagtaggttgaccaaaaaactcgctttgaaatcgtgtgcgtgaataatatctggctggagtgccagaatagctcgccgaaatttaagaagctgtttcggcgaaaaactttgatacgcgattccgacagcttgcaagctttcttgtatcgatcctgattgtgagcagtaggtgaaatcataggatccactcaaacccctactgatattaatgaccacctgctcagcaccacctaatttggcggaaaacaagacatgaacaatttttgtcatcgacaatcgtccctcctaggccaagcaacgcaaatagtacgcctgcgtttgttcaagcatctcatgctcagtatagtgacgttgatacatttgataggaattagtcttgacctcggcgatctttttcgattgatagagtgtcagaattttttcagcaatctggcgcgcatcattggtgaccaaaaagccattatgatcaatcaattcctgaatgcccccaacattcgacgcaataatcggcagaccttgggctaaggcttccactaaactgattgggagtgcttcataatcagaaatcagcaccccaacgtccgattgagaataatatttttgtacattatccaccaccccataaaagttcactttaccatccagattcaactggtgcgttagcgttttacaagcttcaatcgaagggccgtcacccagaaaatgacacacgattggtagattttccggcaagtatgtcaatgcttgaatcaggatatcctgccgttttggtgtatcaaagcgtgccgccattgatagtacaaagacctcggaactggtcgccttgtttgcgcccgttaatgctgtcacgccattatggataacacgagcaggatgagcactagtaatcacaccactttggacacccaaatcataatcaaactgcgagacacagatgtaagccgttgtcaggcgacttaatgctttttcaatagttttcatcaatagctgccgtttcttcccgacaccaggagtaaagccccagccatggaccgtaaaaatgactttcattggcaatctaatcgtggcgagcctcccaatcataccagccttcgaagaatgcaaatgaataatatctggctgccaattttttactaatttccttaacgtgtagattgctttcaaatcactcagcggtgcaatcggatgtaccaggctggcaactctgacaacttgcacgtcttgaaattctttcgcgacgcttgcactcaggcgtccttcaacgccgtatactaaggcaacggcattgccacgcatcacttgcgctttgatcaaactatatagatgcgcctgggccccaccccaagtcgcttgagtaatgatgtaaacaatcttcactaccgcgcaccatccccggaaataatcaccctaaccgttcccatcagcatcttgatatcaaaccaaatcgaaaagtgctcaatgtaatagttatcgtactgacacttggcacccggtgtaatatcatagccaccattgatctgcgcatagccggtaatgccaggaatgattcgtagccgtttcggaaaatcaggatagcgttcactgaattgttcggttagttctggccgttccgggcgaggtccgaccaaactcatatcgcccttcaaaacattccaaaattgtggtaactcatcgatccgagttttgcgcatccagcgtccaaccggcgtcacccgaggatcatttttttgtgcccagatcgcacccgtctgcgcctcagcgtcctgatacattgatcgcagcttaatcacgtcaaaagtcgtccccatccaaccgactcgcgcctgcttgtagaaaacgggaccgtcagaagtcaacttgataagtatggcaaacacaattacgatgggaacgctgagcagtgtgcccaataagccgactgctagatcgaaacaccgctttagatccatcttccagccggtgaccggaacaccaattttgctaataaattcacagtgttgttcgtcagccacgattgattcattaatctcaacttcgtgcatgctcacattccccttcccagtacttagttaatcctcttctcaacggccactctgattcataatttaagcgtgccaacttgccaatacttgcaactgaatgatcaacttcaccaccccgctgctcggcccgtttgatttcaagttgttgaccagcaatctcttgatacatctgaataatgccatttaaactagtttctaagccattggcaatattgatcacttcatgttgcacttgatgttctgtaatcaaccataatgccttgataacatcacttacatatacaaaatcacgggtctgcgttccatcaccgaataatgtaaatggtcgctgtgttttcaaacaatccgtcaaaatcgacaaaacccccgaatacggtgagcttggattctgacgcggtccataaacgttgaagaaccgcacacaaacggtcggcaaatcgtacaactcaccgtatgccaatacaaaacgttcagtcgcatacttatcaatagcatacggtgacacgggtgcgacgcgcgaatcctcgcgttttggtaattcaggtagattgccataaaccgccgccgaagaagtgaatagaaattgcttaataggcaagcgaatttggcgaatatgttcgagcaagttaaataccgcggtatgattgacagcatgcgtttctgccggccgctcaatcgaatccgccacactcgcaatcgatgccagaaaataaatatagtctggccgttcgtctgctaacaattgttgcatgaatttatcgtcacagacatccgcgacgtatatcgtaatctgttcccaatgcttgatattgctgatggcccccattgacagatcgtctaccaccacctcaaagccagattcaactaaatgatcaaccaagtgcgagccaatgaaccccgcacctcccgttaccaatgccttcataactatttacccctctcaaaaaagccaaaattttcgtcgttgatttggtcgcaagacttcccctaacactactggatccccgttcagtagcagtcttgcattcactgcaaaagatgcaggattggtactatctaaccgtgctaatgcctgataacctgcccgcatcataaatcctcgtcgtgccatcaaatgcgcatctgaagcaatcacttggaccagcccgcattcaactaattccagcgctgtacttttaaccgctcgcccaaattgcccaacgagactccccgctgttagctgtgccaaacagccctgctgcactaaatcatagagccgctctggttgtgccataatctgagcatttcgctctggatgggcaatcaccggagtcgtcccttgctgtaagagctcaaaaattacttgcgccacgtaattaggtacctgctcgtgtggcaattctagtaacaaatagcgccgaccaacatcaattcctagcaagtgcggcagagctgtcgccaaatcatctcgcaaatggacctcctgaccggcaaaaacggtcagtggaatttgttgccgcttaagttcggcctggagctcggcaacggcccgctcaactaccaggccagtattctgataacgccgatctagatgatgtggcgttgccaagacgtaatgaatgccatcagccaccgcttgtcgcgccatttcgactgcctgagcaagctgctgggggccgtcatccaatcccggtaataagtgacagtgcaggtcaatatactcagttggtctcagtcccataatagccgtacccataaccgtgagttttaatgtccacgtcatttaaaatagtcccgagtaattgtgcgcgagcattcttcaaggcactcactgcctggcgcaccgcaactttttcgacaaagttttggcgaacgactaggacagtgccatccacttgaccagctaagatccgagcgtcggtcacgggcagtatcggcggcgcatcaacaatcactaaatctaacttacgtgttgcgaccgttaaaaactcggtcattctatcgctggctaataactcagctggattgggtggtttaggcccactcggcatgacaaacaaatgatcaagtacgggataaatggcctcgttcacgtccgtcagttgcccgcttaaccatgaactcactccccgttgattactgatcgcaaacgtctgatgaatcgtcggccgccgcaaatcagcatcgacaagtaagacttgcaggcctttcttggcgtattccacggctaagttgctgccgaccgttgattttccctcgccctgaatcgctgacgtgatcattagtgttttcaacggtttaccgaccatcgcatagttaagatttgttcggatcgttttgacttgctcagttacgactgacatcggtgccgtcaaagttgttaactgtatgccggtatgcatattcgctactcttcgcctcaatttcataaccgttcccccctatgttaaactcgtttgactgccgctttaacaactgacgtcaccggctgtggtttaattgccggttggtcgtgagtcgctgtgaccggctgttgatgattaatgattcctagacttgtcagcattaattcatctgctaggtattcgagtgtctgcactcgccgattggacaagattcggacacttgcatacaccaatcccaaaatcagcccccccacgaaaccaattaggatattgatgatttttttaggcgctaccggctgatccggcgtctctgcgggtgcaacgatcgttacattattgaccctaataatatgctggacctgatctttaaacgttgcagcaatttggttcgcaatcattgcactagctttcgcatttttatcacgaacaacgattgaaaacacctgcgaattggccgtactggtcacgctgaccgtttgcttaagcgactcaagtgagcgtcgaatgtcagtttctgccattaaagtctgccgtgccggcttcaacacgactggttttgtaattaattccttataagtcgtaatcatctgcacatcggcttgctggcccgtcaaatccgcgcccgcactactgtgtttgcggttcactaatatttgaacattggcttgatactcgggctgaatgacccacaaagtcaccactgttgcaatcgtcccgcccaaaatcattaaactcaataataccttccaatactgacgaatgagtttaacaataaaatcaaaggttattacttgctccattccacacgctccaatatttcttgactgacttttattaaacgattgacattattgtagaaaaccagttgcaaacgacgcaatagttttcacgaattttcatgaaactcatataaatacaagcgaatattcgacaatctctaaatttaaattgacattatagacaataatgttatatttattgatagttactaatcaaaataatataaattgtataattatttgactttattttagctcgtatttacccacaattatttcgattaaatcatcggttactccagcaaccaatgtgcttttcaactaatcacaaaatcgacatttttacaaatcaatgatgttttcaagcatcaaaaaagaccacctagttcgtgaaaactagatggtcttcttaacattaattacattagttagccagatgacaactatgtggcgcccttttgataatgcttcggtgttacaccaccaccggctaatgaaaatttgacagtttgtgcaacgtttttagcaattcccagggactgaatctcttccagtgaggcaccagcaattttactcatcgatccaaatttacgcaacaacttattacgcgtcttcggcccaaccccggggatctcgtccaagcgcgaactcaatgaatgtttggcatggacttgtcggtgaaacgtaatcgcaaagcggtgcacttcatcttgaatccgttgtaataaataaaatccttgactcttcggatctagatgcaaatgctgatcaccagcagaagcgagtaggtccgccgtcttatgatggtcatttttgaccattgccgcgactggcgttgcaatccctaattcgttctctaagacgtccttagcggcttccagctggatctcgccaccatccatcaaaatcaggtcgggcaatgctgcatgctccttcagtagccgtgtatagcgccgccgaatcacttcacgggtcgatgcagcttcatcagcatgatcgaccgtccgcaacttatatttccgatacaattttttattcggttgcccgtccgtgaagacgaccatggcagaaaccaagtcggccccctgaatatgagagtggtcaaaagcctcaattttatgaccagcaggaatgcctaaagcatccgtgatttcttgcatcgcccccgtcgtcttgcgctcatccaattccaacaaccggaacttctcttctaagacgattcgagcatttttttgtgccatgtccagcaaatcctttttctggccgcgttgaggggtccttaccggaattccgagaatgtcactcaggacctgcttatcaagaccgttggggactaaaacttcgcgtggtagaacgttatttttgcgattataaaattgcaagataaagctcgtcatttcttcaggtgcagttgacactactgggaacaagcgtttctcgcgcttcatcaaccgcgcttgccgaataaagaagacctgaatcgaaagccagcctttatcaagatagaaattaaacaggtcgcggggcgtattatcgtttgaaataattttctgcttttcaaccgtcatttcaatataattcagttgatcacgtaattcagcggctcgttcaaattctaggtcagcggccgcttgatccattcgtttagttaactgcttcttgaccgtttcaacgtgaccattcaaaaaggatttaatccgcttgatctgagcgtcatattctgccaccggcaccgttttaaagcaagctcccaagcattggcccatatgataatagagacacggccgcttctggaaaccatggcaacgccgcaacggatagaccttctgaataaaattgaccgtttcctgagccgcgtaaacattgggatatggcccaaagtagtagccaccatctttacgaacatcactgacgatcaggatctgggggtctcgttcattggtaatcttaatgtacggataaccggttcccttttttaatttaatattaaagtacggttgatgtttttgaattaacgtaatttctagcaggaaggcttccttatccgttgaggtcacaataaactcaaagtccgcaatctctgatactaaccgcgcggtcttaccagtatggctgcttttgaaatatgaacgcacccgatttttcaagttcttggccttacccacataaatgatctgactgtttaagttcttcatcagataacatcctggtaagtccggtaacaaggataacttatgttcaatatgcgcggatgccataacacaccttcccttcatttagattagcattattagtataccgcctgctagcatggggctcaaccaaacagcccggaaatatgatttttattatgaccgactattcatcactgtcgctactgatcacagtgtagcaaaaaaccggtaatcagcaactgagctgattaccggttatgtgttgtttacatcaaaattttagaaagaaaatcttgggcccgctctgtttgcgggttcgcaaagaattcctcaggcgtattattctcctgaatatagccatcagccatgaaccagattcgatccgctactgacttagcaaaacccatttcgtgagtgaccacaaccatggtcatcccatccttagcaagttcttgcatcacgtttaacacttccccaaccatttccgggtccaaggcagacgttggttcgtcaaacagcatcacttcagggttcatcgccaacgcacgagcaatcgccacccgttgagcctgaccacctgaaagactacttggaaaggcatccgcatgatcgtccaacccaacgcgttgcaataattcgtgcgcttgcttagtcgccgcggcatcatcgacatgcttgaccttcatcggcgccaatttaatgttttccaatacagtcatgttgggaaatagattaaacccttggaaaaccattcccattttttcacgtagcgcgttaacactcttcgtatccaaagttgtgagatcttgaccttcgaaagcgacttgaccacttgtgggcgtctcgagtaagtttaaacaacgtaagaaggtactcttcccaccaccagaaggaccaatcaccacgatcacctgaccgggttcaactttttctgtaatatcctttaaaacgtcattttcaccgaagctcttcgcaaggtctttaacttcaattactggtttagtcatgttgcattctcctttcgaagtagttcaagatccgtgaagcggtaaaggttaagatgaagtatagcaccataataacaacgatcggtgcaaccccccggtacgtatctgaacgaacaatgttactttgataaattaattcagtgaccccaataatcgaaacgatggaactatccttgatcaacgtaataaattcgttcccaagtgatggccaaatgttcttcaatgcttgtggcaagaccacgtaacgcatcgtttcaccgttggacattcctaaactccgagcagcttccgtctgcccaacatcgacggaattaatcccgccacgaatatattcagcaacgtacgcaccagagttcaaggaaatcgcaataatcccagaagtcagtgctggtaaattgacgaataacccaagtccgaagtacacaaacatcacttggaccatcattggcgtcccacgaataaattcaacatacgcagttgctaaccaccgaatggcagtcttaagtggatttcctttagccatccgtgctaatgccaataaaataccgatgataaaaccgaagaaaacggagcaaaccgtaatgattaacgtatattcgatcccggttgcaaaagccttccagtaatgtcccattgacgtattaacggtattggtcttcaaatacttgccggctgccggtaaatattgctttttaacgaggttctgtttcttaatccgatcaacggtcttattgactttgttaacaagactagttgaacctttccgaaatgcgatcgccgaactcgttgcactagagctcatgttgaagtcactaggaatagcaaccaaactcttattgtttgcaacataggcttctgcagaaggcttttccatagcaaccccatcaactttgtgactctgaagtgccaaaatcagatcagattgtgaagtcatccctttagccttggcagtcgtttggtttttgacggcattatattgagtcgttccagtttgggcacccaacgtgccattcttgaatgaattcttattcttgtacttgcccttatcagtcttattgatgacaatatcgtagccaccttgataataaacgtgggtaaaatcaacatttttccgccgtgaaggggttgggttcatcccagagataatcatatcaaccttgccagtttggagtgccactagcaatgagtcaaatgacatggatttgatcttcagcttcacgcccagatccttagcaacttgtttcccaatctgaacatccatcccaacgatcttactcttaccgttgaccgttgcttgaaactcatacggtggataatcaggcgacgtccccattactaagacgccctttttctgaatttgttctaatgaattatcggccgcttgcgcatgttgcgtctgtccgagtgggacgacggtcatgatcagggccacaataatggctaaaaaccacccaaatctttttttcataggtattctcctcgttttgtaatttacaagaataaagtataaccgcatatgattatttatgcaagtatttttgaaaatttctttattttatgcataaataagtcgtttatacacgttttagcccattgattatgcataaacgacgaataactgacaaattgtcggaaatttgctatgataggcgttaatcgaaaggaatgattttatgagtttaaaagtacagcgtcaagataaccttgataagctattcgacaagtttgccattggtcctgacgataaggataaactcaccactaaagcggttcaggatactattgacgaacatgctaaacgcaaagaaaataaggcagctgataaaaaggacgcccataaatagcagtcaaaaaaaacgcgatggcagttagccatcgcgtttttatttgaataactatttagcaaattttagtcccgattgtttgcatcttttcgcgccgctctgcttccgtttctggtgaaacatcgcgccaatcaacaacagccaaagcaccgtcgagcatcccgctatcatccttgagcgctaaagcattatgccagcgagaaatgttgaggccgttccccaagtaggcttcatcagccggtgcaacgtgcatcacataaccagcattattttctaatggcgtggtatagtcgggatcagcggctttaagaataactaactgaaacttattaccaatggcacagctaccgcctaaactcgaatatttgttagaaccatcgtcagttgttaaaattacttgactccctgccggaatcttatctgcaaggtaggcttgagcatcgtctttgatattaatcttcatagttaagcatcctttccgtttcaaaaacatttaagttgtgcacaactcttttacagtctttaatttacgctatttcagctgcaaatgcaattaatttacctagaaaagtgaaaataaacagccgaactcaataatgacacaatttttgcaaatgatatgtggtcgttcgtcgcaataaaaaagagttgggctgccagccttacctgctgacagcccaactcttcaggttagaccactcttcaccgactatttaactggtttaccattcgggtacttatcgttgagtttaacaatattttgttgcgcaacttcttcgaacggaatatccgcccattcagcaacttgtgataagtaccataacacatcgcccatctgtttcgtcagctgatctttattcaaacgttcaccatgaaacgtatactttttgactaagtcaacgacttgaccagtctctgaagctaatcccagcgataagttcgtcagcacctgctcattaccatataatgtccgatttgctaacgactgatactcattaaattccaagttagttgcctcccacagtgtgcgcttcgatccattgccaaacagcatccttgccttctttggtcttagctgaaaaggcgataaaatcgtcttcagcttggaagttaagcgtctttttaattaaactttcctgtttgttccacttaccacgcggaattttatcacttttagttgccacgaccagtaatggcatctcatagtaacgcatccactcgtacattgcgacatcgtctttagttggcgcatgacgtgcatcgactagaataacgacacctcgcagtgtctctcggcttgttagatacgtctcaatcatttgtccccacttctcacgttccttcttagataccttagcataaccgtatcccggaacatcgacgaagtataattgatcttcaactttataaaagttcagtgtttgggtcttcccaggttgactagacgtccgcgcatagctattgcggttaatcaacacattaatcagggatgattttccgacgttagagcgccccgctaacccaatttctggaaacccagtagtcgggtactggctcggcgctaccgcgctcatgacaagttcaacgttatgcacttccatcgaattaactccttctgcaatcgtattgcattcattttaccataatttttgcagcgggttgtcatccgcgctcaaattcgatttaaacagcactcaggaccgcgaatgaaaactcatcgcggtcctgagtgctgtctattgatcttctgaacgaaacgttaggaagctttttgatcagctaaaaccagttctggttcagcgtgatcagcaaccgtctcgcgagtaataatcacctttttaacatcttcacgacttggaatatcatacataatgtcccgcatcgtgtcttcaataatcgagcgtagaccccgagcaccagtattacgtgctaaggcttcttgcgcgatggcacgtaaagcgtcatcgttaaagtctaattctgcaccgtctagagcaattaggcgttgatattgcttgacaagcgcattctttggttccgttaagatccggaccaaatcatcttccgttaaacgttctagcgcagtcaagattggaagacgcccaataaattcaggaattaaaccgaattgtaagaggtcttctggcacaacttgttgcatgagactcttggaatcgtctagaacggcattcttaccatcggtgtccgtaccgaaaccaatcgttttatcgcctaggcgacgtttgacgatgtcttcgattccatcaaaggccccaccaacgatgaataaaatgttggtcgtgtcaatttgaataaactcttgttggggatgcttacgcccgccctgcggtggcacattggcaatcgtaccttccaaaatcttcaagagggcttgttgaaccccttcaccggaaacatcccgtgtaattgagacattttcactcttcttggcgatcttatcgatttcatcaatataaataatccctttttcggcacgttcaacgtcgtaatccgcattttgcagtaatttcagcaaaatattttcaacgtcttcaccaacatagccggcttcggttaacgtcgtggcatccgcaatagcaaatggcacatccaaaattcgcgctaaactctgagctaagaaagtcttaccagaaccagttggtcccactaagctaatattactcttttgtaattcaggaccatcttcggtctcttcatcattatcagccatggccttaaccctcttgtagtggttataaaccgcaactgatagggtccgcttagcttcattttggccgatcacgtattggtctaactcgtctacaatttcctttggcgttgggatatctgttaattcatgggtttgttcttcgctaaactcttcatcgataatttctttacataaatcgatacattcattacagatataaacgccgggtccagccacgatctttttaacttgatcttgtgatttaccacaaaatgagcagttcacagggccgtttgtctcggtattttcaaacattcattctcacctcatcgatgtatttacatggattaatcataacagaaaaactgagctaaaaccagcttaggcactgtcttctacgtccactactataacatggacgaacctaaacccgaaattatctgttcaatcatccggctaaccactttgaaaaccgaatgattctcgcagtaaatcacaggcgtcagccaaatagctattaaattaatcttacgattagctgacgctatgtaaaagggtctcggaagaattattcttccaagaccctcgacttgtatctaattgaattaattagttcttgtcgctgtcgtcttttttgtcttctgctttggcattttgcttagcagaatccgcaatcaagtcaacggcttggcgaatcgcaatgtcatgtgacaacatgtcatccgttaaagcaccacgaacagcactttcttccatgttgtattgactagctaaatccttaacttcggccgcaatttcatcctgagatggcttgatgttttcagcttcaacaaccgcttctaagaccaagttagtcttaacccggcgttcagcatcagcagcaaattgcttgtgcaagtcgtcttcagtagtaccagtcaacttgtagtaagtctttggatcgataccttgttgttgcatattagccaagtattgatccatttgacgatgaatatcgtcttctttcatggcatcaggaattgcttgaatttcagcattgtcaaccgcttggtttaaagcttcgtcttcaattgcatcatgcgcagcggattccttttgttccttaagttcgtccttgatcttagcttttaattcttcaagtgtgtcaacaacttcgtcaacatccttggcaaattcgtcatctaattcagggagttccttagtcttgacttcatgaactgtcactttgaaagtggcttctttgttttgtaagtcttcagcttggtaatccttagggaacgttaccttaacttcagtttcgtcgccagccttgacaccaactaattggtcttcaaaaccagggatgaatgagttagaacctaattcaagtgagtagttttctgattcgccaccttcaaatggttcgccatcaacgaatcctttgaaatcaataaccaccgtatcgcccttagcggctggttggtcttccttcagaactaattcagcttgtttttcacgccgtgattctaattcggcatcaacatccttagcataaacgcgagtattttgacgcgttacactaagttccttgtattgaccaagcttaacttctggtttaaccgttacaacggcctttaatacccaaggcttacctttttccatgctatcaacatcgatttgaggttgatcaactggttcgatttcagtttccttgattgcttcttcatatgcctctgggagcacgatgtttaaagcatcttgataaagtgcttcttcaccatacatttgattgaagatttgacgtggaaccttacccttacggaaaccaggaacatttaagttctttttagtccgttggaaggccttgtcgataccttcactaattttatcagcaccaatttcgaatgttaattcgccttggttgccttctttcttttcccactttgcagccattgtattccctccgaaacattataatttctacaattctagtcaattgcatacttgttaagtttaacctatcgacaccgtaaagtaaaccaaattggctaaaaaagcgcgtaagctcgcgatttattgttcgtttttcttaaaaaaagcgacttggaagaagacttccaagtcgcttagatcaatcaatgaaaatcagttagagattagtcatcaatttctgaaacaacaccggcaccgacagtatgaccaccttcacgaaccgtgaacttggtacccttttcgatggcagctggttgaatcaattcaacagtgaacgttacgttgtcaccaggcataaccatttcaacgccgtctggcaattcaataacaccagtgatatcagtggtgtggaagtagaattgtggacgatagtttgagaagaatggcgtatgacggccaccttcttctttgctcaagatataaacttcacccttgaacttcttgtgggtttggatcgaacctggcttagccaaaacttggccacgaacaacttgttcacggttaacaccacgtaataacgcaccaacgttatccccggcttcacctaagtcaagtgtcttacggaacatttcaagacccgtaacagttgacttaagaacatcttcgtgtaaaccaacgatttcaacttcgtcgccgaccttaacagtcccacgatcgatacgaccagaagcaacagtcccacgaccagtgattgagaagacgtcttcaacaggcatcaagaaaggcttttcagtatcacgaactggagttgggatgtattcatcaacaacatccattaagtgcatgataaccttttcttgttctgggtcgccttcaagtgctttaagcgctgaaccacggataacaggaatatcgtcaccagggaaatcgtattctgaaagtaattcacgtacttccatttcaaccaagtcaactaattcgtcatcgtcaacaagatcagtcttgtttaagaagacaacgatatagtcaacaccaacttggcgagccaagaggatgtgttcacgcgtttgtggcataggaccatcagttgcggcaacaactaagatcgcaccgtccatttgagcggcaccagtaatcatgttcttaacgtagtcagcatgtcctggggcatcgatatgagcgtagtgacgcttttcagtttcgtattcaacgtgggcagtgttgatagtaataccacgttcacgttcttccggagcagcatcgatagaagcaaagtcttgttctttagccaagcccttagatgctaataccttagtgattgcagcggtcaaagtagtcttcccatggtcaacgtggccaatagtaccaatgtttacatggggttttgttctttcataatgttcttttgccattaatgaaacctcctgtgattttcgcaagaataacgtcgaggccaaaatggtctcaacaattctttagttagtattatactacatcctagtgaaaaggccaaatcgcgcacccatcactgagaatccttaaatattatatatagcctaatctgatttgtaaacagatattattcaaaaaattgaatttttgttagtaaattcttattacacacgcttatgattgtaaatcaaggctaaattgctgaattttttgctgaattttcatcattttttcagtttggtcatcagacggcgttatcgtctgcccagtttgcaaactaatcaaaagatcgatccaagccgtggaatctgtaataacctgtgcagcgcatggatataaatacattaattgcaattgtaaaagttctcgtaagctttcatataaaaagacatcttgattaccaagtcgcactttcaaagcatggtaaacggccttgctcgtctcgtcctgaccgagtgcgactaactttgctggacacagtgtcaacatcttctcatccagtagccactgcatcttgaccgtctctgatacttgcaattggtacagtgtatataacacttctactcgtgttaagggatgcaaaaacggatctactaatagaaacttggctgccgtcagatagcgctcatatggcaggtgacgggctgcttgcaaacctgccacctgtttctggacgggctggtcagataaatgataaaaatgacgcattgttgtggtcaatgtcgatcctagcgttcgctcagccgtactctccgccgcttttaaagttgtgtttgcagccgtagtccacgcactcgttgggcgtgccttgatcataatgtgggcagaaatgaagtcatgattagcaaccaatgcattcagatacagatctgcggccgcatcggttgctaaatactgcgcttcaaactcactggcataattagctgctgccacatattgttgatcagccaccaacgcttggaccaattcgtaattaactggtgccgtttgctgtgcctgatacacttgctcccacaaactagccgccttggaccaatcctgagctcgactggcttgttcggcggccaattgtgtttcagctattgtcattgaaccttcctcctcttcattgtaaccaaaaaagtcggaagtagcttccgacttttttaatactaagctttagattcagtctcgactggtttggctggtttagccttctttgtacgccgatgatgctgattaacttccataataaccggtaaaataactgggtgccgcttggtctggtcccataaataatggttcaacttctcacggacagcctgttttaaatggccccaatcaaactctttattatcgagattttcttgcaccgtcgttttgactaactcagcgctctcttgcatcaagtctttactagtcttgacgtagacgaagccccgtgaagtaatcttaggagtcgcaataatcttcttctttttgcgatcaatcgtgaccactgccacgaaaataccgtcttcagacaaaatcttgcggtcacgtaacacaatgtttccaatgtcaccgaccccgatgccatcgatcatcgtatcgccgacttcgattgaaccggccaagtgcatggtatcaccgtcataacgtaactggtcacccttggctgcgatcaggacatggtcgtccggaattccaacttcacgtgcaaagtccgcatgagcatccaacagacgatactccccttgaatcggaatgaaatattggggcttcatcatgttgatcatcatttgcaagtcacgtttagcggcatggccggaggaattcatttcatcagcaatcgccttaacgtccgcatcagcacgataaatcatatcacgggtcttggcaaccacggtttccatcgaatgtgacggtgtggtagtaataaataccagatcacccttttcgatattgaccttgctctcctgcttattagccatccgttgtaaggccttaataggttcgcccattcggcccgtttgtaaaatcacgatttgttcaggtttaagtttatcaatggctttaagtggtacgacaacgtcttcaggcatgtgtaacttgcctaaatcgattgcggtcttcacgatactctcaacgtcaccaggcattaaagcgactttccgattagactttgcagcggcatctaaaacttgctgaatacgcaagatattggatgcaactgaagcgacaatgatccgtcctggatgatatttaaacgtttctaaaacataggccgcaatttcacgttcactgaccggctgttcataattttctgcattagctgaatcactaagtaacgccaagacgccttttgatccaatctccgccaaccgcgcaaaatcagtctgatagtcgcctgcggccgtcggatcaaacttaaagtcaccggtataaacgacctcaccggcactggtttgcaacacgattcccattgaatctggaatcgaatgggtcgtgcggaaaaacgaaaccgtgaccgtgccaaaatcaatttctgtcttctcattaatgatgtggaagtcattaaagtttttagctttagggtccttttgcaattgaatttttgccaactcaatggttagctctgaaccaaacacgggaacgttgaactcattcaaaaagtacggtaacgcaccaatggcatcagcgtggccgtgggtcaaaaagacaccgacgattcgatcagcattttctcgcaaataactgaagtccggaatcacgatatcaattcctaataactcattttctgggtactttaacccacaatctaaaatataaatatcaccatcgacttcgacagcatacatgtttttgccgttctcacggaccccaccaaatggggtaatttgaatttcactactcaattatttcaccttgattcttctaaatgtttaatgttttaaaaagctgagccgtttgttcagtactcaatggtaagattggtaaccgtggttcacccaccggctgacccaaatgatttaaggccgctttaactggcgatggcgatggtgcactaaacaaggcactcatcttgggtgttaagtcccgttgatacttagcggccgtggcaatctcaccctggtcgatggcactaaacatcgccgtcatttcgtcaccatagatatgacttgccactgagataaccccagcaccaccaatttccttggcagccaaactctgagaatcttcaccagtataaacaagaaaatcagccggtgcattttcgacaatcgcgccaaactcttccatcgtcgcacactgcttaatcccaataatattgggattttgtgctaatgttaagatcgtggccacggtcatcttcacaataacccggcccggaatattataaataataactggtaagccaccttgatcagcaaccgctgtaaagtgggcaatcataccagcttgatcaggcttgttgtagtagggaaccaccactaaagctgcatcaatccccttaatctgactaaccttcttagtaaatgcgatggtagcagcggtactgtttgagccggtcccggccacgattggtacccgaccatcgacaatctcagctgctttctttagtaaggttaatttttcatcttcggttagcgttggtgcttcaccagttgtcccacccaccagaataccttgggtgccgtgtgccaataaatgttcaatcaaacttgctaaccgcttttcgtccaattgttggtgatcatcgaaaggggtcaccattgcggtcatcaaatcaacgtttgcaaagttcatgatctaaaaactcctctattaaaatttacaagtaccagcgtacctgttccgattaagtaactctccccagtttaccacattttaaagtaaagcaatagttagaccattcaatgcaatctaatgtggtcgttgctgactaaaatacgcgacccacagcatcaatgccatcagctgtaatccagccgtaacaataaagattgactgatacccccaccaattggcaacaatcacggctaacccggggccgaccacgttaccacaagcttgcgcggactgatttaaactaaacacacgcccaaacgctgcgtgtgggacatgctcgactgtcatcacttgaagcgcgggcaatagtgccgcatccgcaattcccagtattagccgtagcccgaccagccacgtgacctgatgtaccaaactagtcaacaataagtcaacaatcgctaaaatcaaaaaagtaactaagcaacggccagcgcccagccgatccagaatgcgcccaacacgaccagccattagaatcgtggcaagtcccggcgcagccgccacaatccccgtcatcaagataatcgtctgcgccgttgcttggggcgctaactgtccgaccagcaagcttaacagtggtgttatcgcattggtcgtcgcctgaacaactagtaacgatgtcagcaaggcacaaataaagcgaccacccaattgatgtaagattggtcgcaatggtggtaacgtggcgcgactaactgccgtcaccttctcttgaacaccccaccaggtcatgacaaagacaagcgccatcaaactactggtagccacgaacgccccccgatagccaacggtattagccagaaagcttcccaaaagtggccccatcaatgtgccactgatgctaccagtgaccagtttacttaaccactggccacgttgttccgcaggtacggtaatcgaaatcagtgcgttagcattattgatgtaacctgaaaacgctccctgtgcggctcgtaaaatcaagaggacgatcacgttaggtgctagtcccacaccgagaatcgttaaggtcatcatgccagatgcgcgtagacacatcagcttacgccccttttgatccgccaatcggccccacaatggtgcgactaaagctttgcaggcgtatgtcacggcaaacgccgctgcccctagaaaattcaactgggtcgttgaataatcgcctaatgtctgaatatacagcacaataaacggtaacgtcattgcgttacctaaatcagtgattaaactgccaaaccataagacccgaaagttacgagtcaacgttgccattgcttccatgaaatcccctcattcacttttgaataaacataagtatagcgaacggttgtttgggtttaataaagtttatgtatcgtttctgtaattttttacacaaaaaaagaaccacccgcaggcagttctcgtaatctcaatattaacgacgaagaccaagactttggattaagtcacggtaacggttaacgtcttctttacgaaggtaagctaacaagttacgacggtgaccaattttcttcatcaacccacgttgtgaatgaaaatccttcttgtgaactcgtaaatgttcgtttaattcgttgatgtcttccgttaaaactgcaacttggacttcaacagaaccagtatcgccttcgtgacgagcatacttgttaataagctccgtcttcttttcgcgtgaaattgccatgtgtttcaaccacctttccaataattgccctaaactgagtaaatcgttggtggtgcacgaaaaactaagtaaagggttgctgaacacttgatatagtctagcaaactaaggagtaaaaagcaagtttcaatacatatcaagataaattactttacacataacggttgcattcaagccggggcttatgtataatagcatttgttgaaaaaatgatggaggtgaatctgatgccaattatcaaatccgctattgaacgcgtgaaaacaaacaataaagcaaacgtccgtaacaccgcccaaatgagtgcgatgcggactgctgttaaaaaatttgaagctgctaaaactgctggtgccgacaacgtcgacgatttatacttagcagcaactagcgccgttgacaaggctgcttctaaaggtcttatcaagcgcaacaaagctgcccgtgacaagtcacggatggctgcacgttacgctaaataagctaattttacgcccgagcattgcgacggcgtttttttatcgcctttaatgactcaaaagatggtcgaccgaattctgagaattccggtcgaccatctttttttggggctccatatctaagcactattacttttgccttcgtgaatagtcgttctcgcttgtccaacaagccaatgcctaacgggacagccgcgttccgaccgctgcctgtcgctcattaacaaattgaaccataaataactcaaagagcaactccgggtcgcgttgtgtcgttttcatttgtacttctgtttggagcagtcctaagtacgccgcccgtaacgcagcttgatcaaaatggcggaccgtttgcatggctagtttgacccgatatgggtgcactttaagcgtgctagctaggctgccctgactatagcctgcacgcgccataattttgacctgtagcaacaatcggaattgtcctaataagattgcattgatctttagtggggcttcctgagctgccaccagttcatggtaaagttcgaccgctgactgcgtctgataacgaagtacatcgttgaccaaatcaaaaacattttgcgtcagtgatttagtcaccaaagcctgaactgccgctaaatcaattcgttgggattgggctgcgtaaatcatcaacttcggtaattgtcccataatcagtcccaactgcccgtcagttcgattaaccagttcctgtagtgcgtccgcatcaatgcgaatctgtttctcatctaacgccgcttgcacatagcgttgcgtttcagcctccgagacttggttgacttcaaccgtcgtcgcctgtttttttaacgttttaacgagctttttacgcgcatctaatttctcatagggtgccataaacaccagaatcgtacttggttcaggttgttcaaaatagtgctgtagtgaggccagatcatggtcaaccttggtcttcttattttcacccgtcaaaaagtacgggtgattaataaagactaatcgccgttcaccaaaaaacggtgccgacattgcatcatctaaagctacagctactggcgtcgtttccatatcataactgccgacgttcatcgtttgttcttcactgggaatttgctgcgtaaaagcctgtttgagctgatcggccaaatagtcgaccgttcccaagataacatagatcgatgccaagtcaccgttgcgaatcgattttaacgcctgttgtgcgttgatggcgatcaccttcctttaaaaatgtttgccaacgtccctggcgatgattaacgaaacgataggttatcatcccctgcaaagccgttgaataagtgacaatatgctgttcagctagagttattagtgtttcttgattcggatgcccatagcgattgtgccgacccaccgataaaataccgtggtgcacacctaattggcgcaaagctaacggatccgaggctgttttactgccatgatgccctagctttaaaacgtccacgcgtaattgtggatatcgggcaacgattgcacgctcccccgctcggtcaagatcacccgtaaacatgaaacgttgctgaccaaaaacccccgttagcaccaacgaatcttcattttcagcccgtcccggtttaaacggatgcaccgcaaccaatccatctgcaaacgtatggccggccaatgcttcaaccactttaggccgctttctggcgggcactagaagcttttgaaacttggctaggcgcgccattccggcaggtaccaccacttgattgaccggcatcaagcgtaatagttcacccaaatcaccaatatggtcaacatccttgtgtgataaataaactgtatccaagtgagtgatccctagccggtgcaaataattgaccgtaatcgtttccgcacgcgatcgcggttgtacctgctctgcctgccaacgtggccgggaaaagtgtagttgccccccagtatcgatcaaactcacttggcggttaaatggttggcgaatcaagatcgaatcgccctgaccgacatcgataaattgaacggcaccgtgaagtggaaaacgtagactaagactaaaacaagcatatgccagtaacagtccccagtaataccgacgccgcggtgtccgtaacaaccacaaactcaatagactgagcgtccatgcccacagtgtactcggttgaccgataatgagtaggcctggccaatggctgacccactcaagccaattctgaaaattaaccaacacccattcacacacgctggtgacattggtagaaccaaagccaatgctcgcccccacgaccgtcaccggtaataatacccaactaaaaataggcgcaaccaccaaattgactgctaaggaccacagatgccactgcgccgtagctacaagcaaaaccggtaaactgataacctgaatccaaattgctaatcgccacggcggcaaaccaggcattaagatcagcagcaaggctagtccataactgagctgaccacctaattggctcaataccaaaggattatgggcaatccccattataagggcaaggctccaaccacccaacgccccacttgactgatgtgttagcaactgccaaataattggtaaagccgcggttacaactgcccgccgcaagctatcggcaccgccgcccaagacaaggtatgctggcaagagccctaataaccaaatatcgattgcttgctgacttagatgcagtcgtaacaagacccattgcaagaatttaactaataaaataacatgcatacccgacaaactgaacaaatgcaatagtcccagctgttgaacggcccccattgtcgtctgaaaatctgtggggcgtatcccaaccagtagactcgtcgcataacgactaagcgttggtggcaatctttgacaggctagaaagaattgctgacgccattggtgtaatcgatcaagtagccccagccaaccacgccgcgacgcaatttctattcgttgaaccgctgtgaccgttacttggcgggcgatgccttgactgcgataatacctaggcgcattaaactgccccgggttggtaggaggtgcgatggcggcgacttccccctgaacgtgccagatcgtccggtgagtaaactgggtcagatactgtttttcagtggcacttttcagctgtcctctaacaagtactttgcccattggactagtggcaatcagctgatactgaccaccgcgcaccgtaatcgcatcgggttggacagccaaatggcttgtgaccacctgactgggccgctgaacaatggaggcgaaacggtggttttgccagttcagccagattgccaaagataaaacacagccaatcgtcaccatcaaacactgtcgatctcgtaatcggatgactcgcaataaccaaattaataataatccggctgccagccattgttggtcaactaaccaactactaagtaagccgcacgcaatggcagcaaaaaatagtgcacgcaattagtcacgatctaacaagatttgatcaagattcagcttatccaaatctgattggtcgaactgaacttgttgtaaagccacgtgttttcgttcaattaaggacatggcatacgcatcgttatgataattacgtaaataatgaattttttgaattccagcttgtaataacattttcgtgcattgtaaacatggaaagtcagtgacatagatttcagcaccatccgtagctgcaccgaatttcgcacactgcaaaatcgcattcatttccgcgtgaatagtgcgaacacagtgcccatcaacaaggtaacacccctcatcgatacaatgaacatcgccggatactgaaccattgtaaccacccgcaataatgcgtttgtcgcgaacaatcgtggcaccaaccgaaagccgctcacacgtgcttcgactcgccaataagaccgcctgcatcataaaatactgatcccatggaattcgttgatctttcatcattttatgcctcactttcaatgacagtagtataccaaaatgtgcgctttgaaactagacggtgagctggtctttgtatttggccacagtcttttctccaaagccgctgacgtttttcaaatcatcaattgttttaaaattaccatgttgctggcgataatcaatgattttttcagccttcttctgcccgattccgctcaacgtttgcagcgcggccacatcagccgtgttgagattgatcttatccgttgccgcatgatcactagttggtgttccgccagtaggccccgttgactggacgactggtggcgcaacagccggggcctgttcgcccttagctggcacgtagatcacttgctgatcagtcactttggcagccaagttgatctgctgagcatctgcctgtggctgcatgccttgtgccagttggatgacatccgcgacccgcatactagcagtaacctgatacaaccctggtttattaaccgcacccttaatatcgacatacccgggtgaactagcacctgtcggtcgggctgggctcggtgtagcgttcgacggttgggtactcgttgcgggctggtcagcattggcagacgttcgactcgcgcctcccattgatgtggaattgaacgaatgcgccaacaagttatccgtaccggcgggttgaggctgcttaagttgactcagtgcccatcccgttatcaaaataatgatcacggcagtaacaccaccaacaatccgccagtgcattttgagcagcttaatccaatctatcatttgttttcaccccttcagcgaatagttacgcaaaaggagcggctacccatgaaaaaagtttgggttttaccccaaactttgctaacttgcatttcaattttactattggtgtgtctgcaaataatgaacggcctgtttaaatgaggtcactggaacaactttcatattaggcgcgtactttttcgcggtcgctttagcaagttgatagttagtttgacccttttcttcaaccgccaaaagcgctttggttggtttcacatacggtgcaaagaaaattgtcgcccctgcccgcttagcagcaatcactttcttgtcgataccaccaatttcaccaacttgtccattttgatcgatggtgccggtccccgcaatcttccgtccgtgtcgcaaattctgattagtcaattgctgatagatttgcaagctaaacatcaatccggccgagggacccccgatttgtccgggatcaaccttaaccggaatagtcgtcgtcactttaatattatcagttaggccgataccaatcccggcgcggtgcgtgctcagcttgattaggggcgcacttgcttgcttcaaatggccctttcgccgatacgtgatcgtcactcgatgtccgacgccctgcttaccaatataatgctgatacgcactggctgtattaaaatggtggccatcgactttcgtaatcgtatcgccaacttttaactggtttctaaatttcgaattagactgaaccgttaaaacgtagataccctgataaaccttgcggtattgctgatgcgcagccgaatacgccgtcgcgatagcttcgttgattgcacttcgcatataaaacttctgaacccgattataagtcgcgtcatcctgaccgccagtcatatcctgagcactgaccacgtcatagtgcggattcaattgtgcgtaaagccacatcagcggcgtcgctcgagcttctgcgaccgaggtcaacataaacttaccccggtgatgatccggatgccgcttgacggtcacaaaagtcttcaaattgtttgcacttccgggtccttcaatatagtacggtaaaggaattagaaatagtgcaagtaccaccagtatcacgaccagcaagccccagtaacgttttaacaactcccggcccttagtcatgctgatcagttcctaaccgctgatggagtttttgcgccaccgcggtcgggacgtacttggaaacgtccgctcccatcttggcaacttccttaattaagctggaagaaaagtaagcgtacgggggccgtgcaatcaagcaaatcgtttcgatcgtctcgtctaatgacttgttcatccaagcgatatcacgttcatacccgaaatcctgttcattccgcaaaccacgtaccaaaactgtcgcatggacactcgccataaagtcaacggtcaaaccagttgcggcctgaacttcaacgttgggtaaacccgtcagctcatcactgatcatcgcgactttttccgtcatcgtaaataacggttgcttactcgtattgaccatgacggccacaatcaaccggtcaactaatcgactggcacgttgaatcatatccaagtggccccgtgtgattgggtcgaaactccccggaaaaactgctgtcaccataacttacccgacctccgttactttttggtaaatggtaatgaccgtaataccgtaatcttgttgtctgatcaattcaaatccgggtaagaccgttggcaagttcgcattcgtatccgtctcacaaatgacccggcaacccggattcagcaatcctagtgcatcacaatgctgaatatccttcacaatctgttgcttggcatagggtgggtctaaaaacacccaatcaaagtgttcatcttgggatgctaatcggtccaaaatacgctcagcatcgcctttgataacttcaaatcgttcgggggcctttgtaacggcaatgttatccttgatcgtcttgatggcttgatactgccgatcaatcaagacggcccgagccactccgcgtgatacagcttcgatactcaagccaccgctcccagcaaataagtctagggactgcccaccatcgaaataggggccaataatattaaaaacagcttctttaaccttgtccgtcgtcggccgagtttgcatgcctggcacggctttgagccgccgaccaccaaagtctcctgctacaattcgcatttcatcttcaccaacttaatcctcatcatcgtcatcaggcgcaccagtcgtggttggcttaaaaaagccttgatccacacgttcgccaaagttcattgcaacgtccgggcggtatgacggttcaaccctgcggacaaaatttaattttttgattttcgtggtcgcggccggaatttgactttcatccatgtacaagaccacataatgctctttacgcgattggtattgaattaatccaaaacgtttcaattgacgcacctgcttcatcgaatgcatataaacgatgagcgaccggcgcggtttaactgtaaaatccatcgaacctcacctcttctactagcgtttctgtttaaatgttaggctagattcagcatttcgtcaactaagttcttaactacgcagtggtttttattggcgaagcgctgaagctaaaaaacactagtaacctaagccactagtgtttttgcttgaaatatccttattgtggtgcaatctcgagcagtaagtcatccgtctgaatgacgtcacccgcattaacataaatatgttcgatgaccccatcttccggtgcctgaatggttgtctccatcttcattgcttccgtcacaagtaatggctcacctttcttaaccgtttggcccttcttaactaacagtttcagaactgaaccactcatcgttgcgccaacttcatcttcattagttggttccgccttgcgcgtgctggttgccgattggtgaatggcattgtccttgaccataatctcttgattttgaccattgatactaaagtaaagtgtccggacaccatcgacatcgggatcactaatctgattaagcttgacgatcatcgtcttacctttggctaactcaatattgaccgtctcaccgagccgcatgccttggaaaaaggtcggtgtgtctaacagtgatacgtgcccgtagcgcttatggctagcatcgtaatccatgaatactttcgggtacaggatgtagctgagcacttcctgatggctcgcttcatgaccaagcttagccgatagctctgctttgaccgcagcaaagtcagctggtttggctaaactaccgggccgcacagtcaacgctggctggcctttcaagacgatctgctggagcttctttggaaagcctccgactggttgaccaagattgccagcaaagaagttgatgaccgatgctgggaaatcgagcttggtaccctgattataaacatcgtccggtgtcaagtgattttccatcatgaacagggccatgtcaccaacaactttagagctgggcgtaactttgataatatcaccaaacatatcattgaccgtcgcatacatcgtcttaacttcttcccaacgatccccgagaccaacagccttagcttgttgctgcaagttagaatattgtccacccggcatctgcgtctgataaatatccgtttgggggccggtcataccattcgagaagtcttggtagtacggccgtacgccttgccaataccgattgatagcttcaacgttgttaatatcaacatcaggttgccgatcattgtgggctaatgcgtaatacaacgagctcattgatggttggctggtcgtgcctgatagcgcactcgcagcaacatcgaccacgtcaacaccagcttccactgctcgggcataggtaaagattccattaccagtcgtatcatgcgtatgcagatgaactggcacggacagcgcgtctttcaacgtcgatactaattcataggcggcctctggctttaacacacccgccatatccttgatggcaataatatcggcaccagttgattgcagatccaaggccagctgacgataataatcaagattgtatttttgccgatcagggttcataatgtcgcccgtataacagatcgtggcttccgcaatcttcccggtttccttgacggcctgaatactcttttccatttgaggaacccaattcaaactgtcaaaaatgcggaaaacatcaatgccactcttagctgcttctaagataaattcgcgaatcacattatctggatagttctggtaacccaccgcattggaaccacggaacaacatttggaagagtgtccggggcattgcctgccgaagtactttcagccgattccaggggttttcatttagaaaacgataggccacatcgaacgtcgcaccaccccacatctcataggagaataactgtggcaacgctttttgtgaagccgcggcaacggctaacatatccttcgtccgcatccgcgttgcaaataaactctgatgcgcatcccgcatggtcgtatctgttaataacacttgcttctgggctaacaaccactgttgtaatccctggacaccttgttgatccaacacgtcttttgccgtgacgatgtcgggtgcgatcggttgaaaatcatccttaaactcaacgtccggatagtacttcttcgaatgttgggcaacgtcagcgaaaccattgaccgtcacattcccaatatacttcaacatcttatcttcacgttgcgtatcgtcagggaatttgaagagcgttggggtctgatcaataaaccgggtccccgcttcacctgcttggaacgttgggttgtcaatcacattcagcataaacggaatgttcgtcttcacgccgcgaatatcgaactcaactaggacgcgtcgcattttatgaacggccgctttgaagttccgcgccgcaacacaagcctttacaagcagtgaatcaaaataaggcgttacgattgcgccggaataggtattaccagcatccaaacgaaccccattaccacctggtgaccggtacgtctcgatgcgaccagtatctggcataaaatcatttgcgggatcttccgtcgtaattcgacactgaattgccgcacccttatatgtcaatgcgtcttgatgtggtaaccgtaaatcctcgaataggtcaccacccatcgcaattttgagctgagcatggacaatatcgatttcggtaatcatttctgtcaccgtatgttcaacttgaacccgcggattaacttccatgaagtagaattggtccccttcaaccaagaattcaaccgttgcggcgtttaaatagtgtacactcttcatcaagtcgactgcggcgttacagatcttttgacgcaactcgattggcagggccacggccggtgcaaattcaatcactttttgattacggcgctgaacagaacagtcacgttcaaataaatgcatgacattgccgtgagcatccgctaaaatctggacttcaatgtgtttgggattcgctatgaatttttccaagtaaatctcgtcatcaccaaaggattgcatggcctctgaacgggcacggtcaaaagcttcttgtaattcagaagcttcatgaacgatgcgcattccccgaccaccaccacccatggcagctttgatcataattggataaccgtattgctgagtaaactgtaacgcctcgttcaggctagtaaccgggtgtaaggtgctcggaatcgtctgcacgccggcatcgcgagctacacgtttggccgtaatcttatcaccaaacatctcgaggtgctctggcttaggaccaacgaaggtcatgccttcttcagcaatccgccgagcaaaagtagcattttcagataaaaagccgtaacctgggtgaatcgcatccacatgattttctttagcaatgcgaataatatcttcaatatccaggtaagccgcaatcggcgccttaccctcacctactaagtacgcttcatcagctttaaaacggtgaactgaaaactcatcttctttggcgtaaatcgcaacagtctgaaggcctaattcgtggcaagcacgaatgacccgggtcgcaatttcaccacggttagcaattaatactttcttcaccaaaatccctcatttccaaataaaatcgtcttagcctgcctgtcgaactgtattaaggcgcgccattttttcaagtgcactaatgtttaataccaatcctagtgaaagcgtcaataccatcatgctagaaccaccataactcatgaatgggaaggtcaccccagtaatcggaatcagaccaacgatcccacccacattaataaatgcttgaatggtcatgtaggctgcgacaccgtaacagaccaacgcgttgaacgtattagtcgcacgaaccccgatatagatcgtgcgcatcacgatgacaagtagtaagcccattacgattaaaatgccaattagtccgagttcttcggcagtgattgacataataaaatcagtgttcggttcgggtaaataaccacgtttttgcaaactattcccaatcccaacgcctgtcaaaccaccgtttgagatggcatagtaagagttgactaactgtgtccccgctcctgaagccgttttaaacggattcaggaaaccgagaaaccgccgtaactgataagaatttgcaaaagcactttggggcatgcgactcactaaaggcactaaaatccattcaaaggcagcgaccgccccagcaaagacaccaacacctacaaagtatgaaatgccactcgcaaacaagataaccgccgcgatggctaaattaatcgtggccccaccaaggtcgggttgcacaaaaatcagtaaaatcatcgcgaacaacatcacaaactgagcacccaattcacggattcgagccaccccaaaatgtgcctcccgttgagaaataattgatgccaagtaaatgatcaggtaaaacttgcaaaattcagctggttggatcgagactggtcccaaaatgatccagccagccgccccattaattgattgaccaaccaatcggaggagaaccagaacaaataacatcgcaaaccctaacataccaagtaacttggtttgcttaaaatagtcgatcttcaaattcatacaaaccaaggtgatcactaagcctaagacgacccagatcagttgtttaactaaataaccggtgggtgtcgaaccgttttgtgcggctacgtatgaactcgatgaatagaccatgacaacaccgatcccgctgagaatcaaatacgggataaacagcacatagtccatatagtgtaactttttccacatgagcttaaatcccaccctaattaatatctcaattcggattatcccccacaataacgcgaactgtttgcttgcaacaattatagcataagtcgattttaacacagcattttcacatattaatttgttgttttttaatcaagtttggattactgatttacaaactagtgcgtttagcctcattagtaaccggctggccaacgcctccaaatcagtgtatttcccttaataaacgtacctagacaatttgaacaacccgcgccgttccggcacttgacgtcggaatgaatttgtcgcgcattgccacccataacgcgataagcgcccccgcaagagccaacaatcgacaacgtgaacgataaaatagccgtggtaagccctatttaggacccaccacagctattttggattgctaaccgctcgttaacgatcgctttcgtgtcacgcactgggacgattgcacgctcactcggactcatctgccgcaatcgcggctcgcaacttacgctgataccaatccctaacacgccggacattcgcaactgcccgttcaaatgagaatgcgcccagtaatagcaggcacggtaagtactgaattaggtaccgactccgaccaccttcgaacaagaggaggaagataaacccaccaatcatcgccaaccggagcaattgaatcaattgccagcgcgggccaaaacccaacgcgataatcacgagtagcactaaccaccacagttgcgccacaaaccgaaaatctgcaatatggcgaccgtataaataaataaagttttttaaccaattactaaagccctggttgcttggtttttgattttcgcgaaagaaattgccttccttcaaccagccaaaggtcccgtcagcagtattattgcgttgcttttttaccaagaattcaaggtaaccccacggtcccagtttcttgagctgacgcttcagcatcttgattgagtaagccgttttttgtgccttggtgggcaaaacggccatctgtatcgcctgcttttcactatacccgccggtgccgtaaacgcccatggccataaaatgaatcgccggaatcgaccttgatttatcgattttgatatacgtctggttctggatggcctgattcgtataatgataagtgaggccggcactttcgagcatcaagattgccatggcgaccgtcacaaaaatcatcatcgtttgtgaaccctgccgcgaccgcaagcgtgctaaaaagctgatgatggcaatggcgattaccggaataatggatgagggtttcatgaagtacgttaatgtcacactcacgccaaacccgacggcggcggccacacgcagtaacggcggtcgcttcgtttgactcatcacaaaatagcacagcatgaaaaacgaaaccagcggcagtccccaagcatccgtatacggcataataatacttggaaaaaccgccaaccaaccggcgtgcagatacatagcgattcctaacgccgagcgtcgtaccacaaatacgctcattaaattgaaagctgctgaaagatcgacaaaaaacagcgtcacgtaatcaaaaaattgccacgaagtttgaccagtcacttccgatagccagtgcataaaaagcatgattggcatgttgttttgattaagactgtaatacgccgccacgcccacctcctggacgtgtttcgcactggtagccgcatagtggagcatcccagcgtcaaagccactgacgggatggacaaatgtcacgaatacgagctgaccaataaaaacaagtgctaacaagacaccagccgtccggagctgatttgtgattagtagtcgatatagcacccgatgaacgcgcggatacgcatagttcataatcaacacggcgacaatcataataatcaacccccgtcgtcaataaggtcgtactcgtcccaaacgtcgcgttatcccctaaaataatattcggcgacattactgcaaataacaacattggtgcaaatagtaaccaccaaacgctcgtaatcatcttctgactaaattgataaaaataacgtctcatcattaatctacttcgtttgaattcttgcacctgaactaaacaatcaagatattccgctaacttcgcgtgatatcttgtagtcagccaacacgtgccgcttcaactcattttcctttccggcgtcgatagtgattgtggattgtacgcctatcatcacgtaagacggccaacaaccgttgccattcttcggtgaacccccgcattttccaagttgcctgggtcgtcatcgcattgataacaccaatcaatcgaatccaagctgtcaaaaacatataaagtggcagcgttaatgttagccaccataaatgcttgtagaaatggcgttcttcaggatacggctttaataaaataccaacactaataaagttaataacccctaccatgacgtataaactatagatcaagagatatgagagccccacgaccacagttgaatagccaaaagcaatcaaaacaatcgtcgcaaaagtccaaatcattcgtggaaacgtaaacgtgtgatcaatcataattcgccgcaccaaaaattctttgaaaaagcccttgatgctagctgtttgtgacatataatgttgtgcaacttccagttcaccacgttgccagcgctggcgttgcgtatataactcggaaaagcctgaaattggcgccacataaaaaatagcatctgcacaaataacgacctttttgcctaaacgtgtccgaatctgaaacgtcatgtccgtgtcctcaccgattgtatcggtgtcatacaagaaagtttccattaacacttcccgtcgaaatgccgagaaagctcctgacatggtaaacagctggtcacggaacgactcctcttcaaaccgctttggcggatacagccttaggcatgccagtaccaaaaaagcacgccctattaaggacgtgcttccaagcaatcaacttacttgttcattttacgctttttagcttctttttcacgggagttcgtgttcaaaatgcgtttccgcaagcgaacatgatctggcgtaatttcacagaattcatcactattcaagaattcaagcgattcttctaatgtcaaatgcgttggtgtcttgattgtcgccgtcaaatccttgttagaagaacgcacgttggtcatgttcttacccttagtaatgttaactgaaatgtcattttcgcggctattttggcccacgatcatgccttcatatacttcggtacctggatcaacaaaaatcgttccccggtcttcgattcccattgtggcgtatgtcgtggtcttaccctggttgattgaaaccaaagcaccgttacggcggcctgggttccagttaggaataactgggaggtattcagagaaagtatggttcatgattccgtaaccacgtgtcaatgaaaggaattcagttgaataaccgatcaagcctcgtgaaggtgctaagaaagtcaaccgggtttggttattaccagtactttccatgttcttcatttcagccttacgctttgataaggtatcaataattgaaccagtatattcgtctggcgtatcgatttgaacagattcaaatggttcgcaacgcttaccatcaatttcgcgatagataacttctggacgagatgcttgtagttcataaccttcacgccgtaacgtttcgattaagattgacaaatgcaattccccacgaccagaaacgacccatgaaccaggttcgtcagtatcatcaacccgaagtgaaacatcggtttcaagttcagccttcaaccgcatttcaagttgacgggcagttacgaacttaccttccttacccgcaaatggtgaggagttcgtaccgaaagtcatttgtaaagttggttcgtcaatccgtaagattggcaaagcttcaggattagctgaatcagcaaccgtttcaccaacgttgatatcttccatcccagaaacagcaactaagtcaccggcgtgggcttcattgatttccaaacgttgaagaccaaagaacccaaacaacttagttacgcggaaatttttcttactaccatcgagtttcatgacagaaacactgtcaccaaccttgatcgtaccacggaagacccgaccgataccaacccgaccaacataatcgttgtagtctaataaggccacttggaattgtaaaggttcgtcagagttgtcaattggtgatgggatcgtcttgatgatcgtatcgaagattggttgcatcgtatgttcctgcttagcaggatctgattcataactagaagtcccatttaaagctgaaacatagaccactgggaagtctaattgtgattcgtcagcacctaattcgatgaagaggtctaacacttcgtcaacgacctcttcaggacgtgcaccggggcggtcgattttgttaataacaacgattggtgttaggtgttgttccaaagcttttttcaaaacaaaccgagtttgaggcatcgttccttcaaacgcatcaacaacgagtaataccccgtcaaccatgcgcatgattcgttcaacttcaccaccgaagtcagcatgtcctggtgtatctagaatgttaatttgtttgtcgccgtaacgtacggccgtgtttttcgaaaggatcgtgataccgcgttccttttcaatggcattagtgtccatcgcccgatcgtcaatctggacatgttcgtcaagggtatccgattgtttaagcatttcgttaaccaacgtcgttttaccgtggtcaacgtgggcaataatggcaatgttgcggatatcatctctaaatttcaaaattgatcttcctttcatccttcaaaattctgactatcttcgacagcagaaatcttacatatattaatacaatccgccgttactatcaagtcatagcttcaacttgaaaccttcataacgacgttttcagcggctttcatccattgacataaaaaaactgtgacatatgggtcacagtcccactacttactagacgattgccaaaattgagcgttgtgcgcgctttgtcgctatcagtacagcacccgatgataacatattaaccgggttgccgtcaactctagacacaaccaagccaaggcttcccgcgagaacgcgaccagccgcaaaatcccatggtcgcaagtatgacaggtagccgaccagttcgcccgctaagacctggctaatttgaataccagcactacccataatccgtggtcccagtgatttggcaataatcgtctgcatattgaagcggtcttgaattagtaacggcgcactcgcaccaaacagccccgcactcagatcaacatccgcgggtgcagccagcaattcaccgttaagcgtgacgccgacttcaggaccaccagcatataatttattcgccatgacatcaaagatatatcccagtgttggtttaccgtcaacatacaagcccaccatcatcgcaaaatgattacgctgatgcacaaaattcatggtaccgtcgattgggtcaacgatccagacgtgaccattcatatcagtaacttggtcgccggttccttcctcagctaaaatcttcgcaactggatccaaggctcgaatctgacgcaccaaaaaatcttcattgctatgatccacgttagtgaccaaatcacgccgactcgtcttctccgcaaccgtcaagtgggtgcccatcttcgccaacacttgcgctctcgcagtttgcatcacgacttgcattttctgatttaactgtttcaccacattcgtttgcacgttaagtcacctagtctcggtattgaaatcgctgcttgttagtttcctgagctgcgcgcattgtttgataaatccgataacctgaagcagcctcataatcacgagccagtcgtttttcttccgacttagccggaacgaccgtcttaaaatcacgataggctgccaacaagtctgctgtagcgattgttccttcattagcggcctcgatggcttgataaaaggtcgtaaccttaatgatctcggccgtggtccacgtctcatccagtggatattggtaattatcattgtgtttagacatcttcatccaactcccccgccgtgacccggtcaagttcctcttgaacctggctcgcaatctcagcgtattctttctgctcttcatcagatagcaccatatccgccattcgtttgattccgttagcactaatcagtaccggtgatgataatccaaccagctggtcgtcatcgactggtgtttggatatttgtgacggtaccgataaacggtgtctgggcgtaaaacgcattgagcacttgtactaatgctaacacactcaaggtctgattagtaacaatcgtggggtcgtcgatctgctccgtcgctgcactcatttcgtccatcccaaaactaatatcctggttagccaaataagtcatcacgggcgccggcccaatatatgaacgactccatgagatcaggtgtgtcgccgcagttcccactacgaatgcgcggacatccgccgggccgacacttaattgctgacgtagtagttgctccaataaacgactctgcggcaaagtacccaatccgaccactttagaatgatcaatgccactgaaacgcgcagctaagacacttaaaaccgcatcattgctaccagccaaaataatttttccgttaaaaccagcgcccatcgcatcattcacaaacgcgcgaaatagcggcaaagtcgcctttaaatcaccactggcatcacggtcgcttgccaatggcactaaatttccaataatcaagctatctgcttgcgaataatccggcttagcttgcgccactagtgtaaactgacgacaagttaaactcgctgttaccagtgcttggtagcgcggcgcttcttcagcacccgttgcgaccactaatttcactggcaaatctttggcaattgcgactaatattaattgttgtacgaactcgaataatccccgaataattactgtattaatcatttcaatccctccaaccttcgataataattgtacctgagctgtcaatgaattcaagtaaatgttaataaaaagcttactcttttgtaacatttttgcgtaaccaattggtccacttccccccgaagcaaacacattttgatatgttattaatatagaccactacatgctaaaaagttagcaatttgaataacaacatccgcatcaggttcaaaggcgtcacttacggatcagctgagtaatgattaacaagactgaccttcattgcgcctgacagcgcgttaagttacgtttttacgtgactatcttgactggtacttcggtaatccatactggctgcaacatcctatgtaaaataaaagtttgagactcacgcctcaaacttttattaagccatcatccgctttagatgtgcgttgggtaacccatcgcttcatccgccgcttcttgaactacttcacctagggtcgggtgtggatgaatcgtcaaagcaaggtcttcgacattcatcccaccattgaccgcaacgcttaattcagaaatcaaatcactggcacctggtccggcaatttgggcgccgacaatggtgccttcgtccttcgtactgacaagacggaagaagccgtccatggcgttcaacgagattgcacgaccattaccagcaaatggaaacttcgacgtcttcacctgcaagccggcttcttcagcttcagccttcgtcatgccaactgttgccaattctggatcagtaaagcaaactgccggaattgaaacgtagtcgttcgccgtcttcttgccactgattgcaccagcagcaactttggcttcagcaaaagctttgtgtgccagcgcagcaccggcgacaatatctccgattgcgaaaatatcctcagcggccgtccgcccctgttcatcaacttcgatcaagccgcgcttcgttaacttgacgtcagtgtattccaagcccatgtcgtcagtattaggccgccgaccaaccgtgaccataacatagtcagcatgaatctcagtttctttcccgtcgacagcgtaggtaaccgtaacgccactatcatcttgttcggagtttttagccatcgcattagtaatgacatcaacccccttcttcttaaagctgttcaagacaagcttgaccatatctttttcgaagttaggtaagatttgcggtgtcccttcaagaatcgtcacgtgagcaccgaggttggcataggcaccagccaactcagaaccaatgtacccaccaccgataaccactaattctttaggcacttcgggcaaattcaagccacccgtcgagtcaacgacccgaccactgaacttgaagcccggaatttcaactggccgtgaaccagttgcgatgatcaaatgtttgaatttataagtctgaccagtatggtcaccattcatcacccgtaaggtatgattatcatgcatataggcttccccacggaccacttccaccttatgcttcttgagcagcatttcaacgccaccagtcaaccgatcaacaacttgatggtctttccagtcctgggtcactttaaaatccaacaccggatcctgaatatttttaataccaaagatcttactgtccttggcttcttgtagccgatgaccagcactgatcaaagcttttgatggaatacaaccaacgttaaggcagacaccaccgatatattccttttccaccacggtgactttttggccgagttccgcggcccgaatcgcagcgacgtaacccccagggcccgtgccgatgatcattgtatcgcgttcttcagcaaaatctcctacaaccattctgacctcatccttccatcaaaagtaattctggatcatgtaaaaattgcttcaataagttcattgcccgttgtgctgttgcaccatcaatcagacggtgatcaaaactcaaggacaacttctgcatcttaccaacaacgatttcaccatcgtcattgacgtaaggttccttaccgatacgcccaacacctaaaatggcaacttccggttggttgataactggggtaaaccagccgccaccaattgagccaatattactaatagtaatagacccaccactcatttcactggcctttaacttgccatcgtaagctttttgcgtattgtcagtaatttctttggcaattgcaaacaagcccttaccttcagcgtgcttaatatttggcactaacaatccacggtcagtatcggtagctaccccaatattgaagtagtgtttgtaaacaatttccttgtttgcatcatcgatcgacgcgttcaattctgggaattgttgtaaaaccgcaaccaaagctttcacgaagtatggtaagaaggtaagatggatgtcgcgatccaaagcaacttgcttgtacttcttccggtgtgccatcaacgcactcacttcaacttcatcaaataaagtaacatgtggcgcggtgtgtttactgttcaccatagccttagagattgccttccgaattggcgtcatcttttcacgcgtctctaattcaggtgtgtcagaaacatatggtttaactggtgttggtgctggtgcttcacttgcagccggagccgttgtcgctggcgtagctgccggtttagcacccgttgccgctggcgcacccgtgtaattgtcaatatcttgctttgtgatctgaccatgggcaccagttggcgtaactaacgtgatgtcaatgtccttatcacgtgcgtactggcgcactgatggcattgtcaagacccgtttattaggattgcccgcagccggggttccagtcggttgtgctgatgttgcagcgggagtttcagctgcttcacttgccggggcttccgtcttagtagccgctggtgtttcagccttagccgctggcgcagcgtcgccagaaccatcgtcaatcgtgacgatcacatcaccaattttagccgtttcaccttctggaactaaaatatcaataactttaccacttactggcgatggtaattcttccaccgatttatcattttgaatttcaactagagaatcgtcttctttgacttcatcaccaggttttacgagccatgatgcaatttcgccttcttcaagaccttcaccaagctctggtaatttaaactcgtaagccattggataacttcctttcatgacagtctcaggtgactgtttttcgatgccgcgtcttgattaatagttcaagatttcgcgggtttttgcctcaatttcatcttcagctggtaaccaatcgtcttctgctaatccgaatgggtagaccgtatctggtgcgtacacccggccaactggggcactgagataaagcgcacctttttcagcaatcagtgaagcaacgttcgcagcaatcccagcctgtcgttgtgcttcttgaatcgcaacggcccgaccagtcttttgaacagacttgagaattgtttcttcatctaaaggtgacaaggtccgtaagtcaacaacttcaacggagattccttctttttcgagcttttccgcaaccttcagtgactggttaacttgtgcactgtaagcaatcaaggaaatatcagtaccttcacgaaccacgtttgctttatctaacggaacggtataagcttcatccggaatatccgccttcattgaccggtataacttcaagttttcaaggaagaaaactggatcgttattccgaatagaagaaattaatagccccttggcatcgtaaggattagatggcgtcacgacccgcaaaccaggaatttgagctaaatagccttctaatgagtccgcgtgcatttctggtgtatgcgttccaccaccatatggtgatcgaatggtaatcggcatatgccgagtgccacctgtccggaaacgttcccgtgacatttgaccagcaattgaatccaaagtttcaaaaatgaatccaaggaattgaatttcagggattggccggaaaccttccaatgccagcccaattgataaaccgccaataccggattctgctaaaggagtgtcaaaaacacgatcttcaccaaattcggcttgcaggccatcagttgcccggaagaccccaccgtttttaccaacatcttcaccaaaaactaaggtcttttcgtctgacccgagttctaatcgaagtgcatcggtgatcgcttgaatatacgttttctttgacatgttacttcgactcctttgcttggaattccgtaatttgttgttgaatgttttgtggttgttcctcaaaaacattccccaagaattcggtcattttttgctttggtgcttcatctgcttgtttaacagcagccttgatatcttctttaacttgttcaacgtattcgttttcttgatcttctgaccaaacaccttgatcagtcaagtacttacggtaacgaatcaatggatcattatcgaaccaaggttgttcttcgtccttagtccggtaacgcttaggatcatccccagcattcgtatgcgggccaaaccggtatgtcagcgtttcaatcatgacaggaccgttgccagcagcagcgtattcccgggcggcctttgttacttcataaacagctaggaagtccatcccatcgacctgaacacttggaataccggcagcaactgctttttgagccaacgtcttcgcagctgtttgcttgcgccgtggtactgaaatggcataaccattgttttgaacaatgaagacggccggtgcttcgaaggctccggcaaagttcataccttcatagaagtcaccttgcgaagtcccaccatcaccagtataagtgtaggcaactttgtcttcggtaccgttctttttaatccctaaagccacaccggcagcttgtacgtattgagcgccgataataatctgtggtggcattgcatggaagtcttctggatattcgttacccaagacatgaccacgagaccacaggaacgctttgtaaacaggtagtccgtgttgaatcaattgtggaatatcacgataagcaggcattaaaacgtcggttttcttcatcgcggcgttactccccatctcactggcttcttggccctcagtcggcgcatagaatcctaagcgtccttgccgtgtcaaagcgttagaacgttgatgtaacgtccgttcccataacattaatttaaagaattcaacgagttgttcgtttgaatatttagagacaatttctggtttaattactttagcttgaccatccaatacttgcacgggctcaaagtctttcccaagtgcatcgcggatcgcaccaaaatcaacaattggtttttcgttgtccataaatgacacatccctttcatgaacgtacaaacgttgtgcatcgcaccgcgttcgtaatcgttttcataattacaagtctaatttaccattgcgtttcatcttttgcaagcccttccaaagagcgaaaagccggctttttctgtccaaatgattgtgaactatttaatttgtgcttaattctgttttcatctttttcataacgggcgctactttttggcgtaggcttatgataaactagatattaagtgtaaactgcgcgatcttaattttggaggtaattggaattgattaaaatgcgcgacattatccgcgaaggtaatcacacgttacgcgcggaagcaaagcaagttaaatttccgttgagtgaagctgatcagaagttggccaatgacatgatggaatacttagaaaacagccagaatcccgaattggctaaaaaatacggactgcgtgccggtgttggtttagctgcaccgcaagtcgacgtttcggaacagatggctgctgtccttgttccgagtgaaaatgaagatgatgaaccggtctttaaagacgtcattatcaatcccgtgatcatcagtcactccgtccaacccggcgccttaactgaaggtgaaggttgtttatccgtcgaccgtgatattgctggctacgttattcgacacgatcggattacgttacgctactataatatggctggtgaagagaaaaagattcgtctcaagaattatccggccattgtttgtcaacatgaaattgatcatcttcatggtattttattctacgaccatatcaatggcgacaatccatttgccgctgatgatgatttagttctaatttcttaaagtcatttaaaaaagcagtcctgaaatgttcaggactgcttttttggtgcactcgaattcaaccgacgcaaatcttccaaatactctaaagtggcctcattcatcaaataggcaatatctaagtggagctgtccgctgcgcagccacgcatcagtcactcgtaacgctggtccagcttcccggaaagcaaccacctgattgtgaattgcgtacgcttgcaattcgttattgaataatcgccgaacttctggcaaatcggccgtgaccatgcctggtgcatctagcacgtactcaaaggccatcacaccacgcccccagacgtctgcgacgggcaccgaatgaatcgcccccgcaacctcttgaatcgtcatcgcatttgcgagcactttgaatgctgctaccatcgcactatcaaccgttcgttggccagcccgccgaatcttcaacgccgcacgcttcagcacttgccgtcgcagcaattcataaacgacgattgccattagtaccccaccaatgattgttaaccaactctgcatgctcaaccctcaattctttttttgtataatgattcacaattttaggaatttttcattttattacttatgtttagcatagcatgtttcatcaaaaaaaattcttttaaccgctctatttttgaagaaagttaacattgtatacacccatctcaaattatgctaaaatgtaagataattgttgtgtttacacaacctggtgtacggatcaaacttttatttttgctatctatttagattacttagtatctaaataaatcttgtttatattaaggagttttacgcatgatttacaaagtatattaccaagaaaccaaagaacggaacccacaacgggaaacgacccaatctttgtatctcgaagccgagaccgaagtagcggcacggaccttagtggaagataatacagatcacaacatcgaatttatcgaaccgttagaaggtaacttcttggattacgaacaaaaaaatccagagtatcacctaacggagttcaataaatgaaacggttaaacgtcaaaaataacgaaaccgctgtttttgcagtcggcggtttgggagaaattgggaaaaatacctatggtatccaatttcaagatgagattattctgattgatgccggaattaaattccctgaagatgaacttctcggaattgattacgttattccagactattcttatctagttgcaaatcagcaaaaaataaaagctttagtgattacgcacggtcatgaagatcatatcggtgggattccattcctattaaaacagatcaacgtgccaatctatgccggccccctagccttagccttgattaagggtaagttagaggaacacgggttattaaaaacaactgaattacacgagatcaatgaagatacggtgctcaagttccgtaagacgcgtgtctcgttcttcagaacgacccattcaattcctgatacactgggaatcgccgttcaaacaccacctggcacgattgtagagaccggagactataagttcgatctgacaccaattactaaccagccgccgaaccttcaaaagatggcgcatctcggtgaacgtggtgtcttggcgctaatgtcagacagtactaacgccgaacggccaatctggacgaagtctgaacggtgggtggcgcaatcaattcgccacatttttgaacaagttgaaggtcgaatcatctttgctacctttgcttctaacatctcgcggattcaagaggcagcgcaggtcgcccttgaacatcatcgtaaaatcgcggtatttgggcgtagtatggaagcagctatcgtcaacggacgtgaattaggctatttaaacatccctgacgaagccatcgttgatgctaacgatttacgctccctccccgccaataaagtcatgattctatgtactggttcccagggtgaaccaatggcggcgctctcgcgaattgccaacggtactcatcgccagatttctattgaacctggcgacaccgtgatcttttcaagttcaccgattcctggtaatacgttaagtgttaaccacgtaatcaacgaactcgaagaagccggtgcgaatgtcattcatggtaaagtcaataacattcatacatctggtcatggtggtcaggaagaacagaaactgatgctacggctgatgaaaccaaagttctttatgccgattcacggtgaatatcgaatgttgaagattcacaccgaactggccgaacaatgtggtgtgccactagaccatagttttatccttgaaaatggtgatgtgcttgcctttacgaaggattctgcccgggttgccggtcactttggtgctggcgatgtctatgttgatggttctggaatcggcgatattggtaacgttgtgttacgcgaccgccaagtgctttcggaagaaggtttggttgttgtcgttgctaccatcaatttgaacaaaaaagagatccaagctggtccagatattctgtcacgtggttttgtctacatgcgcgagtctggcgatctaattaacgaagcccggcggcatgtcttccgtacgatccggcgcaaaatgaagtcggataaagcaaccgaagcgactatccgcaatgcgattattgacgacctgcagagtttcttatttgataagactgaacggcacccaatgattctgccaatgttgattatgaactaactacttgccggaacgatctcgttccggttttttatggtgtaagactgatatgaggtgtaattttgattgctgaatactacattattattaatgaactggcaggatctggtcacggtaaggtcgtttgggaaaccgtcaagccgattctagaacaacgacagattcgatttgaatatcgaatttctgaatatgccggccacacaattcggctcgcaaatgagtacgttaaaaccattcaacgacgaccaaacgtgaccccggtcattctggtcattggtggtgatggcacactgaacgaggccttgaatggtattatgcaggtcccacaagctgaaccgatcccgctcgcctacattcctggaggttcgggcaacgactttgctcgcggtctgggtatggcgactgatccagcaattgcacttgcacaagtactcaacaatatgcggccccgttcgttaaatgttggttatttccatgaaaccttgaaaaacgaacaccagtatttcgtcaacaacgttggtttaggatttgacgctcaaatcgttgatgacacaaaccgtagcaaaaagaagggccgtctgggtcgttgggcttatctcagtaacatgctggccgcatattcccaacaggaaggcttcccgctaaccgtacacgttaaccggaagcgagactattataagcgggctttcctttgtacagtctcgaacattccatactttggtggcggagttaaaattctgcctcaggctaatctgcacgatgatcagctcgaattaatcgttgtcgaagagcctcactggtggattatcctctggttgttcgtcttactgctactgggtggccgtcatctcaagtcgcgtttcgttcaccattatcgcaacgctaacttgcacttattggttaactctgttgaaattggtcagatggatggtcaaattattgggaatcgtaactacgacctctacttgtccacccatccctacccattctggatcgacactagtatccatgaccaccactaactctactgctaaaacaatacaaattagcgataaaaagtcgttgcgaagatgctcgcaacgacttttttataggacccagattggcaattcatactacttgatcaccgtccacttaccggccagcaatgctaatgaccacttaattgactccccacccactcggctaataaaaaagactgctgaccatctcaatatggtcacacagtcagtcttgattaatcttagtcctcagaagcgttgattgcttccagaagcatgtcaagttgttcacatttacgagataagtgactcacccgttctttcaaatgcggataaatggtcacaacccgtgagcgatcctgttgccgaacggctagcgtccttaaatgatcgagttgggtattagcctcttgatattcttccagaatctcaaaacgattactcactgatagcacttccttatcacaatagatggtccaatttttcgaattgaaaaacgacaaacataatataccacaattattggtaagtttaaatcataaaattcaaaaaaatttaaataaaaatcgggtctatgatatttagtgttgatggataaaatccatcaacactatttttatgtacaacaaaaggacatatcgtcctgtgctacaatcaagtcgaccaaaaccaattgaaagcgagtgtcagatatgtcccaggaccattctactaaagtactgctccaaattaaagacccaaatattactgatttagttgttcaagaagctactaacggaagcttacaagtgcttgcaaagctaacgtatccggttactgtttgcgcacgttgtagcaaacgttccatggttaagaatggctttaagaccgttcacatcagaattcctagaattagcgaacgagtcaccatccttaacttaaagaagcagcgatttatctgtaaaaattgtggtaaaagtagtttaacaacgactacgctggttaaaaaacatcatcaaatatctgaaaacagtctgcatgccattgatctatcattaactgaagaccgtacgatggctagtattgcggctcaatacaatgtctcgaccaatacgattagtcgccgaataaagttactcggacaaggtacccaaccagctttcaacggactaccaacgatgctttgtatcgacgaatttcgttcaactggtaaacaaatgagttttattgcggtggatgcccaaacccacgacatcattacaattttaccaggacgtaagaatgccgatattaaagacttctttctcaatcattattctaaacgtcatcgtgaccgcgtaacccgggttgtgatggactttaattctcaatatcaacccgcgattcgaacactctttccacacgccaaactagtcgcagataactttcatcttgttcaaatggccttacgatctttgaatcaaactcgggtccaactcatgaaacgctttaaccctaagagtcgtgaataccgagtgcttaaatattattggcggttatatttaaaagattatgacagcctcgaaaagcgcaaacctcaatggtttgcgcatcttaaagatcgcatgacaccagagcaattagtcgtagccggtttaaatctagaccaacagtttcgacaaacctaccaagccgcacatgccttagttaaggcttttcaaaagcgtggttatcgatccttcaaagcagcactaggtcatgtcgaaaatgtcagtcctcagctaatgaccaatattaaaagctttatcaagaaccggcaactcatcaaaaatatgactaccggccgattatcaaatggtcccgtcgaaggtgtgaaccgtaaaatcaagcaaatcaaaagaaccgcgtatggttacaagaactggcaaaactttatttatcgaattcaaattgagttcaaaatcaaaatcgaaaaaaagaacccaattcgtaaatgaattggattctaaatataacttcatcaacaccggttgacagagaccctaaaaatacccctaacacttaacaatatcgtgttaggggtatttgcaattaaaatcggcttacttaaccgtacctgcaaaacttggcatgaagtaagaactgattgtctgaacttgaacgttttggccttcagttggagccgcaacgtattgattatttccaatatagatggcatcgtgataagtgctaccacgactaccccagaataaaatatctccaggttgagcatccgcaacggaatgcgtcgtcacataagattcctgtgcaaccgtactatgtggcaaggtaatcccagctgcatgttggtaaacataggaaactaaaccagaacaatccattcccgaaagactcgcaccaccccaaacataagggatgttggcactagccaacttcagcgcaaggccggttacagaaccagtagctaaatcactcgttgaactagtagtggtactgctactattagtcgttgcggtactacttgcggtattgcttgcactgctagtggctgctgaagaactactctgactggtcgtgcttgaactagtcgctgccgagctactctggctcgctgtactcgtagttgatgctgcactagcagctgtacttgatgcttgactagccgtgctagtagcagtcgtactgctagtactagttgcactcgcagttgaagcggtactttgactagtcgttgttgaactagcagctgatgaggacgcgctactcgttactgaggcactcgctgcaacactcttcgactgactggtagcagtcgaagaactagcactacttgctgatacggctgcactcgttgcgactgctttgaccggtgcatttgaggtcgtagccgttgatgaagcaacagagccggtcgatgatgatatcgttgacgtgctagtactgcttgctgagttcgcactgacagcatcctgacttgctgcactggtgctacttacaacgcttgcactcacacttgaaaccgaactcacacttgtacttgaggtggaactcgcactaacagccgtcgtggccttggcagtcgtactcgtagttgacgctgcactagtagctgacatggttgttttttgactcgtcttagcggtcgtcttggtcgttgctcctggcacttgaatgttctgacccaccacaattaaatcgccagaaagaccatttaacgtctggagagcgtgaacagaagtgttgtacttatcagcaagcgcccaaagagtgtcacccgctttaacggtatatgtacccttagtagcggctttcttagttgctgacttagtcgtggcggtcttagttgcggatccaccaatttgtaagttttgaccaacataaattaaatcgatattaccatcagatgctttaatctggttaagtttttcaatactctgcacggaaacaccgtgttgttgagcgaggccccaaactgtatcgtttgcttttacagtgattgaggcagcattggcagcttggcctgtagcaagcaataaaccaacggcaccaaccgtactggctaggaccttgcccgttgtatgtgcttgtgacatttaattcactccttagtttttgaactcaaattaacagtaacaaaatcgtcttgtgactgaagattaagaaattcttaacctgcttttacaaatcataattttattgtagcacaatttaccaaaatacaaactagaatcgctcgtttttttacaaaacagtccggttattttgaaaaacgtttgccaatgccaaagcggcgcatttggctgttatagcaacgtttatgcatataaacggaatgttatcttttgattacttcaagtaattagttgcactgtttggacgagttacgctattcagtaaaccaaccaaaaagaggctgtgacataagtctctagaaacaaagcaggtctggaaaaatcttcggatttttccagacctgcttttgatataatagaaaataaaaaaagagcatcggtcgcacccgatactctacgaactctagaattatcctcgaaaggacattcctaatatgcaagattattataacatgaatcaaaccactttgagtattgccttggattaccaaccagaagatcatcattctgctcgttacatcaaccagcttgttgagagtttaaaactaaatgattaccagtttggccgtccgcgggaatataacctcggtgccatgtaaaaactggtccttttagcgtacagctatggcattttcagcagtcgtaaaattgaacggtttgcccgtgaaaagccagctgggtggttaattgccgaccaaattccgtcctaccggacgatttgtcgctttagaatttctgatgaactggccactttgacaaccgatagcttatcacagctaacccaatatcttcgtcaaaatggcatgattgatgatgtttcatttattgatggaactaagatcctagccgacgccacaagtatagctttgttggaagaagaatacgatacgatttgacaagatgaatcgcgaaaaactcgtgacctgtaggcgagctctgaagctaaaattgtcggtgaaattccggcaggatcagagctgactcccgaacttggaatcatgattagcaaggttgaggatcacttagtggtccttaatgaaaccgtggaagcaactaagcggtttccccgaacccagccaaacagcaacgccggactgttaaatcacaaaacgtaagttggataaacgacgtgataaaatgcgtgaacaccaagccagcaacaatctatggtcagcgtaacagctactctaagacggatcacgatgccacctttatgcgggtcaggaagatccgatgcaaaacggtcaattaaaacctgcctacaacgttcaaatcgccacgagtaatcagttcattacgggatatcggcttttccaaaatccaaccgacacacgaaccttacaaccgtttattgaacatttaaaggccaacaatgtgttaggtcacaccatcgttaccgatgccggatacggttccgagtaattatcggtacttggaaaatgaattcggtcagcataccgttttgattccctacggcacaatgcttaaagagaatagtcgaaaatggcaaagtgatgaccgtaaggttatgaactgggactatcatgaaaagatgattattttatcaatccgcaaaacgtccggtttaattttaatgcttatcgtcgacggactgataagtatggttttacccgtgactttaaagatacattgccgaaaagtatgatgaaaatcatcaactaattgcccggcactaacaccaaaaggatatcttaaaggatttccgtgaacgaaaattgggatatttcaaatcgaaacaacgagaattactttcagctccagaaactggtcagatttagctcaacgtacgatgttgagccagtttttggcaagatgaaggcttctttacatttcaatcgattctcgtgcgaggtttcgacaaggtcaccaaggaagccggaatcgtaatacggcgttaaacattagaactggtcacggtagggaccaactttaaaaatcaaaggcgtaagcaaatgggacgagaaaccaaaattcggtttctcgtcccatttgcttatacagaggctagttatgtcacagcctcttaaagttgcgagctagatgcgaggatcaaacaaccgatcaactggttgctgttcatgtactaatttgattgcatcacccaataatggaccaaccgaaagttgcaccaacttatcaaagtgtttatccactgggatctgaatcgtatccgtcacgatgactttctcgaacttggaagcctgtaatttagccactgcatcctgtgaaaagattgcgtgagtcgcacagccgtatacggtcgctgctcccgcttgtgctaaagcatctgccgagacatcgaaccgggttcccgtatcaatcatatcatcgatcacaatggcgacgcgccctttcacatcaccaataatactacttggcactaggtcatcatcatctgggtgtcgattatcaataatcgcaattggggcccccaatagttctgccatcttacgtgcccgcgaaacaccggcatgatctggtgacacgacgacgagattatcggtaatgccgcgatctttaaaataacttgccaagagtggggccgcaaataaatgatcaaccggaatatcaaagaatccttgaatctgtgcggcgtgcagatcgaccgtcaagactcgactggcccggtccttttccaataacgttgcaattaattttgcagtaatgggctcacgtgaacgcgctttgcgatcttgacgtgagtacccgtaataaggaataaccacgttaatctgactggcactagcacgtcttaaggcatcgatcatgatcaataattctaatattgtatcattgaccggttccgaaatagattgaatgacgaaaacttccgccccacgaatactttcttcgatgttgatctgaatttcaccatcactaaaccgctttacggaacttttgccgagtggaattccgacccgctgcgcaattttttcggctaacggtaggttcgaattcagggcaaacagtttcagtttggcataagattgatctgttgacataacgacctccataaaagttgtttgatgattttgctactttgattatagcagtaaccacggctaaaaaccgcacacaagcaaattttcttgcataatgagcgtcgccgacaatgtgtcgttcaccgtaatttcagttgcaataaccaattaattatcaattagctacttgcggcatgaaattagctggcgtgataccattcatgccaatcatcggatcgattcggccagcgctgactagcgctggggtcaaaattgttggtccagcagactgggaactcggttcctgagttttttcagtggccgactcctcgtcagaagcaactttcttaaccgccgtcgctttttcgccgactggcattgcctctgcttggtcagtagtcgcaatagtggccgtttcatcggatacggtatccccgccaaagacttgttgtaaccgtttcgtcagtgtggtttggcgattaaccgattcattggtaacgctccgctcaaatgattgactatcacctaacaggatcagcatttgttcagcacgtgtcacggcagtatacagtagattgcgttgtagcatccgtgcaaattgtggtaccagtggcagaataaccattttaaactggctcccttgagacttgtggatcgacatactgtacgctaatgtcaatcgattccattcattgcgttgataagtcacttcattttgatcaaaggcaatcgtgatctggtctttcttcgattcattgtgagaatcatttgccagatcgataccgacgattttaccaatgtcgccattaaaaacattatcctcgggtgaattaacgaggtgcaggaccttatcaccgacccgaaaatcttgaccgttatacgttagatgcttctgatgggcactcttcaacggattaaagattttctgaaccgtggtattcagctgatcgatcccggcagtgccgcgatacatcggggccagaatttgtacctcctcagcactgaagcccttcgccttggcacgtgccacaacttgttcaacaatgtgattgacttgataagcgttgcaggcaataaatgagcgatccggttggttgacggcaaaatcggccggtaaatgaccatctttgatggcgtgggccaacggaataatactggaatcattgccctgccggtagattgtcgttaactcaatttggggcagttcactaaactgcaataaatcatgaaacacttgcccggctcctaccgatggcagttgatccttatcgccaacaagaatgacttgcatgtgacttggaatcgccgtcagtaactgctgaaacagtaccgtgtcaaccatcgacatttcgtcaataatcaggaggcccccatctaattccttactaggctcctcgggaccatcttcacgccccgtcaacccaagcaaccgatgaatagtactagctgggagcccagtcgtttcagccatccgcttggctgcccgtccagtcggtgccgccagcaggattggaaaaggcttatccttatactgattgatatctagtgcaacgtcgtgtaattccgcatagagcgcgactaagccacggataatggtcgttttaccagtccccggtcccccagttagtagaaaaacaggcgccgtaatcgccgcttttagtgcttcggtttgtgattcatcataagtaatgttgctagctcgaccgacatgctcgatagcatgatccacggcacgttcagacaatttttcatcattatcggcggctaacaaccgttgtaaatgttccgcaacgcgccactcggcttcatagagaccgcgcaagtagatacgattctcgtcacccacgattttattttccttcgccaagacgaccaactgatcagccagcttcgaaggatcaatttgaacattgcgagcattctcaagtagttgcaacgtttgattcagcaacggttgagccgtggtatacgtatcaccgttttccacgcacagctcattaatctcagtcaatagggccgcctttaaccggtcatccgcttggggatcaattttaagttgggccgcaatttgatccgcttttttgaacccgacgcctttgatatcctcaaccaaacagtacggattcgcttgaatcttagccaaagtgtcaccttgatagcgtgcatagatggccgcagctaaccgactcccaaaaccgtacgcattaagtccgatgatagtttgctccaaaccgttattgaccgtgagcgtgtcgatcaaagtcgtctgaacgctggcccgaagtccgattggttttaaaaccttcggatcagctaaaatttgatcaatggcgtcttcgcccaaagtatcgacgattcgctcagcagtccgcttacccaacccaggaaaatcactaccagatagataggcaatcaagcctgcgcgtgtcgtgggcgtttcattttgataattatccgcttgaaactgaaccccgtatttgggatgcgtgaccgttttaccggtaaaacgatacgttgtctcctcctgaatatccgcaaaatttccagtaacaacgatctcatcttccgaccaatcaatgttctgttcagttactttgactaataagactttataaaaactatcggcactgctaaaaaaaacggcagcgactttaccgacgataaagtgtgtgaccggttcccgaccaatatcgtcggaaaataaatgtgcttgttcgtccgtcacggaaatcctcctaaattagtgattttgattatctgcttgtgcggctaacattttttcaatatccgttagctgttgctgatgacttttaaaatattgactgtccaatttctgcgcgcgttcaaaccaggtggcatacggttttcccagtaccattgcggtcagtccaaggttaaaagcagctcgcccagattgcgaatcaatcttatatgcgcgttgatagtaatccgatgcttgctgattattgcctaatgcaagtaatatgtctgctactaacaaattagcgtcaagttgttgtggacgtgcctcttgagccgtaatggcccagaccagggcatgttggtaatcgtgttgggccattaaagcttgtgcactcattaaataagcatcctgttttagttgatcatccgtaatttgttgataatatggtaacgctttgtcataagtttgagcttgataatagacatttcccaacgcataacgcaggtagtcggctgcgggttgttgatggtcaaactttcccaacgccttcattgctaacgcctctgcctgttcaaaatcttgaccagccgttaataataccactagttcataataagcatggtagtcctcgggctgtgcatcaatcttgccaatgagttgatggactagtgcttgctgtttagctttgctaggacgtgatgtttttgccatccgaaccacttccttctatattaaatcgtatcagttgcatcgggccgccgtgataggtatgaggtgtcattccaatctaatagcttaaaatgttgaccacggtcacgcgtctctaaaattgttgttgacgtattcgacaagccaccccgttgccgtaacgtcgccagtgtcgctcccagtaatgagttgactaaggcattcaaggctgcaccatgactaacgatcaaaacattgtcatcgcgacgtggatttgcttgaacaatttgcttaatagcgggagtcatccgcttcagcagttgttgaaagctctccccctgaatcgctgtcgggtcatactgatccggatgatttcgaaacgcgtcgaattcggccggatacgtagcttcaacatccgtgaaggccattccttccatcttaccgagattgaactcccgtaaacgactcagtaccgttatgggtaactctgattgtgtcaaatcattacgtagtgtcatcgctgtatcacgcgcccgttttaacggactgacatagatatgactaaaccgaatatcctggagcgccgctgccaattcatgaatttcttgataactagtcggtaataatggtgaatctccctgagagccttgatagcgcccctcaagattccactctgttttcccatggcgaacaaataatagttttgtcaattgcttacttccttactctagtgtcttgatttgatcttattttcgagcaatggcccctccaaactgaataacggttgcgatgatttagcagtatcattgcaactcatcgtcaatcgccgttaggccaaccctgttaatacttcaaatgacgtggcggatggtcgtgatacttcgtcacgctcgcaacacgtcttacgttctatattatgacagttttcagactgattttcaaaatctgttcacgaattttaacgatcatcacgctattatttgataaacgcgatcagttgaccgggcatggtatcttttagccactaagtatgcaactgctacgccatactgccaatggctgttattcaccgtactactcagccgtaagagtaaatcgtcgtttttccaatctacttaataaaaatataattatgtaaactaaatcagccgaaccaagttcaactccagcattaccctgctttaacaaaaaagtggtaagtagctttgaaacactacttaccaccactaattattatgcagcgggcacaatcgccaaggtccaagtaataatgctttgatactcaccaggcgttgccaatggtgttgctggtaactgtaatgaactaggtgccacatcaaaagtttgactctgatgaccagtttgccggtaaacgctggttgtcgaaccatccgttggtatcgtttgattgagcactcccgtcgagtctttgagcattaaccgagccgtcttgattgttgtatttccagcagtaaagggactcagactcgccattaactgccagtcagccccaacagtccggtcatcaaccacgtccaaccgatagtcattattaccgtcataaccgtcattagcttttacggccgtcgggtctgtcgccaagtcagtgccttgtgcaagtcgctgcaggtttaacgttccaaaattaaaattaggaacggcactcaatgataaccgcccaccactcttaactgttagcaaagcggcgttggtcgtcaccgtctgtggcttgccattgaccggatagcttagactcgcatagtaggccgttccatcatcatccgcattggtcggtaccttgaccgtataactcgtatccgtgacattgagggctgtagccttaccattcttgacacgataccaattgctaacagtcaccccctcgggcaatgcttgtaatgtaaatgttgccggcgtcccttctacgaccgtcacatcttgtaacgctccaaccaaaattttgacgctatcactcagaccattagaggttccggtaatcgtgacagttccgtgatcatccgcttttccggaattatccgtggcggcatccgctgcggtcacattcccatattcatcaactgccgcaagtgacgggtcactactcttccaagtaattggatccgttgcttcctctggcgtcagtgctgcatgtaccatggtcgtttgtgcattattgagccacgcgtcatcactcgtcactttgatgccagtcgttaccacccgggctggcgtgaccgtcactttcgcgattttggaccaataatcaggaaacgccccaacaccagagaaatcatactggacctgaaaataaagatgcgttgttttggtcacttgcggcgcattgaaagtataggttcgactattagtgccaatcttctgataggtttgcccctcatccgtcgattcccaccaaacgtacttgcgaccactcaacagacttgtcgccgcctcaagcgcactgcgctgggcccgaaccgacagcgttactgagttgccaccaatcacatttgaatcgattggctgttgtgaaaaaccgcccgatagattcaaacctaagacggaactcggtggactgcttggcgattggggcgccgttttggctgctaaggcactcgtgacgatacctaaaccaaccagcatacttatcaccattaggccacaagccttgatcaactttctcatcgttcctcactccttacgcgaacgccgctggccaaaccagtacgccgccattagaagtgctaagagaatgactagtgccactgcaccccacagccaccagttgacctgacgcggtccaaccagatgatgattatgttgttgcgcccgttctgcagtcaaggtaaagtcacgggtgaaatcccagacacgctggccgctcgttagatgcaattttagtcggtacttccctgcggctaagttttgcgtgcccaacgcgacttgatagttaaaccagctattcggtgccattgatcctgatttaagttgctgcgtggcaacggtttttcccgtcgtgcgttgaataacgcgtgcttgaattttgagttgtccaaaaagtgtcggcgtcagattacggagtttggcaaagagtactggttgcccattggtgggcgtcactttgacttcatcgaggactaacttaactggaatcgtcacttgcggctgacaccaaagcgccaccgctgtaacctctgcatagcgattcttcaacataaaaccttgactcgtcgttggccgggccgcattggcggttggattggtgacaaagaggccacctaacacctccccttggaacccagacttgggaatcgtggtcttaaaagccaccgttttcgcttgatgagccgctaacttaactacgacgccacttgacgtcatgtcagtaaacgtcgtcgtggcagatgggtcatgccgcttagacggcacgtacgcgacgctgcctgcatctgaggtcgttgcgttgaccggtgttacctgcaacgtaattgctgatttaccaggattgctgacggagactctgaacgttgacgtcgttcccggcgtgaccttcatattaaagtaacccgcctgcttatctagttgatccttgggcagtaggggtgtcagaataaaacccgatgcgggtgtgttagatgccgcttgaccaggtaatgaccctaaaagcccgcctagtagcaatgccaacactaataaccaccactgaccgatttgtttccatcgcattctaaacacccccacttcacttaatcattgaataacgacgcgcgatgatcagctgaacctatgaagctgcttttggtgttgctgcagcagctgctggtgcattttgaagcgtccagtaaagcgttgctgtgtaagttccagcagaaatattggactgcttaccgacttgcaatgaactgctcgtggcagtcgtcgctgtatttgaaccttcaccactatctgcagcagcattccataacgtttgtgggctcgcgacccatccgtttgtcacttcgctctgattcaaactcaatgcggtcggcgcggcagtattagcattgtcagcgttacccttggtcatattcaaattcaatgtggccgagtcaactttagccgctcccgaactaaacggtcccatcccaactgtcaacgtccagccagcatgatttccccgaaagtcgctaacgtttaaattgccactaccattgccatcatagccactgcctcccgacgtattgctacttgttgcatttaacgttgtggcagcagatgcaatattcttaacgttggtcgaacttaacgcgatatttggcacagcatccaacgttaattcaccgggcataaccgtaaattgtgcattcgataacgcttccgcattacccgtgctatccgcaacataaccagacgaaactgtcgtcaaattgttgcttgctgttccgggtccggccgctaacaccgctaggggcattagcgcaagtgatagtaaagttgcgccaccactcaacccggtcattaatttaaaagttcgcatgttgcttcctccttctcaatcgactgcttttccagtcgcctgctaccatattagtttactaatcactttatgattccgctttcaccgtcctcttcccctgacgccaaccataatttatcatgtataccaatcgaaactgtgggttatgttttgattcattaactttccatattaattaaacgcctggtgataaccggccacaacgtggatacccagtcacccttgtaaccaaaaaaacatcaaggcccgttgtccttgatgtttttacatcattaattcatttatttttttaacgcttcatctaacgcaataacgcccttaactggaccaaccacagtaatcacatcatggagggccatcatatccgtcggcttgggcgagacatcaatgtgtttctcgtgtttgattgcaattaccgtcagaccaaaacgttgccggatctttaaatcgatcagattctgattaacaaagttcggatccgtaatctcgattgcggccaacgtatactcatcacttaagtcaataaagtttaaaatatggttggaaaggatgcggtgggcaatgccctgacccatatcacgttccggaaatacgacttggtcagcgccgacccgttcaaggacccgcccctggtcgctagtttcggccttggcgatgacctttttcgccccctgctccttgctcaacatcgtcgtcagaatactggcttccatattattgccaatcccaataatcacataatcaaacgtatcgacgttcaaatcacgcaacacctgctcgtcacgggtatcagcaatcattgtctgtgtcgccacgtccattagctcgttaactggttcttcgttaatatcaacggccaaaacatcctgatgagctgcggcaagcgcccgaacaacactctcaccaaaccgtcctagaccaaatacagcaaaattttttcgcatgttgcccacctaaccaatcaaaatattttctgccggataacggatcaagttcaccctagcttgacgtctggaaagcgcgtagagtgacgtgaagatccccacccggccaataaacattagcatcatgattacaatcttcccaatcaaagtcagattgggcgtcaatcccaaactgagtccgacggttccaaatgctgataacacttcaaacaaaacgtattccaacccgaagcccttcggaattttttcagtctgcgttaagatcagtgttgccactgtcagcacaatactagccaagaaaatcagcattagcgcccgattgatattctcctgactaaaacgacgatgactaaactcaacatcacggcgaccacgtagctgggcaatactttggaacatcaaaacgccaaacgttgtcgtcttgatcccacccgcagtcgatccaggcgtcccaccaacgaacatcagaatcataatgaccaataaactccccgcttgcaatccttgagtaggcattgtaattaaacccgctgtccggggggtaacacttaaaaacagcgtattgatcgttcggttgacccacgacattccggttggcaacagttccaagtcacgttcagtgatcaacaacaagacaaaaccgatgacaaataaactgaaagttgtgagtaaggtcagtttggaatttaaagtcagtcgcttacgcgtatggtacagcagcacgtcacgccaaactaaaaatccaaggccacccgcaataattaggatcatcgtgaccgtcaagacgtatggatcattacgaaagccttgcagactatcgccaaacacatcaaaaccggcattacaaaatgacataaccgcatggtatagtgacacatacaatccgtgacgccaaccaaatcgaggtacaaaatcaattgcgagcaacccaagaccgcctagctgaaagagcagtgacaaacccacgacatacttcataacgcttttagtatcactcaatcgttccaaattcagggaggccttgaccatcaactgcgtagagagaccgatctgacgacgcataatattaaagaggagtaccgcaaaggtcatgtagcccagcgcaccgacctccgaaagtaccagaatcaccaattgaccaaacgttgtccagtgcgcagcagtattgacgacggtcagcccagtaatacatgtcgctgatgccgacgtaaacaacacatcgatcaacgacgtgtgcacgtttgctggcgtcgcccatgggaggctcagtaagactgtcccaatcagaattaagataataaaaccggctaccattttcttagatagcgtatcaaaaaatttaaaatgtgctaattgtctcataatcattccatcccacaacagcttatcgattataaccaatcagtccgattgatcatactccatttagcttaatcaacctagccaagaaaagcaagtccgacctaagctttgacgtacgccggccacggccgacccaatacatacaaaaaaaccgctaatcaagctcagcttgatcagcggtaaaccaattacgaactaaacatactgtaagacgcgctcatcattataagcagcgtcaatcataccggaacctaagcattcctcaccgttgtagaagacaacggcctgtccaggagtaatcgcccgaactggatcatcaaaagtcacggtaacttccgtgtggtcatcattaaaatgcaccgtcacaccagaatctttttgccggtaacggaactttgccgtcacgtggaagtcattacctaagtcttcatcagtcacaaagtgtaagtcggacgcctttaagtgggttgcgtacaggtgcggattatggtagcccttgccaacatacagaatatttttcttcagatctttaccgaccacaaaccatggctcgttatcctcaccatcaccaccgataccaagtccgcggcgctggccaatcgtgtaatacatcagcccggcgtgctcaccctttacttgaccatcgaaagtcatcatcttacctggtgttgctggtaagtaatggcctaggaattccttaaagttcttttcgccaatgaagcagatcccaacggagtccttcttcttagctgttgccaagcccgcgtttaaagcaagcttacgaacgtcaggcttcaccatttcgccaagtgggaacatcaccttttgtaaggtcttcgaatccagctgacttaagaaataagtttggtccttgttgctgtcaacaccacgcaaaaggtgcatcgtgccatcttcatcatgttgtaaccgcgcgtaatgaccagtggcaatgtaatccgcccctaaatccatcgcgtaatctaaaaacgccttaaacttaatttctttgttgcagataacatcggggttcggtgtgcgtcccttcttgtattcgtctaagaagtacgtgaagacccggtcccaatattccttctcgaagttaatcgagtaataaggaatcccaattttatctgccactttggcaacatctttataatcttcggtcgcggtacagacaccattttcgtccgtatcgtcccaattcttcataaacacgcccaccacgtcataaccttgctgcttcaagagcaacgccactacggatgaatcaacaccaccactcatgccgacaacgacacgcgtgttactgtgatcagtcatacttttcaccatcatttccaaaagattctggagaatccacgatttgaaggtcgtacaagtccagtaagttccattataacaaagaaaacgccggctgcaagccaggcgttccctgattagtccgtcgtgaggacatcccgttcaataaagttagctaaaatataccgtaattgttcaacagcttccggatgggcgtcatttttgaaaatatttgcccgttggacaccattgcccgttaccgtcgtcatcttaaacccagtcaaatccgcattgactgtcatcttcagcttgaaagccgcttgatagggtgaagtgggatccaaggaacgttcaaaactaaacgcgcccgagcgacccttcacaaaacccaaatccatcaacgtgtatttcttgaccgttggactcagcgtatacgtcttagtatccccatctagtttaaccgttgttgtgtatgccatcgtcacgccccctgcttttttaataagcgctgcgtcgtcttcgtcagcaccgttacaaactgatccagatcagccttagtagtatagcgaccaaagctcaaccgaatcgactcgctgatccggggagagtcttcaccatacattgcaattaaaacgtgtgatggttctaggctccccgccgtacatgcggagcccccagaaactgcgacaccacctaagtccaggttagtttgcattgtataggtcgatacccctttgatccataagttcaaaacgtgttgcaagttatgctcaccgagggacccgttgacttcaaaatcaactccgttagccgttaactggtcaacgatgtattgcttgaactcacgatacttagcctgccggtgggctttctcagcggtcgtcagttcttgcacggccgtggcaaagcccgcgattgccgggatattttcagtaccggcacggcgcttatcttcctgttcgccacccttgacaaagctaggaaagttaatgccattgcgtctatacaagaagcccaagaatttaggcccattgattttatgtgctgaggtggacaacatgtcaatatgatcccgttgcacatcaatatccaacaacccgtaggcctgcactgcatccgtatggaaccatgcctggtgatcctttaacaattcaccaatttcatggattggcatctgtgaaccaacttcattattcccggtcatgattgagacgagaatcgtatcaggacgtagtgccgccttcaaatcatccagactaatttgtccctgttcattcacgggtaaataagtaatctcaaacccatgttctgccaaaaaagcagtcgatttaagaattgcttgatgttcgattgccgtcgtaataatatgcttgcctaaatgttggcgcgtccacgcggtctgcatcaccgccgtattatcactttctgtaccaccactggtaaagataatgtcatcgtcagctgcgttaatgctttgggcaatcacgtgccgactatcgtctaaaacttcacgggcggcccgaccgaatgcgtgggtgcttgaagcattgccaaacgtattcgtcatttgatccgtcatcgtctgaataacggacgctgccattggggtcgttgccgcattgtctaggtacacttgcttcattacatcatacttccttctaaataattcttagttattagcatcgctgcgatacatctgactaattttgcgccgcaaataatgcaagtaacatcgctgcggactgcttacccgcttccaggataaattcgtcaaaactaacaccggcattttcatcaccgacatcggacatcgcgcgaatcaccacatatggcgtctggaactggtgacaagcttgaccaattgcggcgccctccatttcactagatagtgcttctggaaagtgtgctaaaatcttatcggtagccgccttacctgcgataaattggtcaccggaaacaatcagtccagtcttggcattcaaaccggttgccttggccgccgccatgatttgctttacccaattggcatccgtttcgtagtatagtggctgttgtggtaattggccatattcgtagtcaaaggccgtcgcatcaacatcgtgataagcagttgccttagctacgacaacgtcaccgacatgcaaaccagcgccaatcccacctgcagaaccagagttgatgacaacgtccacatcaaagttagtaatcattaaagccgtagtcataccagcttgcactttaccaatgcctgattgcactaagacaacttcctgctgatcaattgtcccatcatagaacgtaatatccttaatattaacgatcttttcgtcttgcaaagcatcccgtaacgttttaagttcttcttccatcgcacaaataattccaaatttcatgtgagcctagcgcctactttctatggtgttaaaaataaaattaaaaagacaataataatcccaacgactagtccagcaatcgcccaattcaatttgcgggctagccgtttcgtcttggcttcttcaacagcccggttgttctcagcagcatacgcttgtcgggatgcactgggttcggccgttggtgattcttgttcctgagtatcgtgaccagttggctggctacgttgttgtcgatattgctgtctggtgagtcgatcatcatctgccactatgcttcaactcctaactcagggtgactttgccagtaccaaatcgccattacggttttggcatcctgaatctgaccagtctgaacttgactgacagccgtcgcgaggtccagcttgatgagcctaatttgttcgtcagggtcttgtgggaatgccgttgcaaccgcactcagaccggtagcaacgtacaacttcattagttcgtccgtaaacccgggtgacgtgtagaattgggcgactgcttctaagtgctgagctgtcaatcgggtttcctcatttaattcgcggacggccgcctggtccatggtctcaccggattcgaccttaccagccggaatctcgacggtcagcccaccggttgcagcgcgccactgttgttcaacaatcattttatgttgcgcggtaatcatcagcatcgcgacggccggctggtgtcgcacaatttcacgtgttgccgtcgtttgatctggtaaagtgacttcttgtcgttcgacctgtaccaacccgccttgataaaccaactgacgactctgaacccgttcctcaaatgtcattgatcaagaacccctttcagtgtctgctctctcaataaggataccgattttttagctcgattgcaattttcaactgggcgatttcggtaattttaacgaacccgcaaaaaatgggctaacgagcgaccaatttggctccttaacccatttttccaattcttaaaatcaagcggaccaattgacactaatcgccattaggcctttgcaaggttagcgacgaaatcttcataagcaacctgctcaccagtttccgttgcggtagctgggctgtagtcgccctgaagcgcatcttctaatggcaaagtcacgatccggacgaacgtcgcgttaccgatcaattccatccagtattcttcatcggcaccttggtgaacaacggttttgaccatcccaccaggattggtgacgtggatttcttgattaaaatcggtactttcttggtgtaataacacgtacatcaatgaggaagccgacatcgcagtcccacaagcattggtaaaaccaaccccgcgttcaaacgtgcgtacaaaaattgaatttggtcctaagacttccacaaaactaacgttgacgccatcagggaaaatttggtttttaccatcattcatccattcaccgatacgtcctaattcggggccaaccaacgtatcatggtcaacgaacgcaatcaaatgcggattaggcaccgccacagctgagaatttcaagtcagcagacagcgctggaatcttttcattaataattgtcgtcgcatcgttattcgcatgcatgccaagtgtctgcgcgtcgaaagttacgggtgaaatttcaacactgtaagctgggacgtgggccgcaaaatcagcaacggcctgcacctttaagtccgcatacatcgtctgaacccggaagtcttcctgactattttgcgtgcccaaataacgagcaacggtccgtagcccattaccgcacatgctagcttccgtcccgtccgcattaatgacccgcatccgaccaagtacttgtggatgttctgatttatcaacaaccaacacgccatcagcgccatcgtacaaacctgcgccgtcacgtttacaaatgttaattgccaattgcttcaaatccgcatccgataacggtgcttgaaattgtgtttgatccaataaataaaaatcgttaccagaaccgtgtaccttgatcattttcacagccatcaacatcctatctatataaaatcgaccttaatttaaactacttcattatcatactgactttttcatgaaaattcaattgcaaaggaccatttctcataataaccattcaaagtcctgcgcagcaactgtaaattcttaatagctcttaaatcttgcatctgaaaaacgcaatcagttttttacagctgtatctcaatcatcccggtgttcggatttactgactacttgataatccccacacgccagcacaaaaaagtgccactaatcagtcccgtttgactgattagtggcacttttcataagttatcaagactcacgctaaatttaattcagattaagcttccaaaccagttgttactgattcagggtagttttcacgaacgattgcggcgcaccgtgcacataacatcggataagcctcgtcactgccaacatcggtcttaaccattcggcaacgatcacaaacgtcaccgtcagcatggccaaccttgatggctaacgtgtcaccaaatgtttctgcgtctgcaggcgcgtcacttaacgcgtgtagatctaatgctgaaaccatcaacatctgccgaacattggtgttcaaatgatctaagaaggcttgcgtatcatcatcaacatacaaatccaagtgtgcttccaaggatttaccaatcaacttagcatcccgggcttcttccaacgcctttaagacgttactccgaagatccatgaaccgcgtccattgagccatcaactcgtcgctgttcgcataattttgaacagctggcatctcagctaattgcgcaaattcttctggttccttcaagaatggccaaatttcttcagtcgtgtgtggcagcattggtgtgaagagcttcgtcaaggcaaccaaaacatcgtagaagaccgtttgcatcgaccgccgtgaatggctatcctcggcatcaatgtacataatatccttggcaatatcgagatagaagtttgataaatcaaccgtcaagaagttgatcaacttcttgtagatatccaagaaatcataatgatcgtaatggtccttcgtctcagctacgaattcgttcaaccgtgtttccatgtactggtccacacttgctaaatcttcataagccacgcggttggtcttcggatcaaagtctgcggtgttgcctaacatgaagcgtaccgtattccggaacttcttgtaggaatcggctacttgcttaaagctttccattgagacccgaacgtcggaactggtatccactgaagcgacccacatccgaacgatttcagcacccatctgcttaataacatcagctggcgcaatcgtgttgcccagtgacttactcatcttacgaccttgattatccaacgtgaaaccttgtgacaagacttgcttgtatggggcatgtccagaaacagccacactcgtaatcaagcttgagttgaaccaaccacgatattggtcagaaccttcaaggtataagtcggctggatagtcgaggtatgagcgctctgccaggacaccctggtgtgatgaaccagagtcgaaccaaacatccataatatcggtttccttagtaaaggtaccgtttggtgaatgttcattggtatagccatctggcaatagatccttagcgtcgcgttcgaaccaaacattcgaaccatacttgccaaataaatcagctacgtggttaatcgtcacttcgtccatgatggcagtgccatcttcagcatagaagattggaagaggtacaccccaaactcgttgccgtgaaatgacccagtcaccacggtcacgaatcatgttgtaaagacgctttttaccccactctgggaagaattcaacgtcatccatcgacttaaggatttcatcacgcatatcaccaacggaagcaaaccactgtggcgttgcccggaagataatcggcttcttagtccgccagtcaaatggatagctgtgttcgtatggcatatatttcagtaataacccagcggccttcaacttgtccagtgcgatcttgttagcgtcatcgtagaagacccccgcaaaatcatcaccagcttcagccgttaagaaccctttgtcatctacgggagcaaagattggcaggtcgtattgcttaccgatccggtagtcatcttccccataaccaggcgcagtatgcactagcccagtcccagaatcaagtgtgacaaaatcacctaacatcgttactaaatgccgactgttgtcaaaaggatgttcgcacaaaatgttttcgagttccgcacccttgaccgttttaagcacttgaacatcttcccaaccaaatcgtttggcattttcgtccaacaattcagccgcgagcacaaacttacgattttcaccagccggttgcacaacgacgtaatcaaaacttgcatcgattgtgattccttctgaagctggaatcgtccaaggagttgttgtccaaacaaccatataggtatcatcatctaagacacccttaccatcaatgacatgttcaccgtagaaggcggatggcgatgtcacatcatgatattccacttcagcttctgccaaagccgattcagaagaccatgaccagaagacaggcttttggccccggtagatcaagtgacgtttagcaaacgcaccaaagacccgcacttgagccgcttcaaattctggctttaacgttaagtatgggttgtcccattcaccagcaacgcctaagcgcttaaactcatcacgttgacgatcaacttgttccaacgcgtatttccgacaaagttctcggaattcattgtccgtcatcttcttgcggtcataaccggcttgctttaacttctgttcgattggtagcccatgggtatcccaaccaggaacgtaaggtgcccgaaacccattcatcgacttatagcgaacgatgaaatccttcgtgatcttatttaaggcgtgccccatatggatatcaccattcgcgtatggtgggccatcgtgtaagataaagcttggcttaccttcattcaatttttgccgttgttcgtagactttattttcagcccacacattttgccgttcaacttctttgaccggtaagtttccacgcattttaaacttggtcttaccgaggtttaacgtttctttaacgcgcatattctcactccttaaaatttttatcaaacaatcgccattggatttttagacacaaaaaaacttcgtccacccagggacgaagttatcgtggtaccacccaattttagaattgtttaaattctctcttagcatggttaacgtccatggaccggccacccttactcaattcaggatagcattcggagatgatctgcaactaactaagggacgactgcctttccattgccggcagctctctgggcgtattagctaattgtttgctgttctcctcaatacattcaattcgcttcaattgtgcctgacgatcgcctaattaattattagtgctgtcatcatcagggaaaataaccaccgtctgttgttggacttgatcgccaccgtccgcaacgggggtctcaccactcgttgcttccgtaatttcaacggttgcttctgagtttacgctcgcatcccccgagttgtcaaggttatcttcctttaaaacgtgttgaatttcagcataatcagccgtattcgtttcgctaagtagttgatcccaatccttgctcttaaccacttctaactgcgattctaacatcacttgcaagcgttgccggaagacccgcgtttgtttcttcaaatcatcagtttcaacggataatcgtttggccttttgagaagcttcgtcgatcatttggtttgacttgtcggttgcttcactcacaatgtcagacgcttgtttctgagcttcgcgggtgataatgtcggcttccttcttagagttcgtcttcactttatcagcagcttcttgagccaccaagatagattgattcaaggaatctttcaattcattgaaatacttcaacttaccttcactcgagtccaaccgttcttggaggtctttattttgcttcaaggtaatttgataatctttgataatttgttctagaaaatcattaacctcatcaatattgtaaccacgcagtttcgttgaaaactctttgttatgaatgtcatcaggacttaacaccattagaattcctccaatatctatttactatgaataatatttaatgttattcgcagccgcgcttttttggtctcaccgctaatttcggcaagtcggacacgaccgtaatggttcacactcagcatatctaacaatgctaactcgtaatcagctttcggtaagtcagcccaattcagccgaaccttagcaccttcgatcaattccttggcgtgatgccgcgacaagttgaacgccgccttaatgatactatccgcacgtaatgaactaaccgtcgtagtaactgcctcccagtcgtcttccggtgtgatcaccgccgacaatggtaccgctgttaagtggactttcgtcttaccaaaacggtcgatttgctcctcgaaatagctggccatctcggtttcgcacacaaactgccatgtcgttccgtcagtcacgatgtcaccaaagacatcacgctcgacgccggcattggcaagcgtccccagaatttgaccatgctttaaggtggcaaacttcacgggataaacaatgttaaacagtgtgatttgaaaatcggccacttcaggttcgtaatacaccgggtaaaataagatccgttgtaactcagcaccttcaaagccaccggatgcccgcatccgcacgtcgtctaactggttgaccagcgtttgcgcaatgtagatttgtcgcgggttcaaaaacgcagttaagattggtcggtactgatcagctacttgccgtagccaaccagtgacctgttcaataaatggggcttcactatcgcgaaaatgttgttttaagttatcattcacgatactatcctcgttattttaatttagtatatcaataaagttatcagataaaataggccactttcagctaattggagcactaacagcgcaatgatcggcgaaaaatccagtccggcaattgcgggaataaagcgccgaaaaatactgagaaatggttcacagatttgacctaagaattggcccacgcgagtattataagctcccgggaaccatgacatcaaaatgtaaaccacaatggctaattggtacagttgaaacaaccgactaataatcgtcactaacaggccactcactccttataatttgctcgtatcaaactgacttgtcgtacttccggaaacctcgtaattttcaggaatacagaggaaaatttcatcaccgatccgttcgatctcaccattgatggcaaaaaccgtcccggtcaaaaaatccacaatccggcgtgccatttcatcatcgacgtgatcaaaattaatgattacagcttgatttttcaataactgcgtcgcaatttctttcacgtccgaataaattttcggttcgaatagggcaattttgctattcaccgacttgcccccttgcattggaactacctttggcgtgctccgagtattggttgcagattcagtgggagccgccgcttgggaagcttcggtgggttcctcatactgactgtcagaatcaccaacaccaaaaaagttactaatgaatccggccatgtgcttgcgctcccttcaccgttttacttacgccggcgcttgaagaatggtggtgtatctagcgaatcaccactgttatcatccttactatcgtcagcttgtgagttgtcattaaagacatcaaaatcagttttttcaacattgttaaactcttgaccattgttgactggccgtgaattgttcggttcgcgccgaatatcccaattaccgaatgggtcgttagcttgggactcacttgattgggccgcttcactcgtcgctggctggtcagttggcgttgcgaacatgccgcctcgttgctgactagcttcactacgactaggctggctgtccatcttgagttcgcgttgcttctgatcgataccagtggcaatcacggtcacccggacttcatcgccaagactttcatcgatcgaagtcccaaagataatgttaacatcagtcgttgccgcttgggaaacaatgtcagaagcagcttgggcttcatacaaggacatgtcggggccacccgtgatgttcagcaagacttgttcggcaccatcgattgaaacttccaataatggtgaagaaatggcttgtttagtcgcgtccgccgtccggttctcaccactagcagagccaatacccatcagagcggaaccttggttttgcatgaccgtcttaacgtcggcaaagtccaagttaacgtaccctggtgacgtgattaagtcagagataccttgaaccccttgacgtaacacattatcagcttcttggaaggcttccatcattggagtcttcttatcaacgatttcaagcaaacggttgttagcaataatgatcaacgtatcaacgttgtctttcatctgagcaattccttcagcagcattacgagcacgcttaggaccttcaaatgtaaatggacgggtgacaacacccactgtcagcgcgccggagtccttagcaattttagccacaactggtgccgcaccattaccagtaccgccacccataccggccgttacaaagaccatatctgagccttgtaacgcttctgtcaaggcctcttcactttcctgcgcagccttggaaccaacatcaggattagaacctgcgcctaatccccgcgtaagctttggtccaagttgaattttagtttcggcatttgaagtttgtaatgcctgcacatcagtgttggcaacgatgaattcgacgcctttaacatcttcagcaatcatccggttaacggcgttaccaccaccgccaccgacaccgatgactttaatattagcccctgagttctgggttgaatctaaagaaaattccatgttttttcctccgtcatttctatccgatattaatcaaagaagtggttgaagaagcctttgacccgttcaacagttcccttatgatctggatcagcctgttcctgtggtgcttgtggcgcagactgtttcttagttgcttttttaggttgtgctgcgggttggctaggtgctggtgttgtatcagcaaattccaacgccacactggcacgagtatcaccggtaagtgcactcttaacgagtaacgtaacttcactcaaggccgcttgatatttgatgaccgctaacgcctcatcaaacgacggatgcctcaagcccatttgattaggcgtaaagacgcgaactcgcgttccaaaacgttgcgccgccaaatcagtgataccgggtaatgctgccaccccaccagttaaaacaatgcccccggggagctcgagcgcccgaatctcatccaagtgctgcttgaccttatcaaagatctggtctagacgagcctcaatgatttctgctaagtattgctcacttatttgctccggtgtactttgcccaacaacatcaactgggaaaagttcatcatccgaggcctgctgagcatcggcatagccataatcacgctttaacttctcggcattctcgatcgatgtattcaaaacgaccgagatatctttggtaatatactggccgccttcttggtcaacgtaagtatacttcaattggtgatcatgtataactgccgcagtcgtttgaccaccgcccatgtcaataatgatcgaaccaaaatcttgttcaccgtcattcagcactaaggaacttaatgccaagggcgcgatcacaatctgttcaatttgcagtccagccttttccaaagccttccgcgtattgtgaatgattgttttcggaccagtgaacagggtgccgtgcatttcaagccggaccccaaccatgccacgtgggtccttgatgccatcaaaaccatcgacgacaaattcatcggggatgacatccagtacttcccgctctggcggtaaactctgaactaacgcagccgccgcaacgttttgaacatcttcattattaatttctttggactcatctgccacggcaatcataccacgacagcgttcaattttaaccaggttagcgggaactcccgcaatcaccttttttatttcgatacttgctttttcttcagcttggcgtactgctgatcgaatcgtttcggccgccttatcaatatcgacgatcacgccacgacttaaaccattagaacgtgcgcttcccacaccaataacgttcatttgccctttaacacgttcagcaacaatgacttttattgaggtggtccctatatcaagtccgacataaattcctgaattatccataatagaggaacctcctagtattttacataaatattcaaggatttgctgacatatccagttattccttagtttaccatatcctaagcgcttttaaaaaggtcacacttagcattctatcaattattctgattcttgaacggataggagtatgcgcccacctcaagattgatgacacccttggttttcatcttcgccacaattcccggataataagccatcttgctagcaaaagtgctaattgttgcgtacacttcattaccgtcattcatgtaaagatgaacccgttcgggattagccttgttcggcgcaaacttgatctcagaaatattgtgtttgaccgccgatggtaacttagcgtactgtgcaatcatcgttgctaagcggtgaccgcttttaaagttggcatagatcggtgaaccgccaccgggttgagaataggtcgctttcaaaatcaacccattttccaaaattcgtcgatagtgttgaccagtcgataagtaacccgcgatgcgaatttctttaactgtcacccgaacactgttcaatccaactaacttagtcgtgaccttgccgatttgcggctgggcacgttctgcgcgcttagtagtccgttgatcatgaccaatcacggaccataaggcaactccagggttgatcttagtcgccgtcttgacctgcgtaacagacaattgatcgttaccatgtacggtcaccgtctgaacatggctcagtggtgaaatgaagtaaccagccacaccagcaccgatcagaaaacagcccatcaagatcacgacccgtttgaaaagtaatcggcggcgctgagatttgagtttcggtaatttatcgccaattcgcaggcgtttacctgaccaactatggtgactcttttgcgctgcgcgatgattctcagccgcgtctcgttgaaaccgttcccagggtgtcagctgctcggggtgctcacgctccttgggctttttatgaaaaatggccatcacacccaccctttcactctagtctctgtgctacttaatcaccgtttctaaaacgtgtagtaactggtcggccgcatcaggcatccccagttttttcgcattagccgccatcgtttcacgatgcgtggtactttggagaaggccatctaatgcagctaccaaactggttcccgtcaaatcagcttccttaatcagttcagccgcccccgcattcacgaggctttgtgcattcttggtctgatgatcattcgtaacatatggactagggactagaattgaaggaatccctaaagccgtaatttccgcaatactagttgcacctgctcgaccaagaataaccgcgacttctggtagaattgctggcatatttttgatgtatggttcgattttaacattcggagctagcgctgtcgctgacaagccattccgaatcttttcgtagtgtacctggccggtgacgaacaaggtctgatagtcacgtttgttcagttcaggaattgccgcgaccgctgctgcgttaatgcgcgcagcaccccggctccccccaaaaatcaacgccgttggaatgtcaggatccagatcaaactgcgccaaagcgccactttttttaatattagccacttgttgggctcgaggattcccagtcatcacaactttttgagcgggaaattgtgatcgcgcactctcaaatgaaatggcgattttatccacaaaccgacttaggaatttgttagtgacaccaacaactgaattctgttcatgaatgaccgttggaatgtgcatctggctcgccgcgaaaacgaccgcaccactcacgtagcccccggttccgaccacaacatcaggtttaaacgccttaatgtacttacgcgccgtaaccacgctctttaaaaataaatagactgttttaacattttgtaatgacaatgaacgcttaaagccctggatcttgattgttttaaaatcgatcccccgttccggcacaatgcggctctctagtccacgatgggttcccacaaactgaacttgcgcttcgggatcatgtgcttttaaggcatcgatcagtgccagtgcgggatagatatgaccacctgtcccgccgccagaaatcattaatcgcattagttttcttccgcctttccagttaactgttcgattgctttaataaatcggtcgccccgcacttcgaagttcgggtactgatcccaactggcacaagccggtgataacatgatgatgtcaccagcctgactatgttgccaagcaattggcaccgcagtctcacagttgtccgtaaactcaatatcttgaataccagccaaacgcccagcgtccgccattttttcagcagtctcaccgaagacgattaacgtcttgacatgcgcctttaatgcgggagcaagcttttcaaacgtattaccacggtccaaaccaccagcaagtaaaatgaccggctgatcaaagcccttcaaggccatctcggtcgacaccaagttggttgctttggaatcgttgtaaaattgccggtcctgatacgtctcgacatattgagtccggtgtcgaacacccgtaaacgtcttcaagacttgaacgattcctgctgttggaacggcttgaagtttagcaacggcaatcgctgctaacgcattttcaacattatgatcaccaggaatccggatatcagcagcatccatgatgtactcatctttaaagtacagcttgccggcctcttcataggcgccatctttcgtattggcttgccgtgaaaatggcacgacggttgcttgtgattgcttactgagttgccgccattcttcactatcccaattaatgactagataatcattagccgtttggttcatggtgattcgcatctttgccttgacatagttctcacgtgagccatggtaatccaaatgcgtcgaataaatattcgtaatcaccgcaatatgtgggtgcaaagtttgaataccacacaacataaaactcgaaagctcagtcaccattgtgtcggccgccgtagccttttgtgcaattgctgaggccggcacgccaatattgcctgctacgtaagctttaccggcatttgtgcgttgattaagcatcatcgtgatcatcgtcgttgtcgtggttttaccgttcgtccccgtcacaccaatcaactctcccgctaggatttgcgatgcaagttcaacttcggtaataactggaacacccttttcctgagccccactcacaattggatttgagtatggaatacccgggttcttgacaacaactttaaaatcttcatctagtagtgacaacgggtgaccacccgtgataactttgattccatcactcaataattcctgtgcatccgggttctcatcaaatttctttttatcattaacggtcacaaacgcacctaatttgtggagcaaccgtgcggcattgaccccgctctttgctaatccaagaaccaaaaccttttggttacgatactgctcaaccgacttcataaaccaagatctccctataatgtttgtagatgatacctaaattaacttgttatgtggctgatgcaccaactcgtggtcatcagcaaattattcatggtgagccagtgaccaattccacgacataatctgcggcagacaacgcaaccatttaaagaacaatcgttgcgttgataggaatcagtactatttacttgtcacttacttggcgaccaccaatgaataaagtcataccgcaaagaccaattatgtacagctaactcggacaagaatgcccgagttagcaaactgtgactaaataatcgtggcaacactgattacggctgccactaaaccaatcgaccaaaaaacgatatcaatcttccactcgctccaacccttcatctcaaagtgatggtgaattggactcatcagaaagatccgttttcccgttaacttgaacgaggcgacttggaggataactgaagccgtttcaatgacaaaaatgatgccaatcaagaggagggatagttcatgatgcaataagattgatactgcagctaaagcaccaccgagcgctaatgatcccatgtcacccataaagatcttggccggtttgtgattatacacgaagaaacctaatagtgaccccacgacggccaaacagaataacataacattatactgattttgagcgtaagcaatcacggcatacgcaccaaaggcaatcgtggcctgaccagcgactaatccgtccaacccatccgttaagttgacggcatttgagaagcccactaaccagatgatggcgaagagcatgtaccaaattcccagcgaccagacccccaaacctggaatcctaagtgccattggcaaatgttcatgttgatagaccaacgttaaaattactgccccaatgacttgaccaagtaatttttgccaagcctttaaaccttcgttttgtttacgccaaagcttgatactatcatcccaaaaaccaagtgcaccgtataagaccaggataaacatcaaaatccaggtggttggttgtagctgatgttgccacccaccgacccataacgtggtgactaagattgcgataatgaacagtaggccccccatagttggcgtcccagattttttctcatgccacttaggaccttcctcacgaatcatctgtccttctttgcgggcgcggaaataccgaataagtgacggcattaacgcaaacacaataataaaaccactaattagggttgcaccccacactaataaactcacaacaattctccattctaagacttgataactacttcagtgtcacactaattgcctgcttagcttcgatcggattacccgcagtcacactttgcgtcttgacgtaacccgtcccgctagtcgtgagcttaacgcccgtcaacgtcgcaaaatcagccacttcacttgccgaccatccagataagttcggcatatacatctgcccgttggtaaccagaatgacgcgttgaccacttgaaacgacagtgccagaagaaatggattgcttgacgacccgactacccttaccaacaacgaccacgtcaagtccctgcttcttagcagctttcttggccgcgctagtcgacttactcgtcaaatctttcattttgatcgtcgtcgctttagtctcactcgctttttgttcttccaatgcccgtttcatcacggtatcaaaaatctctgccatgtcatctgacgcggaacttccgttaagtgtcggttgtttcatcgtaatgtacataatgtacttcggatttttagctggcgccatcccgacgaccgagtacagataggtgttgtcaccttgctcatacgtactcccgttgctgacctgggcagtcccagtcttagcagcaatgcgatacccgctgatcttatatgatgagccagtaccgtatgacttatataccacatcttgcatatgatccaacaccttgctggcagtcttcgaactaattggctggcttacaaccttcttcttacccgtataaaccgttttgttggtgttagggttagtgatcttggagataaagtacggctgtaacatcttaccatgattagcaatcgctgtgaatccacgaagcatctgcatagcggtcacctgaatcccctgaccaaaggccgtatccgcttgttcgattggatacgtaaattgaattgaaccactctgctcgttgtcaagaccactattagtactctcacgcaacccaaagcgtttaatgtacttcagccaagtcttggcccccattgcttgttctaggtgggccatcgccgtgttacttgaaagggcaaaccccttagcataggtaatattgccccacccgctcgtattccaatcaggaacggtattattaccgatcttatattcaccggttgggacggttacattagcattgtacttaccgctgtcgatcgccgctgccattgtaaagaccttcatcgtcgatcctggttcatacgtgtcttcaaccaacaaattacgccacattttagatagtccggtctttgtttgcgcattaaatgtcggtcgctgcgtcgtcgccagaatggcaccagtcttcgcgttcatcaacgttgctgtcattgacttaggtgagaccttagcgtttacttgtgaaactttagtttccagtaatgtctgtaacttactatcgatggtggtataaatattatccccatccttaaccttcttaccagtctcagtgctaccttgatatccgctcttcgtaatcgtcttgcgaccatcggttcccgataactgcttgttaaaagccaactcgatgcccatcgaccccgttaaccgcgtctgatcggtatccttctgactcttggaggtggtcagcccaaccaagtgggaagcaaacgtgccgtttgggtagagccgcgcttcagattcaataaagtgcagcccagccacattttgggcatcgatcttttccttagtcgtcagtgaaatattcttaccagccgtcccaaattcaatttggaacttacctgcgcctttttgcaaggtcgcgagggctttcttatagctgattggcaaatacttcgataagacacgcgccgccttcgcattatttttaacatacagtgccttgccactagcactttgctgatttttcgccataatggcgtagaccgtgtacgtgctagtatcttcagcgattgggtcaccgttggccgtataaatagtcccacgtttggccgtgatggtctggtcttccgtataaagtttcttggtggcctcgaccagattgaccccgttgacgtggcgcacaatcgcgatatatgaaaaacgaatgatcaaaacaccaaagacggcaatcgcgccaaaaaatagccattggccaaaaattctacgattttgttttggtgaccgtttcgaagtcattcgttgtttgttcttattcatttgtaaacattccttatgctaccgttgttcagcgataacccgtactgcttagcaattttatttaaacggctccgacttgaaagttcactgatttcttgtgcggccgacgtattttttgcctgcacttttgtgactttcgtttgcaccgtctgtaactgactttgtgcgttactcgttgcaatgttcgttgaaactaacataatggctaatccaaacaccaccaaactcaaaccaacacacaatactttttcaaataatgaaaaagcaactcgctgcgtcttgatggacggattcggggtcacaacggtttttgttttatgtaccggggtggttgcgccaggagtttgctgtggcaactcccgcgctaatccattttgggccattttaatcactcctttaattattcctgaatattatttattcgttatctttaaacgttcgatggctcgtaacttggcgctgcgggcacgacgattagcttcgatttccgcatcgctaggcacgaccggtttacgactgactaagcggtaatctggttgcatttcagctgggataactggtaaaccaggtggcagctccggcaaatcgctgtgctccttaaagatcgtcttgacgagacgatcttctaacgattggaatgtgatgacactgacacgaccatgaacattgattaaatcaatcgcttgttcgagcgaagtctccagtacgcccaattcgttattcaccgcaattcgaatagcctggaaaacccgtttagcgggatgaccacccgttcgccgcgctcttgctggaatggcattcttaataatttcgaccaattgccccgtcgtcacgatcggctgaaccgcccgttcacgctcaatcaaccgtgcgacttgtttagaaaacttctcctcaccatagcgatagaaaatacgaaccaagtccgcatagggccaagtattgacaactgtttgagcggttaatttctgactctgatccatccgcatatctaacggcgcatcatgttgatacgagaagccgcgggcagcatcatcaaattgtggcgacgaaacgccgagatcataaactaccccgtcaacatggtcaaggccccgagcatttagttcagtcttcaagttggcaaagttacttttgatgaacgtgacctgaccacgttcaagataagtcgctaagttactttggttataatcgattgcggtttgatcctggtcaaagctatacaagtggccttccagacctaactgttgcaaaatttcacgagaatgaccaccgccacctaatgtacagtccacgtagatgccatccggccggacgtttaacgcggcgattgcttcatgcaaaagtaccgttgtgtgttcaaatgttgccacgcgtgcgcccccttcctaaattattattgttatttaaaaatcaatcaagttttctgcaagatcatcgaagttcgctgcggtctccgtctcaaactgttgccagtgttcggcaccccagatttcaaatcggtcagaaactccgacgatcacacattgcttttccaactttgcatattgtctcaaggttgcaggtatcatgacccgtccctgtttgtctaattcacattcagcagcagcagcatagaaaaaacggacaaacgctcgcgcatccttgcgagttagtggtaaatcatctaactgtgcttgaagcgttgcccaccgttcagcgggatagccaaaaatacaaccatccatcccacgagtaatgacaaacgaagtgcccaatagctcacgaaacttggcaggaatgattagtcgccctttcgcatctaaggcatgttcaaactctccgaaaaacatcttagacgccacggccaatcaacccctttcattaaacataattcaagtctaccacacccccccacttcctaccacatcgttttgttacttttccaaattgttaacaaaatatcaaaaaaagtcccacctaacgttagtttcgttaggtgggacttagtgggggacatttttacgatgttaaaaagaagtggctgccaagtgctaggatatagacgacgagtgtcaataattccgctccccgccaatagagcttaaaaaagcgccagtaaaggatttctccgcgttcaacagcttcaatcagtgttaaaccgatccccaaaatcattagggacaacacttcgtacggtgccagcgaactatccgttgcttgcagtgtcagaaagtgggtgaaaacaattaaaaatggcggccaaaaatccaacaatcttaatccatgtggccaaacgcggtgtgcaacccgtttagcacctaaaatgatcatcgagatggcggctaaaaataccagctgcccataccaagtggtccataaatctcgcatatgcgtacttgcctccccattagtgtcgggttaaattatagagattatcgttaaacttttcaatcatctgtgacagccctataataaacataaactattactggagggatgaccgttgttacaatactttaccactggtaaaaatggccttttgactacgccggacgaccatcacgatcagccatactggatcaacgttgaacgcccgacctcaactgaaatcgaccaactggtcacacaatttgaccttcccaaagattacttaactgccatcctcgacgatgcggaggtttcacgagccgagcaattatcaaccacgcaatccagtcaaccaatcttaatcgtgatgcagtatcccaaactcacgacgagtaagctgggttaccttgaatttcaagtctatcccttcgccttgattttagtggatcaagtggtcattaccgtcagtaattacccggctagttttattcaagactttgtgatggacccggcctcttctaagctaagtctggataatcatgaagattttgtgctgactatcatgtggtacatcgagcacagttttgtgaccgcactcgaattgatcaaccaacggacaagtgccctggaaagccgtttgaatcaagctactcacaacgtggaactctttaccattatggcttaccaaaaatccttgattcgttttaaggccgcccttaatcagaacacacccacgcttgacgcggttgaaacttcgatcacccatttcaacgcacctaatcaccaatcactcaccgatgacattaagattgagacccagcaagcgagtgacatggctgaaacgaccaatcagattttgcagcaatatagtcaattagtgggttcagtaatttccaataatttgaatgatgtcatgaaatttctgacctcactcacgatggtgttgacgattccaacgattatcggtggaatctatggcatgaacgtcaaattacctggtgccggtctcgtccacgctttcacttggctgatgctaggaacgattattctttgcattattagtatcgaatatttacgaaaccatgactatttttaatttcaattgaaaaaaaactgattccacgttaaactatgaaagaattactcgtaaagtgtggtgcatacaaacataatgaagaaaaaatcaacttttcaaaaaattacgatggtcgttatctggttaatgatcatttctaccattgggtcattggtgcttaccgccttatctgggttaggtttactaaccttctaggttaaacaccttgcgaaccacgaatggttgcaatacttaccaagaaaaaagttacgcttgctcacaacaagcgtaactttttttattactggtggatcactcagccatggtcggcaagcctagccaccaacttctgagacaatgtgaattaaaaaaatcacgcatttgtctctgaaaaaggttccaaccgttagtcaaatctggctaacgattgaaacctttactttaacgtcgattattcaatcgtatcggcagcgccaccatgtgaagtcatgccattcaaatgatgcccaccaatcttactggacgctaagcgtcattacccgacgcgggcgcttcgtcagccgatttttggcggtaaaccttacgtggcttactcccctccgaagggcccaccacgccgcgttcctccatttcgtcgacgatccgtgctgcccggttatacccgatacggaagcgtcgttggagcatcgagacactggcggactgttgatcagtcaccaattcaacggcttcggcataatactcatcctcaccgtcacgagggtccccactaccagcggcatccgtctcgtcatccttgaccagcatactatcgtcataatcagccgtctgttgggctttgataaagttgacaacttcttcaacatcatggtcagaaatataagcaccctgcacgcgcagtggcttattcatgcccattggctgatacagcatgtccccacgaccaagtagcttttcagcaccgttactatcaataattgtccgcgaatccgtcccacttgaaacggcaaatgccatccgtgacggtacattggctttaattaatccggtaataacatctaccgacggccgttgtgttgccaaaatcatatgaataccggctgcccgggccatttgacccaagcgaataatggcatcctccacttcgctcgaagtgaccatcattaaatcggctaattcatcgacgaccaccacaatgtatggtaagacgggccgtgactgcccatcagccgcattttgttgacggatatattggttgtacccctgcatgttacgctgcttggaatccgcgaacaattcatagcgtcgctccatctcggcaacgaccttatgcaacgcccgggccgccttcttcggttccgtgactacgggcgtcaacagatgtggaatcccattgtaaacccctaattcaacctttttagggtcaatcagcataaacttaacttgacttggtttcgtgttcatcagtagccccgtgatcatcacgttaatggcaaccgacttcccactcccagttgaaccagcaatcagtaggtgcggcattttagacaagtcggcaacgactaaattaccagaaacatcacggccgagcggtacggccaacggtttggtcgggtgcgctggttgggcctcaacgatatcccgaaatgacactgttgaaatctgtttatttggcacttcgattccaatcaatgatttaccgggaatgggcgcttcgattcgaagatccttcgctgccagcgctaacgctaagtcgtccgctaaattgacgaccttgctgaccttgaccccaacagctggatgtaactcatacttcgttacggatggccctaagctgacattcttcacttcaacttgaacaccgaaacttgccaacgtggttgttagcttctgcgagttactctcaatcgttgcgtactcagcactctgatccgtttttggaatcttcgtcaatagtgttgactctggcaactggtagtccgcatcatccatcacttcagtcccttggagttcttgttcatgatcaaccgtagcagctgaagttggggattttatgggcaaggcttcacgatcactagccaccgtgatattcaagtcggcaggcgagctcgtaactgcactggctgctgagtccggcgccgaagtcccgctcgttgtctcagcaggggctgctgactgtggtacggttgacgttggctgcttctcagtacttgccgcttgattggcgcgcacttgttggtgaacccgccaacgggcaatttgaacccggagcacgtgcgtcagccattcataaccggatcgcagttgctggcccaattgcatcaaggcctgacgcaacgcttgcatcgtcttatggaacggcaaatcaaaggtaatgtagatactggcaaccatcaggatcagtgcgatcaaaattgtcccgacattagccaatagtggataagtgacactatagccagcagcgccgactaatccgccaccaagattactggccatgccccccttggcaaaatcatttttgatcagattccacgtcaacgaccaaaaatcggtatggtgattcaattgattaaacatcgggatctctaatagcaataagtaactgaagaaaaacaagttaccaccgacccaccaccgccaagtcagtcgtggccaccgaccaaaaatcatcaaatatcccatgacgaggagtgttagcccggcaaaaatctggtaggcattcccagcaatggctcggaaaaactctgcgaataccatgcccactaaccccaccttcaacaaggcgaggatcgtgaccaatagtccaatcaggccaatgacattccccgtcatctgccgcttagccgcaaccgtcggcttcttcttgcgcgtcgaggtccggcgcttttttgttgttgcttgtctacgcgccacgcttcgttcatcctttctcaattaatactgtcttcattataacaaactcaagttcccccgtccccatcaaaaaacgcaccctaacgtttagcgctagtgcacgttctgttggttacttcaacttatcattttcatagtggtgcgaccgttcaaggttcgggaattgttgttgccgcagggcttcataaatcacaatcgcagccgaattcgataaattcaaggctcgaatatgtgaatcatcttgaggaatccgaatggccttttcgggatatttgcgcataaatggttctggtaaccctgtcgtttccttaccaaataagaaatagtgatccttacccgtatcactataatcaacatccgtatagtcatgttcagcaaatttagacactaagtacaactgatttaaatcagggatactagctaaaaaatcttgcaagtcagcatgataagtaatatcgacactatcccagtagtccaagccagcccgttttaagtgcttatcatcaattttgaagcccaacggttcaatcagatgcaaggccgtatccgttccggcacacgtccgggcaatattaccagtattcgctggcattaacggttcaaataacgcaatgtgatttgtcaaaataatcgtcctcattcatattagtctctacgccatgttcattcatagcaatcctattaatcataccatgtctatggttcaacagcgaactttgaaactaaaaaacgctttgttcgcattcttaaccaatctttcctatactaatcaccgtacgcgccggagggcggaacaggacgcacactggctgacgaacaccaatctaaacctgacacgttgtcatcatgattcatgccggattaacacgtacaaggcagcattcggatcattttataactcgaggaggaattatctatgaaaattatgattattggcgcaaccggaatggctggctcagccatcaccaaactagcacttgaacggaaccacaccgtcgtagccatcggacgttctgaagaaaagctagccgctctaccggctaacccaaatttgcagaccaaagctaaagacgctttcgatctcacactatctgagctacaggcggttgacgtggtcgttgacgcaatggcgactagtcctgataaggcttaccgacacgtggatctggcaactaagctgatcgctcagctccgcgaacaacagcggccacgtctcctcttcatcttaggggccggtagtttaacaactggtgatgatcaacacctcttcgtgcacgacattgaaagtaatcccgccaatgctgccttcgtcgccattccgcaaaaccaactggccgaactgaccttcttacgaaccgtcaccaacgtcgattgggttggaatttccccggccgccaatttcacagcaggtcctgctaccccggcccagtacggccatgacacattactgacgaacactactggtgaatcagtgaccaatagtggcacgatggcggtagccgttttaaacgaactggaaacgcccaaacatcatcaagaacgctttacagtcgctaaccagtaaacgtcttgcctagcagcgctaaaatatcgagtggcagccaaaccacaagccgagcgctacttgagcaatttagttaactgtgacgcgctttaaataagaccaattaatcccgccagaatctgacgggatttttgtggcgtcgcaattgctggcagtatttaacagctaagtgctgccaccgccccatctctcctcattgcgacagtcgtagccaacattgtcactaaccagttggttgcattacaccgccagttaacgccctcaccgacctttaattaattcttcaccaaagcatgctaaactattgccatgtttatttgaaagtggggataccatgaataaccgtttatcaggacggaatttactcttcatcggcaccatgttatttggactatttttcggtgctggtaacttgatttttccaatttttctgggccagcaagccggccaacacgttggtgcggccattatcggactattgatcaccgggattggacttccattactaggcgtgatcggcatggggctgacgcgcagtcagggcgtatttgacctggcaacaaacgttagccgatcatacgcgtatgtcttcaccgtactgctttactttaccctcgggccactttttgcaatgccacgattagcaactacggcctttcagattggactggcccccttcttaaccacccaattacaacccgtggtgctattgggcttctccgttgcttttttcgtcgtcacttggttactggctcgtaatcccggtaagattatgacctatgttggtaagtggctgacacccatctttttgctattattaggtgccttaatgcttgtcgctatcattaagccactgggatcacttaacgtcgcggcgagtggcgcctatgtcagccatccagttctaactggttttactgaaggctacaacacgatggatgcgttagcctcgctagcttttggcatcgtcgtgattgatgcgattcgcgacctcggtgtccgtgatccggggcaaatcgcaactgataccattaaagcaggtctaatcagcatgagtttaatggcagtcatctatggcctgctggcgattatgggtaccatgagcttaggtcgctttgctccagctgccaatggggggattaccttagctcaaattgccgatgcctacttcggccgattcggtaatgttttactagctctaattgtcatcatcgcttgcttaaaaactgccattggcctcacttctgctttcggtgatacgttgcatggcatgtttcctaagatttcctaccattggctgatcaccatcgcttgtctcattccagccattcttgctaacgttgggctaactgaaatgattacttattcaaccccagtgctgatgtttctctacccgctcgcaatcgtgttaatcatactggcagtactggcaccatggcttgggatgtcccgctggttatatggaatgacaactgtctggaccatgattccggccattcttgccggcattaacgctatgccatccgcctgggtacaagcatcctggttgcaagctttgcttcatctcaacgcgtggctaccgcttgccaatctagggttaggctggagtgtacccgcactgctaggcttcggtttagggtggttgatcagccgtaaacaaccatctgcttctaaattgcattaatatagcgtcacatataaaatagcggaccttctgatagccatccacgacttttcagaaggtccgctttaaattacgagagccatgccaattgactggttgccattgaacctcaccggtgaatcatggcattattcaggactggtatgaatgcaatagcaacacatggtcacacctcaccgtcagcttttgaagacacaaaaaaacgtagtatttcggtgtgggcacggcgaaacgctacgttaatgaagtacaactcggtagtcaccaacgacatgtcgatgttaactaccaaacgatttctcaaaggttatcttaacaccggcgtttcaatcatgcaagcacccgcgctaacctttttgcatcgttaataaactcacatcaacggtaatcttagttaacccctgccgtttagcggttgcgagctgctcagcatccgcaccccagtgcagcggtgtcatgactaataagtcgttaaagtcaatgttatcaagcgcaacttggtattgaattcgttgccgcttagcagtgggatagtgctgggcaaacagatctaacacccgttgattatcatactgatactgtcgatcagtcggtttaaatagtaaatgacgcagttcaactaagtactcaggatttggcacgatcttcaataactgtccaccgggcgcaaggacccgttcaaactcttggtaagcggatggtgagaagacatccataatggccgtgaatgccccatcggtaaagggtaattgggccaaatcggccacacaataataagcagtcgtcgtcaattgggtcgctaagttaaccccatccttactaatgtcaaaaccaatccccacgtcttcagaattggcatgcattgtcaacaaatcagctaggggggtgccttcaccgctaccaatatctaagattcgttgcgccgtttttggcaatgccgcattaatggcttggacaatggggccgaaaaaaccagcttgcaaaactcggcgccgcgctgccagcatgttagcatcgtattcgctagcgacttgatgcgtcagaaaatacaacgtccctttttttgaaaaatctacttgatgcccattaggacaacataagctgtggccgtcaattgtcacatatgcttgattacaaactaagcatcgaaagcgatcgatatttgcctgaacaaactggatgccgcggtcaatttttttcacaggtgtcaccttaccttggttaattttatcattaggcgtcccatatccaagcgatgctttccagcttacctgaaactatggattcacgatgacaacatcgtgtaaaggacgtatgttcaatcataccatatcggggcggacaaaatagtagctgttacgatttaggtgtggtatcttattaactgttctaaaggctgacttaaattgtcaaaatgaatttgctaccgaatggcatgaatttaatgacataaaggagactcattcagatggcaaagaaatcaaaaattgcgaaagaaaaacgcatcgaagcaaccgtggctaagtatgccgaacgacgccaagcacttaaagctgctggcaactataccgaattggcaaaattaccacgtaatgcttcacccgtgcgtattcatcggcgcgactcacttgacggtcgaccacatgcttacctacgtaagttcggcatgtcgcgccttaactttcgtcgcttagcgcacgctggtcaaattccaggtgttaaaaaagcaagctggtaaagtgacaactggcgtgatattcactaatgattagtaacatcaccattcagttaaattaaaaaggttccacagaattgtcatcagacttctgtggaacctttttaatttggcgttattggtttaatcgcgtttcagcgccatctgagtagccaacaattaccttacttgttagtttgatcagttgatggggttgcttcagcctcatacaatcccgaagaccgtcgataccagtcaaacagatgtgtccacaaaactttcaagatcgcatagcctggaatcccgaaaataacccccatcaacccgaagattttaccagccgctaataggacgactaaaatcgtaatcggatgaatagctaagctactccctaagactaacggtgagataaagcggccttcaatcgtttgttcaatgacgaagacaatcagaacttggaccaacatccatggtgaggtgactaacgcaatgaccactgaaggcaccattgcgagaaaagaccctaaatatggaatcaaatttaagattccagccgcaattcccaacgtcagcgcaaatttcaagccaataatactgtaaccaaccgcaaacatcacggcaacaaagaacgccacggtcaattgaccacgaatataattactgacctgtgaattgatttctgtcaaaacttctaagaatcctgagcgcgctttggtaggtacaaacttagccatatacttcggtagttgatgaccatcgcgcaataggtaaaaaagaataaacggcattgttatcaacccaatgatgacggtcgttacggtactaaatacgcctgtaagtgaagtcaccgtcccggtcaaatacttcgaaaagcggccactcactagcttactgagatccgtgttccaactttcaagttggtcacggatactactgagttgcggatcattgagccagcgattaacttcagtactggcatttttccaataattgggccagtcattgataattgataaagtttgatcgcgaatcgttgggataatcgcaataatgcctaacgccaacagcgcgacaaccacaataaacaaaccaatgatcgtccaggttcgtcgtacgcgaaaacgcttttctagccagtcaacaagtggattaagcaagtagtacagcacaccggccaaaataatcggcaaacccacgatgctaaaaaattgccggaccggatctaatagccaatcgacttgcttgcccataaagaagatcgtcaatactaataaaataacgaccaaaatccgaatgagccgttgcgctgaccaccgttgtttctgtgaatcaggtttcaaacaatccctccttcctaagcctgatacgtaataacgctaccgaccttgattgttggtaactggtttggtgtcaaataaatgccgttttccattggtttggcaggtactggtttgaagtacaacgtcgcgtgcccaattgacgttaaattagcttccactagtccccctgcaaaggccaccgtataagtttgtcgatcgatcgtaatggtgctaccagcaactaacgacagactcgcgatgggctgctcaaatttctgaatcaccgcgatttgctgtaatggtgccgtggccgtttcatcgaataaaactaaaattggttccttggaatcgatagcactcgcaccaatcgattgtactgttgcagttattgtcatattgagacccccatcggttaattaattgctttaattgtagcatagtcctaatcacagacgccaatttgtcatcgcttacacgggccatatctatgctatacttgaattatctatcaaggaggtttgttatcatgcaagaacgcattttattcggaacatatacgaaaaaaacaagccaagggatttaccaaggaacccttgacaccactgccaaaaccttaaccaacgatggcttactggcagccactcaaaatcccacctatttggccctctcagctaaggattgcctatacagtgtcgataaggaagatgacgagggcggtatcgctgcttggcaaatcgacgggcaaactgctcacaaactaaacaccgttgtcgcacctggcaccccaccagcttacgttgctgtcgatgaggcccggcaactcgtctacagtgccaactatcataagggaacggccgaagtcatgaaaattgctgctgatggcgcgctgactttgaccgatactgttcaacatagtggccatggccctcgtcctgaacaagacggctcccatattcattacaccgacctcacgccagataatcgcttagccgtaatcgatttaggtagcgataaggtctatgtctataacgtcagcgacgccggtcagttaagtgaacaatccctgctcactatggaagctggctttggaccacgtcacctcgtgttcagtccagacggccaatacgccttcttagctggtgaattatcgagtcagattgcgagcttaaaatatgacgcccaaactggtgcctttacgcagcttggcattgtgaagaccattcctgccgactacacggcgcacaacggtgccgcagccatccgcttaagtcacgacggtcattttctctacgtctccaatcgtggctacaatacgttagctgtctttgcagtaaccgccgacggtcatttgaccctgattcagcaaatcagtacggaaggtgacttcccccgtgattttgatttagatccaactgaagcctttgtcgtggtcgttaatcaaaacactgataatgccactttgtatgcacgcgacttaacgagtggtaaactaagtctattacaaaaggacgttactgtgcctgaaggcgtttgcgtccgtttctagtaaaggatgaaactcatgttattaaaagaagtctgtgttgaaaattacactaacattcccgcagccattgcggccggtgccaatcggatcgaactcaacgataacctatccgttggcggtacaacggtcagtcgtggtgtaatggctgaggcagccaagtataccagtgaacatcacgtgcccctagtgaccatgattcgcccccgtggtggcaatttcgtttataatgatacggaattaaaaatcatggaagcggacctgctacaggctcaatcattaggtgttgatggtgtcgcatttggtgctttgactgcggataatcagcttgacgaagaagccttagcgttactaattggtgcagccggtggcatgtcgatcaccttccacatggcttttgacgccatccctgaaaatcaacaagccgcggcaattgactggttagtagaccatgacgtcgatcgcattttgacacatggcggcccacttgatcagccgattgctgactgtgtcccccacttgcaaacgacgatcaaacaggccgctggccgaattcagatcctacctggtggtggcattaccaccgccaatgtcgccgacatcaccacaacgctcggcgtcaaacaggcccatgggaccaagattattaattactaagaactgccaaaaaggcgcatctcattttttgagatgcgccttttgattggcgaagtaaactaaaaaattagaccattaatcacggttattcaatggtctaatattggcacaagcgcccgcactaagccaacttgccctgagccctcttccgcaacaaattggtcattgtcaacgctggtcaattggctcgtgttcatcatcaatcatgctaattaggataaacataaaacggaccaaatcttaatggtcactttatgaattggcacgttgattatgaataattaaacggttaagatcagccggtaatggtgcaaaggtcgtgagggtctggctaatgaatggatcatcaaattccagttgcatgcagtgcagtgcttggcgctgaatccacgggtcacgaggaccgccataaagggcatcaccgatcaatggatgaccgctagctgcaaagtgcacccgaatctgatgcgttcggccggtatgcagccgtacccggacgactgtcatgttacgcagccgcttgaccacccagtactcggttaaagacggcttaccgtcgggacgggtcgttcgtttgataaatgaatcagcggcacgaccaatgggcgcatctagccacccgtggtcagtcgtcaattcaccactgacgacggctaagtacattttgcgcatcgcatgggccttcaattgatgatcaataatcgaatgggcaaaatggtgcttagcgaagagaacgataccgctcgtatcccgatccaaacgcgtggtgatatgcacaacctcattatcataatgggccgcttgataataaccttttacccgattcgctaaggtattgtcaggtaaggcatgcgccggtactgaggccactcctgctggtttattcacaatcaggtagtcacgatcctcatataagatatcgatcggcaacgtcgagacgcctaagtggtcattaccaatttcagcaggtgtgaccatcgtcacagtctcaccgcctgtcagcatatgaatcgctaataccggtcgttcatcaacgagaattgccccaccatgaaacttaacttttttcaacaaactacgtgtcacaccatgttgtgccaagagtgtcttaactttcatcggggtcgtctcatggttgatccaagtaaacctcattgctcgtccaacccgatgaaggatgtcccgacccgttgccagaagcgattatgacgatgctgagcaaatgcaattcgacgattagcaattgaataacgaatttgttcaattggccgcggctgcgtatccatttgatcagctgtaaagacaaagtgtgactgctgttgtggccgaatcgttattgtttcatacggcgctacgatgactggcgagcctaatgttcggaagactcggttgttgatcgacgcaatctcggccatttgtaaagcgtccaagcgcggatgaatgacagcaccaccaactgacttattataagccgtcgaaccagttggagtggagacgcataacccatcgccacgaaaacgttcaaatagttcatcttgaatataaacatcggcaaccatggtactcccaagcttcttaagcgttgactcgttcaacgccaaataatgatcagtcgcatccgtatccgcataagtaatatctacagctagcaagggataggtcacactctggccgttgtcttccagtaaaccgttgatcagttggtcgatttcataatctcgccagtccgtatagaagcctaaatggccagtatgcacgccaacaaagcgaacttggtcaaccatgtgactatagtggtgaaacgccgctaaaagcgtcccatcgcctcctaccgacaaaacaatgtctgggtgctcatcatcaatttcaaacccggcagccagcagtttagtatgtaactcacccgctactttcttggtcttggcactcgcatttgcaaaaatcgttactttcatgaattttgatcttcctttgtcgtgtcaggctcatcgttgcccggccccttcccatacgagaacaagctctgagcttcttgaatttcctcacgaatttctgacatttctttatccaaactaaaggcggcttccgcagcccgttgtaatcgttgactcaagttttcagagaaatccccttgatatttatagttaagcgaatgttcaatggtcgcccagaaattcatggcaagtgtccggacttggatttcggccaaaattttcttttcaccaccgaccatttggaccggatattcaatcacgatatgatacgaacggtaaccagatggcttttcattactaatgtaatcgcgttcttccagaattgtcatatccgtccgttttcgcaataaatcaacgacctgatagatatcctcaacgaattgacacataatccgcaaaccagcaatatcctgcatatcttgttctaggcgatcttcttgtactttacgtcgggtcatcttttccttaatgctatcaacgggtttgacccgccccgttacaaattcaatcggttcatgctgattcaaatcacgaaattgtttgcgcattccccgcaatttaactttaagctcatcaacggcttgctgataaggcagtaaaaaatgattccaatcttccatcggggcacctccgtttcaatccataccctaaaattttaccataaatcgtcggaataaaaagttaacgttctcgagattgaaccctaagttcactttttttccaaactgtaatcctagaaacaaaatactttacgaatttagcaaatcggtgcatgattacgggtgaaggtttaagctaagtaacgagtgattttctgcattaaaaaatttatgaaatgaaaaacttgcaaatacctcgtttgattggtattctgcactatgacgcgaatagagaaagtggaggaattataacgtgttagaagtgtatttatttgtaaatccgttggcaaaccaatgcgtacgtgatgagcaaaacgtgttacggttggcaaacgactcagacaagcaaatccaatttcaattcgtaccattactcaatattaatgtgattcaacgggctctaaagtgccaaggaatcaaggcatccgactggcatgctcaaaatcaacagtctcaaacattgtaccgagttattttggattataaagccgccctttttcaaggcaaaaaacgggggcgtaactttttaattgccttgcaatctgcaatgctcaaggctggtcaacactattcggaagagctcgtcaaaacggttgcaactaactgtcagattgacttagacatgttcatggaagatcgggacagtgacttggcgaaacaggcctttcatgctgatcagcggcttgcatctgaaatgaacattaccgaagcatcgtcggccgtcgtttttgattgcgaccaatatgattatggtgtcttgctagaacattttaattacacgactctttttgacttagtcaatggcaatctggatccttttcaagatgcaactcgggcaaccaatgccagctgtgctagccttgccaacgcacaattacacgttttataattccagtaattgcaattattcaactggtcctaccagtcaaaagcacccgacgatcattttcgccgggtgcttttgactgtatttaccttttatagctgccagaataagccttctggactcggcagctaacaccctaactgataagcgggtcaggtgtaaaataagcgtcgggaccgaacatcctgacgctcattgtgcttgcttttataactggttaatcttgggtgaccaactgttcaaattcatttaatcgttcttcaaatacctcgaaagctgcatcaagataatcaggcttggtcatatcaactccagctcggtgcatgacatcgattgggaaagcagatgaaccagctttcaagtaaccgagataatccgcaacagcatctgtctgttgcgtactaatacggtcagccaacgttgaggccgctgcaaaacccgtggcatactgataaacataataattgtaataaaaatgcgggatacgggaccattcgtcggcaatttgcggatcactgacgacggcgtcaccatagtagcgttggttcaactgcaaataatgttttgacaagcgatcggcagtcaaagcctgaccttcttgatcttgctcatgaagccactgttcaaactcagcaaattgcgtctgccggaaaacggtgcctttaaatccatctaagtagtaattcaagacatacgcccgcatttttggatcttgttcagtcgctaagaaatagttcgtcaacaagttttcattagtcgttgaagcaatttccgccacgaaaattgaatagtcaccatactgataaggctgatgatgtgtcgtgaagtaagagtgcatactgtgtcccatttcgtgcaccaacgtatataaattatcaatattatcctgccagttcaacagcatgtatggcgcggtatcatacattcctgacgaatacgccccgctacgtttgccttgattttccaccacatcaatccaccgtgaagcaaacgctgttttgacgtgtttgagataatcagagcccaaaattttgagcgcttgtaaagcagttgcttgagcctgctggtaggaatagttggtcgtcggcttgggtgccaatggcgtgtacatatcatacatatgcaactgatcaactccgagcagttgtttccgtaacgcaacataccggtgcaataagtccaaatgcttgtcaacggacgtgactaaagaatcgtaaaccgccgtcggaatctgattggcagcaagtgctgccgtccgcgcatctggataatgatgagcctgggcaacaaaattgtgtaccttgacttggctagctaaagtcgaagcaagtgttcgccggaactggccgtatactttatacagtgcttcaaacgcctctcgccgaacagccggatgaacggactcaagtaacaccccataaattccttgtgacaatttgacagggttgccgtcgtcatcctttaccgttggaaattgaaagtcagcgttattcagtacaccaaaagttttcgcagaagcaccaaaaatatcactagcgcctgcgagtaaagcttcttcgctttcagacagaacgtgtcccttttgcaaccggatcgtatccaacaaatgccgataatcacgtaaatcgacgttttcatcaaggtacgtatccaattcgcccggcgttaattccaagattgctggttcgaaccaggcagtcgctgcggataccttggcagtcaaactactagcttgatcgtctaaagccgcattggtactattgccagtatcctggtcacttttcagacttgcgtataccgccactttctctaaccgacgatacagcgctaaaacagcctggatgccagccagcaccgtgtcggccgagcttgtaaacgtttctttaagcgcagtgacggtggggattgcagctttgacttgtgcaatatccgcctcatacgcggcctgatctgcataaatgggcgtcaaatcccacgtcagttcttcaggaacggccgaacgggtcggcaattgtttggttgctaccatgcaaattcctccaattatttcaatatagcactagattaccacagattgcgcctatcgcggtagcatctgttccggaatcaatgtttgcgccatcgaagctggccggaattcacatgccactcagttttctgccagtttatcacttgctgctcgctaagcatcgtaatcatggtcgttatcagttgttgtattaacgtgcctcgtgcttgcaggcaggcacgccgggcaagtaatggccgtaattgggcccagatcaatgcctctaattgtggcccagtaagccgtccggactgttgccgcagtgcaaaaaagacgtgggcgtgccagaccagatatggtaccgataacagcggtagttgcggcacagtgggcatcgtccacgtcggtaactggacaatcgttcctccgcgttgatagcaagccacttgtaacgcatcaaaaccacgttgatgtcgaagccgtgccaacattaactgttgataataatgccgtaaatgcgtgtccggcaaagttggggtgttaattttaggagccaattggcgaaaacgtaacaccgactggctgcgcgtatccagtcgaatcgtttgataggtcagcggttccgtatccaatgtcaagacgtgatgcaataaacgaacactagtactttgagtgtccaaaaaaagtagaaacaggccccaccgttgctggtactgcaaaaacttcaaagccttgctattgaggtgcaattgtcgctgataggggcgtcccaacaaccataacacttgatagccatgctgacgatagccctgcgtccgagctgcgagtcgctccactgacaagggtgaacactgaaattctaacgcgagtggttgcgctgtacctcgtcgaaccaagatatccgggcgctgatgtatctctggcaaaccagcctctaagcgcaccgtataaccactggcagcgaaccaggtcgctaattgttgtttaccacgaagatgttccgttgtttccccttcagagaaagcatcacaatccgtggcatggacgtgggcaaaatgtggcacgatcactgccccccgtttcaatcgcaccggctgcacacattctggacagtaatattctatttggcgatcagccgtcgccgcattaacgagttgatgctgggcatccatcgcgatcaacatgatggtccctcccttcaacaactaattacgtcattaaagccaattctcacgcaaacccatcatcatttattgaccccgagcagcacccgtcttttggcaaagcgtccggcaggcagattgtttatccgtggatacaaaaaagccttaacattacgaataaacgttatgttgaggcaattaactgctatttaaaatagtgccggatggtttccaaagcagcattagacatgatcttttcaccatgttcaagtagtacgtcagctgaaatattagctaaatgggcatattccaaggctactgcgacatcatctttgatagtggccgttgatgattgatcgacaaagaaaaccagttctagataatattggtcgcgatacttgaataagttagacgcgagtccctctggccggaataattgtgccaatgaaacaagatcctcaaattgatcgaatttcaacacgtattccttagttggtgtatcaggatcatccaaatacggatcgagatcattagtgtccttagttggattatgtgcaataccttgtccatcttcaacctgattcgtatccgtctgcatcagtttacgcttcaaataatctgaaacatcatcttgtgagtcgctatcatccgattggtcgggtgactgagttgctttagcaatcgtatcttgtaaattatcactgtttttgctaataaataattctaaaccatttcggtttggtaatacttggaaagttacggcatcattgtcctgaaattgatgatcaacatcaacttcctccaagatgctatagaagaaactttcaatttgcttatgattccctagtaaatctagtacgcgaataccgcgttcattgagatcatcatttccaataacgacgcgaatcgtatcttcgttgatgcgttccatctccattacagatccacccctttctaagtgtcaagggccataatcactatcacaattctaacttatttcagtttattgtaaagtaatctatctgaaaatacaaaaattggccaattagttaagctaactagccaatgataatcacatatttgctaattgttgtgcccgtaataattctaatgtccgaattcttcgtggcaagaagcggcgaatctcgtcctcattgtaaccaacttgcagccgcttctcatcaagcataattggtcgacgtaacagactaggatcatgagtaatcatgtcaaacaattcattgagtgacaaatcattaatatcaacgttcagttgttgaaaggcctttgagcgagtggaaataatttcttccgtccctgattcagtcagttgtaggatctgcttgattttttcaattgaaagcggttcggtaaacagattgtgttcttgaaaatcaatgtcgtgtgtctgtaaccaagccttggctttgcgacatgaggtacaacttggtgcggtatataaaataaccatcctgggtcctccttggcatcgttaatcaattttataacataattcattatacgctactcacttttaattgtgaataggtttaacaaaattaatttatttaaaactaataatataaaatacaattattcgatatatgtattttttctattgaataaaccgcttttatagtcattcttgttattaattaattcgtatacaatttaattatgacttatgatatcaataatctattaacggtaaactgacagaaaaagcttagcaaaataatttgctaagccctatcatactagccaagattcaattgtaaaaacttttgagcaactgtcacttgaatgtcattaccggcggctgcttgtgcttcttgttggagttgtgtaaatgagacatcttgtggcaagtgtgtgagcaataattttttgacgcgggcatctttggcaattttaccagactgtgccgacgtcatatgccacattttaccagttttatctgcggcaaaattcgtatcagtcatcaataactgtgccccggctgcgaaagtcgctaattctggcaaataagccgtatcggcggaaaagacaagttcttgccccgtcgctcgctcgaccaacttaacggcataggctggaactggatgtttagtcggtaaaaagctcacatcaaacggcccaatttgattgacagcagccggatcataggcccgaccttctgtggcattcgcccaggtcaaggcaccaaagttaagtggatcagcggtgtgcccgtaaatcggcagcacgggcgtcttccgttcaccagcacgcaactgccagtaatattgtaagaccccaacgtccgccgtatgatcgtgatgataatgagtcaggagcacactatcgagctgtaaggggtctaaaatctcttctaaggcgtttagcgcccccgacccacaatcgagcaataaatggtaatcaccggctgtaatcaggtaagaactcgtacccacgccatcgtatggataaccaccatagtaaccaagaactgttagtttcattattgaccatcccttcatttctctgtccacttctattttaatatagcaccaagaaaaaatgaaaccaacaacttaacatattttcaattattttgaaaaacacgtataataatagatgtaataaataaggagtgatattgatgagtggaaagattgcagcaacatttgggacacgtaaaattctaaccatgatccaacaacaaaatgctgatcgtgacttgttattaatgcaggccaacgccactgaagatcgctatatgctactcgatttaaccggcgaaaaaaccgttttttcaagccccgtaacgtatgacgttttactttcaaaaggatcagctgactggcatggaatgacaagtttcatcttcattgatttaccggaagaagaacaaaaagtctttaaatctaagtttagtagtttccgacacgattataataagccagatgggctgaaacatttttggatcttacgtgagtccaaaaataattcagccttcgtgattgtcacaaattggcatagcgactccgaatatgctgtttggctgcgaagcgcttcattcaagccatttgccaagtacatcacctcagattacggctaccacgaaagtcgctattcatttgtacgttcattaaaatcataatcatccggtattggatatttcaagtcgctgcagtgattgaactgcaacgacttttttcatgaatattacttttactcaacactgctaaatctcatcagttgatatataagcctcgttcacaacatcacatcgcagtcagaaccaacatatgtcccgatcagtgtgatcctaaagaatctgccgtcagctttagttgagcaatcgtgagcccaatcagccatctgttgaatgacacccaccctatttactgattacagtgcgcacctctttaggtgatctcgtcaaacagttaatattctgaaaacacaaaaaaacgtcattcatcaacgaatgacgtttgtgacggtccgtacgagactcgaactcgtgatctcctgcgtgacaggcaggcgtcctaaaccaactagaccaacggaccaattgcgggagcagggtttgaacctgcgaccttcgggttatgagcccgacgagctaccagactgctccatcccgcgataatataatgacccctacgggattcgaacccatgttactgccgtgaaagggcagtgtcttaaaccacttgaccaaggggtcatatttttaaatggtacaacggagaaggagggattcgaaccctcgcaccgcttgcgcgatctatacccttagcaggggcacctcttcagccacttgagtacttctccaaaatgggcctaaatggacttgaaccatcgacctcacgcttatcaggcgtgcgctctaaaccagctgagctataggcccaaaaaaagcgggtaacgagaatcggactcgcgacaacagcttggaaggctgtggttttaccactaaactatacccgcagaatacagatatggcgcgggacggaatcgaaccgccgacacatggagcttcaatccattgctctaccgactgagctaccgagccattgtagccatttagaactattaacttaacggtccgtacgagactcgaactcgtgatctcctgcgtgacaggcaggcgtcctaaaccaactagaccaacggaccaaattgcgggagcagggtttgaacctgcgaccttcgggttatgagcccgacgagctaccagactgctccatcccgcgataataaggaggatgagagattcgaactctcgcgtggtttgacccacctgacggttttcaagaccgttcccttcagccagacttgggtaatcctccatatgatgtaactaggaaatgtccactattaatagtagatggaccttgtagggctcgaacctacgaccggacggttatgagccgtctgctctaaccaactgagctaaaggtccaagctctaattcctatcgcggcagggggaatcgaaccctcgacctcccgggtatgaaccggacgctctagccagctgagctacaccgcgatgtgttaaataatcgtatatgactacttaatcgggaaaacaggattcgaacctgcgaccccctggtcccaaaccaggtgctctaccaagctgagctatttcccgttatatgcacccagtaggagtcgaacctacaaccttctgattcgtagtcagacactctatccaattgcgctatgggtgcttcataaaagtgccgaggaccgggatcgaaccggtacggttatcactaaccgcaggattttaagtcctgtgcgtctgccaattccgccaccccggcaacactttggaacaaagcggaagacgggattcgaacccgcgacccccaccatggcaaggtgatgttctaccactgaactacttccgcataactattcagttaatgccgactagaggattcgaacctccgaccccctgtttacaagacagatgctctgccagctgagctaagtcggcatgacgattaacacaactataacatcatatcatgctcagttacataaatcaacaataacttttgtgaaactatttaattatgagccgtgaacaatgagccgtgacagtctcgaactgtcgaccctctgattaaaagtcagatgctctaccaactgagctaacggctcatgatggaggatacagggctcgaacctgtgaccctctgcttgtaaggcagacgctctcccaactgagctaatcctccaatttcgcatggcaacgtcctaccctcgcagggagcgatcccccaactactctcggcgctaagaagcttaacttctgtgttcgacatgggaacaggtgtatccttctcgccatcatcaccacactatgtgaaactaaatattaaattgaataatatccatttaaccttgcggttaaatgagccgtgacagtctcgaactgtcgaccctctgattaaaagtcagatgctctaccaactgagctaacggctcatgatggaggatacagggctcgaacctgtgaccctctgcttgtaaggcagacgacctcttcccaaaacggcagctaatcctccaatttcgcatggcaacgtcctaccctcgcagggagcgatcccccaactactctcggcgctaagaagcttaacttctgtgttcgacatgggaacaggtgtatccttctcgccatcgtcaccacactattgagaacctatggctctcaaaaactagacaatccaaaatcctaatatgaaccggaacaccaattactgtggttaagtcctcgaccgatagtattagtccgcttcatgcgtcaccgcacttgcactactaacctatctaccgatcatctttcggggtcttactccataaaggaatgggaaactccaatctcgagggtgtgtttcacacttagattgctttccagcgttttacacatccctacgtttagcctacccgcgatgcctgcctggcggcgcacaatggtaaacaccagaggttgtccatccccggtccctcgtactaaggacaggtgcccttcaaattcctacgcccgcgacggatagggaaccgactgtctcacgacgtctagcacccagctcgcgtaccgcttttaatgggcgaacagcccaacccttgggaccggactacagccccagggcgatgagccgacatcgaggtgccaaacctctcctcccgtcgactgtggaactcttgggggagagtaagcctgttataccccagggtagcgtttaccagttgagcgatggccttcccatacggtaccgacacggatcactaaaggccgcgacttcgtccctctcgacatgtctgtctgcagtcaagctactttgccttacactctgcgatgatttccaaccttctgagggacctttggcgtcctccgttactttttaggagggcgaccgccccagtcaacgccacacctgacactgtctcccaccacgattagtggtgcggggttagagtggtgctacagcgagggtagtatcccaccaacgcctccacgcaactagcgtttccggtttatggctctcctacctatcctgtacaactgtacaaacacatcatatcaagctacagtaaagctccatgggtctgttccgtccctgtcgcgggtagtcgctctcacggacaataataatattcattcatcacaaaattctgagtctcgttgagacagtgcccaatcgtatacgcctttcgtgcgggtcggacttcaacccgacaggaagtttcgatacacttaggccgttatagttacgggccgccgtttactggggcttcaattctgagctttcgccgaagctacccaatctttaaaccttccacaccgggcagtgcgtcagcctatatcgtcacgtaatacgtttttgcagagacctgtgttttttgataaaacagtcgccctgggcctcatactgcggctgatcttgcgatcatcccccttctcccgagtacgggtcattttgccggtttcttaacgaagttcactcgctcaccttaggatctctcctcgactacctgtgttcggtttgcggtcgggtagtgttaagtactcctagaagcttttctttcggcagttgtgacatcagaacgcttcggactaatcgtaaattcgctccccctccacagcttgtccgttaaagtgagggacaagcatttgactcttcacaaacgtactgcttggacattcaatccacaacagaagcactccttagcctccttgcgccctccatttgctcacaacgcacttaactagtaacaggaactcaacctttatccatcgtctacgcctctcgggcctcgacttaggtcccactcaacctgagaggacgagccttccccaggaacatttagtcattcgtggtatgatctcacactatcttttcgctactcatgaccggcatctcacttcgaacgctccacaaggcctcacgatctgccttttcacgcccttagaaacgcttcctatcacgcgacctaatggtacgcatccatggttcggtagtattcttagccccgggtacatttcggcggcgaggatcacctcgcactagtgagctattacagcactcggctttaaatggtggctgcttctgagccaacatctgttgtctatgcaatccacatccttttccacttagcatacattagggaccttaactgatggtctgggtgttcccctgtcgacggttgatcttacactcatcgtctgacgtcccggatatgaatcaatgagcatcggagtttattctgaattacagaaccaagacgggcccctagtccaaatagtgctctaacctcaacctcgatcctgaattccattcgaggcttagccctacacagctattcggagagaaacagctatctccagttcggtttggaatttcacatcaaacactaatttccaacaccaacctctatccacctcacctccagcaattttcaattaccacgggtgtcggtcctccagtgcgtttttacacgcatccttcaaccggtggacatgtgataggtcacctggtttcgttcagggtactataacctcgtactcaaaaacgccccatttcagactcgctttcctacggctccgacttttttagtcttaccttgcacggatcataactcccgccggttccattctacaaaaaggcaacgccatcacgcatacgcgcgtctgacttattgtcggcaacatggtttccggaactatttcactcctccagggttctttttcacctttcctcacggtactggttcactaatcgagtcatagtgtgtatttagccttgggagatgcgtcctcccggatgttccgacggaattccttcaacgtgttccgccgtctaacttcaggatcccgaactgagagaatttggctttacaatcgactggctacatcaccatctatggccggatttcccaatccttcgactaatcaagttctttggtgtaactcaaaatgttcagtcgcacaacccaaagtgcaagcactttggttggggctgttccccggtttcgctcgcccgctacttagggaagcgaaatttctttatattcctgctgctaattggagatgtttcagttcacagcgttacctccaactagactatgaattcattaagtggtaaacagttgattaaaactgtgggtgtgccccattcggaaatctccgatcatagcttacgacagctccccgaagcatatcggtgtttagtcccgttcctttcatcggctcctagtggccacggagcattcaacacatgcgcacttgttaacttaaacctcatttacctaacggttaaaatgcgattcctgacttatcga

SEQ ID NO: 717 - DNA, 82819 bp, Unknown
  Metagenome-assembled genome
gctcaacatctaaacgcatttcagttcctccaaatttgagatgcgtttattttaccgtaaaaaaatgttggaaaaccgacattttctaatcggtattttccaacattttacaaccgttgctgatattaagataaattcgtaacatactgcctgttgttaacgtagaatttgagaggatgattctgtttatggcaaaaggttccattattgatggtgtgttagtttagatgattagattttatatgtcactaagtgttgtgaagcatacgatactttatttgtgttttatttttctattactgtatttaaaaaagcgttatccagacaatgtaattatcggttttttttaaaaatacggtggtgttttattaatagtatgcttcatttacattttatcgcaatttggattgccggttaccgcaatcgatgttccaatagttcttggaattttaggtatttcggttgttgtgttgagacacaagcaaaagtaggacgaactgctaccaatctgttgcttacggagtcatgataactcatggctctttctggtttttatctaatattgacgtccctgataacgtactgtcatcaaaggacttcatggttcagaccctgtttctgggtcattccatatgagcacctaattggcggtaaaagtattaaaaatcagtggctgatcaactatcggcattcgtgcgctttagaaattaaaatggcagataacccggagcgctgagcactttaatacagttttttaccaacatctcaatcaccgcgacggctaatcagatcaaaaaagcgctatccaaatgcacttatgcattcagatggcgcttacgattcgtcatcagctggaagtcactttttcagcaacgacatcattcagaattttcgtggttgctgaatgatttatgcactcgctgtgacagcaactttgaaataatgtggattactcgttgctagttagacttaattcattcataaaagtcaataagagtttggcatagctgggatggtcggtgttgctcttaacttcttgctgcatttccgttagattatcagtgactacgccggtgacgcccatgaacatcatttgatccatttggtccgtattatcaatgtcccaggcgtaaaccgtcttgtgattgcggtcagccttgtcaacgaattggtcgtttaatgtggtgacctccatggtgtagccgttcgcgactgtatgcgggaacgtgagattataaggcaagatgtaactaacgaattgtttttgatctaagcgtttcaagtcacgcatgactttgaaactaagcgtatggacttggtcatgatgagccagtagggtcgcaccataacgatcgatgaaccgtttagtatcggcggcggtgtaagccgagctggtcttgatttcgactaatagtttttgatgatgcttgtgagccgctttcaggtaagcatcgaaacttggaatctttgcctgatagccattttcacgaacagtaattttttctagttgttttaatgttaattgagatggctttttcttaacgccagctaaggcttttaaggttggatcatgcatgacaacgaattgatggtccttggtgacttggatgtccatctcaacgtaatccggatgttccttgctggtcttgatcagtgcaggaattgtgttttgcacgccgtttccgttatcgacgccgcggtgggaaatcatgattggcttggtaatcactagtccatttaagtagactaaattaacggcaactagcaaacttgtcgctaacagcaagccaattgcaacactcgcccgggtcaatttgcgcaaccgtggtgcctcgttaaagtattgcggttgttggcggaggagtgtaaagtcttgacgatagcaaacaataattaacatcatgaagatggccgtggtataacaaataataatttcggtgattgcttccatgataaagagattaacagtggcagcggccatggcaaaacttgttttatcgaattgaagctgggctacgtaaatcaacgtataaatggtcgtgacgatcagaaaaatcatgaataaggtcacaatcatggtccacaagtagcgccaaagatggtggcgcgtttgttgccaactacgagtaacggccgttttccatggaagccgatcgacaatcattagcggtaataggctaattaggcgaattccaaggtaaccagccagtaagtagaagcaccccaagccgagcgtcatccacgggttttccatgagatagctgacaatgaaggctggaattttggccttgttgagtaatggtgttgtaaagatgaaacttccaaatggcaaaatcacaataaagtagccgataaagaataagaaagtgctgggtgaggtgccagtcagactagtgaccgttgaccgcaagaccgcgcgcacagtttgtggtcggccacgaaagatattcataatacccagtagcagaaaggcaaattgccaataaactaaaataataatggctaataagatcgccaccataccgagtgcggccagtggttggtgaataataatactaccgatattcgtgtacgagacataactgacccgttgccacttgagtaacatttctagcacccaattaaaaaaaggaattgctaggtaactaatgaccaaattggtactaaatatcagggcaacgtaactgccccagttcttataaaaacggcgggtactatcccaccaaaaacgccaagcgcccatgcgtggtgcctcctcccttgatccggcattgacgaatcaagtcattattaattttattgtaacacgcattgtgttagttatttttatctaaataattgcttagattagtcactctaggaaaccactttcaactaagcataatggggctaccgagcacgtttcggtaacccgcgcgaatggctgatgaacggcactgaacttaagagatggcacgtgttaatcatcgtaatgcgcaagcatgagacaaaccacaattagtattttatcatgcaaccgatgccagatggatgagggcagcgtcatatttaaaggagatcataaaaaggcgcgatggcaaataaattgccgtcgcgccttgcattgtaaatggaatgcttgttgctatttggaactgctagagctagtcgtggtactatccgtatcatcagggttggtaatcttgatacgagtagaatcagtcttcttatgcgaagcttccggtgcgtcggtcgtatacaacgagtccgttgacttattaccattcttcgagtagagactggttgacttgccagctaatttattttgaatctgaatttctttttcaaggccatcggcgtaattgtaattagaagcgtcgactttcttgaagcccttaggggtgtagaaacgtaacaaatttttattgttaagtgaatcagagaggcttaattctttgtcgactttcttctgatctttatcaacagtcttctgaactgcctcatcatcatcaatcgtttcgccagttgcgttgtcataaattttgccgctaaggacggtgtatttagacgtgacgaaatcgcgatttctaaacgcaacggtactatcgtgttgtttagagaagaggtcggtcccaaactgaatataacgtttgcttgaaatccctagtaagtgcagaatcgttggtaggacgtcaatttcaccgccataagtcgattcgactttaccactcttgattcctggaatattgatcatgaatggcacacgttgaagctgggcgctatcaaaggaagtccaatcgtccgcagatttaccgagaataggtgccaaggtcgagttttcactgttggataagccgtagtggtcaccatagagtacgagcatcgaattctttaataaaccagccttttgcaagtaggtatagaattctttgacggattgatcgaggtagtgggcggtctggaagtaaccgttaatggcggaatcactagtatccgttgtcttaaacgtcgtgtcttccttatcaagtgtgaatgggaagtggttcgttaccgtgatgtatttgacgtagaacggttgttgtagccgttcaagatactgaactgaattcttaaataacagcttatcctttagaccatatccagttgatttatcaccagtcgtatcgaaataactggcatcaaagaaatattggtaccccatattcttatacgtgttatttcgattccagaaactggccacgttaccgtggaagacggcggaggaataattggcccgttggtttagaatcgcgggagcggcctggaacgtattatctgagcctaattgggagaacaatgatccagttgagagcccgtaagtactagtttcaagcatattttcggcatcagaagttttcccttgaccaacttggtggaaaaagttcttaaaactgtaagttgagttgctatgatacagtttatttaagaacggcgtaacttccttaccgttgactttctgatcaataagaaattgttgaaaactttctagatgaatcacaatgacgttgcgacccttcgccagaccgtacatcttagcgtttggcgcggcatagtgtgattcagtataatctttaacggtatctaattctgatttctttgcgctggcgcgttgatgattggtctgttcatccttgataccatcatagactgtaaaagcatctataccaagatatttgacgatataagtgcggtcaaacgttctggttagtagttgtggtcggttggattctgctaaggtcaagttaagactgaaacctgcaatcgcggcagaggtgtacgcaaaggccgtgtgtttcttaattggtcgtgtgtcttgctcaatccgatgaagaatgaccaaggccagaatgacaataatatccgcccagtaaagaacatcgccccaactcgctagggctaacgatgagccggtaagtccctgactgaccttggacacgccggtaatcgtactaacagtcatgaaatccgtgaattcacgatggtagataacgttggcatacagtaaaatggtgtcgagtgcatcaatgaatagcaaaatatagtaatatacaccggttttacgaatgtagaacgccagactaaacagaaagaccgtcgttgcaatcgggttcacgagcatcaggaatgcctggagtggatcggcaacgcctagtgaaaattcggttaagtacgcatagatcgttttggcccagaataagaagactagtagccaaaaaaatccaattcgcgtgttaacgtattggcgaaatttggtaaacatcgataaagacctcatttttaacaaatttggatatgactcgataaccagtcatcaaatcattttaacataacatcggaactcgtaatcgctaacaattttaagaatgcgttaatttcgtttcgagttagtttgacgataaccggtgaaacgcgtattctcaaagtatttcagaagaacgggtgataacgtgatgcagataaaaatgagtaaccaggttgattcatcagtttatgcggatgccattgcaatccggcgggcagtctttgtgcaggaacaacatatcgatgaaactttggaaattgatacggtcactccagcgacgtggcactacgtcttgtatgatgatcaaaagcaggcggtagccacagcgcgagtgacacctagcgaccaatggacggggcatgttcaacgagttgctacgttgaaagcggcgcgagggcagggctatgcacgacaattgcttcaacggattgcagcggatgggctgagccgtggttggcgacagttggtactaggcgctcaagtcactgcacaagggttttatacacaattagggtatcagccacaagggcgcccgtttatggaggcgggtttgcgacatcagacgatgatattgacattgtcgtaagcatattggcgtaactttcagttggttaggttgttgattcgagtcatattccagaataaaggggccttcagcttaaggcttagctttgtggttattttttagcgagacaatgtaaatggaatttccggtagacttctaggcatagttctaggggccttttttgctaaacgattagttcggatagttcgcaaataaaagttttgattcgtagtaaactagttggttgcagtattgtacatgtggagctgattagcgtgaatcactaactggtggccgaccctgacaatcatacgcgactgtgagggtgtgttgggttgtgagaatgacaaaaacaaagctttttttgaatgggggaggagcgtatgcgaagaaagctagttgggtatatgctaagcatgttgacggtaatattagcgctatttatgctggggagtactgcacatgctaaagaaatcagtgttacgggtttaacggctggcaatgccatcgtgcttgatgcgaatggcaaacccgttactgacacaagtacgttgaatgataaggctggctaccaattaacgtatcattggagtattccagattctgaagtgattaaagccggcgatacagcaaccgttgagattccaacgtacgtcagtatcgatcatgatgttgtgatgccgttaacagattctgccgggcaaaccttgggcacgtttacgtatacgaaaggtgccagtactgggacgatcacgtttacggatgcgttgggtacactcaatagtcgggctggcacattgagcatgaatgcgaagggcaatgcgacggcgacggaaggatcagccgaaattgctaaaagtggcttggttgtttcgtcgggaagtgatggtgcgccaacggtattggggtggcacattaccgtgacaccgggcaataactcgacggttgtggttacagatacgctagggcccaatcagacattcattccagattcggttgcggcacaggccgtgcaaattatcaatggtatccaagtgccacagcaaccgttaacaccgactgttgcaactaatggtaacgtgattacttttacgtttaacaacattcattcgccgtttgtgattacttataacactaaggttgagaattttaatccggctgacacagctaaatggcataatacggctgcactggacggactaggcgttgatgcgacggccgatattacctatggtggcaatggaacagcagggatgacctataccatcgaattaacgaagcatgatgcggcaaccaagtccgtgttggctggagccgtttatgaattgcaagatagtacgggcaaggtaatccaaactgggttgacgactgattcgcagggacaattgattgtcaaaaatctacgtgctggtgattatcagttcgttgaaaccaaggctccgcttgggtatgaacttaataccaccccagtaaaatttactctcggcggtattaagccagaggttgcttttcaggtaagtcaggatgatgtcaagcaaccagttgtgccgacaactggtgatgtcacgttaaccaagactgatgccacgaccaaggcggcattggctggggccgtttatgaattgcaagatgccactggcaaagtgctcaagatgggattaacgacggataccactggtcaacttaccgtatcaggtctgaccgcgggcaattatcaatttgttgaaactaaagcgcctagtggttatcagcttaatgcggcaccgttatcatttacaatcaagccgaatcaaacggcagtggtaacggtagcagcaactgatgaaccggtcactgaaccaggaacaactgaaccaggcaaaccgggtgaaccaggaacaactgaaccaagccaaccaggtgaaccaggaacaactgaaccaagccaaccaggtgaaccagggacgactgaaccaagtaaaccaggtgaaccaggaacaactgaaccaagtaaaccaggtgagccagggacgactgagccaagtaaaccgggtgaaccaggaacgactgaaccaagccaaccaggcaaaccaggcgaaccaggaacgactgagccaggtaaccctggaaccacggggccaaccgcgccacaaccggaacgaccagctgtacccggtccaagccaacccgctgcacctaaaccgggacaatctggattaggtcaaccggcattaccaggactgatcaagcaaccaagcacgggtgtcaatggtgctggtggcactgtgggtaatggtgtgacaactggtatgaacggctttggaacgccaactggtagtgaccaaagcacatcagctggctataaccacggaactttgccgcaaaccagcgagaagcagtcgccgatttgggtgatttttgccgggcttttgggcttgttaattgccgcggtgggaatcggttatcgccgtcgtgcttgaagacgcatgaattgatttattaaagtatcatgtagggattgatgatgccccagaaattttatggtttctggggcattgttttggttatgtgtagagctaacattgtttacggggtcagttcagaatttcaatcaataaatttgaatcatcgtgtgagttacgattaagcaatatggtctagctagctgatgtggagattgttagctgtgtggtggcacacgcaaaatctttggcacagtgaatggcggatggcgatgaccttattagtctttgtcgttgctagtatgacgatattgagttagtcagcggtgactatcagattaccggtgctcacacaatcattaagtataaacgactggcagtttgctacgattcaatttagtattgtaaaaaagttgcttttccagatttgacgtctggaaaagcaactttttttactcaaagattaggctaatcaattgctagcggttggtagatgatgggcgaaagtgctgccaaagcgtggctatagctggtggctcattagcccaacgtgtccaccctgaaaatcccaatggaacgatgaggttacttatcgtaatcccaatgagactcatgagtgcaagcccctttaaggttggtgcggtcgtcaaaagcagtggcagtaagtaggtcaattcaatcattgttaccgggcaaacaaatcgtccactagtataaaagtgttgctgcagttgagtgggttccaagtgtcgtaaccaactttgacggtaactggttgcggtggtaatcattagccagtgcagtgtcaacaacatcaagctaccaagcaagacactgctactgagcggcccggtttgcaaccagcgtgttaatattaactgggtccaaccccaactagttaacgtcacgccagttaagcacgcggtcattaacagactgaaggtcaatgaacgcaggccgaaccataaaacaactatgccgatgattaatccgagtgtgagccatctcagtgcgtgggtcgcaatcagggtatgctgatagtgctgttgctgtgttaccccggttgttaggattttggcgtgcgctaagggcggggcgagtaggctgtcgtgggtgactgcctgaagtcgttgcagggtcctgcgactagccgcactagccggcgctgatttcaaagtgaccgttagctgtgtcatgcttaaatcactactaatattagtaaaaagactgttttgataggcctgattagtagccgcgttagcaggcaggtaaaaactccggccaacttgactagcggctaaatcatgtagataggtcttcgtatttttcagtgaagcgagtaaggtggttaagggttgaacggtctgcttcaatgattggttgacgtggtgaacacgctgatcaacgtgtccagcttcggttgcgaccgtagtttgggccgttaccacgtgatttagtgcggttgtcatgcggtcagtcaggtgatctaacttggtgacctgctgattgactttggttaaatcgggttcagcctcagctgatgtcgttagcgtcgtgtcaatagcctgtaattgccgttgcacttgatcattcagttcagccaaatcattgatgcggtcggacaactggtcgaccgacttggtatggcgactagtcgctgcttgttccagactttgttggtcagtcgtgagttggctcttgagtttcgccatactcgtcagtttaccagccaaatcaatgttgatagtcgcaagttgctggttaacgtagaaattacttagtggttggccggtgggctgggtcactgagatgacttgagccacatttggtacggcccgcagtttagtcgtcaggtgatcgattgtttgtaatgattgctgctgcgttaaattctgcggtgctcgtagtgtaattgtgattggcgccgtggcaccggtaccgaagtgagcttggactaattgctgacctaattcagcattactaagctgattttggcgccagggtcgtaagttgtcatcggcaaactggccgttagcaagaatgaggccggggagtagtaacagtgcgacggccaagctcccaagcgctggctgccagtagccgaacttgctcaattggccccatagattgcgtggacgggtcggccaagccgttgttcctggccaaaataaattatcaccgagccaagcggtaaaggcgtaattgagcggcggtaccgccagtaaggtgattccaagcgctacagtaatggcccaagcagcggctaatgagatgaaggcagtccagtgtaaagtgatggttatgagtattaatgggataaaaacaagtgcccactgtcgatattgaagtgtcagaattttgagactgacagtggtcggtgcggttggtgcgctcgattgccaatacgcgtacataaagtgccatgtcaatagactagtcagtattaaactgattagaccagcaaggctcagcgcattagccgtcagtggccaatgccaagctaaacgcgcgttagtgataaagctaatcgttgtgatcagagtgaccacttgacacagtaagttcagtaatggcactaacagtgagcggaagatgaggccgagaatgattaaactgagcagactaccgacaagcatgctaatcagcaagttgcgacgttgttgttgcacgtgttgttggtagatcaagtccgtactggtgacactcgtattgaggtcggcgattgcaatcgcattattaagttgatttgcaatcacagataggtcaccccgggatgtctgaacggcgacaagggctaattcggtggaaccatcattggaacgtaataagtgccagtcattagtcataccggttggcgttcgaagctggttaatgccataatcatcggctcggcgattaagtttggctagggtcgtggagatttgttggcgttgctgtttggataatttaccatttgaattgttgaagactaacgttaaggactggctgttggttaacccgtgaccccattgttgttgatatttaggactcgttgttgcatcttgtggcattgcggtttgttcattcacaaacgtggtaatgttcggtaaaatcagaatacttgcaaacaccacgattccccagaaaaataagaacaaccactttggttttaataattttcgcattcgtcttgacgcccccacatcaattactttattttgacttaatcttaccatatcaggtgttagagaagcagtttggtcgtcagtttgaaaagttaattacagtaattacttgtgagttatggtatcctaaaacgctgtgggaggtgctgattttgaaaacagatcgatttcaggcgttcagtgatggtatttttgccattttaattacaattttagtcttagaatttcacattcctgattaccaaccgggacatttactggcggcactattagcgcaatggccgttgatcttgtcgtatgtcttttcgtatttctacgttggcacgctgtggttatttcatcatgattatttcaacatgctacaacgaattgatcgcaacgttaatatgctaaacttattaatgctctttagtatcaccttattggattacccgatgtcattagtggcagatgcgttgacaactggtaatcgacaggatatgcaaacggcatttatcgtttatgatttggttgccctgtttatttcggcgacattttatttcatgtacgcttatctgcatcatcaccaggatctaaagaagccgggaatctcaatggctttttataccgcaattaagtttgatccggttcgaagtgtcacgatttatggcttagccatcgtggcaacgttttggtcggtatggttaggtgcaatcttactagcaggtggcatcatttttcactttttggcctacttacggatgagtcgccagctagaacaggcgaagggagggacggcataatggattattcaagtttattaggacctgatcgttatgatctcgccgtgacgttagccaagcagtatcatcttgaccccagccaggtcttgttcggctatttgcaagtggttagtcaagttacgggtggtccgaatgcagcgcaagctgatttacatgagccccaagtacgagcagcaatcaatcaggaatttgatcattttttgaagcagcgtcattaattaaaaatcacgatgtgagttcagtctcaacatcgtgattttttagtttcaatcggcaggaaagaggtacggggttcgccaggttgttgccatttcaggtgttagtgtcagtcgttgttcgtgaccagtcgtgcgtggaataaagcggtaagtacgagtcgctaacgtgatcaaacaacgatagtgcgtgtagttgtggctgatgagatggcgacggtcggcgtggtatggcaagcttacttcttgtaaccagcggaataaagtggtcggcacttgttgcggtgctagctgcggtgttcccagtcgtcgaagtgccatgtgaatgaaacgatcagtgggaatcggcccgctcggtaatggttgcttagtctgaatcacgtgctgagcagcctgacgagtggcagttgtaatctggttgccagatactgctaaataacgatttagtcggcgctgatggtcgcttaggactggtgtattggtcaggacgccggctggattcggttgcgccgtcagtgggccaccagtgggttcgatgacggcactggtgtgtgcatcactgagataccagtgaaagggatagacttcaccagtgtcatcaccccaggacgcaccgaccaggttaacacttggcagatcggcgatcacggctgcgactgattggtgttcacctaaagcccagttgatgaaggcttggggtgttaaattaatttggttgacttgtggttgagtggcgtattcaacggcgtggggcaagtacagttcagcacacatcaaaccagcttcgttaatgccgtcagccatcaaacaagccttaaagtggtcaggtagccgaccaccaccgagaatggcatactgcgtcatacgcgtcgtcgctaacccagttggccacggataacggcgcggcaaaaaaattggccgccaaggtgtcgttgttggaaagtccatggtgcgggcgaagtagcggtgattgtcagtatcaagataagttaagctggtacacatggcgcggcctcctttgaattaggttcattatacgtcaaaataggcgacagctaaatgactgtttaattaacgatggtaacggttactttttttgatgatctgcgtgtgcaaaacagctggcagtgcaatcagtgacagattaatttatggtcggatggaactcattattttctaatctttacaaacgtgctataatgaggtttcaataactatcaaagcgaggtcttcatagtgagtggatataacgtcgcgattgtcggtgcaactggtgcagttggcgcgcggatgatcaaaatggtggaacagacgagtttacctgtcaactcagttaaacttttggcatcaagccgttcagccggtaaacaattacagttcaatggtcaagccttaactgttgaagagaccgttcctgaatcattcgaaggaattgatttagccctcttctcagcaggtggctcagtatctaagaagttcgcccctgaagcagtcaaacggggtgccgtagttgttgataatacaagtgctttccggatggacccaaagattccgttagttgttcctgaagttaaccctgaagcattgaagcttcatcatggaatcgtggctaacccgaactgctcaaccatccaaatggtcgttgctttggaaccagtgcgcaaggcatttggtttgaagcgggtcattgtttcaacctatcaagccgttggtggtgctggtaaccgggccttgaaggaattgcatgatgagacggaagcctacttaaaaggtgaagagatggaagctcatatcttacctgttgcgggcgacaaaaagcattatccaattgccttcaatgcgttaccacaaattgacgtgtttgaagaagatggctacacccatgaagaatggaagatgatccatgaaaccaaaaagattatgtgtggcggcgacatggacagtaaggatatcaaagtaacggcaacttgtgtgcggattccggtgccagtgagtcactccgaatcagtttactttgaagttgaagatcctaaggcaaccgtcaagggcattcaagatgctttggcagctgcaccaggcgtggtcttacaagacgaccctgataaccaaatttatccgcaagcgcataatgcggaaggttctaaagacacgttcgttggtcgggttcgtcctgaccaagaaacgccacaagccttccacatgtggaacgtttccgacaacctcttaaagggtgctgcttggaactcagttcagattgcggaaaccatggacaagatgggtttattgcacatgcaataaaactaatttgttaagggtaatgaaaagctgatcgctagaatcaatattctggcgaccagctttttttgatgtcgaattattcgagcgttagagtcagataaaatataataagcgtcatgttgaaattaggttcgttttagaaagcaatattaagaatttgttaagctaaaactgatgagtgtcctttatccttgtcctggagtcagctccagcatataagctaagtttattcaaagttagtgaatggtcaatgagatgtcatgatgttaatttgctagctagaataaaattttaacgcgaatatggaggaattaataatgaaatcaattaattggtcaacggactatttaccagggcatactgataatttcgtgtcaaacgaggtcattacagacggtgtgactttagcggctgtttggaaaaatttagtcgatacatcgaagtggacgacgtattatgacaatgcgactaacattattttggatgatcaaacgaatactgaactaaagtttgcggaacatttccgatttgatacatttggttttcctatcgatgcccaggtcatggaactcgttgaaccgacggatggtgaaacagcacgactagcatggcatggctggcaaaatggtgatgcagatactcaatttgatgtctatcacgctttcttaattgaaaaattgacagatggccggattcgattattaacacaagaatcgcaagttggacagcctgctaaagacttagctaatcaaacacccaatccgatgctaaatggtcaccaaagctggttagatgggttagtcaaggctgctaaaaggactatgactgagtaaagtagtagctcagcaagattaataggagtgattaaaagatgaaaacatggtttattacaggaacttcaagtggttttggaaaggaactcgcgacaattgttgcacgtcagtctgacactcagctgattgcggctgcccgccacaccgatgatttagcctacctagatgtttttgacgcgacgcgtattgagaaagtaagcattgatgtgacaaatgaatcacaaattaaaactggggtcgctcaagcgattcaacgttttggaactattgatgttttagtgaacaatgctggcttaggctatttttcaacaattgaagaaagtgatatggcgaaagttcgctacatgtttgaagttaacgttatgggactcgctaacgtgactaggaccgttttaccgaccatgcgggcacaccatgctgggataattattaatttatcatcggcgttggcattgacgacactaccaactatgggcttttacagtgtgacaaagtatgcagttgaggggtatagtgataccttgcggcaagaagtaaaagacttggggattcaaattatgacggttgaaccaagtggcgctcgaacgcagtggtcagggcggtcatcccaaaagatggtaccgacaattgcagattacgccgcgtttagtgacgcgattacgacggtatcggactcggttactcaggcaccgggcaatccgcaccgaattgctcaggttatgtttgatcaggccaatttggtagaagtaccggcacacttgccattaggtgaatttgcctatcaaggtggactcgctaatttacaaagcattgttagtgaaattaagtcacgtgaggacctttcattatcgacagacgattagctgcgttaagatagtggttaaacgacaatcgaggaggttcagttcagtatgagttattcaatcggacaagtagctgataagttaggagtgacgattgataccattcgttactatgataagtcgggattactgccattcgtgaagcgtaattcaattggccggcgtgaatttactgataatgatctacatttgatgaggaccattgtatgtctcaaaaatgcgggtgtgtcagtagctgacattgctacttttattgcgctcagactcgaaggtgatacgacattaaacgatcgttaccaattactcaaaacgcatgagcaggaattacaacagcggattaccgacttacaggatacgatgagttatttgaagtttaaggagtggtattatgagaccgctacggctgccggacatgaggatattcattttgtaccgggtactaatgaagttcttcccggtcttgaccaggaatatgatgcgtatttgaaggcgaccggtcaactggttgagctgtctcgatttgctaatgtaaaggattatcggttgcgcaagcgatagtccttagcagtttcagtttaatcgatgaaactgtacagaaaaactggttttgatagcttggatattggataagaataaccaaaataaaaggttctgaattgtcagttgtttgacagttcggaaccttttgaaattaaaagcagcgtatatttaagcaattagttgtaagacttgtctaactagcgccactggtacgggttgatccaggccaatgttcagccgcttttgaccggttgcgtaaccagcagttttagcagcagtgagggtcgcatcgtcaaggtcggctgaaatacttagactgacgtgggcctgataagcagcaatgctaacgtattgtttgtcatgttcatagaacggcaaattccacttgattttagcagtaaagtcaagcaattccgatgtaatcagttgggcaagggtgctcaagattggttgtgcagcgattgcagctttattgatgtaatcgttggtgtccgtgactttaactcgactaggcatttttaaaacctcctttatttacgaaatgaattgcgtcgtagcaaccaaatggttagggcacatagtgcaacggcgatgaataccgtaatctcccaaccgaatggattcttcatgaacggtaagtcgacgttttgcccgaaaaaaccgaagacaatgttgggcattgtcaggacgatggagaaaatcgtcagcacccacatcgtgttgttcaaactgttgtctagaatgttcgagtaggcgttcgacacccggccgatgatgtctgaggcaatgttggccatttccaatccttgttgtgcctcgacaataatatcgtcgagccgttctaattgggccgccgagaatttgaccggtacaaaccgtttgagtgactgcaacatgtcgttattacttttaagggacgtgaggaaatagactagcgttgtttctaagtccatcaattgaataatgactgaacgctgaatttgctttttcatcttcatctgaatgtcttggcgttgtttattgatcttgttgatggccgaaaaatattgccgtgatagcttgtacaagatgttaaagatatggtcgtatggatgcaggacatcttcccaatcggcatcgatttcgtctgccaacatatcctcaacgaatattgtgttatcggtcgtaaaagtcagtagggtgtggtcaatcaacatgaaactgacttgggcggtataagtaccttcctcaacgtcttctgtgaccacgtcaaaaataatggtcgtgatggcacttttggcgtcatattccaaccggcctcgttcgtgttgatcggttgcgtagcctaacatttcgtcggtaacgtgttcctcacttacgagttgatgataatcattttcagtgtaattattaacagcgacccagcgaaaatcgtcgcttagttcatggacttttatcattgtttttacttccagcgttttgagatatcttcaatttaacatgagttgcgagacaacgcaaaggaagttttaaggccacctaattatttaacagttgttctacttaacttttcacaccataactggtgactgcgactgaaaagcgctaacaataaatcataactgataatcagtaaaatgactgaaacgacgacaaggtagacatccaggcggttaagggtggcactaggaacgttgcctagacgattgaataaccataaatccaagaataaaagtggcaggccgattaggtagagcccactgtaatggataagcagttgccagagattggcctggtgaccactgatggttacgatctgactattgagcaggcgaccaccaatggttttaccatgccaacaccaggcgggcccaatgaagaagaggatgatatcggccaggtatagccagcgaaaatcatgtggtaatggccaattaaaatgtttgactaagacgaagtagacggtgtcaaaggcggcaattgcgagccaatcgatgaccaacgccccaatgcggcgccaattgatggggtgttcctgccaattcaaccgggtactgtggtcgcgattgcgccactgtttaggaatcagatgtagacacccagcaccgacaatcccaccaagtgtgttcatcattaaatcgtcgacatcgaacatccggtaggctcgtgagtagtagccgtataatccggttaactgcgtggtttcgaagaacaatgaaatcgagaagctcgtcagggtgatcaaccagagcggccagcggtgccgccactttaagtaggcaccaatcggcataaataatagaatattgaagaacggctggaagaacgtgtcagatttgaaggcggctaaccaagtactggggtccccgagttcaaacggcgtaagtgccttcaactgggtgagaaagtagaagggttgtaaattatactcagcagttgttaggctagccacggatgagcgagtcgggagtggcagaataattagtaagtaggctgctgccaagtaccaaataaacgaataggtactgatcaagttacgctcactcagtgtttgacgtgttcggagctggatagtcaggataatcatggcgagtagtaaggtcatgatgggtaaagctaagataacgatgtgcacgggttccagcaacgtactgacaatgtgactggaaagtgcgagttgataaagttttgtaatgagttcgtgcatggccggtccccccttttttgggaatagcgctgttctttaactaatgttgactatatcatggtataaagaaattgtgacgattaatataaataaataagtaaattgttagactttcgccgtgactgctagcgtattgtcgcgaatgaccgtttcgaccatacttgcttatctaaaaaaaatatgattgaataagcataaattatgagagggtgatgaggatatgctaatggatgggcatacccacacggaactatgtccgcatgggagtggtgaagcaacggaaaaaatgattcaacgggcgatacagctaggttttcagcggtattgtatcacggagcacgcaccgttaccaccggcatttcgtgaccagtatgaagggacgccggccggttatactgaggcgtcgttgcgtgagaaccaagtagccgattatttggcactggctaacggactgaagaccaaatatgccgggcaaatcgagatctcagtgggttttgaagttgatttcttaccagagcatgttgcttggacgcgtgattttctgaatacctatggtcctcggacgcaggaaagtattttgtcagtccatttcatgcgggggttacggcagcatttctggtgtgttgacatgtcaacggatgattttgcagccggttttgggcagtggcttaagacgccccaacgtgtttttgaacagtattatcagacggtcttggcatcagtacaagcagatctgggcccttacgcaccacaacggatcggccacatgagtctcgtccgcaaatatcaggattactttggcttgactgaacccttggatgtccataatcttcaattagtagatcagacgttggcgttagtgaagcagcaacggcggcagttagatttgaatttggctggtctctacaaaccgtattgtaatgatttttatcccggtgaacagattctacaacgcgctcaaaagcttgacattccgctggtttatggctctgatgcccatgacatagccagtgtggggcgtggctatcatcttataaaaaaattaattgagggttgacagccgtcagtttagtgattacaatgaattataaattaaacgactaatcaaattttaataaacggttgtgattagaacaagtaattaagtcttcctcatccagagagcccgggtagctgagaaccggacagacaggcttaacgaacacacatctatgaactgctaaggtgaaccagtctcattagccttagccgaattggtttcgttatccaagttgacttgatcaacatgaggtctaccgtgcgaacggtagatgaaataaggtggaaccacgcgtaaacgtccttttagcaaattgctaagggggcgttttttagtttcaccgatccatgcggtaagtttgcgtgacggaatcgcaagtcgctctggttagcatgtaagcaattgattaagcacgttgataagtaacgatatgaattaaactgattagttttaaataacgacgttttaggaggcgtaaattatgttgaaacacttattaccactaggaacccgggatgaatttggtcggcgggcacgtaccaaacaacacttgatcgcggtgatccaagcccattttaaacaacgcgggctcgcgccaattgcaacgccgttattagaaaacgaagcggtgtttgatccatatcagatgggtaactaccaactataccgcttatttggcaacgatggtcgcaccttggtcttacggccggacatgaccttaccagttgctcgcttcattagcgcgacgaatgtccccttaccgcaaaagtttggttatgtcggcgatatctttcgagtaagccgtcaattatcaggttcatataaccaaatcacacaagcgggagtcgaattagtcggttacgcatcgctgaaagccgaatttgaatgtttaacgattgccaaccagctttcaagtgagctgattgccgatgctgttgaaatcgaattaggagatgcccaatttgcacaacgggtcgtggccagcttgactggtgacgaaggcgaacaacaagccattttaaccgcactgttcgataagcaagtaccacgctacacgaaattgattgccaagtaccgcgcacagcctttatacgattttctcaaagcatggccgcgtttgttcgggcgtccagaatgtatcttcaaagaattagcggcagcaccactacctgaaacagtccaaccaagtctgaaacggcttcaaacggtggtggcctggatgcaacaaacgatgccggagcaagtcatctcggtggatttgagtagccaagcaccacaaaaatactataccggcctgacttttcggggttattcacaagcgggggctggctacctgttcagcggcggccgttacgacaaactgttaacgaactttcaagctgaagcagaaccggctgtgggaatggggttaaacgttgacttgttaacaactttagccaccgaccaacagaccgcttatgctgaacaattgatttactttgagcctgaacagtggtcacaagcggaggcatacttagcgaaacaaccgcacgccattttgagtttggcggatgacttagcaggtgcgcgcatcgaagcacaacgtttgaatgcccaactgattgatttaactggaggtatgaccaatgactgaaccacgtttaaagattgccttgactaagggccgcgtcgaacaacaagtcctgccgttgctggaagaagctggactggattgttcgcaagtccgcaacaagcaacggcggttgatttttgattctgagacgcaaccatatgagtttattttagcgaaagggccggacgtgacgaccttcctcgaacggggtgctgctgatatcggcatcgttggtagcgatattttgactgaacacgagagtacccaatatgaactgttagacttgggggttggtaagtgccaatttgtgctagcatccacggccgactttgatcccgttgcaccacgacgcaaaatcatcggcaccaagtacccattgattacccaacggtattttgatcgcttgggccaagatgttgaaattattaagattgaaggctcggttgaattagcaccactgactggcttagccgacgccatcgtagatatcaccgagacggggaccacgattcgtgagaaccatttacaaatttatgactatttacaaccagtctcgacccgcctagtggtcaaccggttagccttaaaacagcaacaagccgccatctttgatttagttgatcggttggccacagttgttgatacgaataatccaaaggagtttgtctaatgaaaattattaatgaagatttagctagtttaaaacgcttagttcaaacgaagacccaacaattgactgacttaaaggttgaatcagcggttcgcaaaattattgccaatgtgattaaaaacggggatgccgccgtcaaggattacgaaacccaattcgataaggtcaccttgaccgactttaagttgtcacaaactgttattgatgatgcttataacaatctggacccgcaagtgaaggacgccttgttgttagctaaacgcaatatcacgagttttcacgaaaaggaaaaggcgactggctttattgatgctgaacagcctggcgttctacgagggcagaagttaatgccgcttaatcgggttggcttatacgttccaggtggcacggcagcctatccatcgactttactgatgagtgccttgcccgctaagattgccggcgttaatgaagtcattatggtgacgccaccacaagtcgatggcatcaatccagccgttcttgctgcagccaaaatcgctggcgtcgacgccatctatcaagtgggaggcgctcaagcaattgctgcgttagcttatgggactgagtcgattccagcggtcgacaagattattggtcctgggaacatttttgtggcgactgctaagaagcaggtctttggtcaggtggcgatcgacatggtggccggcccgtcagaaattggtattttagcggatgattcagctgatcctcggcaattagcggctgacttattgagtcaagcagaacatgaccgtcgagcccggccaatcctaattacggatagtgccgacttagcgcaggccgtcagtgacaacgtgacgtcacagttgaaagttttgccacgagaagcgatcgctaccgacgctgttaacgaaaaaggcttcattgccgttgtcgcaaaggttgaagaaatgtttgacttgatgaatacggtggcaccagaacacttggaagtgcaattgaagaatccaactcagtacttgaatttaatcaaaaatgccgggtcggtcttcttaggacgctacgcctctgaaccactcggtgactacgttgctggtccgaaccacatcttaccaacgagtggcacggcccgtttctcatcaccacttggcgtctatgatttcgttaagcgaacgtcctttatccaatacactaaggacgctttggctaaggaagctccggcgattaccacgttggcacgggtcgaaggtctggaaggccatgctcgtgcgattgagagtcgttttgacacctattacgattagggcgtaattagtagttgatactgattgtgattacagccggtagtcgttttagcagatgaggaggaaatgaacatgcgacaagcaacgattaaacgtgaaacgaaagaaacccagattgaaatcagtttgaatttagacgaacagagcggtatcgaaatcgataccgggataggctttttgaaccacatgttgaacttatttgcgaagcacgggcgcttcgggttggtcgtgaagtgtcacggcgacctcgacgttgacccgcaccacactactgaagatacgggaatcgtgcttggcgaatgctttaagcaggcgttgggtgataagcagggaattgaacggtacgggacagaatttgtgccaatggatgagactttaggtcaggtcagtgtcgacctaagtggacggtcatacttagtttttgatgccgagctcacgaatccgcggctcggtggcttagatacggagacagttgaagatttcttccaagccgtggcctttgctgctgaaatgaatttgcacgcacgcatcctgtacggccgtaacactcaccacaaagttgaaagtttgttcaaagcgtttgggcgggcaatgcgcgcggctgtcacgattaatccagatattcagggggtcaactctacgaaaggcgtgatttaaatgtttgcaatcgtcgattatgatacgggtaatacccgtaatttgaagaaagcttttgactacctgcaagtgtcaaccatcttaacggctgacccgcaacaattagcggccgctgacgcagttattttacccggtgtgggagctttcgcagctgcaatggccgctttaaaagaacgccagttagtcggcgtgttacaagcattggcgcggagtggcaaacccgttctcggtatttgcttaggcatgcagctcttgtttgaaagtagttccgagtacggcgagcatgctgggctaggcttgttaagcggccgggttagcgctttgccaacggacttgaatgtcaaagtcccacagatggggtggaatcagaacgagcttcggcgtcctgatagtccctttgccagtattgacgcggcctatacttacttcgttcattcgtactatgcggtatgtccggcaactgaaatcgtggcgacagttcaacacggcgtccaggttccaagtattgttcagcatcaaaatgtgattgggatgcagtttcacccggagaagagtggtcgagtcggattacaacaactagcagcttttaaggaaatggtgagtgcaaatgatttttccagcaattgatttacgagccggtcagagtgtccggctctaccaaggtgattttaaacaggcgacattgattaatcctgatcctgtcgttcaagcccaacaaattaacgcagcgggcttgcagcaattacacatggtcgatttggacggtgccaagtcagggcgcccagaaaacttcgcgacaatcacggcgatccggcaagcatttaccgggacgatcgagctcggtggaggtattcgaacctacgagctggcgactcgttatctcgaattaggaatcgatcgcttaatcttggggtcagttgcgttgactgatccacgactggtcaaacgactgttaagtgagtttggtggtgagcgaattgtgattgggttagacggaaccaatggttatgtggcaattaaaggctggttggagcagtcacagaccaagatgagtacattaatgaagacaatgactacgagtggtgccaagcactttatcgtgaccgatgtcgcccgtgatggcacgatgcaaggccctaaccttgcgttataccaagaactacaagcacaggtgcccacggccaacctgattgccagcggtggcgttcggaatttgaccgatgttcaagtgttacaagccagtgggttcaaggatgttattattggcaaggcgttagctgaaggcggtgtgacactggccgaattagcgggggtgactgaatgttagcaaagcggattattccgtgcttggatgtggcggatggtcgggtcaagaagggcgttaatttcgtcaacttgacggatgtcggagatccggtggcgattgcagctgcctatcagcaacagggcgcggatgaacttgtctttttagatattgcagccaccaatgagcaccgcgagacgatggccgccatggtcgaacaagtctcagctcaggtcttcatgccactgacgattggtggcggaattacaagcgttgctgatatgcaacgaatcttacgtgcgggtgctgataagacggctattaattcggctgcagttgccaaccctgaactgattcgtgccggtgctgaaaaatttggcaaccagtgcattgttgttgcgattgacgcggcgtgggatgcggcagctggtcaatatcgtgtctatacacatgggggtcagcaagcgaccgacctcgatgcagtggcgtgggccaagcaagcggtcgccttaggggctggcgagttattggtcactagcatggatcgcgatggcactaaggcggggtttgataccaagttatatcaggccctgggagcagcggtcaatgtgccaatcattgccagcggcggtgcgggtaacttacaagactttgtggatgtttttagcacaaccccggttgatggtgcattggcggcttccgtctttcactttggcgagttaacgattgcagatgtcaaagcgacattaagaaaacaaggagtggtcgtaagatgaaaccagactttgaaaagggtgacggcttactgacaacggtcgtcaccgacgcggatacgaaggatgtcttaatggtcgcgtggatgaacgcggaaagctatcaacggacattggcgtcgggccagacgtggttttggtcacggtctcggcaagaactttggcacaaaggcgctacgagcggcaatttacaagatgtcgttagtatgacgctggattgcgatcaagatacactattggtcgcagttcatccgcatggtcctgcttgtcatacgggacatacgagttgtttctttaacccggttgaactagaaccgggcgcctaaggattgatgacgatagccgcatgagttgggagttagatggctgattggttggaaaatgcggtcccaacggtcgataagcaggattgtttttaacccgtattaaattgatgaatatattatagaagaaagtggtgtcgaatatgcaaaatatggaagaattatacgaactgatcaaacaacggaaggcaacgcctaagaagggctcctacacagattatttatttactaagggactggataagattttaaaaaaggttggtgaggaatcaaccgaagttattgtggcggccaaaaatcccggtgacgacgaattaacctatgagacagccgacttgttgtatcacgttttagtgttattggtcgaacgtggtgttagttttgaccagattaagcaagaattggctaaacgtgaaggtaagatgagtgactataaggatcggcccgaaattaagaacctataggaggtagccgaatgaaagctagtattgaacagttagaaccctatgtgcccgaaaagccgttggcgaccctccaagctgagttaggattgacagaattagtccggttatcagctaacgagaacccgtatggcacctcgccaaaagtggcgaccgctgtgaagaattgggacttcacccagagtaatcgttatcccgatgccgacgcacagaagttacgacaagcagtggcccagcaacagggaatcgacccgaatagcatcgtttttagtgtgggtcttgatgagatgatcgtgatgttatcacggacgttcttagccaccaacgaccaggtgctagtgtccgcaccgacgttttcagaatatggactacatgctgagatcgagggggggcaattaatcagtgtgccaacgttgcctaatgaccatgtgaacttcgaaggcttaatgaaggccattacgccccacgtgaagatggtttggctgtgcaatccgaacaatccgacgggcaccgtggaatcattagcggcaattgaagcgttcgtccagcaagtacccccggagacgatggtcctgattgatgaagcctacattgattttacaccgggcgcggctcaagtaacggccatgcagttaccagccaagtacccgaatgtagtagtcatgcggacattctccaaagcatatgggttagctaactttcgaatcgggtacgccgtttttaataccaaatatgccgcaacgatgcaaactattcggcttccatacaatgtgaattccttggctcaagtggcagccctggcggcaatcgatgatcctaattttgtgaaacaaacggtccaaaaaaatgcgacggaacgtgctaagtggatggcattctttgatgatcagggtgtcacttacgatcaatctggcgcgaacttcattttctttaagtatccgagtgccacgcaactggctgactatttagtgcaccatgggtatctgattcgcactggcttacggccagggtggttacgactaacggtcggaacggctaacgataatcagcaactccaacaattaattcgtgagtttaaggcctagaattggcgcaaagaaacctgagtaatcggtttctttttttgttgccctaactgctgaataaattcgaggcagctggtccgcaaggatagttgtcaataacacctgctaaaccattaactcaagtgttgacttcgacgccactctaagcagtaaaattagggtgataaaatacaggagggacaacaatgtcagaattagataaattagcagctggggaatggtatcaatttaaagatgctgaggtggccgctcaaaaagcgcgggctgccaagttatgtcaagagttcaatcagatcgatgcaacaaatccagatgcgcaaactgccaagattcaagagattcttggtagttacggtcgcaatctttccgttcaagcagactttaattgtgataatggtcgtaatattcatgttggtgataattttcttagtaattataacttaactattttggatatcgcgccagttcatataggggataacgtgatgattggccccaatgttgatatttatacggtcaatcacccgttgacggctagtggtcgacgtgctagcttggcccagggtcatccagtcacgattggtcatgatgtttggattggggggagagcggtgattacgcccggcgtgacgattggtaataatgttgtgattgcggctggagcagtcgttactcatgacatgcctgataatacgttggtggccggggtaccagccaaagttattcgacaattagaataagaaaggtcgcaattggctagctttttgggcacttattttactcattggcatgatgagtcgtaaatacgacgaaaataaggtttatttttgaaaattagtccacgtaagcggcaccaattgtttttacaggtatacttagattaacaaactaatattaagagaaagaggatgccgtttgttacatttaatcgaacagttgtatggacccttcttcagtgcgactaactggggtaacgtcatcacatctgctaatgactggttaatcattttatcgttagcaattattgagtgtttactatcagttgataatgccgttgtcttagctgctcagacccagagtttagataatttacaagagcgggaaaaatcgttattctatggcttgtggggggcctatatctttcggtttttaatcattgggattggcacgtatttgatcagtttttgggagatcaaagtgttaggtgcggcttaccttgggtacttggtgtatcgatactttagtcagccgaaaaatggggccaaggtggcacagaaacccaagcaacaacgacgcttcttcggactaagcaacttctggtcggtcgtcattcagattgaaatgatggatatcattttctcaattgattctgtattggcgtcattggcaatttcggataatccggtgattgttttgattggtgggatgattgggattgcctgcatgcggggcattgccgaggtcattatgcgcttaatgcgcaagattcccgagttggaaaccatggcgtattgcttgattgtcttgattgccatcaaattatttatttcaattcctgccattggttgggatattcccgcaacggcttttggtggtatcgtattagtagcatttattattacgttgctgattcatttttggcgtcggcgccgcaatgaacagtgcgtggaaggaaaggtgcgtaaatgatgaaattaggttggattggtaccggcgtcatgggggcagcgattgtccgtaacctgatgacggccggctatgacgtgacggtttataatcgaacaaaaagtaaggcggatgcgctagttgcggcgggggccacttgggctgatacaccggctgccgtggcagaaacgagtgacgtgattttcaccatggttgggttcccacgggacgtcgaacaagtttattttggtgatcacgggattttcagtggattggccgctggaaaaacggtaattgacatgacgacgagccaacccaagttagccgttaaaattgcgacgtacgcgcgtgaacatgacatgcacgctttggatgcgcccgtgtccggcggtgatattggcgccaaaaacgccactttgacggtgatggtcggtggcgatgccgatacgtacgaggcgatgttaccattatttaatgtgcttggtcacaaggtcaatcattttggggatgctggtactggtcaacatgccaagatggccaatcagatcatgattgcagggacgatgactgggttaactgaaatgttattgtataccaaggcagccggtcttgatccggaaaaagtcttggcaacgttatctagcggtggtgctgacaactggagcatggataattacgtgccccggattctgaaggacgattacacgcccggcttttttgcccgccattttcttaaagatttgcggattgctttgagtgaggcggatgcgatgggacttaatctggttgcgacggcgcaggctaaacgactttatgaagtaatggtcgatgtcaaaggcttgggtgatcaaggaactcagggattgattaatatttattagcacgtggctgacttgatgaaagtcgctcaaacatcatatatttattgaaataatagttatcaaggcggaaattcagcgagtttaatctttctgaatccccgtcttttattaacatgatacgcattatgcgaggtaatttgtcatgaatcgtgattaaaacgtgccagttatgtcagttcaaaagcagccagcttaggcctgctggaaaaaagttcgagttagcgtaaaattacttagttggcgcgtcctacgccgacttccaggcatttctgccaattgctggaacgcggtggacacagatttaagccgcagaccacgtcttaaatactggtcttccacgctttaatgccatattggtgaaacgtgctcgggtcagacagaaaatgatattgtaataatttactattcccaaatcaccatagtaataattaaacgtctcgacaaagtggttaacgccaccctaacattatgtttaaatttccagtaaaaaatatagtcagcgactaattgtaccaagttaagtggctgttcatttgccatttgagcggcttcccgactggaggggctgggtgacaatgctcagtagccaaattattcttagctggaagtgtttttcttccggcttagaataagactcgtatttgagatgacgcgggttatgcgttagctcaaatcgacgtcggctgcgttccagcaattggcacccagccccggaggtaggcataggacgcgcaccggctgacgaacagtaatttaactggcacgttttaatcacgattcatgctgagtaataactagtacaacgtctagcatggtattttatgaaacgatatctaaaaataaacttggtatactgtcaatcttgatgactagcattttgatgcattaaaaaacggattcttcaacgatgtgtggctgaggaatccgtttgatgtttcatggcttaattaaggcctaattgatttagtttaaggttgcggctgctttttgggcagcgacgttgataatgttccaaggacggtcgaagcctggttggaagaagaagtccgtgtaagctaagtcagcaacagtcagtttagcttgaatagccactgagatagcgttgatgttagcagtaacatcgtacttcgacatgatttgcgcaccaagcacgcgaccatcagttgggtcaaaggttagtttgaaccaaactttggtgttgccagcatcttcagagacaaacttaggccgaatggtatcggtgactaacacggatgccgtcttaacgcccagcttgtcagccgtgccttctttaacaccagtggaagcaaagtggtagtcaaagacggaaagtgcggatgaaccagaaacagcaggcattggtacgttttcgccaagtaagttcttagcggcaatccgaccttgccgacgagcgttagtggctaacgcaatgcggttatccttgccagttggggcaaatgggactaaggtcgcgtccccgacggcgtaaatgtcagtgtcactcgtttggaggtggtcgttgatcttgatcaaaccgtgatcatctaagtcgacaacgcccttcaagaagccagttgctggccgaatcccggcggcagttacgaccaggtcagctggatattcgccttgatcggtcactactttggtgacgtggccgtcaacaccttcatacgctttaataccttggccaactgcagcatagatgccgtgatcggccatcttcttagtcaagatatccgtgaattcttgatcaaggtaaagactaagtaaacgtggtaataggtcgataaccgtgacgtgcatgccagctttggcaaagacttcagccgcttcaatcccaatataaccggagccaatgacaaccacattcttaacgctagggtcaacggtcttggcctttaatttgatggcccagtcgcgtccacgcattgcgtagatgttggctaagtcatggccgggtactggtaggtcaaatggtaccgcgccgacacttaggactagcttgtcataagcttcatcacgttcgtcaccagtggcgtggtcaatgacgtgcacactgtgactagcagggtcgaccttactaatttcactatttacaaagacgtgaacgccttgggcttgcatgccagcaggagtggcatagctgacggagttaacgtctttaacggcaccttcgaggtataattgcatcccacatgagaggaatgacagaaaattacctttttcataccattgaatttcagtatctggttgagcggctaaaataccgcgaaccgtttcataaccaccatgagaagaaccaacgacaataactttcataattgtaaagcctccaaattttagtttagaactgttctaaatagaatataacacgaactaagtttgtcggcaagggtagtttgtaattattctaaattatcagtgaaaaatagctgtgcccgtcgacaccatttagtttagaaatattctagttagaatatagcactaaaataaattgttcacaactaaaacggttacaattagctgcaaaaaacacccaatcatcaaaaaattgatgactgggtgtcagtattaatagggatggacttaatgattattcaataatatcgaagaaacttagcaacttttctttggtcaattgggctttttcctcatcacgaacatcatacttaatctggccctgatcaaggacaatcaggcgattaccatagcgaagcgcatcgtctaaatggtgggtgatcatcagacacgttaacttttcctccgtgacccgttgattcgtttgtgtcattagttgagcgctggtcttaggatcgagtgcggctgtgtgttcatctagtaacaagagatcagggcgctgctcggtagccattaaaaagctcagagcctggcgctgccccccagataaattttctgttgccgtgttgagccgagctgaaagaccgttgccatccatcgtttccgttaaggcttgaaagtggggcaggtgctttttcaattggcgtaattttaacgtacgtcgcttaccacgttggctggcaagcagtaagttttcggcaacggtcatccggggtgcggtgcccatcttggggtcttggaaaacgcgcgccaggaaagcggtccgcttttcaacggatagtcgggtgatgtcctggtcacgtaactggatggtgccactatcaaccggtaactcgccactgatcgtgttgaagagggtcgacttaccagcaccatttgaaccaagtacggtaataaaatcaccatcatagacgtctaagttcaggccccgcaaaattttgacctcattcggggttcccgaattaactttggtcacgatattttttaatgataataatggggcactactgttcgtcataacgggccactcccttctttaaaacgtgattaagatgtagaactttactgaattgcggtaacattaagcagattgccagaattaatgcggataacaggttcatgtcgttggtgttgaagcccagttggaggactaacaggcgcacgaactgatacaaaatactgccgagggtaaccgcaacgagtcgttgattcaacgttaattcaccaaagacaacttcaccgatgatgatcgaggctagcgcaattacgatgattccgattcccatgctgacatcggcataaccgttattttgcgcaattaatgcgccgcccaggccaatgataccgttagagaccatcaatcccatgatggtcatgttatcggtgttaataccaattgaacgtgccatttcacgattgtcaccagtgacaatgaaggcttggccgaggttagtttgcaagaagacaatcagaagcacggtaatgatactgatcactactaggccaacaaagacgctgtcaaaatatttaggcagtgattccaaaaagtgattagaaaaaatagtttgtttgcctagcaatgaaacgttggaactgccgcccataatgcgcaaattgattgataagcacgcggtcatcactagaatcccggctaagagaatgggcactttacccttggtataaagtagaccggtgaccaggccggtaatcgcgcccgcaacgaaggctaacagggaagcggtaacggggcccattccatggctaatcgccatgacagcagtggccgcaccgagtggaaacgtcccttcgacggtcatatcaggaaaatcaagaattcgaaatgtcaaaaataatgcgacgcctaaggttgcccacaagaggccttggccgatactcgatacgatcatactcatttgtaaataacccctttcgctttggcttctttaaggacacttgctgggaacttgatgccgagctttttagcttcacttaaattgatggtcatcttacccttagtgatgactttgattgggtagtcgctagttgctttgccctttaaaacttgggctgccatttcaccagttagtttaccaagttgatattggtcaacggataaggttgcgagcccgcccgctttaaccatcgtatcaacggctggaatgactggtaccttagccttatttgtaacggagactagcgttttcatggcacttgcgacgccattatcttgcggcgcataaacggcgtcgacattggcggccatggtttcagccacttgctgcatatcgttggtgttagagatagtatataacttgtatttcacaccttcttgtttacaaatccgtgcaaactttttggcgttatattcaccaccatgatctgaagtggtgtaaataattccgattgttttagcgctgggaacgagcttccgcaacaagtctaagtgggatttcaatggagattcaccagaagtccccgtaatattggcaccgggatgttggtcgcttttaattaggccgctacccgatggatcagtaatacctgctaacataacaggggtttgcttgttagccgcagaagcgagggcctgcgcggcgggggtggcaattccgactgttaacgcggcgttttcgttcatgaatttttggctcatggttttcaagttactttgatcgccctgggcattttgatagtcgattttgaccgtcttgccatcgacataaccatattcctttagaccagcgaccacgccacgatgaatcgcgtcgagtgcggggtgggtctggagttgaagaatgccgaccgtcggcactttctttgtactggtcgtcttcgtggcggtggttttgcctgtcatgacaaaggccactcccagaaagacgatcaaggcactaatgaatgcaatcatacgtttcaatctaatcacctcaaaaaatttcttaagctcgggcaagttcaaagccaataaaaaagggcaaaccagtaagctctggtttgccctttacggaaccgaagcctgctgtgttaaaacccatgcagacttctttgaatatcaaagtgagccggcacagatacaaactgtttgccagattgtatccgtgtggacggcattacaatctgaacggccggctttgccatgaactgttcaagttagtaactgactttgacatgcttggttcctcgctttcgttattgaatgagttcagtataggcaaagtcgaaaaaagtgtcaaggataaatttcaccaaatattaaaatttgtggtgaaaatcttgtgagatgcggatgcttggtcgtcggcatttgttcgttctagtccgacctccggggcggggggccaatggctggaacgcagccgacgtcgatttaagcccgagcaaaacccgcctggtctcaagcctgtgaggggccacggttgaagccgaacattgtctagtaacggattaatacggttttgacattagtctgttggcgtagcaagcacagaatttagtggtaccgaacacgtttcgggaaaccgctcgaatggctgatgaacgaccaccgagcttagcgcaacttatcggtgcctattttgatactggcactttaaacaaagcgttaggttcattaaagcattctgttgagagattaaatcttactacaccgattcaggattagtgagctatctcaatatcactttcagtctgacagttgattgacaaaataactgtttataaaaagcaacgacgaattcatcaaaagttgagtacatctttgtccgccattcgaatactatcccgactggaagacgttccggcaattggcagaaatgcctgtaagttggcttaggacgaaccagcaaagcatgtttacgctaactcgcacgttttccagcgggcctaagctggctgcttttgattttagttattcagcaagttttgaataagcattcaagtaaaacataacgaaaaaacaataaaatgagttgacaatgaataaaggtggtgttaaattagttttaaattaaaaacagattaagacgttgaagagaagagtaatcgcatcactgatttgcagagagcttcgtaatggtgagagaagtattcaggagtgcggtgaagatgagcttggagtcatgatgcgggtcgtagtggttacgcatgcggtggcaaccgatatattgcggggtttcctagatttttcagggtactcgtcgaggttgtgatcgtgagatggcagcgaacaacggtggtaacgcgaaagctttcgtccgttagtttctaacatattagagactaatggatgggagcttttttttgtttcaatacaggtgagagggagcggttagatgacagtcacagcaaataatggattattagcggcccgtggagaatgggcgaacgcaacgtgtcaagaaagtcatcaggcacaacagattttaattttaaacttgatgccgactaaggtaacgacggagcggcagttcctaaagcgttttgcagccggtaacacagatgtggctgtgacgtttatgtatcccgctagtcaccatttcaagagcctgccacaagcagtggtcgcggcacattacgtgacgttggctgatattcaagatcagtattttgatggcttgatcgtcaccggcgcgccagttgagacgttaccgtttgaagcagtcgattactggaacgaattgttaacaatcattgattggtcacgacagcacgttagccagactttatttgaatgctgggcagcacaagcagggctatacgcacagtttggaatcgcaaagcgtgacgttgctcacaagatattcggtatttatagtgcgactagtactgatgttaagtcaccgctgattagcggactgaatgctggaggcttactaaaaatgccacagtcacggcatacagcactagtgatgccggaacgcttacccgctggattgcaggttgtcgctgacaatccgaaggtgggaccgctcgtcttatctgcccccaagctgcacgcggtctatgtgaccggtcatcctgaatacgaacgccgcacacttgccgatgaatatttgcgcgaccgacgtaagcacttgccgattcagttacctgaacattactttgctactgaacaattaacaacagttgattatagttggcaaacttcaagcaatcaactgtatcaaaactggttagcaactttgaatttaacgaaagtaggttattaattatgacaacaacgaatcctgaaaattatcactttgaaacgttacaagtccatgcgggccagacggttgatgaaacgggcgcacgggccgtgccaatctatcaaacgacttcatacgtctttaaggatgccaagcaagccgcgggtcgctttgccctgactgatgccggcaatatttatacacgactgacgaacccaacgacggacgtggtcgacaaacgagtggccgccttggagcacgggacggctggggtaacgctcgcaacgggttctgctgcgataaccgcggcaattttaaacattgcgcaacagggggatgaaattgtggcggccaacaccttgtatggtgggacctatgacctgtttagcgtgacgttaaagaagttgggcatcacaacgcactttgttgatcctgacgaaccggcaaattttgagacggcaattaacgatcatactaaggccttgtacgttgaaagtatcggtaatcctggcattaacttagttgattttgaagccattggaaaaatcgctcatgatcatggcattatttttattgttgataatacctttgggacaccatacctagttcggccacttgaacatggggccgacgtggtcgtacattcagcaactaagtttatcggtggtcacgggacgaccatgggtggcgttattgttgaaggcggccaatttgactggcgtgcgagtggcaagtatccagatttcacaacgccagatccgcaatataacggcctcgtttttgccgatttgggcggggcagcctttacgactaaggtccgggcggaaacgctgcgagataccggtgcaactatcagtccctttaattccttcttgttgttgcaaggtctagaatccttgtcattgcgagtagaacgacacgtgaccaatacacgcaagattgttgccttcttaaaagcacatccaaaagttgcctggatcaattatccagaactggaagatagcccgtaccatgacttagcaactaagtacttcccgaatggggttggttcgatcttcaccctgggcttgactggtggcgaggctgctggtaaggcattaattgaacatctacaactcttttcattgttagcaaacgtcgctgatgctaaatcattaattatccatcccgcttccaccacgcatgcgcaattaaatgaacaggaattgttagcagctggtgtaacgcctgacttgattcgaatttcagtaggtgtcgaaaatgccgatgatttaattgctgatttggatcaagcattggcacaggtttaataggtcggaatggtcgatgattgaaagtatgtgaaacggagggtgcgacaatgacaacgacaattgaagtgggcatgttagggttaggaactgtgggtagtggggtggttgaacggttgacccgctcggctgccaaaattgaacaaacgcagggtattcggttgcacctagcagcagttgccgttaatcatttgaacgcgcctcggactgttcagttaccgattgggacgcgcttgaccgattcattaacgaacgttgtttgtgaccgaaaaatccaactagtcattgaagtcatggggacggtcgcaattgctaaaaaggccattgtggcagcacttaatcagggtaaggctgtcgtgaccgctaataaagacttaattgcaacggcgggacctgaattggctgcgttagccaaaaaacagggctgtgatttattttacgaggctagtgttgcgggggggattccgatcttgcggacattaacagatagttacgtgacggacaatgtgcaggcggtcagcggaatcatcaacgggacggctaattatatgctaagtgcaatggcaaccgggcaatcgtacgaacaagctttagctactgcacaagcagccgggtacgccgaagctgatccgactaatgatgttgcgggcattgatgcggcatacaaattgatgatcctcagtcgctttgcttttgggcaagagttgagcctgccgcagattgcacccacgggaatcacgcatttaagcgcttcggtttgtcgattagcagctgaaaatggctggcagattaaattgctcgcgcagattcagcgacacggatctggtttgtattgtcgtgtggcgccagtggccgtgccggttgatcaacccctgagtcagatcaatggggtccaaaacgctgtagctgttcaaagtgaagccattggtaccagcttgtataccggaccgggtgcgggaagtacggcgacggctaatagtgttctaaatgacgtcttagtagcggccaagcaccttatcaatggttatcgaatgattcgtaaccagaaaagaagtgtctcgttaacggtcactcgatttgaccagttaccacaaacatacttaggcattggtccggtcgcaccagaagccgtgaaatattacgctaatgaagctgatttctcagtaaaaacgattgccgatgattgttatcagattactggattaagtgcggtgaaacgcaaaaagctgcgtgcgaacttgccactgactttgataccaattgccggtacaacggactggaagcaagtgaccgaaaattcaataacatctcccataaatgttgcaatttgaaaaagaatgctcaggtacagtatactgtatctgagcgtctttttttgatgctaagttcccatgggatatccatggctaagtggatgagctaattgaaatgagttagcgagacgtggcagttggttgactgacacgatgaggagtgaaattatgaaaattgcggtggtgaccgaaagttctgctaatttaaaagcgcaggcggtgaaagactaccaaattacggtggtgaacgacccgattatgttcggtaatcatgtttaccacgagaacgtagatatcacgacggatcaattttaccgattactaaaagttgaaaaagaaattccaacgatttctcaaatttcaatgccagagatgcaagtcgtttttgatcagctgcaagcggcgggctatgaccaaattctagttattgggttgagtagtggtatcagtggctggatcaataatttgaagacctatgcgccgtcagttgacggtattgacgtgcgggtgtttgattcacgaactgcttgcgcggggacggcgaacatggtgaagctggctgcggccatggcattggcggactataccttagatgaaattattgcgcaactgacgcgcttgcgggcggctacgacgacggtcttaatcgttaactcgatgcgccatctagttaaaaatggccggatttataacaatagtagtctggccggaacgatggtgttgcgcaataagccgattattacgttcaatgggcatgggaagattcaacttttaggtaaggaacggacgcttaaaaatgcacaacaggctgttcaagatgaatttagtcagtttgtgatgaacagtcaattaccagttcggctggacgtcatcagcgctaatgacgcgcagattgccgaagattgggcgagcgaactacgttatcagtttccagcagtccgggtcaagactggggttatcggtccagttttaggcgtcttgactggagaccatgcgctcggaatgatctggtcattagattggaagccattgttgacgaccctcaatcaggagcaaaaacaataggccattggggttgcccgtgtgcggtttgctgatgatactgtcgtatacagacagctgggttttaaaaaagttttgcatcgaaggttgacattttactaaaatgatattatggttataacattaaaacttgatgaaaagctataatgctttaaggagtaactgacttgtgatgctcagaaagcgccgttgctgtgaaggtgtgatgacaagtgagtaaaagttaaaggattggcgtgaattttacgagattcactggtagcacccattattgtgcacgcgtttagttgttgtgaacgcgatgagtagccggatgtgagttcggttagcaataaggtggtaccgcgcgtaagcgccctttggataatttgatcgattattcaaagggcgctttttcgtcaagtgacacatagcattattttttagttaacacatagtagtcattatttaggtcgcgcatcgcggttaatcatcgtaaacacatagttgttcgacatcacgtgacagcacatagtagatcgtaagcacgggcccgtttattggaaaagcactgaagcgagcggggaacatatacacatagtgggcaagacgaaaggatggttttacttatgaaatatggcattattggcgcaggcgcaatgggatatcggtatggtgtaatgttacaagaaaacgccggtgttgacgttgattttatcgacacgtgggaaccaaacgtcgcaaaggtccgtgagcagggcggcgttgatgtggcgcgtgatcatcaaaatcaccatgtcgttccaattaatatttattatcctgaagaatatcagggtcatccagatgtttggattgtttttaagaagcaaatgcagttagccgatgagctcaagcgcgatgcgtcgttatttcatgaggaccagtacgttttcgccgcaatgaacgggatggggcactttgaaaagattgcacaatatttcccggaaaatcacattattggtggtacggcgatgattgcaacggtcttgaatggtccgggtgcggttgattttatggggcctaagggtagtgaggcgatgcatatgagtaagtatgcaggtcccattgatacgactactaagcaagtgatggccgattttaaggcggctgatttaaatccgatttggtctgataattttatgggcatgtgcatttccaaagttgtgtttaacgcggtcaccaatagtttgtgcacgatgttcgagattcagatgggccaattcatcgaatatccgggcgtcaaggatatggcgactcaaatgttcaacgaagcctatgatgcttgcgaaagggcaggcatcaaactcattgagacgcggcaagaagaaatcgactcggttgaaacggtcagtcgagcctataagtaccattatccatcaatgtatcaagacttctcaaagggacggccaaccgaagttgattatattaatggctatattgctaggattgggcgggaacatgactacgtttgtcgcgtgcatgagtttgtgactcacgaagtccatttagcagaaatgatgcggcaataccggcacccggaaatccccgttgctgaaaaataagattattaatgaaaaagttctgagtattttcagaactttttttgtgggcggaaaagcttaatttagtaaggttgaaatcggtttctttgacattggtctatacacttagataaccttgtaaactttcaatgaaaacatgttgtgataggatttataacgtgcttaaaaagagaatgaggagaaattggtatgaagacatattttcagaaaatcggtcagtcattgatgctgccgattgcaacgttgcccgcagcagcgattttggttgggattggtaattacctgccaaaacagtggctgtttgcaaattacttgattcagggtggtaacgttgtcctgaataacttagccttgctgtttgcagtcggcttagctatcgggatgtcagtcaataaggacggcgcggcagctattgctggtttgatcgcgtttgaagttccggtgatggtgttaaaaccagcgacattagcgacgatgctgaatgttaaagtgagtcagatcaatccagcatttagcgcgttagataacaatgtgctgattgggatcagtgctggactgattacggctgcgctctataatcggttccacgaagtaaaattaccaatggcgctctcattctttagtggtaaacgcctagtgccaattatggctgcttttgtgatgctgattgtgacggcggtattgtaccttgtttggccgtttgtctacgatgccattgtcctctttgcaacggggatttcaaaattaggtttcgtgggggctggtctatatggctttttcaatcgtttattgattccgactggtttgcaccacgccttaaattccgtattctggtataacgttgctggtatcaatgatattggcaatttctgggccagccatggtgttaaaggaatcacagggatgtatgaagctggattcttcccaattatgatgtttggcttgccagctggtgcgtatgcaatttatcgtaatgcacgaccggaacgaaaaaaagaagtgggttcattgatgttagcgggtgcgtttgcgtcgttctttacgggggtgaccgaaccgcttgaattttcattcatgttcgtggcatggccgctctacttattacatgccgtttttatgggactatcattaggattcgccgcgttaatgcactggaccgccagcttttcgtttagtggcgggttagtcgattatttattgagttttcggatgccgttagccaaccaaccctatatgttactggttcaagggctggtgatggccgtcatttattactttggttttgactttgcaatcaagcggtttaatttgaagacgcctggtcgtgaagttgtgtctgcagatgtcgatggggtgggtgcacctgctagtccagcggtggccgttgcagcaacggatgataaatatatgcgccaagcaaagcaaatttatgcggctattggtggtcatgacaatattagtgtgatcaacaattgtacgacgcggctgcggttacaacttaaggatacggaaaaagttgatcagccggccgtaatggctgctggcgtgcctggtttgaacgtactggatgttcataacatccacattgtgatcggtacggaagtccagttcgttgcggaggctttacaaaaattattttctggtcaggtggcgacgaccccggcatctgatgctgaatcaaaggccccgcttgaaccgcaaactgctactgtaacggaagcgccggtgacaacgattttgcgggcaccggcaacgggacaattaatgccgattagtgcggttgcggatgagacgtttgctggtaaactcttaggtgatggttacgctgttgaacccgaagatggtgaagtcgttgctccggttagtgggacagtgacaagtgtctttccgaccaaacacgctatcggtttgaagacgacgagtggtttagaagtcttattacacatggggatcaataccgtggaaatgaatggtacgccgttcaagttacacgtggcaacgggtgatgaaattgcggccggtactgcggtagcgacggttgacttggctgctatcaagtcagccggtaaagcgacaaccatgatggtcgttatcaccaatatggatcacgttaacaaactaacccttaatccaactggtcatgtgactagcggtgatttgattggcgcagctgaataagttacgcgctgtcgacgttgggtttattgaaaaagtttcgtctaaatcttttcgatttaggcggaactttttttgtcgcattggttatcgaggcaacggatgacagcaaatgaacaacttgatgcggggacagtgcgtttgattgcttcccactgactcccacgatatactattggcattataggggggcggtaacatgattgacgaagtattagtattgaactcaacgccaacggggattttacagaattcagtttcaggaagcatggtgattgacgcggcacttgatgcacgactagtcaagcgactaatgcaggcgctaactcaatcgatgcttaaggtcagggttgcaaccgcggacgacttaccggtgaccgaccaccaattgctggtcgtcagtcgaccagtggcagccgtgttggacttacaagctagtgcgcgagttctgatttatccagaagcaacgggactgacagccgctggaatgacacagctagcagtgcagattgatcaacgattgactaaaatatccagataacgatcaaaaaacgcccagggcagttgttcgcaagttactgaacagttgccctgggcgtttttaatgattagtctttgtggtgttttttaatgatagttactaatttcaatcaagttgttatcaggatcacgaacatacagtgacgtcaactttccgtgggcaccagttctttcaaccggcccggcaatcacatccacgaaataactctttaagtgatgctgaatatcatcaatattatccttcgcaatcaagcaaagatctgcactgccgggtgtcggcttagccgcaatgggttggtgtggctggttagtggtctgaaagttaattttttgtttacccactaagacagcttgacggtcaccatcgaaggtcacaatgggaaggtcaaatacttcatggtaaaaccgtaatgaccgtgcaatgtcagtaacggttagggtcaaatgatcgatatcgcgaatattcacaagctcaaatcccttcaaaaataattcattattaaacgtgtcgtactcatcagatttggcatgaaccatgattaaaatgtaccagttagattgctgttcgtcagccgttgcgcgtcctatgccgacctccggggctgggtgccaattgctggaacgcagccgacatagatttgagctaacgcataacccgcgtcatctcaaatacgagtcttattctaagccggaagcagaccacttccagcttagaataatttggctactgagcattgtcacccagcccctccagtctcaagcctgtgagaggccacgggttgaagccgagcattgtctagccaacggattaatgcggtttgggcattagtccgttggcgtagcaagcacaggctttagcggcaccgaacacgtttttggaaccccctcgaatggcagattaacggccacttaacttggtaaaatttgtcgctgactattttgacaccggaaccttaaacgaaacgtcagggttccattaaccactttgtcgagacgttcgattattactatgccacttgaggaatagtgagctcccacaatatcactttcagactgacaggtaattaacaaaattaccgtttatgaggaacaatgataagtccatcaaaggttgggtacatcttcgtcagccattcgaatactgtcccgactggaaggcgtttcggccaatgctcagcggtgaaattccacttagcaagcgtccttggcttggttagtggaagaccagtatttaagacgtgatctgcggcttaaatctgtgtccaccgcgttccaacaattggcagaaatgcctggaagtcggtgtaggacgtcgctaactaagcaagtttacgctaaatagatctttttccagcgggcctaagctggctgcttttgaactgacacaactggtacgttttaatcatgattcatgccaataataatgagtataagacggtgttattcagtataccacgattgataatgggacggatgtgacagtatttaggaagcaactcaaaaaacaacaactgtaaccgttcacaccgaacgcgacttttgacaatgcttgcttttcatagtaatgtaggtgttactataagaaggagggctattcgtgataacaattcgaccagccgatcaagacgacgcgggccagatagcaccgctaattaatatgatttttgatgaaatgcaacttgaggaactagacgatattcctgaacctgacttagagcaggccattactgccgcttaccggacacctgattatttgtctggtaaggcaacgacggtagtggccgaggccgatggtcaagtggtcggggtagcgtttggttatcctgacaaaaatgaggacgcggtggacgacgtgttagcacgagttactgcgaataatgatgcgtttggttcagcatttgaagctgaagctgaaagttatgagcacgaatggtacctggattcgattgcggtcgacccgaattatcagggtcatgggattggcgggaagttactcgccgccctgccaagatacgcgcgacaagctggtcaaaagcggattggtttgaacgttgacatggctaatttaggagctaagaagctctatgaccgttatcattacgaatcggtaggaattaagcctatcggtgatcggatgtacttccatatgcaatatgaactagataaagacttggtgctagcttagtatcagggctatcgcaacgggcctcgtgatatgacggggcccgttttaatacgggtcaaaatgaaagtgtaggttgaaaacaacatggctttactagaagtaacggatttatcgcaaagctttgcggaccgtaaattatatgacgatgcgaattttacgctggaacgagcggatcatatgggtatcgttggtcaaaatggggcgggtaagagtaccctaattaagattttaactggccagatcttaccattatctggtcagatcaagtggcagcgcaacgttcgaactggctatctggatcaatacgccgatattccagccggcatgacgctatacgcctttttgaaaacggcttttcaacgcttgtatgatttagatgcgcagatgcaacaactttatgcggattatgctgaaaagatggatgaccagttattggaacgtgcaggtcggattcaggagaccttggaagccaataatttttatgatgttgagacagaaatggaacgggtaattaccggactaggattagatgaaatcggtcgggatcacgtcatcagtgagatgtctggtggtcaacggtcgaagatcatcttggctaaactattgctggaaaacccggatgtgattattcttgatgaaccgacgaactacctcgatacggcgcatatcagttggttggaagattatttgaacggctttgaaggggccgttatggtgatctctcatgactatgatttcttgcaacaggtcacaaactgtatttgtgacgtggcattcggtaaaattattaagtaccggggcgattttaaagcggctatgcggcaaaaagaagcgcgtaaggaagcccaactgaaggcgtttgaaaagcaacaagttgtgattgaaaaagccgaaaagttcattcgcaagaacaaggccggttcaaagtcaacgatggcgaagtcacgggaaaagatgctatcgcatttggatcgggttgatccaccgagtgaaaatgaacacgccaagtttgcctttccataccttgatacgggttctcaaaatgcattgagtgtgacgaagctgtctgttgggtacggaaagccgttgttggaacccgtaacttttacgatgaccaacggtgaaaaattagcgtttaagggctttaatggggttggtaaatcaactttgatcaagtcaattttaggtgtaattccagcgttaagtggtaagtcagatttttcgccatctgctaaaatcaattatttcaatcaagatttggaatgggataacccacagttgacaccgttacagacgattcaaaatgaataccctacgatgttaccgaagacaattcggactaagttggctaagtgtgggattaatgcggcgaatgcgatgaagccaatgcacttactcagtgggggcgaacagactaaggttaaattagccttgcttgaattggttccaagtaacttcttaattatggatgaaccaacgaaccatttggacgatgaaactaaagaaggcctcaagcgtgcattacaggctttccaaggtaatctaatcttggttagtcatgagagcagttttgtgaatggctgggttgacaaggaattgaacgtcgagaaactcagtttgaaagaacgacaaggctaattcttatcctttttaatagcagtccatgcttgggcttgtctgtggatagacattcaagcatggactgtttttggatgtcctgattaggagaaaattattgttagctgactagttaatttgaaaatggactgctggcgattcagtaattattggaccgtcagcgcgccattgtccccatcggtaatcgctaaacccaaaaaggccgttaatttgtaaatcgggaacgaatttacaaattaacggccttttgggaacaattattaatccgttagtaattgactttcaaccgtggtctggtcgcgaccggcctgcttggactgatagaggtagtcgtcaacgcggacgaaccaatcagtgaaagtctggtcagttggttgcaattctgaaatgccaattgaaacggtcacgttcaacgtttgaacgttaaatttgattggtactgttttcagtttacgctgaatcgtacgcattatttgaccagcttcaagcgctgagatgccacgaaaaatgatgacgaattcttcaccgccatagcggaagatctgaccgtgagtgctgcgctgattaagttcaagttcaacaaaatgcgccacgtgtcggagtacggcgtcgccagccagatggccgtactgatcgttaaaggctttaaagtggtcaatatcgaacatgaccatagtgacgggccccatttgatggtgctgatacgcggcaaacacttcacgcgcatgcgtgtcaaagctggcgcggttacgaataccggttaattcatcgtaattgacttgttgatcaaaggtgagcacttcattgaaaaacttttggacgcgattgactgctaaacgaatcaaccacatgtaaaggacaaaggctagaatgatgacgagtgtatggctcaatttgaacggatgaactgaccaaataacgccccaccaagtgccactatatagtatttggaacaggagatacttccattgagtagcgtgtaattcttgatagttatgagtaatatagacgactgtactaatcaagataatggccatggccagaaaaactggcaggtactgcgtgctgtggcccaaccagatggcctgaccataaatgaacaatggcattaacaggttaataatttcaacggccaggttgcgcatggtgttaaggctgaacagaagaatcgttaattgaaccgttgcgtaggtccaactgataatgctacctgaattcagcgtaatgaatatttgtcgtaataggatcatactaatgaggacacttaaagcctcggcaccatgggccccaatagtccaatatcgattttgacgacgatggacctgttgctctaggaggtaggtcagaatggtcattagggtgatcaggccaattgtaatgagaatgacaattagcattttgatattaaaaagatctcggcctaagctcgatagcgtaagtagatgtaacacagtgcgcccccataattgttgcgtttaattaatttgtcctttaatcataacacgttacgcaggtaactgttaacagcagtttgcaataatttaaaaatcatcaaacagtctttactgaaaaataacctagtctttacataaatatgatgatgatttaggcctcaatacggcatacttaccatgtaaggttagatagcaaacgcaataaaaaggagtttgtaaaatgctgcatggaacgttctatggtgtgatcttgattagtttcttgattggtatcggcgtgcagtggtattttcgtgaatactttcaattattagtgttcggccatagtgttgagattttatttatgatggtattaggttggtaccagttcggcatgctcgttttactaccgctgttagttttatggggaattggacttggtgcaatttatgtgatgaaccgattcgcgtaattagtttgtgtcgtggaggtgcccaatgagacgatggtttgtgagttacacgctaggaatgattgttggtgcggtgttatttttgtgtagtttagttgccattcattggttgggaccacaattatgggtgggcgtggctttaggtgggagtctattggtaggctgtaatattggcttagaagttctcaagcgtcattatcaagtgacgacaccacaagcgatttttaggttattgaattggtcctgaggtgcccataactgatagttgggtttgatttgaagcgggctaccgatctctgacattgcaattggaattcattaaataggcgcatcgagaaactaacatggtttctcggtgcgcctattaagctacagtttccctgtgcatgcggattaatgattaattttagacatgtcgtgatcatcgggcaacgtgaggccacggttagggacacttgttgaaaagacgatctgagtactcgtttttccaaatgtttgtaattggttgacaaactcgtctaatgcctgcgttgattcgaaaatcactttcaaaatttgagagtattcacccgtgatacagtcacattccagaatattaggaatgccggcaacaaatgggtaaaagcgctccttttgcgttggttcaagttggagttgaatataggcttttatgtggtaattgagcttttcaaagttaagatttgcttgatagtcacgaatgatgccactctttttcagacgagtgatgcgagcggaaattgcgggcgaagaaatgaagcattgatcggcgagcgcttttaaggagattcgcgcgtcggcctgcaaggcgttcaaaatcttcaaatcggttttatccatcgttaaaacgcctcctaagtaattattagtatcatagcatactttcacagtgatttttaatatttagtgtaaagtttctactgaaaggatagcttcttaacgtgccgaggtgccacggcggtggggggcgatcgattaaagttaaaatcacttcaaggtttgaccaggaagccagacgtggttccggagatatggtaaactgaaaaaatgaggtgactagaatgcaatcaacacggattattgcggccgttgcgaacgtgtggcggcagccaaacaatacgtccatcgatactccggcactagcaaatgtcggcttacaaccatggttggcgcagttatcagatgaagatactgtggctttggaacgcgacaatcgcatcgtgacgcaggcgttatttaacgacgtctttttagtcgaacagtttgtcaatggctgggcctatggttacgttgttaatcaggccgactcccggcatccacaggggtatccaggatgggtatgggcggcgcaattgtcgaccgtcccattgccggttcaaactgggccgatgattacgatacggcgtggctttacgccgttactatgcttagatggccgtacgttcttaaatcttagccttggaacggaactacccgttattagtagcaaagatcatcgttattatacggtccagaccccactcggaacgggcaaaattgcaaaacgtgcgacgcagtttgcatttagaaccgcgcgcttgacaccgggagcgacactcgttcgactcggtgaagaattcttggatttacgctacctatggggtggcatcagtgcttatggtttcgattgttctggattcgtctataccttgcatcgcagtctaggtattcgcttaccgcgcgatgctcaggatcagatcaagcaaggagtggcggtcgacatagcaaatgcccagcttggggatctgtgtttctttgctcataatcatgggaacggtgcggtacaccacgttgccctatatgccggtgatggctggctattacatgcacccacgcctggcaaacacgtgacatacttgcagttagcaagcacttatttacaagatgagttggtcgctgtcaaacgaaattggtaatgtgagttcaattgacttagatttaattaaagtagaatatttcaaaatattaatggggcggataaagtgaaacaaattaaatggtggctggtggcagtcttattagtcgttggcttaaccggttgtggttctcaaaccactaagcaacaagcaacgcaacgggcggcaagtactaaaaaaatatcgccgtatgtgaatcaacagacccccacattttacgtccacgggtttcaggggagtgcgaaatcaacgaataccctgattgcgcatgctgaaaagactgctcatgctcacaaagttttggtggcaacggtcagtaccagtggtcaagtgacgttgacgggtaaatggcgtggtcgggtgcgtaacccgataattcaagtcgtgttcaagaacaatctggcccagtatgaccaacagagtgcttggctggctaaggtgattaccacggttcaacaacagcacgcgtttaaacattataatatcgtcgcccattctgcgggctgtgtcgctagcgttaatatgctgatgacgcaacaaacgacgacttttccgaagatcaataagttagtgacgatcgctggcccgtttgatggggtggtcggggaagatgatgttgctaatcagaactcgtttctgacttctgggcaaccgaaatatttacatgcagcctatgaattattggcagccaagcggagcaattttcctaaaaatgtgcaactattgaatatcgtgggaaccttgaacgatggtagtcattcggacagcttggtcaccaacgtgtcggcccgttccatcaagtatttattgcgtgggcgggatgttgattacaccgaaaaagacttttatggggcccatgcgcagcacagccagttacatgaaaatgctaaggtagcactggcagttgaccgctttttatggcatcgatgatatgaccggggctctgctaatcaatagttggtttgggactgtgagtcagtcacgttacgcaattagaatcaaaatcaaacaagctcatccggccttagtcaggtcagatgagcttgtttgatgatcgttatcctgaagtcagcgggttggtctgggctagagaaagaatagaatataagccgttcgaataaggtggtacaacgcatatagggtaattaaataaacaactgagataccgccatatacggcatatttataattgcgcatgtaaaaacctcccttataaaattacctttagtgtaaatcggaatctgtttttacacaatgcaaacgccttcattattagggctaaatttaaattaagtcaaagaaagagcattctgttagcgataacttcaaaaatatgataaagttaattgttagttcggtggacttcacgctgccggattaaatttacctcagattttggataaattaatttttagtatcatgtacttgccccagtattgagtattagaattatttacagatttcctgagcattaggaaaggatgtaattcaatgcgcgttaccattaatcgcggtcaagaggtctacactgatattcccttaatgaccgcccgacatcgctatatcaaagcggatgtctgggaaataaaaaaagcaattattgaaaagtcagccattaacgggtggacggttcaagcgctacaagcaatgaattaaaaaataaacaacggccacggcatttgccagtggccgtttttgtaggaggacgatttgaatggcgcatgaagtcagttatcggccattaatcagtattacgaacgtaatctggagtttcgatgcagtgaccaagcaactgctggtcctgcttattcagcgtgatcacgctccttttgagaatacctggggattaccgacgacgtatttgagaacggatgagagtgcggatgaagccgcattgcgattagttcgtgagaagttgggcgtccagcttgcccaattccatacagaacagttagggacgtttaccgcggtcgatcgcgtgccgggtgaacgctcactggcgttgacgtatatggtttatttgccagtcaagccggaactagttccggggtatggtgcgcgcgatgtcaagtggtttgccattacgccgcgggtggatcgtgatgatctggtcgctgatggtttggcatttgctggtgttcccgattcgcagacggagcgggagttttatcaacgaatcgccaagcagttgttaaccgccgatcatggcctgatcttaagaaacgccctacaacgtgtgcgcaatcgcctggactatgctcctacgatcttattagtgttaggtgagcagttcacactcaaacaggcgcgccagctgtatgcgattttgtggcggcagccagtggcaactatcgacaattcaaactttcgtaaaacccacgttcatttatttacagaggtggggacagcccgacctggctcttctggacgccccgctaaggtataccggctaaagtagttcatttgacacgtccaagtcggtatgctacttttatagcaccataaaggtaaaaaatacctaaatcagcggaaggctaattaggaaatttgggggagtattggaatggtcgaaagtaaaagaaatagtgctaagctattatgggtcatcgggacggcctggctttttgatgcgttagacgtggccctgctatcatttgtgatgccggttattaaagaaagttggcagctaactgcaggacagttgggagcagtcagtgcgatcaccacgcttggcatgatgattggggccttggtatgcggctatttagcagataaattggggcgtaagccggtcctcattgggacgctactgctcttttcgcttggtaatttgttattgacgattaccccgaacgtcgagtgggtcttagtcgttcggttgttgactggcattggtctggggggtgaactaccggttgctgcgacaatgattgctgatcattatacgggaacacagcgctcacgcatgctagtcctggtagatagtttttgggcgtttggttggattgcagcatcgttattggcctttttagtgatgccacacattggttggcggatgacggtcttaatcaccgccttaatggggttgtatgcgttgctgttacgccgacacttacctgcagaacaggaggctaatcggccacaaaaagttgattttagacaggcattgcggcaagtgtggtccgctaaatatcgacgagctacgatttgcctcagcattctatggtttgtgattatgtttgcctattacggtatgtttttatggcttccaagcgttttggtgttgcgcggattttcattagtacatgggtttggctatacgatgttgatgagcttggcgcaacttcccggctattatctagctgcgtggttgatcggcgtcgtcaagcgtaaggcggtattggcaacttatctgattgggacggtcgtcagtgccgcagcttttgggacggccaataatccaacgatgattctgattagtggtgcatggttgtcgttctttacgctaggggcgtggggaattatgattgctttcacaccggggcaatttgcgcccgcggtacggggaattggtatgggcgttgcccagtcaattggtcgcattggcgcaaccatcggcccatttttagttggtgcgctgatggcaattggatttggcattccggcaatttttatggtgttcgtggccgtactcttactcggtgttggggtattgctattcgggttaccgaatcaagagacggatgattaagtatcggtggcagatataaattaaatcgtaagttaaaattacttatatggaatggactagtgatgtgggcgctgttgctgaatttgaattgaaatgattcaataatattttttgtgaaagttaaacgagctcagtgatgacgcggctttgagggtgtcattcgttgcgaagccaaagcgaaactcctatgattacactgaggagttgaaaaaaatggcaaaggcaaaagcacgtacgacccaaccgaatgaacgattaagtgcccaactagcacttgccagcatggcaattgagattcgaagcgatgttgtgttgaccaggttagttgcgcgggctcgtcgccggcttaatcgtagtggtgacagtattgctatcgcgcaccaaatcgctgttgatctaggttattatttagtgtgtcatcaatacaaaatgccccgagctgcttatgatttgttagcagttgtgtatgaagtaagtgttgagacgcccacacgagcgactattattcagttaccgtcacgaaaaaaatagactaggactatcaattgattcacacttatattagaatataatgataaatagatgtgcgaaattggagggaattgaatgggaaggtctgaacaattaaaaaaactcgtcttggcagggttatttgccgccattatttttattggcatcagtgtattacgaattccgttgcccgcgattgttgggcggccatttattcattttggtaatattttgacagtgctcgcagtgatgctgcttggttttggctatggtgctacggctggtgcagtggggcttggcttgtttgatattctgaatgggtatgccgcaacttcgtggttaacaattattgaagcaattattctggccgcgatggtcaacctgagtttcaagtcaatcggctatcgtgaagatcgtattggccggctttactgggtatcgttagtcgcagggctcacaaaaatcgtcacttcgtggtgtacaggcgtgattgaagccttaatggtggggacaacgctcaaggtcgccatgattgggtccttcacgagtttattagcagcgaccattaatgcggtggcatgtgtcatcattgtgccgttattgtatcggatcttagtacaggttgggtttaaccgccagcgggtcggtacggtctaaatggccgcatgctaacgcagctggattagtgccgtgagcacttattattttaacagactggttgcaatccactttaacaccgttggctgtggcgtttataattattggacagatttcggttgatcaggttaaccatggttgtattatcggtaaaaaaagccctttccaatttggaaaagggctttttactgaagtagcacgctaatcaaaataggacaaaaaaagctatcccgttaggatagctttaatgaatattgatataacaagtgttctggagcttattacatcactttgaaactcagtaatggagatggcgagagtcgaactcgcgtccaagcatattgcccctcggatatctacgctcatattcatactatttaaatttcatcattgcaaacgccgtatgacagggcacccagcaatgactaacctgattagtctcttctcgcaactccaggtggaagctttgagcgtaagtccactaaatttaggacccagatccagaacatggacgatcctgggaggatctacgttaagcgcttattaggcagctaaagcgtaagaattgttattattttttgcagttataatttaaactgagcgtttttacgtagacgcaacctacgaagcgcaatccgaactcaaactatacctgtcgaatccagaacatccccaaattcaacaatcctagtttagcacagctcaactgttctgccaactaatctgtctactggtcatgacaatcattacagcagtttaagatgaagagtgtgctcggcggcgccgcaaaaagtgcaacattttatgtgtgttcagtgaaagtgccatgactgccaagataatcagtaagccgccgataaaatcgaagctagtgagttgaacgtttagaaaagtaatcgagaaaatcgtcgcggctaagggctcgaaggcgtccatcaaactggccgttgtcggtagaatatcgcttaaactacgcgcaaacatcaggaagggggccaccgttcctaagagaataatgacgattaacaagcctaattggggccaggtaatcgtcaggtggacacgccacatgggttgtaacaaggttagaaacagacccgcaatcagtaacccccagccagtgacggttaatgcgccatactttggtaaaatggttcgcggaatcaaggtgttcgtggcgaccccgatggcggataagccgccccagaacaagatgacgggtgaaattgctagactgtttaagtgaccgtgtgtcacgatcaatagtgtcccgataaaggccatgatcataccaatcagttcgatacgactgggtgtcacgtgcttaaataagaagtaatagatgctgataatgaatgggccaagaaattggataatcgtggcaatcggggcattaccaacgcgaaccgcttcgaaatagcaaagttgaaccggaatcagccccagcaaaccgtaactcaccgctgtccaagcggcatggcggtgatgccagattttaaagggatgtttaccagccaccatcccccagacgagtaaaatcaagcctgcactgatcatgcggacctgcgttagccacattgcggttagatgcggattattgatgaagagggtactcgcagccacccctgagataccccacagaatacaggcactactagcgagtaagacgccccgtaaatgattttgttgtgtcaaattacgactcctttctgaaaataataagcaattttcattatagcaaaggtgcgtctgggaacctatgtttatgaggaatctcttattattctcatgggttacttcatcaaaagtaacgggtgcgtttcagaagaactcatgctatgatatgaacaatcaaacgcgaataatgatgcgtctaacggaggctataaagatgaaagcaattattaccgttgtgggacaggaccaagtgggaattgtcgcaaaagtagcgaacgagttagcacgtttaaaaatcaatattgtcgatatttcgcaaaccttgatggatcataattttaccatgatgctatcggcggaatgggatgaccagcaattaagttttgcggcggccaaagaggcgttagaatcgctcggtgaggcatcagagttaacgattcgaattcaacggcaagcggtttttgacgcaattcagaagttataggaggcggccatggaaagtcgttcaattttagaaacaattcagatggtggccgaggaaaatcttgatattcgtacaatcacaatgggcatttcgctctttgattgtgttgatagtgatggtgagcgggcccggcaaaaaatctatgataagatcacgactagcgcgaaggacctggtcaaagtggccgctcaaattcaagaagagtacggtattcctatcatcaataagcgaattgcggtaacgccgattgcattgattgcggctgcgagtcaggatcaagactatgtcgcgtacgcagtaaccatggaacgggcagctcaagcgctaggtgtcgatctcattggtggtttctccgccctggttcagaaggggtatcagagtggggaccgcaaactgattgcatcgattcccgccgcgttagctgcaactagccgtgtttgcagttcggtaaatgtcgggtcgacacgggctggaatcaacttggacgcggtcggtgaaatgggtcgtattataaagcagattgcggctgacgatccggtcaattgcatgagtttagtggtatttgccaatgcggtcgacgataatccgttcatggcgggcgcttttcacggtgttggtgaagctgatcgagttattaacgttgggatcagtggccctggtgtcgtaaaacgagccttagaagaagttcgcggtcagtcgatcgacattgtgtcggaacaaattaagaagacggcgtttaaagtgacacggatggggcaatttgttgggtccatcgcgtcagaacggttgcacgtcccatttgggattgttgatctatcactggcaccaacgcctaacgaaggcgattcggttgctgagatcctggaagaaatcgggttggaaagtgtcggtgcgccgggaacaacggcggcgttggccttactgaatgatgccgtgaagaagggtggcgtgatggcctgcgaacatgtcggtggactgtcgggtgcctttattccggtttctgaagatgctgagatgattcgggcggtcagtgctggtcgtttgaatattgaaaaacttgaagcgatgacagcagtgtgttcagttggtctggatatgattgcagtacctggtgatactagtgccgcgactatcagtgggatgattgccgatgaagctgcgattgggatgatcaacaacaaaacaacggcggtgcgcgtcataccagctaccggcaaaggtgttggtgatgcggttgaatttgggggcttgttcggtcaagcaccagttatgccggtcaacaccaatcaaccaacgacgttcattaagcgtgggggtcatattccggcaccaatccactcctttaagaattaggcacagtggacgttgtgaaggggcgaaccggcagtcatcctgaacttaaatggtgacttcacgctcgcaactcgtgaaatgtaactgaatgatgcacgatttcctggtcggtatgaacggcagaaaatcgtgctttttatgtcagtgagcatgactctggtatgatgtgtgactgatgtgccaagattattaagtgtccctcaatgatgggatgacacagttatttcacaaatcgtgcacgctttgttattaatttgttgttatactaatcctgaatcctagcgcgaagtagggtatgataatagataggttaataaatgatgattaatcaacaaagttagcaatcgtaattaacttggaggacgttgcactatgaaattattaatgattgaagataataaatcggtctctgaaatgatggccatgttttttaagaaggaaaagtgggatgcccattttgcttatgatggcaatgaagctgtcgaaatgttcaatgaagatgtcgatggctgggatatggtgacgctcgacttgaacttgccaggcaaggatggcatgcaagttagtgcggatattcgcaaggcttccccaactgtaccaattattatgttgacggcccgtgattcggaaagtgaccaggtactcggcttagagatgggcgctgatgattatgtcaccaagccgttttcaccgattacactgattgctcggatcaaggcccttcatcgccgagcagatttggctaagaccacgctggctgaccaacctgccagcacggtgagttcctttgatgttcagacggaccattttaaactgaataccaagacgcgggaagcctatttagcagacaaacaaattcgagacttgacccccaaagaatttgatttattgaagaccttagctcaaaagccgcggcaagttttctcacgcgaacaacttttgcaactggtctgggactatgaatattatggtgacgaacgtactgtggatgcacatatcaaaaaattgcgccaaaagattgaaaaagctgggccacaaattattcagacggtttggggggtcggctacaagtttgatgatagtggagttgacgctcaatgaaactgatttatcaacaaatgctagcgttctttgccgtcattattacggtaatcgtcgtcctcggattttcatttattcgaacgactagaacgatgctttatcaaaactcatggcaacaattgcagcagtacgccgcgagtattgaaaaggaagctattcggtataatacgaagactaatcaagttgtcgggtttaatcaacaatttctaaatgatgggaccgtcatcttacgagatcaacatattcacttttcggtatatgatgctaacaaaaagttggtctatccaagtggtatggggacaacaatgagcgggacccccggtggctcgatttatgatcccaagatctcagccaaagattggaagaagctgaagcggaataagattattacgcagtcgccccacgtcacgttcagaacacgcaatcgtgatcaacccgtgaatacaccgtcgttgcgaaccattgacgttttagtgccacttttctataagaatggagcaacgaagaagtttgttggggccatctcgattgggtcgtttgaacagaccttgcaggccaatgaacagcagatcgaaaaaaatctgttcattgcactgttagtctcagggattgcggctctgttgttaagttacattttggcacgttattccgttcgtcgtattaatcgattgcggtacgcgacgcattcggtcgcaaatggtgattttgacattcaagttgacagtaatcataaggatgagattgatgacttggcggatgatttcaacggcatggtcaactccctgcgaacttccaatgaagaaattaagcgacaggaaaagcggcgtcgggagtttatggccgatgcggcccacgagatgcgaacgccgttgactacgatcaatggtattttggaagggttagcgtacgatgctattccagaagaagacaagggtcattcaattgaactgatgcaaaatgagacgaaacggttgattcgactagtcaatgagaacttggattacgaaaaaattcgaaccggacagattgctttgaacaagaccaattttgatggcgccgaggttttgcataacttagttgaacagctcacaaagaaagcggccgccgcggatgatgaattcaagctgacggttcccgagaaactgccagtatgggccgattatgatcgctttgttcaggtcttgtttaacatcatgcagaatgccattcagttttcacaagctaacgtgatcgaagtaacgggtagccgtacggatcatgcgacggttgtcgcgattcaagaccatgggattgggatgacaccggaccaagtcaaaaatatttgggaacggtattataaggctgacccatcacgaaagaatacgaagtatggtgaatcaggtttagggctagcgatttcacatcaattagtccaacaacatggtggttcgatcaaggttgacagtgtggagaacgaagggacgtgctttaccgttactttcccagatgaaggttttgataaaccgattattgatgattaacgtgatagtttaaagcgggtaaatccgtacggaccgggcttggggatcgtaatgatctcgaggcccggttttgctaatgcggggtaacggtgggccatagcaataacccatcattaatagtaggaacggacgtttaatagtaatcgattgcggaccttaagcctaatacttttcagcgattgacactgttctacctcgcactctgaggctaaatatgttacccttaacaaggctgcaaacagcgatttatcaatagtttagataagatttgaaatgaataggagaaacaacaactatgcaaagagtacagattacgggaaattcgcaacgtaaagtcaaggacggctatcctttactcgtacaagatgatctcaaggatccgagtatgaaactaaccgatggctcttttgtggcgttaatggcaagttctcaatttatgggctacgcgctgattgcgaagcatcgtcggcaactaggctgggtcttgagcttggatgaaagtgagacgccaacgaccgattactttcgtaagttattcaaacaggcgttggtccggcgagcaacgagcatggatccacagttaccacaacgggtcttcaatgcggatggcgacggtctcggcgggttaacaatcgatcgttatcaagattactatgtctttacatggtacgcacaaggtgtttaccagcaacgcgaaatgatctatgcggcttttgaagcggctactgaacatcaatttaaaggcatctatgcgaaattacgatttaatgtcgaagaagctaacttaaagagtcaactcgtcacgggtgaagcagcaccagagccgttattagtgactgaaggcgcggtgacgtatccattacaccttgctgatgatttaacgaccgggttactattagatatgcgtcccatccgggaatggttggccggagccgaattgcaaggtaagacggtcttgaacttgtttagccaggaaaatggggttacggctgctgctgccgttgcgggtgctgccaagacgatttccattgaaacaagtaagaagggtgccaaagagaccgctgatcaattggcggtcaataatattgaccctgataagcaggaaattcgagcaatcgaagtgaacagctatctagattacgcccagaagcaccgactaagttatgacgttgttgtcgtaacggcaccgacttttgcgcgggtgaaaaagcagaagttccaagttgcaactgatttaactgacttattgacagcgaccttaccagttgttcggcgtgatgggcaattagtgattgcaacgactgcgaataatttttcaatgaagaagtttaaagccgcggtcacggcggcctttgtcggcagtgatcggcacttcacacttagtgagacgttccggttaccagcagacttcgtgacgcgcaaggcttacttggcaagcaactatttgaaggttctggttttgacactcgataagtagtgtgtgcgccataatttaagtggaatagaaaaaaattttaaagggtatttcggggaccgttttcattaattgaaaacggtccctatcgctaagaaaacgaattcatgaaaatataaaaataattatatttaaccctgaatccctgattgtgactggtaaaacggttacttaactggtaaaataattccttgtcgttaggcaagagagaaaacatagaaatgaggattattagtaatgggaattctaattgcactgattcctgcgattgcgtggggcagtatcggcttaattagtggccgaatgggcggtaccgctcggcaacagacccttgggatgaccatgggagccttggtatttggcttggcactctgggccgtagaacagccaactttaacaagcaaaatttggttgattgggattgtctctgggttattctggagtattggtcaaggtcaacaatttacgtcaatgaaggcggttggtatttcacggactacgccgatttcaactgggatgcaactggttgctaatgcgttggccggtgtgctgttattcaatgaatggcacggaaacatgtattggattggctccgcttctgtaattgtgttgattgccggggctgttttaacttccttaactgataagactgatccgaaccgtagtgcttctgaaaattggggtgttgggattcgtgccttgatcttatcaacgattggatacgctggctatacgattgtggtccattatggtaacgtcaatgcacaggcagttgtaatgcctcaagctgttgggatgttgctgggtgctttgatctggtcctttaaggataagccatgggttgttaaagcaacttatcgtaatatcgtcactggtctggtctggggtattgggaatctcttcatgtttatggcaatggcccaaatcggacaagctgtcgcatactccctttcgcaaatgggaattgttatttcgacgtttgggagtatctacctcttaggagagcacaagacgaagcgagaaatggtttacgtggtgattggctcgatcctggtcattgttggtggggtcgcgttatccttaatgaaggcttagtaaagctttactaaaaaattaattatttgatttacagattaaaaaaatctgttgaaggtgcggtaacggtaagttatcagcaccttttttgttaataattgtatttattttttacacaaatgacgaaaatttacgaaaaaagggaggaagcgcttttcattattaggcgagctattgtataatatgacatgtaaatacgtatagaaagaggtaatagtaaatggcacacatttcatttgacagctctaatttaactaagttcgtccataataacgaacttggcgaaatgcaagctatggtcacagctgctgataaggagctgcgtgaaggaaccggcgccggtaatgatttccgtggctggttaaatttaccaacagattacgataaggaagaatttgcacggattaaaaccgctgcaaagaagattcaagacgattcagacgtcctcgttgtaatcgggattggtggttcatacctcggtgcacgggcagccattgaattcttacacgaaactttctggtcatcactttcacgtgaagaccgtaaattcccacaagttgtctttgctgggaactcaatctcatcttcatacgtcaacgatttaattcacttaatcggcgaccgtgacttctctgttaacatcatttcgaagtcagggactacgacggaaccttcaattgcattccgggtcttcaaggaacgtttaatcgcgaagtatggtgaagaagctgctaagggccggatctatgccacaactgaccgcaagcgcggtgcgttgaagcaagaagctgacgctgaaggctacgaaacctttgttattcctgatgatgttggtggtcgtttcactgttttgacaccagttggtttgttaccaattgcggtatcaggcggcgacatcgattcattaatgaagggtgctgcggatgcccaaaatgaatacaaagatgccgatttatctaagaacgaagcttaccaatacgctgcttaccggaacatcttgtaccggaagggctacaccactgaaattcttgaaaactacgaaccaaacatggcgatgttctcagaatggtggaagcaattaatgggtgaatctgaagggaaagaccaaaaggggatctacccatcatcagctaactttacgactgacttacactcattgggtcaatatatccaagaaggccgtcgtaacttgatggaaacggtcgttaaagttgacaacgctactagtgatgttgacattcctaaggaaaccgaaaaccttgatgggttgaagtatcttgaaggcaagacgatggctcaagttaacaccaaagctttcgaaggggttattatggcccacgttgatggcggtgttcctaacatggtcgttaacattccttcacaggatgcctatacgttaggttacacgatgtacttctttgaagctgcagttgccatttctggttacttgaacgggatcaacccattcaaccaacctggtgttgaagcttacaagaacaacatgttcgccttacttggcaagcctggttacgaagaattaactaagaagttaaccgcacgtcttagtgactaaggtgctagcactttagaaattaagatggaagctcctaaaacaaacaactatcagctggctgataggctgcttgttttgggggctttttgcttgtctttctgacgctgtgttcgtagctgttattgagcgtcgtcgctaatctaaaatttatgaatcacaacgttgttggcgaaatgaatcgctacgtccgcaagatgaccctaatttaacatggtgacgctcgtaatttttgaccgcactggtcgcactaactttgaatgacatcacgcaatgaaaaatctgccgacctatctcgagtttaatcgtgagtggttggcatgtgatttaacagcagacgggttataatagattaggtgttaaaggacaaatatagtcatgcatggtagttgctcgcaacgatgtgtgatgtacgtgaggagtttgagatgcgtaaattaaacattatcgaaagtatcattattgttctcgggttactagtcttttggctggggagtgaagtgacagtaatcaggcaacaattgccatggttgcaatttgcagggctgattgtcgtatttgtgactggtttagcggatgcgatttaccgcgtggtcacgaagcggtccttttttaagtaggaatcctgctgattgaagttggagtcattaggtgtaatttaatacgatgaagcgtccgttactggcagtcagtgtgcctagtaatggacgctttttagttcatgccttgaatgtgtggggtgcttggatttatctctgctgacggttaagtcgtgattgccgtcataaaataagttcgaaatagaaaaaattttattgtaaaaatcagcaaaatgggtgatattttacaaattgtaactaccaagtaggcggtttattaggatttaggatgattataattttaattatgaatgatgaccacaggtattcaataacactttacatcattcaccaaaaatcgcaatgttattaatgaggaaatacattgtggggaatgtagttaataaaatagtggaggtacatatatgagctttttagaattacacgatattcgtaaggcctataccttaaatcaccaagagaatgtcatcttgaagggcattaatctaaacttcgaacggggggagtttatttccattcttggggagtctggtggtggtaagtcaacgttaatgaatattattggtggcttggatcatcattatgatggagatgtcttgttagacggccaatccttgcgttcaatgaatgtgcggcaaatggaccggtatcgtcgggagacaatcgggtttatctttcagaactttaacttggtaagttacctaactgtcttggataacgtcatgctttcattaaagatgactaagacgtcccatgcgcaacaagtccagcaagcacaggacctactcaagcgggtgggacttgagcagcagacgcaccagtatccaaatgaactatccggtggtcaaaagcaacgggtcgccatcgctcgcgcactagccagtgaccccgatattattatcgcagatgagccgaccggggcgttggatagtgaaaatacccaagaagtaatggatattttatactcaatcgctgcggaaggtaaacttgtgatcaccgtgacccattcgcaggaagtggctgactacgggacgcggatcgttcatttggatgacggccagattcatgacgaattagtgatcggggcgcctttcgacgtggtcgataagcaaccgacgcgttaccgaacacttggctttcggcagatgttccggatgtccatgcaacatatgcgtcgaatgtggcttcgttacctgctgattatctttggatcgtcgatcgggatcagtagtatcgtcgtaatgctgggcttgggatcagggattcaaaattatatgaatcaccagattacgtctcaagttaatccaaccgctgtccaagtatcaaagaagacggggaaagtcagcacggctgcgcgtaaaaaagcaaccagtgcagcagcttacaaagcagcggttaaccaagaacaagtcacagccgcgaagaatgccgaagtgacgactgcaaacgtcaaacaattagcggctatcaaacatgttaagtctgctaagctgggctattacacgagcacacaagcgagttataaaaaaacaaccgtgacggccagtctccagacggataaccccacaattttgagtaagacaattaaggacggttcacgtcctgaaaatggtcaagttttgattggtcgtaagttagctaagaagatggtgggtaagaaaaattatcaacaagcgctcaataagaagttgaccgttaaattggcaacggttaatcgcaagaatcagtccgtaacggtcagtcagacgctgaccgtcagcggaattacgggtagcgatgatactagcgtcgtggtcttaccacaaaccgtcaaaaagatgttaactgctaagaatgtggcttatcgaccaaattttgccattgttcaaatagataaattggcgaatgttaagcaagtcgaacaccaaatcaaggcaatcaagggaacgaataagaagcaacagtataactataccggaatcggtgatttaattgattcattgaatacctatattcgtttagccactaacgtattgaccggggtggctggtattgcgttattagtctcagcaattatgatcattgttgtcctgtacgtcagcgtttctgaacggactcgtgaaattggggttttgcgcgcacttggcgcccgcaaacgcgatattagtcatttgttctttgctgaggccttaactatcggggtattagccgccgttatggggttactgtttggagaaggttggcaattcttaggcaatatggccatctatagcttaattaagtatccaatcgttcgaatctccggggcagcaatgctgggcggcattacagtcagtgttgtcatcagtttattggctgctttggcaccggcacatatggcggcacggttggatccagtcgagagtttatcacatgaataaaagcgggggcgtagcaaatgtatttctttattacgagcaaaattgattcgacgccatcagctattgagttagccatgattcagcgtcaaaaattattcacaaagcaccgggtacctgcgttgatcgtgacccgtaactttgtacgcgatttacatcataatatgcaactcattgggtatgatgatgagttccaggtcaatatgtatgattattttcaaggcactacgaattacgaaggcgaaccgttaactgcggccaattatccacgggtgacgggtgaaacgctggaacgggtcagcgctaatgaatttgacgtcattcaacgggaacaacggcaaaaagcactgatgttaaatgcgcaggggaatattgattacgtcgatattctcaatccacagggcgcggtcagccgtcgagactattatgatacgcggggcttcttaacggtggcccagtactttgatgacaagcagaatattgtgttagagcaacactgtaatttacaacaacagcctgtcttagagacgtttttccggccaaatgagaagcaacaaccagttgccactcatcaacggctgttaaactatcacgggcataattacgaatttgaggactgggatcagctgactgcctttttcttagacgcgttaaatactgagtatggcggtcacggaaccatgatcgtggatcgtagtgatgctggaatgaatccgattgttaaaatgtccacagcagcgcgcaagtatgagttcttacacagtaatttcacgctggacccacttgacgttgtgaactcaccaattgtgccgtacactcaaatcgggttagatcacgccagtcaaatggctggtttgatcatgtccacgcaagaagagtgtgatgatatgacgaaccacattcataatgtgattccaactttagcgattccagttggtagtgtaagtgacgaacaattagcagctcgtccggttgactttaaggatcggattgagggcaaggtgattgccgttgctcgcttatcggcagagaaaaatttggaacaattgattaaggcggtcgcctatgttcatgaaaaacagtcgaatgtgaccttagatatttatggttatggtgattcatggactggatttaaagaagaaaatcggttgcgagccttggtcagttcgcaacgttggcagtcatttatcacgtttaagggctttgagcgcgatttgacaccggtctataaccaagcacaactgatggtccttactagccaatatgagggctttaacttaggtattttagaagggttaagtcatggcgttccggtggttgcctatgacattaagtatggtccggcaacgatgattacggatggtgaaaatgggcgattgatcacccccaataatttagttgaattgggcaaggtgattttaacgctcttacaacaccctaaacagttggcgaagatgagtgaacgggcatatggcaacagtagccgtttttctgaggctatgatttggcaacggtggaatgatcatgtcattcagcctgatattcaagcaatgaggggagttacaaccaatggaaacgcatatcacgtcatcggctaaacaaccacatgccaagtatgggacccgtgatttattgagattgatcatgacccatgctcacccgaagaagggactctttgtgattggaatcctgttgtcgtttgtcgcaacgatttgtagtcttggcattacgttgatgttgaaggagtttatcgacgcctttaaccatggtacttcgggtcaactgttgcttcggttaggcgctgtgattgtcgtgcagctatttgcaagtattgcgtcgagttttctacttagttatacgggggtcgacgccgtttcgacgttgcggagcgcgttatggcaacatatcgtggacttgccgattccgtattttgaccataaccggacgggggaactgtctagtcgggtagttaacgatacatcgacgatttttgaattgatttcaagtcagttttcgaatgccattaatgggatcatctcaattgtgggttccttgacgttaatgttgttattaaacttccgcttaacgattattattttaattgtggttccattgatggccgtgatcattgtgccaatgggtcaagtgttagcgcggatctccaaagcgattcaaaaagaaacggccaacttaaatagtgcagcagtacaaatgattggtcaaaatcggttagtgaaagcaatggttgctgaaaaggcactgaaaaaacagggaaaagatcaagttgatcggatcaaaggcttcagtgtccgtcaaatcaagctgatctcggtgcttaatccagtgctaaacatcatgttactggccgcaattttcattatcattgtttatggtgggatcttggtacaaacgaacgcgttgacaattggaagtttagtagctttcttaatgtatgccgttcaaatgatttcaccactgagtagcgtaacgggcttagtgactgccttgcaacaaacggtcggggcaactgagcgaatcgacaacattttagatagtccggaagaagataagcggttgtcaggcgaaacgctgtcaacaatcgatacggtcgactttgatcacgtcgattttggctacgaaagtgataaaccggtgcttaaggacattgatttgacaattcatcgcggtgagcggattgccttgattggtgagagtggtagcgggaaaacgaccttagtttcgctcttagaggcttactatacgccaactcgtggtgagctggacgtgaatggcgagacaatggccagttatacgattccctcgattcgtaatcagatcggctacgtgagtcaagaagtagacttgatgcccgggacgattcgcgataatctcctgttaggttcgacggaaccggtctctgatgaacaattgagtgcgttgttgacacaagtcggcttagcggactggctagctgaactgtcagctggtcttgatacggacgtcggtgaacggggcttgaatgtttctggtggacagcggcaacgtttggccatcgtccgggcactcgtccgccacccgtcgttattgattttagacgaagcgacggctagtcttgataatcagaaccaagaacgggtgacccagctcttggcgacgttaccagctgacctgacgactattacgattgtccatcggttaaaccagatcgaagcttatccgcgaattctcttcatggaggatggtcagattacgggtgatggcaatcatgagtccttattagcaacccatgaacgttatcgtgacttttatcggctgcagtatcaacacggttaaaaaggccttagtgaaatattgtttgattattaaaattagtaagtggttattgctgagtgttggcaatagccacttttttgatcccaaaatatgtattcaactggataacgtgggttaaggcatgaaataaaaccgccgtaaaaaatataaaaagtattaataattttaataataagtcgaaaaaagcgatatttataattattttttagggaataaatttcccgatggtatggttcataattcggaaaaaaagaggggatgtcgcagcaagcaactacgctgaaatgctgatattatcaggggtttaaacgctttctgctggcatagttaactggtgataaatataaataatattgatattggacacaaattttgaccgttaatgaaacgcgtaagttgtccatagtatacacatttactgattgaatatgatactgccctgtatttattcaaatattagtaattttattgacgattgtggggcgaattagttaatatttaaatcgtaaacgaggttacttgtttaacgttcgcattagtaatcaatattagttatttaacagactaaattaaattaatgattattgagctgctaatttgtgaacaatttgtaaattttctaaggaggatattaacatgagtttcttcagtgatttacatctcttaccagggacccacacatcatcacatactagttatgtcagcaaccaaccacttggtactttctatcagtttgtgttgaacgtgattgccgcaatcaaaggttaagcgttgctagagacgggtgttagggaattcaatgattaattagttgaattttctaactgtttaatcaagtttgtcggaatttaatttgttttccaaactctcaagtcttgccatacaagtggctaggcttggggatttaaccattaactaacttaaaaggaggagttattcatgagtttctttactgatttgcacttcttaccgggaacccacacgtcatcatacacatcaagtgtttcaaatgacatcttcggtggcttccacagcttcatcttaaacttgattcctgcaatcaagagtttgttcagcaaataatcatagttaattttataggaggatttcaacatgagtttctttaacgatttccacgtattaccaggtacgcatacgtcatcatacacatcaagtgtttcaaacgatatcttcggtggtttccacagcttcgtcttgaacttgattgctgcattcaaaaagtaatttagtcaaacaatcataggaggatttacattatgagtttctttaacgatttccatgtattaccaggtacacatacgtcatcatacacatcaagtgtttcaaacgacattttcggtggtttccatagctttatcttaaacttgattcctgcaatcaagagcttattcagcaagtaatcaaaactaatcttttaggaggatttatattatgagtttctttaacgattttcacgtattaccaggtacgcatacgtcatcatacacatcaagtgtttcaaatgatatctttggtggcttgcacagcttcatcttgaacgttattaaagcgatcaagggataatctatttcgataaactaattaattaatatattaattaatgtcttgatattatttagataatgagggaggatatacattatgagtttcttttcagatttacactttttaccaggtacgcatacttcatcacacaccagctacgttagcaaccaaccacttggtactttctaccaattcgtattgaacgtaattgctgcattcaaaggctaattaattaacaattaaaggggattaatctcatgagttttttcaatgattttcatattttaccaggtacacacacatcatcatatacatcaagtgtttccaacgacatctttggtggattacacagttttatcttaaacgtaattgccgcattcaagggctaattcgttaaatataactgaaatgccaacaaaatcgttatggtgttattaagcacgacacgataagcacgactaagatgatgggctggcaagcgatttgtcgcccatcattttacataaatgcagaaaatcgtgggtgctcggggaggattccatatgtcaaaagataatcaaaaaatgaccggtgattcggtttatcgggtaaagatgtataaagatggcaagcgttgggtttatgccggcgcaaccacgttagctttggctgcaggtttagtatttgccaacgttaatgcttctgctgatactgctgctagctcagacgcaaccacggaacaagtttctagtgctgccagctctgctgcaactagttcaacggcgacttcatcagctgctacggatgccagttctgcatcttcaactgcaacttcaacgtcaagtacggctagctcaactgctactacttcaagtagtgctgccagctcgactgcttcttcagctgctacgtcaacaacgagtgcggctagttcttcagctgcaactgtcagtgcgactacaccagcaagcagtgatgcgacatcgacttcaacggcaactgttgcagcaacggctgctaaggcatcagttgcaacaccagcttctgctgcagcaacggcaaccacaactgctacgaccacaactgctacgaccacggctgcgactacagccccaacagtaacggcaccagcttctgaagctgttaatcaaactgttgctggctcagttgacgctggaacattgacgagtgctactcagtcgggtggttcgggcaacttacaagaccaagcacaatacattcaggaaaatgttgatggcacgaacatcaaagttactgccgggcatacgtacgcagttgccatccggttaaccaagagccaagcgcttgattgggctaatgcttctggtcaagtttcaattgcgccaaatggttccaacagtaatggcacttggactgccgttgaatacgcaactgaatccggtaaggaatacagttacgcagctggtgcttcaactgccactgtggacatcacgaagctaactgatgctgatagttatgtcactgttctctatactttcaaagctaacgacgacgcgacgacgggtagccgggctgcatatttggaatttacagggactacctcagttaataagttatcaactaatactaacaacactgatgccaatcagcagattgaggcttggagctatgcaacccaagtaatggatacttctgttgccgctggtacggtcgttgtccattacgttgatgaaaacggcaataagattgcggatgacacgactgttcaaggcgatgttgacaatacttacaccgttacacctgctactttcagtaattacgcgttagatacgactaagtccagtgctttgactggaacagttgccgctgacactactgattctgatggtaatgtgacggctgctggtactgaattgacgttagtctactcacaaaataccgaagcttcaaacttgactgttaactacgttgatgctgatggcaatacgatcttaccttctaagacttatacagaaggtgctgatggtactgcagctgaagttggcggtgcttacagtgtaaatgccgcttcgattgacggttataccttaacgggtgatgcaacccaaactgggacttttgtttctggtggtaacacggttaccttcacttatacgaaggatgcagccccagttgaacaatcaacggttacggtaaactacgttgatgctgatggtaacacgatcaaggccgctacgacccaaactttggataacggctcaacttatacggttgaaacgccaacgatcgatggttacacttacaagtcagctgatgccgctttgactggtacggttgatggtaataagacgattaccttaacttacaccaaggattcaacgacaccagttgaaaataaagctaacttgacgatcaattatgttgacgctgatggtaacaccatcaaagcatccagcgtaactgaatatatcgttggtcaagcttacacggttggtcaaccagaaattgctggttacacttatgaccatgccactggtgatgccattgccggaacgattgcctacaacggtaacacagttacccttgtttacacgaagaacggtggcactactccaactgaacaaactaagacgatcacagttaactatgttgacgcagatggtaatacgatcaagagtgcgacgaccacaacttacaaagttggggacacttacacggtcgcaacaccttcaatcgatggttacacttacaagtcagctgatggtgctttgagtggtacggtggctgatgacgcgacgatcaccttaacttatgctaagaatgataacggcggctcaacgactgcacctaccaccgcacctggtaccggtgacaatggtaataacggtggtggcacgacgacaaccgcacctacgactgcacctggcactggtgacaacgtcaacggtggcggtactggtacaactacaactgctcctgttacgacgccaagtgacgatactgttgataatggtaatggttcatcaaacaacggttcatcaacgacgacttcaacggcaccagcaaccacggtttctgatgatgaagtaacgccaacgacgacggctactactaacaatgggactagtggggttgttcctgcatcagcctcattgaagccagtagttacgactaagacgacgacttcagacgcaaagacgttaccacaaacggatgaagacgaaaacgggactgccttggctgtcttgggtctttcaaccttattgatgggttcagcgctatactttggcgtttctcgtcggaagcatgaagcataataattagaatagcttgattatttgctgaacggatagaaaggtcagcgatgacctttctactctttgagcaaacaatcaagtttatggaggagttgcattatgaagatgttcaataaaaagcgcagagataagaatgaggattaccgtaatcattctgagcgtgcaacggcgacttcaaccgttgctgctcaaaagccaaaaccaaaggcgactcaaagtagtacgacccccaatgtgcggtcatctgctggtgtccggccaactagtagcagcgtgactgcttcaactagtgccccagttaagggccaaaaccgggtcaaccaacggcgtgctacccaaacagcagccaaaaacagtgtggccattgaacgcgaaatggctgacttaaacaagcaataccaaactttacgtggggagcttaaggtccaattagttcaggatcgtaagcacgaaaagcaacagtatgaaactttagttgccgaacagttaaacttagaacaacagttaaaggacgctaaggttactctgtctaaacaggacaaagtcgttaacacgaacgatagcgaacggcagggaatggtcaagaccatcaatgctgctcaaaaacgttatgatgatgctaagaaagctcttgctaagagcgatcaaaccatcaaatcgttggaaaagaagattacgcagtctgaacaatcattagctgatttgaagcaaaatgaagctgatatgcgtaaagcaattcagggcgaacaggatcttaagaagttattcgtgttgatgaagcaacaggagaagcaagcacaggatctgtatcaaaagagtgacgcaatcaacagtgaactcgtgaaactccagaagcgtgaacagactgaaacccgtgaacgttcgcggaaggaacacgcgattacgagtgcggaaaaagacttacataccgctcaagatgcgttagttgcttatgatcgtaagaagaagagtgctcaagacgaacaagaacgttcactcaacttgattaatcagaaaatcaatcgattacaacatgattatgatcaaaatgccacgattgttaaggggctccaacaaaagattgaaagcattgatgccaagttaaaatcggattacgggacgactcacttagtatcgcccgtcgaatttgaccagtctgcaaagtacttcttgttcagcaccgatctgattcaatcattgtctggtgatgaaaaggcttcgatggaaatgatcatgggcttattgaagagtgaagttaaggataaagctaatgttattacggttaactataatgacagcttgccagaaatttggaacagttaccaatcagctggcttagttgataaacgaactggcttgtacaacatgtactacacgattcaggcaaaggtaccgggtgccgttgcgaagactaaaccagaattacctgataatcctgcatggcaatataagcgcaatgctgataagcagattgtgtcaattgccgatgatggcggtaacccaattatgacgttgaagtaccgtaagaatggtgccatttggtacatgacttacttcaatgggtcattagcaactcgtcgggatgtgtacgatgctgccgggttcttgtcagtcactcagaacgtgtttggatactttgacattcgatttgattttagttaaattagatcaaaaacaggagtttttaatccatgaaaagctttgcacaccattatagtagcgacatctctcgtgaacaatttga

SEQ ID NO: 718 - DNA, 52685 bp, Unknown
  Metagenome-assembled genome
caagtaacgactgatgagatcctagcagcacttgaactaattaatcaacgaccattaaaaatacatcatcaacagactgccattgaaagattccgggcttgttcggattaaacttgtaatttgccgtgtgataaaataatattaagtcataacgttgtaaaaaaatagtgaggtgagtgccgttatgcaaaaaccattaacagctgagcaagaatacgtgcgcgagtttattccgtttgttgattttttagcagatatcttaggccccagtagtgaagttgtcctgaacgacttgttggatttaaaccactccgttgtggcaattcgtaattcccacatatcacatcgacaagttggcgatcctgcaactgacttagcgttgcgaacgatgaaggccggtaaaactgaaaagcgtgattatctagccaactacaagggtgtttcgcaagggaagcactcactacgatcatcaacttattttttgcgattagatggtgaaatcgtcgggatgatttgtattaatacggatgatagtgccctagacgatctgcaggaacaagtgttgaaggtaatggcgagttacaaacatttgaactcaccaacgattcatcaactcaaaggaacaccagctaacgagaagacccatgacacgccggtcgctccggaacatctaaccacttctatcactgatttagctcgggaagtgacccaggctgtctgtgctaagtatggcgtctctgttgaatatttaaagcaaaatgaaaaattagaaatcgttcgtagcttataccaccaaggttacttcctattgaaggattcagttagtgaagccgccaaagtgctcaaagtctctgatccgagtgtttatcgttatttgcagaccgtcaaagatgaggatctccagcaggattaaacgatgtaattgtaagcgattaacgtcatgaaaccctgtcaaaatttagttcagccatagtggcgaaactgtgaggaagctactctgagttcccggacaggtaagaatcatggtcaccaccgtaaaaatgcggcagccaacacaacaagtttgtgtaagggctgccgcattttaagttttaaactgagcaatcaaatatcccgttgttcagtgatggccggtcgcaattattgtggatgttagtgccagggtagcgtgtgtttttatgggattcgggttggaacgcagccgatttttatgataatttgtttagaatgatattattgaggatgacagcggggattttctatgtcttatcaaaacgggggtattaatgattttattaatttagttatcaactgattatcatcatgataaaactcatgcaattctcattagctgacatcaagctaaaaggctgatgtagcagggggtaattgctattattatcaattatcaaagattatcaaatcgtatcatagaccgttgatcattatattatatggtattatggtgaataataaatggaggtgatgccaatgttgacaccaaacgaaattcgacgtcggttacgacgcgatttggttactattgccgaagcttatcaaattggttttgagagccgtctatacacagaagctgagtatgaaaacttaaagcagacgttattgcagttgcgtgaacttaatatgaacccccaacatatggaacagctacttgcgattaacgggtaacggaatgttactaaattaaataaggaagtgattagtcatgaatgctgatagtccatcaggttcaattcagtccagagagtgctaatgccagtgaaatttatcacgcgcattagcactcttctatttttctagcgggcggtgtgttaataatcatttaggacttgagtaggattaaaataggtcgcttagttgaattattattcggtatcacgtcgctcccaatcatcgtatggagtacatagtatgacagtagtaaaatcggtggacaatcgtggcgttaattacgtgacaatgttaactgttgatgtcagaatgaattgtacagcatcgcacgtcttggtggcaccttaaattacgcagatttaacttaattatcttacaaaatcgttcatgaaagcgtttgaattagtcgagttaatgattttattgcgtaaaaagattacagtttcctgatattggttgtatttttgacggacattctttattatggttaatgattgtatgatacagtgtgacacttatttagcgaggaaagttatgttatgaaaaaaatgataatccatggcggaaaacgactttctggggaattaacgatcggtggcgcaaaaaatagtaccgtcgcactgattcctgctgcgattcttgcagacactccggtccaattcgatacggttccgcacatcttagacgttcacaacttacggctcatcttagagtcgatgaacgtccattccacttttgaaaacgatgttctaacaattgatccaacaaatattgaagaatctgaattaccaagtcatgccattaaaagcttgcgggcttcttactactttatgggggccttactcggtcgctttaaccgtgcaacggtgactttccctggtggtgataatattggtccacgaccaattgatcagcatatcaagggttttaaggcgctcggcgctaacgtcgttgaagagaatgactctgtctttatctcaacgggcacagagggccttcacggagcgcgcatctttttagacgtggtttccgttggggcgacgatcaacattattttggctgccgtcaaagctcatggtacgaccacgattgaaaatgcggctaaagagcctgaaatcattgatttagcgacttttttgaataatatgggcgctaaaattcggggtgctggtaccgacgtaattcgaatcgaaggcgttccggcactgcattcgcgggcaacccatacgattattcctgatcggattgagacgggaacgtatctatccctggctgcttcgattggggacggtattttgctaaagaatgtgatccctgaacatatggagtcattcacggcaaaactagtcgaaatgggtgtcgatttacagattaatgaagatagtatttacgtcccacggtccaatgatttggacccaattcgggttaaaacaatgacttacccaggctttgccactgatttgcaacaaccaatcaccccattattattgcgtgctaacggtagtagcgtggtgattgatacgatttatccgcaacgcacgcaacacgttgaacagttacgtaagatgggggcggacattcgcgttcaagataacttgattgtcgtgggtcattcttcccacttacaaggtgcacatgtcgaggccggtgagattcggtctggggcggcactaatgattgctggtctcgcggctagtggcgttacggaaattagtcgcgctgacaatattctacgtggctatgatcgggtcatcgataaattgcatacacttggtgcggatgtggaaattgcagccgacgaagaagttcccgaaaactaacgatgtacagctaagaaagaacagtggttatggaaaaaattttaacaatgcacgatctcgagcagaaaacgttaaaagaaatttataactatgctcgtgagtataaaatttcttattattcgcaaatgaataaaaaggaactctcattagccgttctccgtgagcaggataaaaagcggggctttgtacaaatggaaggcgtcttggaaattattagccaagagggctatggctttttgcggccaattaattatgggccttcgcaggaagatatttatatttctcagtcgcagattcatcgctttggtcttcgtaacggagactatgtggctggtcaagcccggccaccgcgacctaacgaacggtattacggtttaatgcgggtagggacggttaacggtaaggatcctaatgaggccaagcaacggccccattttccagcgttaacaccactttatccacaaaaacaaattaagttatcgacaacggccgccgttttagcgacccgtttgattgatacttttgtcccgattggcttcggtcaacggggcttaattgtcgcacctcctaaagccggtaagacgacgctgttaaagaatattgcaaatggcatcgtcgccaattatccagacgctaagctgattatgttactgattgatgaacggcccgaagaagtgactgatttagagcggtcaatcaagggagaagtggtgagttcgacttttgatcaacaaccacaaaatcacgtgcgtgttgcggaattggtgcttgaacgtgcgcggcgcctagttgaagacaaacaggatgtgattatcttattggattcgattacccggcttacgcgggcatataatttggtcatcccgtctagcgggcggacgttgtctggtggggtcgatcccacggcgttttacaagcccaagcgattcttcggttccgcgcgcaatatcgaggaaggtggtagcctaacgattttaggcaccgcgttagtcgatacgggtagccggatggacgacatgatttatgaagaattcaaaggaactggcaactcagaattacagctatcccgcgagttagctgaacggcgggtcttcccggcgctagacttgaagcaatctagtacgcgtaaagaggaattgttggttagtcgtaagaatttggagccagtctggcagattcggcgatcaatgactggcaacgcgttagagtacaccgaacagcttttacaatttttaaaacacacgaagaccaacactgagtttgttcgtgatctagctagcttaaagttcactggtcaatcaacccggcggtcgcgtcgttaatactggcaggcaggctactttgtaggttgacgggaagctgtgattcgtgataacatgtttatcgttggttaaaactatgataatctctgtttcagcaaatgattcagggcaaaggagcgaaatacaatgcaaaaaggaattcatccagattaccatttagttgtgttccaagactcaactactggttttaagttcatctctggttcaacagcaacttcagcagaaactgttgaatgggaagatggtaatacttacccattgatccgtgttgaaattacgtcagattcacatccattctacactggtaagcaaaagtttaccaaggccgatggtgcggtcgatcgtttcaacaagaaatacggtctcaaataagcagacaattaaacggcgttccggcttcggcgggggcgtcttttttgtatgtgcaaatcatcgacgctcacaaacaaagccgcaccagttcgagtaatgaactggtgcggctttgtctcacttacgatatgattagtagcgcataatcgcgagagcagcggtttctacgggcatccggtctgcggggatgattcggatttgcccgttcatggcaatcacgacatcgaccaggtcgtcaattaaattatcaggagcagcaattggatcagttaattgaacatcggccgctggtaaggagccggcgacattcgcgtctgcggcgacaatcaaggtgtcgatccgcccacttagtgctggcttgatcatgtcaaaaggatcggccaatgctaactggcgggacttagcctgatcataacgttctagtaaaatgtcggctaattgggtatgccacatcgtctgaacgggttctgtggctgtttgcattgcgcccaccgttaagtttttcggtgacttattgatcatgaggtgttgtgacaggtacggattcttgttgacggcacggaagactgcctggttatgtggtagtcccattaagatcaatggccgtcgcgtcttttgtgaatgggcctgaacgtactgcgccacttgttggtaataatttcgttggtcaatatcgcgttcttcggccttcgcattatgaccatgatagttggcaccgtgaacggggctggcgttgaaattcaggtcaccgccacgtttttcagtgcccaatgcttctgtcagggtgcggggggcctcagctggcaaatcaagttcgacgaaactgccatcacgttgggcgtagagcgccatgctatcttcattgagtgctagcaagtcgaagtcgaattgatgctggcggtcggctagtactgggcgaatagctggcatgctattgacgctgacatggttgtcagtgggatattgtaagtcgaaaatgtgtaggtcacgactgttagtgatgatgcctgtctgagggccagtgtgctgtaaccagaaggcgttgtcattaattaattgctctagttgcgtcgcgtatggcgcaaattcggttttcggaaagtggtgggccatctgggtttcagcttcattaactaattgtttgaattgtaagcggcggcgattgaggtcgttgagcacaacggccgtgttgaggtaaattgcaatgtatgggccatcctcacgttgttgcattagttgattgagatcgttttttaccatcgtttccataggtccaacctgctttctgtttttgatacaattagcataacaagaatctgattacggacgcaaatataatgattatgataagctatagataattctaacgaactaaacgaattcggggctttattatgcgaactaattaaggtatatttaccgtagaacctttgataaagggcgtaaacaaattaggaggcgggattaatgaagtccaagcaacatcccgggttaaagtggttaggtcggggcgtttttgtcctgctggtgctagtatcattggcattaattttcaatgaacagatcaagagctggttagtgagttcatactcgccgaccgttacggctaagacggttaagcagaatacgaagaagaagagcgattttaacttctcaaaggtcaagtcacttgactttcagaccgttgccaaggcccgcatgaataagaatgcaatcaacgtgattggctcgattgcgattccgtccgttgatttgtacctgccaattggtaatggtgtcagcaatgaaacgttagcattggcggctggcacgatgaaagctaatcagaagatggggcagggtaactacgcgttggctggtcaccatatgatcaagcatggcgcactattcagtccgttgtactataagagcaaggttggccaaatgatttatgtgagtgatgccaaaaagatttatgcgtataagacgagtcagcgaacattcattaaagcaactgatgtccaagtaattgatgatgttcctggtcagaagctgattaccctaattacctgtgataagaccggggcgggtcgcttaatgattcgcggtaagtacgaacagcaatggtcgtttaagtcggcgccaactcaggttcagaaggcctttacaagtcattttaataacaaatattaacaattattacattctaggggtatcgatatcttctaacggaatttcacggtacaatataacttaaggtcacatgtctcagataagacataatttagagggggtctattgatgatagctttaattatcgttgcggtcgtattggttttgatcgcaatttacgtggtaatttataacggtttagttaagtcacggatgtatacgcaggaagcgtggagccaaatcgatgttcagctaaaacggcggactgatttgattcctaatctggtcaatacggtcaaaggttacgcgaaacatgaaaagagtaccttagcggaagtgatttcattacggaatcaattaacgcaagtgccgagcggtgatcaccaacaggctatggcagtttctgatcaattgacaaattcgttgaagagcatttttgcgttagctgaaagctaccctgatttgaaggcgaatcaagaattcggtaagctgatggaagagttgaccaatacagaaaacaagattgcttattcacggcaactgttcaactctagcgctgccagctataacatgaagttacaacaattcccgtcaaatattattgctggcattcatcacttcaagaacgttgaattcttaactgttcctgaagcagaaaaagcagcacccacggtttcatttgaagattagaggttatgcccatgttatttgagcaaattgcccgcaacaagcggcacacgttatacgtgatggccgcttttgtcatattacttgcagtgattggtttagcagttggctacgtgttttttaatagtgcgattgcagggttactagtagccttgattgcagcggtattttatatggtattaatgattagtcagtcgactgacattgtcatgagcatgaatcatggacgtgagctgcatcaagctgacgatgatccagagctctggcacattgtggaagacatggcgttggttgctaaagtaccgatgccacgtgtctttattattgatgatgagagccccaatgcgtttgcgacaggaaatgaccctgagcatgcggcagttgcagtgacaactggtattcaggcacgattaacgcgtgaagagatggaaggcgtcattggtcacgagatgagtcatgtgcgtaactatgatattcggttacagaccattgccttggctctgacagcggccatcagtttgttagtcaattggggtatgaacgccttttggtggggcggtggccggcgcagtcgggataatgatcgtgacggcaacggtgcccaggtcttactaatgatcctagcgattgttgtcattattttagcgccgctagcagctagtttagtgcagatggcgctatctcgtaatcgcgaatacttagcggatgccggcagtgtggaactgactcgtaatccgttgggcttaatcagtgcccttgaaaaaatcgatgacagccaacccatgcaagcggcggatcctagtagcgcggccctctatatttctgatccgtttaaggcgaagaaatcatggacgcacttattcgatacccacccaccgatggctgatcgcatcactcgtttaaaaaacatgtaataaaaaaatgcgtttaggttaataacggattataatgaaaacaaatagaaagttgaaagagtgagacggttgcaacgcaaatatatttacgccaatttggaaaaactggataaccttgtctttgcttacgggatcgaccagagcgactttgtgcatggtatcaaacgcttgccagctaacttggtctcgttagtcggtgttgatgataacgagcatgcggtaaatgctcacacgggtctgaacgtcattaatgatgaaaatgaaattcggcgatatttgttacagagtcacgcgttacccgttaagtggcttgattatgatgaagttggcgatttggattttctaaccgcgactgagattgccgagctattgtatctcggacatatggatcgtccaattcgatcaccgtttaattacaaactgcgcaaccactacgttttcttggaacaacgcaatggtggtatcaaagtgtacttctattatatttccgcatttagccatattttaagtgctgccattgtgcggcacactttggcagcttaccgtggccggcgtatgtttatgcgttcactgagtgttccacgagtacctgaagcgattctcaagcaactcgttcaattgatgccagatggtttgttcatttactttgatcagtcaatggttcggcaacgccaattattggtgccggtgcacacggagacgacaggcaatgaaatcgaagtttttgatcccgctcgtggtggagagaatcggcgaacccaccatgtcgcgacccttacttttaacttgaattcaggcgtgtgggacttgcaagtgcaggaccaggctgcgttcgaagaacatttatagtattatcatcttaacgcttggctgatcattcagcgggcgtttttaagtcgtttggggcgggatttaggggctaaattggtctagccatagagtccctggggtcaaagtggtataatttttatgcgcgtagcttgaattgggctacgattcgagaaagtggaaccttagtcagaacttggctgaccgacaagtggtcgccatgaatggagagtttaatcgatatgaagatgcaagttgccgaaattgctaaggccgttcaagcggtcaatgccgaacaggcgtggcccgatgttaatgtaacgggtgtggcgtttgatagccgaaagctccaagcaggggatctatttattccgctgatgggcgctaatgatggtcatcaatatattcaaagtgcaatcgagcacggggccgttgctaccttatgggccagcgaccatgccgacgacgttccagaagacttacctgtcattatggttgctgatacattgacggcactacagcagctggggcaatactatttacaaaaaattaatccgaaagtcgtggctgttacgggtagtaatggtaaaacaacgacgaaggatatgattgcgagtgttttgagcactcagtttaacgtgacaaagacgcacgccaactttaacaatcagattggtgtgccagtgacgttactcagtatggaaccgaatacagaagtggtcgtcgttgaaatggggatggaccattttggcgagttggatttcttgagccgtctcgttcaaccagacgttgcggtgattaccatgattggggaagcccacattgagttctttggtacacgggatcgaattgctgatgccaaaatggaaattgtccacggcttaaaagaagatggcacgttcatttttaatggtgatgaaccactgctacaagaacgtgctaaggaagtcagtcagcatcaacggacgtttgggttggatgatacgaacaccttagcaggcagtgatatcacgactagtcgggctcaaacgcaatttaagacgagtctgtggccggacaacacgtacacaattccgatgatgggtgcgtacaatgtcaataatgcattggcggcactcttggtagctgatacttttcacattcgaccagccgctgcgcaacaagcaatcgccagttttgtgccgacggagaaccggacggaatggttaactggttaccgtggagaagccatcttaagtgatgtttataactctaatccaacggcagctcgacgggtcctagccgcttttgcggcggtacctactaagggtcagcgaatcgctgtactcggtgatatgcttgagttaggtgaacagtcggatgcactacacatgagtttagccagtgaattggatccagccacgattgccagcgtctatttgaatggtgaacatatgcgagcgttggcagaagtgctacaagaaaagtacccagccggtgcggtccactattatcaaacggatcaacagcctcaattgattgccgacttaacggcaacggttagtgcggatgatcaggtcttattgaaggggagtcacgggattcaccttgaaaaggttctgacggcgctggaagctgctcctgaaaaataaaatttaagtgattcgattaagcaggcccctcgcaatgactgggtaatggtgacgctaacattagactgataatgttatttcccttccggtattgctaggggctttgcttgcttatttagaataaccggtgtatgataattcagttgtaccatatgaaagtcagaccgttggcttacatgacagcgtcttacgggaaacggattttttcctagctggcagtaatcccatggtgtcatccttaggaggaaacatatttgaagtttacagaactaggcttatccgatagcctacttaaagcagttaatcgggccggatacgaagaagcgaccccgattcaagccgaaaccattccaatggttctagaaggcaaagatgtgattggtcaagcacaaaccggtactgggaagaccgccgcgtttgcattaccaatcttacaacgcttggattttgacaaccataacattcaagcattagttgtttcaccaacgcgtgaattagcaatccaaactcaggaagaaatcttccgcttaggtaaagacgaacgggcgaaagtccaagtcgtttacggtggtgctgatattcggcgccaaatcagaaatctgaagcaaaacccacaagtaatcgtcggaactcctggccggttgcttgaccacattcgccggggcacggtcaagttagaccacgtcaagatgttagttcttgatgaagctgacgaaatgttaaacatgggtttcttggaagatatcgaatcaattatcaaacaagtgccggatgaacgccaaactatgttgttctccgcaacgatgccacctgaaatcaaacgcattggtgtgcagttcatgaaggaaccgcatcacgttaagatcaaatcaaaagaaatgactgctgatacggtcgatcaatattacgttaaagccaaagaatttgaaaagttcgatattatgactcggttgtttgatgttcaggcacctgaactcacaatcgtgtttggtcgaacgaaacgtcgagttgacgaattatcaaagggtctcgaagcacgtggttataatgccgctgggattcatggtgatttgagccaacaacgtcggacgcaaatcatgcgtcaattcaaggctggtaaattggatattctggttgcaaccgatgtggctgctcggggacttgatgtttctggtgtgacccacgtttacaattacgatattccacaggatccggacagttatgttcaccggattggccgtactggccgtgccggacacaagggtgtttcattaacttttgtaacaccaaacgaaatggaatatttgcgggtcatcgaaaagttgaccaagaagcggatgttaccattgaagccaccaactgaatctgaagcttttgctggccaattagctgctgcagaagcgaatgttgattcgttagttgctaagacttcgactgaaaagtatgctgatcaagctgctgaattattacaaaaatacgatgctactgatctagttgctgccttgttaaatgacttaaccaaggacgacgcctcagccgtacccgttaagattacgccagaacgcccattacctcgtcacaaaggtggcggcggtaacaaccggcgtggcggatatcgtggcggtaatcgcaaccgcaataacagtcatggcaatggtcgtggcggttattctcacaatggtcgcaatcgcgaccgtgatcgtaacggtggccgtggcgatcggaagagcaatggttataaaggtcgcagtcgcgatgataaccggagcagcaaccgcaaccatgatgaaggtcgcaagcaaagcagcaagcggagctatacgatccgcaccaatgattaaagtcaacgcaccaatgattaaagtcaacgcaccaatgattaaagtcaacgcacaaattaagttgaattaaattaactttgcacaaaagccgagcgcatgctcggctttttttatgccctacaatgttagaatacaagtagtcggcagatgttcgtatgaattattgttaaaacgttccaatttaattggtttgttgttcgtcagcacttgcacgtcttattccgacctccggggctgggtgccaattgctggaacgcagccgacgtcgatttgagctaacgcccaacccgcgtcatctcaaatacgagtcttattctaagccggaagcaacccacttccgcctaagaataacttggctactgagcattgtcacccagcccctccagtctcaagcctgtgagaggccacgggttgaagccgagcattgcctagccaccacaggctttagtggcaccgaacttagcacaatctatcgttgcctattttgatactggaactttaaacaaagcgttaagtgcactagcactttgtcgagagattaaatcttactattttgattcagaattagtgaattatctcaatatcactttcagtctgacagttgattgacaaaattatggtttatgaaaaacaatgacgaattcaccaaaagttaggacgcgctaacaaaacatgtttacactcactcgacttttttccagcggtctaagctggccgactttgacttgacgcgtttggaacgttttaacaataattcatgctgacatgaaaagattgcgtgtatgggcccttttatcgcggcggtagctgtggtaaattggaaacatcagcctaagttgacgtgataataatgagatagagggggtcacagcgtgatttatggtaccggcattgatttaactgagcttagtcggattgaagcgattctagcgaaggggctgagattgcctgaaaagatcttaacaccggctgaattggcggtgttttcacgttacccggttaaacgccagatcgagtttatggcagggcgtttttcagctaaggaagcatatagtaaggcatatggcacgggaattggtgcggcagttggatttcaagatatcgaaattttagacaacgcccagggtaaaccggaagttacgcgccacccgtttgatggtccagcgtggatttcaatttcacacacggatacgttagtaatgacacaagttatattggaaagaggcaatttgtgatggttgtaattggggagcaccgccacacacaagtcacagtcgacttgcaggcaattaagacaaatattagtaatgaaatggcgcaaaaggatgagttgaccgagttatgggcagtcgttaaagcgaatggttatggacatggaattatccaagttgctcaggccgccaaagaagccggggcgaccggcttttgtgttgcaatcctggatgaggccttagcgttgcgggccgctggctttgcggaacccatcctagtacttggaattacggaaccggaatacgccccgctggtagctgaaaaggatatttcactagctgttggaacgcaagattggctgactacggccgcagcaattttagcggctaaccaagtgacgacaccacttcacgttcatcttgcattagatacgggtatgggacgaatcgggtttcagacgcccgaagaattggcaacggcggttacgactttgcgtcaaccgcagtcaccatttgactttgaagggatttttacgcattttgcaacggctgaccaggcagatgatacgtattttactcatcaattaaataattggaaacacttgattgcagtggtggatgagctaccacgctatgtccacgtgtccaattcggccaccagtctctggcatcaagcttgcaatggcaacatggtgcgctttggggttgcactctatggtctaaatccttctggtcgcgaactcagcgcaccataccccttgcaacccgcgttgtcgctaacggcacgcttgacgtttgttaaacgcttggctcggggcaaatcggtcagctatggtgccacgtatacggccgcacaggatgaatggattggcacggtgccgattgggtatgcggacggctatgaacgccgattacaaggcttccatgtacttgttgatggtgagttttgcgaaatcgtcggacgggtctgcatggaccagctgatggttcgtctgccacatgaagtaccggttggagctaaggtaactttggttggcacggacggtgctcgtaccatttcgttgcaagatattgctgactattgtgggacaattcattatgagattgcttgtgggttagcaccacgagtgccgagagtttatatagattaagttttatcagacgataggtttgcgccgactgtctcgtacaggctatggttacatggttggttattgagattaagccaataaaatgagtgccggagaaattctggcgctcattttttagagtctcctattttattgatgagggctgttaagtttatttcagtgattcgattgatttatcggcatctaattataagttcgtttatttttaaacattgatgaaatcatcactgggcagtcttaattaatcggtctgaagtattagttttaacggtgcttagcgattagttctttggattaaattggtaaacggttgctaaaagtgaatggttcatgctattatgagtagcaagatggttatattggggtactatcagatacattgggtatcgaataaagggagatgaggcgatggccgcagctgacattaagcgtggtgacatcttttatgcagatttatcaccagtcgtaggctccgaacaaggaggcatgcgtccagtactaatcgtgcaaaataatgtcggtaaccattacagtcccacagtgattgtcgcggcaatcactgctaaggttcaaaaagcgaagatgccaacacatgttaacatcaacgctgcccatacggggattgaaaaaaattcggttgtgttgttggagcagatacgaacgattgataagcaacggcttaaagatcgcgtcactcatttggatgatcagacgatgcgccgagttgataatgcgttacagattagtattgggttagctgatcgaacacgacgtcggccacaacgcacgtttcaatcatagtcaatcgatggggattaattatttacataattgaactatttcggtgcgatgaccgagtatggataatcagcgggtttcaattcagttaatgactggattgaaacccgcttttagtttctaaattggctaccggtaaatgttacagggcctgttggagcatttagtgatgagctaacattattgtgcattatgattgtctttctgacgacgattaggtaagctagttgaacccattataacgagggacgattggctgtaaatcgtgaatatcgctgaaaggatgggggcataatgagtaaacaggctcagttcaataagcatcgggtggcaggattgttagtcgcgatgggtgttgtatatggtgatattggaaccagtccgttatacgtgatgaaggccatcattaccggtcaaggtgggatgcaggccgttgatgagaagtttatgttgggggccgtctcgctagttttttggacaatgacgctgctcacgaccgttaagtacgttttgatcgcgttaaacgcggataatcatggcgaaggcggtatcttttcactattcgcattggtgcgtcatcgtgcgcgctggttagtcattcctgccatgattggtggggctgcgttactggcggatggggcgctaacccccgcagtgacagttacgactgccatcgaaggcttacgcgatgtaccagcatacgttcaactgtttggtgccagccaaaatacgattatactgattacgcttggaattatcaccctattatttatgctgcaacgttttggaacgaacacgattggcaagttatttggccccatcatgttgggctggttcacgtttttgggagtcagtggcttcgttaatctggtgcaggattggacgatcctgcgtgcactgaatccctattatgcgtggttactcttgatcagcccggcgaacaaagtgggaatcttgattctagggagcgtctttctggcaacgaccggtgctgaggccctatacagtgaccttgggcacgtcggcaaaacgaatattcggttgagctggccgtatgtcaaagtttgtctactactcagctatttcggtcaggccgcatggattttaggtcccggccaagcgattcagggacatgtgaatcccttttttgcaatgttacctgctagcctgacgatggcggcagtgatttttgcgacgctcgcggccattatcgcgtcacagtcgctgatcagtgggtcgtttacgttagttagtgaagcgattcgactgaaactattcccccgattactgactacttaccccggtaaagcagtgggccaaatgtatttaccggtcgttaactgggggctgtggggcgtgacgagtatgctggtgattttctttcaaactagtgaaagaatggaagctgcatacgggttagccatcacactgacaatgctgatgacgaccactttgatctacgcgtttttacggcaaaagcgcttaccattaatcggtgcgggactactgaccggtttcttcgcgaccatcgaagtgattttcctgattgccagcgcagccaagttctggcacggcggctacgtagcggtcggacttgctttactaattttcctagtgatggccgtgtggtatcgtggcgaacaaattgtccgacaacataaccacccgcttagtttacgacaatatcaggaccagcttgctaagttacgcgacgatcagacggtggacaagttccagacgaacgtcgtcttcctaacaagccgaatggatggcgaccaagtggagcgaaaggtattatattcgattttagacaagtggccgaaacgtgccgacgtctactggtttgttaatgtgacaatcacggatgaaccgtataccgcggagtatactgtcgacacgttagcaacggactatttggtaactgttaagttatacctgggctttcgtgtccgccaagatattaaccgctatttacggacgattgtccgcgacttaatggctactggacgtttagcggcgcaaaagcagacatattcagtcacttctggccgcgatgtcggtgacttccgcttcgttatcatcgaggagaagttagaaaatggtagtcggttatcccgcttggatcgattagtgatcgagacgaaattaatgattaaaaaatacgcgacaacgcctgccaaatggttcggcctagaattctccgaggtgactcttgaaaccgttccaattctattcaatgagatcccggcgttaccgatcactgaaagacagtaatgccatgcagatttctgggggtcagaatcagccagcttagatttgcttgaaaaagttcagcgtagtgtaaacacgctctacgacatctaattgtaaggcgcttcacgtcggctacgttccagcaattggcaactagccccgaaatccggaataggacgaacaagtgctgaaaaatagaaaactaactgtcggcttgcttaacaactcatctaattttaatttttttattgagcaactgataactcaaaactaatttcaatagctgatactggacgcaaaacgttgatttgacagcgataaaagaacgactgaattcaaatcaaaaattagaaacattaaattttgtgttgacaagtgtgaacttagaactataatctaattatattctaattattcaaatgcggtgatgagataagtaaatcaatcgtgggtttttcagagagccgggtcaggtgcaagccggtattcccgcatggttgaaaatggtcttggagcattcagtgccgaatgattaagcgctgacggtggtccccgataaacggacaaaggtatctcaattcagtgagattgacgtacctgctgaggactattttgcgaaaaatagtcgaattaaaggtggtaacacgagtcatcgtccttctgtcataacgacagtggggcgattttttattatatatttttggggaggcttcgcgtatgcgaaaaaaggaaattatttttgggttattaagttttattgcactgggaacagtattagctggctgcggcagtagcagtgctagtagtaaggatacatataaaacctataagtatggtgaagtaacgataccagctaaggacggttctatttgtaatgcgccaaattatatcgcgtatgagaaggggttctttaagaaaaatggtatcaaggccaaactagtagcgaacccgcgggatatcagtgacctagaagtgggttttgcgagtggcaaatatgacgcgcaaaatggtgattttcaatacttacctgcgattcaaaacggggcgcaaatcaaagctgttggtggaatccaccaaggctgtatcaagttgctggttccgaaaaactcaagcattaagagtgttaaggacttaaaaggcaagacgattgggattccggctcagggttcaacaccacaatacgtgacgtccattgcacttcaacatgcgggtattgatccgaagacgggagtaacgtggaaggtttacagcactgatctattggcaaaggcggctgaaaaggggcaggtcgatgcaattgggacggtcgatccgtatgcttaccaagcacaaaaggaatctgggtttaagaccattattgataataataacaatagtggcaatgctaagatggctgcaatgggaatgaaatcaaagggtgcttgctgttacttgtacgtttcgagcaagttagtcaaagagaatccagcgaaggctaaggccattgtccgttcatacaaacaagccgctgcttggatcaataaccatcctgaagagacagcaaagattgaattaaataaggggtatgtctccaagacgaagtttatcaatgtgaagaatgtgacccagatcttgaaagatgaacattttgaactaaatcttaagacaggtaaagaagatttaagttattatatcaagcaattgaagcaagcaggatatttgaagaagaatacgaataacaagcaattgttgaagcaagcttattggtatccagatttatctaagaactaagttcaaggaggtagaatagtatgcaaataacagcagtccaattgagtcgaaaaaaagctgtgcaggcagctaagacaactggccgttattggaagccctggcacttgacctggaacattgttagtttagtcgtattagcaattgcgtattttgaaaaccaattggttgtatcacaggaaaccgttaataatcagacgtatcattggtttttagatgggtactttgcttatttattgattgttacgctgattggcgcagttacaaatggtcgaattcgctggtataatggacattttgcccagttgaacgtttcgttagttggcttgctgatcgtgcaggatcttctgaccgaaaagtttgccgttctagaacagcctttcttcgtgagctttgcacaaatcttggaccagatgcgcgaaaatgccggcttgctctgggcttcgacgttgtcatcattagcgctttggttgattagttttgtgattgggaccattcttggaatcttacttggtttgggcatgggacgctatcgtgagtttaactactgggcattcccctacttgaaggtcatcgggattatccctgcggctgcatggatgccgctgacgatggtcatctttccgactagttacatggccgaagtcttcttgattgccttctcggtttggtttccagtggccttcatgacgattggtggcgttcaagggattagcaaggaatacttcgaatcagcaaagaccttaggatttagtgagtggcagattatccgcaaaatcgtccttcccggagcgttgccaagtatctttactggcgtttatacggcaatgggattgtcgtttacaatgctggtaatttccgagatgattggtgctaaggtcggactgggctggtttatcaactgggcaaagggtaccgggaattatacacaagtctatgcggcaattgtgattatggcgattctgttttcagtgttatttgcggtgtttaccaaagttcaagattactgcctacgttggcgcgatggtgctcactagaaaggagcttataagatgggattacttgcagttcaacatgttaatcagcggcttcaagacaatgatggtcatcagatcgacgtgctagatgatattgatttcaccgtcaatccgggtgagttcgtagcaatcattgggccgtctggttgtggtaagaccacgttactacgcctgatttctggattagaccatcccgctagcggtcagctaacgatcgataatcagcagattaagcgaccagataattctcgcggttatgttttccaacatggcagcctttttccatggtcaacaatcaaggagaatattagtgtcggcctgaaagtgacgcgtggtcggcattatgaccaccaattggtcgaccattatattgaattgatggggctaaaaggctttgaaaatgcttatccgcatcaggtttctggtgggatggcccaacgagctgccctcgcgcggtcaattatcatgaacccgcagctcctacttttggatgagccgatgggggctcttgatgcgtttacacgtgcggatattcagaatgtcatcgaacaggtttggcagcagacacagacgacgatgattttagttactcatgatatcgatgaggcagtctacttgagtgaccgaattattgtgatgacgcctcgtcctgggagaatcaaagaaattgtgacaaatccattaccacatccacggtcacggttgagtgtcgattttgctgaatttcggcatcggattcaagataaattaaactttggcgctcatgatggacaggttgctgggtgatgactaaaaaatgcttatcaagatgattggcgagataccagtcttgataagcatttttgctgtgaaaaaacaggatcgcatggtggtgagcttgatatggccatccaggggacttcgttagttggactaagtacgaagaagcaggcttattcgcttaccatcgttgtcgtactggccaatagggtcttaagcgtatcaatcgccgtaatcaatggctgtccatgattcaatgcagcgatagccacgggattatcaggttggtcattaagcgtgaaacccactgctttagtctttgcaggccaatcagtcgtgttagcgattgttgtgacggtgaggtggttagccgcgaacagttcctggaccgcgggttgcgccacagtggcaatatcggtgatgagaccatccacggtttgccaagtctctaagtgataactatcagccatggcggcatgccaagcggtcgtgaaagtcgggccgataccaagagtctcaccagttgatttcatctcaggacttaaaacgactggtgattgtggcaatttattgaaagagaagactggggcctttatagcaatttgttgtggaacgggtgtcaagagtccggggactaggccaagggttgctaaactttgaccgagaattagccgggttgccaattgtgccagtggcaagtgagtaaccttgctcatgtaaggaactgttcgacttgcccgcggattaacgtcgattacgtagacatcatcggtgacgacgaactgaatgttcatcataccgacacagtggaggtgttgtgctaatttggtggcaatggtgacgatcttatcttgaacagcagggctgaggtgctgtggtggatagactgtaatggaatcgccagaatgaacgccagcaccttcaatatgttccatgattcctggaatgaagcacgacgttccgtcggagagaacgtcaacttcacactcggttcccgccaagtattggtccattaagataggcgcaccatggccagctgccaccgctgatttaataactggcgtgagctcatgatcgttatgaacgattgccatggcccggccgccgagtacaaagcttggccgtacgagtaaggggtaaccgattgcgtgagctgcttgacgggcaccggataactcagttacggtcgttccagcggcttgggcaatctttagtagacgtaaacagtccgcaaaagattgccggtcttcggtcaaatcggtagcggacacactggttcctaggacggtgactcctaatttagtgagctgatgggcaaggttgatcgcagtttggcccccaaattgaacgatgacgcccgcgggttgctccaacgcaatgattggcatcaaacgttcgattgttagtggctcgaaataaagcttatccgaggtagaaaagtcggtggagaccgtctcgggattgttattgacgatgattgcatggtagccagcttgttgaatggccttgacacagtgaacggtggtgtagtcgaattcgatgccttgtccgattcgaatggggcctgatccgagtactaaaatactgtgtcctagtgggtgactctcattagtttgtccaaaagcagtgctgtaaaaatatggtgtaacactggcaaattcaccagcacacgtatcgaccattttataaacgaagggtaaatcagcagtcatggcagcaatggtcgctaccgaagtttgggcataatgcgccatggtcgccagactcacaccgtactttttcgccgataagaggtgttgggacgtcggcacttgcttgatattccggatgagttgggcgatgtgctgtaacttactcaagaaaaatggcgtgatttgcgttagcgtcgctaattttgctaacggccaacccgcttgcagcgccgccaatagatagaagagtcgctgatctgtcgggtgggtcaattggtcgatatattcagtcgtggtgacgtggtggtcaggggtcaaggaagcttggatcttgggatcgatttcaagcgaagcaatcgccttgagcgtggcttcctccaaggttgacccaatcgccatgacctcccccgtggctttcatctgtgttcccaagtgagcgtcggccgttggaaacttgtcaaacgcaaaccgggggattttggcaaccacatagtctaaagctggttcaaaggccgcataggttgtctgcgtgactggattattgatctcagataaatttagaccaattgcgatatcggctgcaattttggcaattggatatcccgtcgctttagaagctagcgccgatgaacgactgacccgcgggttcacttcgatgacgtagtactgacgactattcgggtcttgagcgagttgaacgttgcacccacctctaatgtcgagggcttccacaatcgtcaaagttgccgttcgtagctgctgatattcagtgtcagtcaaagtctgaacgggggcatacacgatagaatcgccagtgtgaataccgaccggatcgaagttttccatggaacagacgatgatcttggtaccctgattatcacgcatgacttcgaattcaatttctttgaagccggcgatactttgttcaatcaggcactcggtgacgggggacatggtcagcccccgctgtaacgtttgggtcaattcggcggcattattggcaatgccaccacctgaacccccgagtgtaaaggctggacgaacaatgaccggataaccgattttttcagcaaacgacaatgcactggtcacgtggtgaacagtggtacttgctggaatcggttgatggagccgcttcataagtgttttaaatgctgcccggtcttcagcttgattgatggtggctagggaagttcctagcagttggatcttcaactcattaagaacgccagcctgatctaacgccatcgctaggttcaatccggtttgtccaccaagtgtcgggagcaaagcatcagggtgggtggcccgcagaattttagtgacactggtcaaagtcagaggttctaagtagacttcgtcggcggtggccgtgtcagtcatgatggttgctgggtttgaattgatcaaaatgacatgatatccggccgctttaaggcttagacaagcctgagtaccggcatagtcgaactcagcggcttgaccgattttgattggaccagaaccgatgacagcaatcgaatgaatggcattgtttttaggcattaacaaccgcctccttttgaattgttagtaagaaatcatcgaaaaattgcccagcttcctggggtcccgggtgtgcttcgggatggaattgcaccgacattacggcctggtgcggtaggcgcaagccttcaatgctgccgtcatttaattcagtgtgcgtgacgatcagcggggtgcccttgatcgatgccggatcgacggcgtaatcatgattttgcgaagtcatgataatacgaccgtcagcgcaggcttgtaccggatggtttagcccgtggtgaccaaaggaaagctggtaagtctgagcaccataggcgagcgcaatcaactgatgaccaaggcaaatgccagccagcggataacgttgtgcgagttggcgaatggtcgctaagtaagtgtgatagtcggtcggatcaccgggaccgttggataacaaaattccgtcagggtgatacgcggccacggccttgagactagctgtaggtggaaggacaacaacgtccgcgccccgggcttgcaattcagcggtgatagctgctttttcaccaaagttgagaatcgcgacgcgtggacggatggtggtcgtcgctactgggaggggggtagccgttagtacttggggtgcgaatgtggcgagttgcgcttcaaaatcagtgatgggatgattgctcaagattgccatctgggctcccgtttggcgaatgtgaatcgttaggtcacgagtatcgacgccttcaatgccggctacatggtggattgtcagaaaacttgccagtgattggcgactagtatagtgatcattaaaagtggtcagctcgtgaacgatgatggcttgtgcgccaatcgttggtgcctgggccacggtcggatcgataccataattaccaattaatgggtaagtgaaggcaatcatttgatttaggtaggatggatcagtcaatgtttcctgataacccgtcattcccgtattgaagacgatgcgccccgcaacctctagctggcaatccccaattgccgttccaatccactgtgtgccgtccgctaaagttaagtatttgttcatcccaatcgcacctttctgataatttggttaaaatttcattttggttaatgggataagtaaacatcattttattgtgaatgtcaattaaaaatacatattaagtgcataaatgactgaataaagctaaaaatatgcaattaatagaataaaagtgaatattttttcaataaagcttgcaatttaaaagcgatgagaatatagtgtgaatcatactttttgcatgaacatgcagctaatacactatttttgaatatttgaggtgattatatgcaagtcgcgctagttggcgttacggggtacagtggcatggtgttgtaccggctcttgaaacaacatcccgagatcgatcgcatccaattatacgggcacgtgggagcaactacggtggcattaaagacggtggcagccatgtaccagaaagaaacggcggttattcgaccattcgatgcgacggcaatcatgcgcgataacgcgattgtgttctttgcgacatcagcgggtatcacgcgacaattggcattaccattcatcgctgctcattttccagtcatcgatttatctggtgacttccgcttgcatgatccagagcaatatcagcggtggtaccaacgtgatccagcaccggcgaccgctttggcacaggcgagctacggcttagctgatatgccggcgcccttgtccacctacattgcgaatcccggctgttatgcgactgctacgttattaggactagcgccacttgctcagcagcagttggtcgaaccgacttcgattgttgtggatgctaagtccggcttatctggtgctggcaaacgagcgacagctgcgagtcattacgtcgctgtgaatgataatttgagtttatataagttgaatcaacatcaacatatccctgaaatgatgcaacagttacagcagtggtggtccgcgatttctgcgattgaatttactaccactttgattccagcaacgcgtgggattatgacgacgatttatgccaaagcgaagtcagcattgacaacgacgcaggtctgcgcagcttttaccgcgacctatcatgagcagccgttcgtgcaagtgctaccaacggggatgccgacgctcaaggacgttgttgggtctaataactgtgcgttaggcgttgattataatccggtcacgaacaccatcgtggttgtgagcgtcattgacaatttgatgaaaggtgctgcggggcaggccgttcagaattttaatcgctattttgatttcgcggttacggccggattaccgacgttacctgtatttccctgataaggtgcaataagagaggaagttatgcagatgcaagttttaacgaatacgaagtttgaaacggttgcctttcagtggccggcaggtttttacagtgatggcattcatattggtcttcgtcgtcataaaaaagattttggttggctattttcaaaagtgcctgccagtgcggctggaacttatacgacgaatcagtttcaggcagcaccaactaagttaactaaacagatgatcgaccagggccaccaattacagggactgctgctgaacagtgcaatcgccaattcttgtactggcgagcaggggtggcagaatgcgctgcaagaacaagcctggttagcgaataaactaaacgtggcgccgaacttgattggcgttgcttcaactgggctgattggtgctcagttacccatggataaaatcaaaaacggcttgccgcaattgacaccaacgaagagtgacgcggtgacctacgccgtgttaacgacagaccagcatccaaaaaccgtctgtgtgcagtgtgaactcagcggccagttagttaccttgaccggttttgccaaaggttctggaatgattcatcccaagatggcaaccatgcttggttttgtcaccaccgatgcccaaatagacgggccagttttacaggacatgctaagtactaacgttgatcagacattcaatcaaattactgttgacggtgacacgtctactaatgacatggtggtcacgttggcgaatggtctggcagataatccgagtttacaagtgggtaccaccgactatgatatttttaatcaggcgttgcactatgtcttaggccaacttgccaagcaaattgccgctgacggtgagggtgcgaccaagttagtcgaatgtaatgtggtccacgccgctacaacgtttgatggtcagcaaatcgccaaagcaattgttggctctaacctcgttaaggcggccattttcggtgaagacccgaattgggggcgaatcattagcacgattggcgccactgatgcagacatcgatgtggcgacggtcgatattgaaatgaacggcgttttacttgttcaacaaagtctggccgttgactttgatatggcagcggtgcaggcgaccttacgtgataaccagattatgatcgatgttgatttacatcacggtacagcaagtggtcaggcttggggttgtgacttgacttacaattacgtcaaaattaacgcgagctatcatacttaaacggaggtggtgaaaatgacaaaattaattgtaattaagattgggggccaggcgattagccaattgagcaccactttctttgaccaaatcgcacagtggtaccaacagcattatcagattctgatcgtacacggtggggggccaatgatcaatcgactgacgactcagcttgctttgcccgtgcataaggtgaacgggttgcgggtgacggatgcggcgaccttagtgctcaccaagttggccctgctaggagatgcgcaaccagccttacttgcaaaattaacgcaacatcacctacctgtgttggggctcaatgcggcggataatcagttactaactggtgaattgattgattatcgacagctagggtatgtcggccggctcaccgctgtcaatcaagtgcaattaatgcaattgttggctcatcatatcggtattttggcccctttagccttaaccgagacgggacaatggctcaatgtcaatgcggatatggcagcgaccgtgctagcccaacaactacatgctgaaaaattggttttgctaaccgatgtcccgggaattatacatcacggtaatgtgatgacatcactatcgccacaacaagctcagcaattgattcgaacagctgtgatcaccgcgggaatgcaacccaaagttcaagctgcaattgccgcgattcagacgggagtcaagcaggctattattacgaatgcaatcgatcaaccaggaaccgcaattattcaggaggtggccgtatgaccatgcaacacgtgtttccaacctatcaacgttttccatttgccattacggatggtcagggcgttcatctgactgataatcatggcaagacgtatttagattttacggcgggaatcggggtctgcaactttgggtatcaccaaccacaaattcaggcggccgtcacccagcagttgacgcatatctggcatacgtcgaatttatacgaaaatgaattacaagatgccgttgccggcctgttagcgaatggtgaagagcgactcgtatactttgcaaattccggaaccgaagctaatgaagctgcattaaaactcgcacggaagtacacaggtaaaaccggcatcttagcttttcagcattcatttcacggtcgaacctatggcgctatgtcgatgacgggcaatcctcatattcaggctggctatgcgccattagtgcctggcatcacgtttgcaacctataatgacgacgcggctttggacaaaatcacaccagagttggcggccgttattttagaagtcgttcaaggtgaaggcggcgtctttgcgggacaaacagcttggttacaagcggttaatgcgaaatgccaagcaacgggtgttttgttgattattgatgaggtgcagacgggaatcggtcggactggttaccggatggcctatgaaggttacggcctggatcctgatatctacacggtcgccaagggcttagcgaatggcttgccagtgggggcaatggttggtcggcggcaattagccactgcctttggtcctggcagccatggctcgacgttcgccggtaatgctgttgctatggcggcggcaaaacgtgtcttgacccaattaacaccggcgctgttaacgacggttcgggcccatgccgaacttgtctggcaagccctagcgactcaagtcgaaccgataccggtagtgaaacaaatcacggggaagggcctaatgattggaatccacttagatgaacaaatcccggttaatcaagtcattacccggctacaagtagaaggcttattgacgttatcagctggcgataatacgttacgtttgttacccccaattgtgatgcaaccggccgatttattagctgggattgccttgattgcaaaggtactgacaactttgacaacggaggtcacgacgaatgaataatcaatttgaaggtcggtcattcttgaaggaaatcgactatacaccaacagaattagcttacttaattgactttgctagtcacttgaagacccttaaagcacaccatatcccacacccttatttacaaggaaaaaatattgcgttgctgtttgaaaaaacgtcgacacggacacgttctgcgtttactgtggcggctaatgatctgggcgcgaatccagagtttttgggtaaggacgacatccaattcgggacgaaggagtcagttgttgatacggcgaaagtactggggtccatgtatgatggtattgaatttcggggctttaaacaaagcacggtcgaagacttagcgacctatagtggtgtgccagtctggaacggattgaccgatgagtggcacccgacgcagattttagcggattttttaacattaaaggaacattttggtcatttaaaagggttgacgttagcgtacgttggtgatggtcgcaataatatggctaatagtttacttgtggcgggagcgatgctcggcatcaatatcgctatcggggccccggtagcgttacagccagccccagcagtggtcgcgttggcccaacagtatgcgcaggcagctgggagcacgatcgtgattacggctgatccgcaacaagccgttactcaggctgatgcgctttatacggatgtctgggtctcaatgggcgagcaggtcgactatggtgagcggatcaagcaactattgccgtttcaaattaatactgcgttactcgcagctactggcaagtcatcgacgattgtcatgcattgcttaccagcactacacgatctaaagacgcagctgggagccaaattaggcgaacagtacggaatgacggcgtttgaaattacggatgatgtcttccagagtaagcaggcggtcgtctttgaagaggccggcaaccggatgccagcaattaaggcggtaatggcggctacattaggtaacttatttattcctaccagcattttcaattagcaagcttgcgggaactactagagcgtgctacgattatattcgctttgtttcaatcaatacgtggttcgtaaccatcccacgttaaaaaaactaggaggaattaagcgaatgacacaatcaaaaattcgaccatggattatcaacgccctagtcgctgcaatgtatgttgtattatgcctaggccccgcagcttttagcttggcatcgggcgcaattcaattccgcgtttctgaagggttgaaccacttagccgtgttcaatcgcaagtatatttggggaattgttgctggcgttattttgtttgacgcttttggtcccggtgcgagtctcctcaacgttctctttggtggtggccaatcattattagccctgctggtattgacgtggttggcccctaagttgaagacggtttggcaacggatgttactgaatatcgcgctattcaccgtttcgatgtttatgatcgcactgatgattaccatgatgagtagtggtgtcgctttttggccgacatatctaacaactgctttatcagagttgattatcatgagtatcactgcgccaattatgtacagcttggatcgggtcttgcactttagtgaccggattcagtagggtgtgactgaatttaatattaagaacgaccggcgtagtatgtgaagatggtttttcgcatattacgccggtctcttatttattcatttaatgaaatgtggttaatttgatttttggttgattattttgaaatggtcaacgcgttttggattgttaactgcttggcagcaatgatcgtcctaattcgaactgttttcagcagtcttaagctggtcgcttttgatctgaaaattcatctcattaaaaaagccccaaggtaaccttggggcaactgtgattattcagcttgtaaatcttccacttcgatgactttaaattgtttgcgattcaagttgtcgataattcgtttgagcttttcactgtcgacattttctggcaaggtaaagagcgtccgataaccgagtgtcccgttttggacgtctaaggtcaggcagccggcgattgaagtatatttcgtgataatcttagccatggctgcaaggtcgccgcgttcaccaacggagacaactgttaaaacatagctaccaacgttaacgttccaagattgtgagagcatgtcgagcagacgcgtatgagtgagaatgccatagaaatagccgtgttcatcgagcaccgcaatgtatggcaaatctttgatggagaagaagatattgtagaaggcggagtcgacttgaatcgttttcgtggcatttttaagcagggtcgtcacgggaagcgacatgtcgccgctccgtgacttgtgccgatagatgtgcatcttatagatgttgccgcggaagatatgaccggtttcatctaagattggaatacagcggaagccggaatcctccaagacttttaaggcgtcctctaaggtcgcgtccgccgtaatggtgacgaggcgttctttaggctttacgagtgtttttaatagcatagcagttggtcccccagatttattagtttgttttaataaataataccataaaacgaccgcttacacgtatcattatgacatcaaacgacggctaaaagggatgaaaaagccggcctgataacattcagaccggcttggttaaattagatttaaattagaaaacaatgactggtgttccgactggcacggcagcaaaaacttttttcatgacagaaggtggggtgttcacacaaccatgcgagccgtgcttcttgtaccaagtaccaccatattgagtttgccatgaagaatcgtgaattccttcgccagtgtcatcgaacggcatccaataagaaactggttgggaataacttgagccatcgtcattatcacctttaagggtcgcgttcttttccttattccagatgtaccaaacacccgttgttgtagcgtgtttaccgggctttccagtaacgatgtccgttgaaactttgagctttccatcaacgtagacgtacatatgctgattttctttatcaacttcgacgtaggtattgccgatgtcagtgcccttgttgttatatccggaaccactggtgattggtgagcgggtaaagtccttgcccttcaaaatttcagtagcaagggctttggcctctgcttcggtcttaatggtccagccataaaacccaccgctgacggatacggtcccacgcgccgtactcttgaactgacgcgtcgtatgataggtatgatacttatcattcaattgcttcacgtaagtcagaacagcgttttggtctaaactcactttaccttgcttatcgactttaatccaactgagaattaggtcgtgaggaatcgtgaatttatgaccgttgatattataggtggccttttcggtagcgtatttcgctgattttgctttggccgtctttaaactagcactcgtgctggtaacggtcggagtgacgtaggcgtctttaagggtgatatgactgtcaccattactaattgctttggtgacgaccgtcttaagtttagcttgatctaattcggttccttgaacttctttcttaatctcaacttggttatgttgataaactaacttggcgttttcagtttttgttcgtttggtttgattggcagtcgtggtgattttttgtagtagggttttcaaatcagtgtgattgatggttagttgtccaaccgctgagctatcatcagcctgagccgattgcaatagtgcaaggggccaacgccagtagttttgtttggtcactaatttggttaaatcttttttagtattgattgtaataccggctgatttgctggtaaatgagtactttgtttggccgttttcaataattcgataagtgcgatgttctaaagcgcgattaactttcggtgctgcttgagcggcggttttaccactgacgtcaacaccagcgaccgacgtattactgaggaacgtttgttgatgttgccagattaagctcgtggcaacatatccgatgacgaggagaccgaggatactgcccccaatcataagtccacgtttatgtttcataattaagttggtcctccatatattcgtaatattctcaccttataacagaagtgagatgagtgcaaacttcaaggccggtaatcgtgataagaaagttttaaaaatagcctttagtgcgtgttgcgctttaatgaatcgctaaggtaccctcaagcaaacaaaaaaacgcccgtctgctataaacgagcgttcatcatacacttaatcgtatgaaatgattatttattttctaattcagctaaaccgtcgttaagcacttttttcaaagttgcggcggaatcttgcatcttcttgagttcgtcagctgaaagtggtgattcgatgatttgtttcaaaccagttccaccaatcacagccggagtcccgatataaatgtcgtttaagccgtattggccgtccatgtaggcacctactggtaaaacggcattttcatcacgtaaaatggctttggaaatccgcattaaagcagtcccgataccgtagaacgtggcacccttcaagttgatgatgtcgtaagctttgttacgaacaccatcttctaacttggctaaatcttcgtcagaaacgccttgttccttagcgacatcgcgaactggacgtgtcccgatggttgcagttgagtaagcagcaaattcagaatcaccgtgttcacccatgatgtaagcatcaacggaacgaggatcaacattgaattgtttgcctaacgcaacgcgtaaacgtgaagagtctaaggaagtccctgaaccaatgacacgatcctttgggaaacctgagaatttccaagtagcgtaagttaagatgtcaacagggttagcagcaactaagaagatgccgtcaaagccggagtcaacaactggtttgacaatggatgataggatatttaaattcttgttaactaagtctaaacgtgattcaccaggcttttgaggcgcaccggctgtaataacaactaagtcagcgtccttacaatctgaatattcgcctgagtaaatcttcttgggagcggtgaatgcttgggcgtcttcaagatcaagggcgtcaccctttgtccgatctttaacaacatcgacaattacaaattcttcagcaattccttgttgtgccatggcaaaagcgtaactagaaccaacagcgccgtcgccgactaacacaactttttgatgatttggcatgcttgacaaaataagtcatcctctcgtagtgaaaatttagtttttacggttaaagtataccatgtttgtgcaaaataagtgttagattgagcatgcttttaatacaattattaacaatgtccgcaaaaccctttggcgggcgtcaataagccctttgtggtatacttatcgcacttaataaacgctaacttttgaacacttgactggcgggcgcgtcggtcacggtgtgagtagtggtgccaatacgacttaggtggtatcgttactcagagttgccgaatcgggtcgattaccggttcggcctgttttggtatgcaaagtaataggagaagataaaattatgaaaatgatcgttgggttaggcaacattgggcggcaatatgcccagacacgtcataatgttggttttatgattgtggacgaattagctagcaaactaaacgttacgtttcaaacgagtaaatttgaagcacaggtggcaacggcttttcaagacggtgagaagattttactggtgaaacccgccacttatatgaatgattctggacgagcggtgggaccgttgatgagctattacaatgttgatcctgctgatttgctcgttatacatgatgatttagatttgccattaggaaaagtacgcctcaaacaaaagggatcggcgggtggtcataatggcatcaagagcattattagtcatgttggcgatcagcacttcaagcgcgttaaagttggtattgaccatcctcagaagatgagtgttgttgattacgtgttggggaaatttacgccagccgaagtggcgaagtttgacgatgctaagattacggcgctagcggcggtcgaagcttggttagcaaatgatgattttgcggcagttatgaatcaatataactagcccgggaggaaacgacagaatggatattgaaacgattgttgagcaaacgcccgactttcaaacaattttagcaggtatcagcccgcgtagtcggcaactaatcaccggattgaacggttcggcacgaacggtttatttaagcgcgctatttcaccaattaacgcattcattactgatcgtgaccgataacggttttcacgcgagtcagctagtggatgatttaacgagtctcttagatgaagaccaagtttttttattcccagctgaagaaatgattgcgacggaggttgcgacaagttcaccagagtcacgagcgcaacgggtccaggctttaaacgccttattgcgtgacagtccggcagtgatcgtgacctcggttgcaggtgcccggcggttcttgccgcccgtcgcacaatttcaagcagccacgttaccggtagccgttggtcaagatattgatttggaagacttgcagcggcaactacacgacatgggttacgttaaggaaaagttagtcgcacgcccaggagattttgcggtacggggctcaatcgtggatatttacccgttagatgcggactaccctttacgactggacttctttgatactgaagttgatacactgaagtattttgacccgggaacgcaacgttcggtggaaaacttggatgagtatacaattttgccagctaccgattttatcctgacaacagctatgctgcaggccggggcacagcgtcttaaaacggcgattgcggctgaaagtaagaaactcaagccagccgaacgccagactttggccgataatttagcacaacctttagctgacatggaaaaaggaattatcggaaacgatttattgttatatggcgattatttatacgaccggaaaacgagtatttttgactatgtggccgctgacgggctcgttatcttcgaagaatattcgcgtttgcttgatagtgagcagcagttattaacgcaagaagctgactgggttacggaccaattggcacatcaccgggtgctggcaactgcgagttacggcaatgatattcgggatttgctccgggatgaccaacatgcacaactcttgatttcgctgtttcaaaagggcatcggtaacgtcaaactagcgcaagtcactaacgtgcgcacacgcccgatgcaggaattttttgggcagctcccagcgttgaagaccgaactggatcggtggcataagcttaaacagacggtggtcttgatggtatcagaggctgagcgtctgacaaaggtcagtgatacgcttgatgattttgaaattgaagcggtcatgactaaggccactaatttacaaccgggtgcggttcaaatcgtgcaagatagcttgcaaaatggatttgagtttccggatggtaaattagtcatcgtaaccgagcaagaaatgttcaagaaggtggctaagaagcgtccacgtcgtcagaccttggctaatgccgaacggttgaagagttatacggatctcaaacccggcgattacgtcgtgcacgtcaatcacgggatcggaaagtacgttggtatggagacgctggaagttgatggtgtccatcaagactacattacgattgcgtatcaaaataatgcgaagatctttattcccgtgacccagttaaacctagttcaaaagtacgtttcgtcagaatcaaagacgccacgcatcaataagttgggtggtaccgaatggacgaaagcgaagcgcaaagtcgcggcgaaaattgaagatatcgcggatgaactagtcgacctgtatgccaagcgagaggcggagaaaggttacgcctttccaccggacgatagttatcaagatgatttcgataacgattttccgtacccagagacgccggatcaaattcgtagtattaatgaaatcaagcatgatatggaacgaccgaaaccgatggaccgcctattggtcggcgatgttggttatgggaagacggaagtcgcgttgcgggccgcgtttaaggcgattgaggccggcaaacaagtggcctttctagtgccaacgaccattttagctcagcaacattatgaaacgatgctgaatcggtttgaaggctacccgattaacgttggcatgctgtcacgattcagaacaactaaggaaatgaaagagacggtccaacagttaaagagtggtgaaattgacatcgtggttggtacgcaccgcttactgtctaaggacgtcgcgtttgctgatctgggcctgctcattattgatgaggaacaacggtttggggtcaagcataaggaacgactgaaggccttgaaggctagtgtggatgtcttgacgttaacggcaacgccgattccgcgaacattacacatgtcgatgctcggtgtacgggacttatcagtgattgagacgccgccaacgaaccgttatccgatccaaacgtacgtcatggaacagaattttggcgtcattaaagagggaattgaacgagaaatgcaacgtaatgggcaggttttttatttgcataaccgggttcatgatattgataaagtcgttgcacagatcaaagacttggttcctgacgcggcggtggcccatattgatggtcagatgcctgagtcacaactcgaagggattctctacgatttcattcggggtgagtacgatgtgttagtgacaacaacgatcattgagaccggggttgatattccaaacgtcaacaccttatttgtggaaaatgctgaccggatgggactgtcacagctataccagttgcgtggccggattggtcggagtagtcgggtcgcctatgcttactttacttatcagcaaaataaagttttgacagaagttggtgagaaacggttacaggccatcaaggactttacggaacttggatctggctttaaaatcgcgatgcgcgacttgtcgattcggggtgctggtaacttgttaggtaagcaacagcacggctttattgactcagttggttatgacctctatacccagatgttgtcagaagcagtggcgaagaagcgtggtcaggcggctaaagttaagaccgatgccacggtcgaacttggaatcgaagcctacttgccgaccagctatattgaagatgaacggcaaaagatcgaaatttataaacggattcgccagctggagaataatgatcagtacatggaagttcaggatgatttaatggatcgatttggtgattatccggtagaagtcgctggactattagcagtaggtaagctgaagttactggcggatgacgcgctgattgagaagattcagcgtgacgatagtgagctacacctaacgttatccaaacaagggacggctaagctagatactaaagatatttttaaggccttggcaaaaacaaaattaaaagcgacagttggaattgatgatgataaaatgaaggttaaattagtcattcagccaaagatgcaacaggatgagtggctggcgcaattaacacagtttgtcgaacaactgagtttgatcttagccgaagacgatgtcgctagtgcgtcttagctcggtagttgttgttatgaagcatggttgcacggggtgggttaagcgctatcgagtggaaccaatggcaaatagcaggaattatcgtctgatggggcgttgtcctggctagtcagggcgcggctcaaatgaattagtatgagacaccgagttgctcggtagaagggatttgttatgccaaaggatcacttgaacaccgtgttcaaaggtgcgttaattttatcgatatcatcattagtcgctaagattttaagcgcggtataccggattcccttacagaacatggttggtaatacgggattttacgtttatcagcagatttatccgctgtacggcattggcatgacctttgcattaaatggatttccaaattttatttctaagttagtggcagaacagccagacgaaacgagtaagtcgctgattgcacggcgggcgtttcatatcttatccggattatcgttggtcgtctttttcggcttgcagcttggtgcaacgtggattgcggcccacatgggtgacgttaatctagcaccaatcattagtgccgtggcttggatgtttgtctttatgccatggttagcaaccggccgtggttactatcaaggaaaatttttgatgggaccgaccgcagtgtcccaactgatcgaacaggtcgtacgggtcgcaattatcatcatggctgcatatttcagtgtccgtctcggttgggataattatcggatgggaacgtgggcaatgagttcagcgccactagctgcaatctgttcatcactgatttttactgcttttggtctacgctatttattggcgcccgcacccgcaccgacccacccgttacctagttatcgcaaattaaccaaaagatttgtaattgaaggtgggacgctgtgtcttgtcgccgctgtcgttatcttactgcaattagtggattcatttacggttatgcggggcttggtgcatcaaggtcagttaccagaagtagccaaggcactaaaaggggtctacgatcgtggtcaacctttggttcagttagggttggtggtggcgacggccttttcagcaacgttattgcctgctttgacggatgcgttagccaagcgtcaaccgattgaattcaagcgccagacacaggcgatggttcacgttagtttagcattatcaatggcagcgacggtcggtctagttgcgttgatgccacaaatcaatcgcttgttatttggttcattagaaggaacaacggcattgcgaatctatattattagtattttatttgcagcgttgattacgacgtatacaagtgtgttacagagtttgaacgaatatacggccatgatcattggcatcattgctggattagcgacaaaagtgctggctaattacatcttcgtggtccactatggcatcaacggtgccagtgcggtgaccgtattgagcttggccgtgatgtttgcggtcatgtggttaggttcgccggaagacttgcagcaggtgctattagagagtggttatttgataaaattgctcgcattaagtgccgtaatgggtatcgtggtgatccttagttgtcatcaaatcaccgccttagtaggtccgatactagcgaatacgcgtggaatggctggaattataacggtgattggggtgctaatcggtgtgctggtgtttgttgccggggccgtctatgcccgattattcacgattcgcgagtggttagtgttgccatatggaaagcggctaattaaggccgttgcaaaaggaaaggaacatcattcatgagtatgcgtttagataagtttttaaaggtttcacgaatcatcaagcggcgctctgttgctaaagaaatcgccgataaggggcggattcaaattaacggtaaggtagcgaaatcttccagtaatgttagcgttgatgatgaactaattattagttttggaaataagacattaacagtcaaagtgacgcagttattggaaacaactaagaaaaatgatgccgagctgatgtatgacatcatcagcgaagactacaaaacggattatcgccaaccatttagtgattaggtcggtgtatccgttcatcgaaatggtcgtaaacgttgacttaatcagcatgatgtcgtttacaccggccgatgaagttgttataatttaggcaacccaatttgaaaggactggaccaacatgacgaacgggtcacgtaacaaaatcaagcagttagataatgattatattcgtcaagttgccaccgacgagcatgggcaagcccagcgtgttgcacaagtacggcggcgacggtttattttgattgttgcggtgttcggagcattgatactattctttggttttcagttgattaatacgcggtccaatctgcaccaggtaaaccgtcaagttgcgaccagtcaagttaaattaaaaaaggtgcagcaaaaaaataatcaacttgagagtcagatcaaacagttgaataataaggattacttacaaaagttattacgttcaaagtatgattatacgaagagtggcgaaacggtctacagcttaccaaatgataatgctgccgatgtaactgccaactaatcggggttgtggtctgctttatatgagtagaccactttttattaattgcttaaatgtataactcaacgtttcacaaagtatgctatactaaaaccattatttcataggaggaacaactttttttatggcaattgaagtaggtacaaaagtcactggtaaggtatctgggattactaattttggtgcatttgtaaacttgggtaataatcaaacggggctagtacacatcagtgaggtttccgatggctttgtaaaggacattcatgatgtcttgagcgtgggcgacgatgttacagtcaaagtgttatccgttggtgatgacggtaagattggcttgtcaatccgtaaagcggttgacaaacctcaaggtgaacatgaacatcatggcaaccatcagggtggcaaccggccaaacaatcatcaaggtaacaaccatggtcatggtgaacgtcaaagcaatggcaatcatcacgatcggtcaaataatttccatagtcgtgggggaaatggcggcggtcgttaccaatcacgacaacatgaacctaagaagcaggactttgattcattgatgtctggcttcttaaaagatagcgaggatcggctagcaaccttaaagcgtaatactgaaggtaagcgtggtggccgtggtggtcgtcgtagctaaacttagtgacttgccattaatctagttaaattttgaagcacggtgcggctatttagagtcacgaccgtgctttttttattgaaaattgccgattgttcaaggtcagtcagcgagacacgttggaaacggtgtgagttactgtaaacttgcttggctagttcatcttatgctatccagtcggaataatgttcaaataggtgacaaacgaccagccaactaatcggcaagttttaacaataaataaatccaatgtatttataatgaagttagatgggaggttaagatgacaccaattcaaaagttcaatcggcaattagctgcagccaaactgttatcaccacagcaaacagtggtggtagcggtgtcgactggggtcgattcaatggtattgttgcatttgttgcaacgattgccagcagcggaacggccacgggtagtggtggctcatgttaatcatcatttacgcgaacaaagtcaaatggaagcggactacttgcgacaatattgccagcagcaaaacttgaagctagtcatggccgattggctacccgcggcacatcccaagagtggtattgaagcagctgggcgtcagtttcggtaccatgtttttgctaaggtgatgcgggaaaatcgtgcaacggcagttttgactgcgcaccacgccaatgatcaagtcgaaacgtatctgatgaagcttgcgcgtggtggcgacatctcacaattgacaggaatcgcaactagtcggccctttgcaacgggccgattaattcggccgttgttgacgtggtcgaaagatcagctacgaaactatgctgccgagcagcatgtcgtttattttgaagacgttactaatcaagatgtggccttgacccgtaatcggattcggcaccgtgtcgtgccagaacttatgacggttaatccccagttattaaagcatgtggccgattaccagcaacagttgacaacgctgttgacggctaaaaagcaaatggtcacggtactactgtcgcaggtcgtaacggccacaggggcgttggttgttgatcagtggggcgcactcccgagccagtggcagttagccgtttttgcgacgtggctcgagcagcagacgcaacaactattcaccgagtcgaagttacaaccgctggtctcgtggggacaacggacgcggcctgccacgagtagattaacggtaaacgcggcctgggagttgtaccgtaacgctggtatcattgaagctttgccaataaaaaaaaggggtaaaaagttaatgccccgtgaaaaaattatggtagacttaaaccaatggcagaaaattactgcaacccaaacggtgggaatctttacgcgggtgccaaatgttgtcagtcagccattttggttaacagaagccgattggccgctagtgtggcggccgtggcaagctggtgatcgaatcgttctcaagggcggtggtcatcagctggtacgtcgactgctgattgatcgaaaagttccggctgaacggcgtgaacaggtgcaagtgttagtgaatgctcaagggaacgttctgtgggtggtcggtcataagtttagctatcgtacgactggtacccagacagtatttttagccttaaaacacgagagttgaaaggagtacatctgaaacgatgaacaacgacattgaacgagtactttatagtcgcgaggatatccatcaggttgcacaaaaattaggaaaagaactcacaactgcatatgctggtaagaacccattaattatttgcgtactcaagggtgccgttttatttaccacggacattattcgtgaaatggatatttacgcggatcttgattttattaatttatcaagttacggtaatgaaacgatctctagtggtgaggttcaactaacgaaggacttagatgctgatgtgacgggtcgtgatgtgttagtcattgaagacatcattgataccgggcggacgttgaagttcttgatcgatttgttgaagcggcgcgatgtgaactcagttaaggtctgcacgttattggataaaccagctggtcgactcgttgatattaaggcagattatattggttttgaagtaccgaatgagtttgtggtcggttacggtcttgactatgcagaacgctatcggaacttgccgtacgttgggattttaaaacctgcgatttacgagcataaataattggtcaatgatagtcaaatgtgctattatttagactatcgaagtactgtatataaaagtttcgatgaaggaggcacatatgaacaatcgacgcaatggactctttcgtaatagcttattttacattttgatgtttctgagcttgatgggaattatctactttttctttggcggtaattccggctcacaaacgcaaaatattcgttatagcgaatttgtcaaacaattagataagaataacgttaaaaacgttagtatccagcctagtggcggcgtctacaaggtaactggttcataccggaaagcacggacgacttcttctgcaaacgcccttggtatcaagagcgcatctacaaagacgacgtcattttcaacaacgatgttggaaaacaactccacggttgaccaagtttctaagttggcggctaagcatgacgtcaaggttacggctaaggccgaagaatctagcggcatctgggtcacgttattaatgtacatcgcgccagtcatcctgatgttattcctcttctatatgatgatgggacaagcaggacaaggcggcgggaacaaccgggttatgaactttggtaagaccaaagcaaaaccagctgatagtaagcaaaataaggttcgtttctcagatgttgccggtgaagaagaagaaaagcaagaattggtcgaagttgtcgaattcttgaaagatccgcggaagttcgtgtccttaggtgcacggatcccatctggggtactcctcgaggggcctcctggtactggtaaaacgttgcttgctaaagcggttgccggtgaagctggtgtcccattcttctcaatctctggttctgacttcgtcgaaatgttcgtcggggttggtgctagccgggttcgggacttattcgaacaagctaagaagaacgccccatctatcatctttattgatgaaattgatgcggttggtcggcaacgtggcaatggtatgggcggcggtcatgatgaacgtgaacaaaccctgaaccaattgttagttgaaatggatggttttacaggtaatgaaggtgtcatcgtcatggcggcgacaaaccgttctgatgtacttgatcctgccttacttcgtccaggtcgtttcgaccggaagatcttagttggtcgtccagacgttaagggtcgggaagccatcttaaaagtccatgctaagaataagccattagcagctgacgttgatttgaaggaaattgccaagcaaacacctggattcgtgggtgccgatttggaaaacttattgaacgaagcggccttgttagctgcccgtcgtaataagaagcaagttgacgctgcggatctcgatgaagcagaagatcgggtcattgccggacctgctaagcatgatcgcgttgtgaataagcatgaacgggaaaccgtggcttatcacgaagctggtcatacgattgttggattggtcttgaatgatgcacgggtcgttcataaagtaacgatcgtgccacggggtcgtgctggcggttatgccatcatgttaccacgtgaagatcagatgttgatgtcgaaacgtgatgcgaaggaacaaatggctggtttaatgggtggtcgtgctgctgaagaaattatctttggggcgcaatcatcaggtgcttctaatgactttgaacaggcaacgcaaattgcccgggcaatggttactcaatatgggatgagtgaaaagcttggtcctgttgagttagaaaatgccaaccaacaagcagcttaccaacagggtatgggtgcgagtgccttttcacaacatacggcacaattgatcgatgatgaagtccggcgtttgagccaagaagcgcatcaaactgctacggatattatcgagtcacaccgtgaacagcataagttaattgcggaagccttattgaagtacgaaacattggatgaaaagcaaattctcagtctgtttaagactggtaagatgcctgaaaaggatagtaatgaatttccaagtgagaaagcagctaccttcgaagaatccaaacgtgaattggaacgtcgcgaagctgaaaagcacgcgcaaaaccaaagtgcggatgataagcaagcagactcagctgacactacgactaatgtgagtgttgctgaaccaagtttcccaagtgaatcggatgctagttcagaagttagtgctgacagtagtgtcaattcaacagctaattcagccactgaatcagctaccgacagtgatgtcgcaacttcagccaccggtttaccaaatgctgaaagtgccacaccatcatcgcaggatgatactaattcgcaagcatagtattgaataaagtaaaatgaaggagctgggactttgtctcggctccttttatgcgttatgatatttcaggaaaataaatcaattgtgttaattcggttatgagcgtcgggtcgcaattaaagacggattgagataggagtatgattaaatggcagattatttagtaaaaagcgtcgcgggtaatgagatgtttcgagcgtacgcagttagcgcaacgggcgtggttgctgaagcccaacgccgacatgatacctggagtgcagcatcagcagcgttaggccgcagcttggttggtacgttattattagcatcatcggttttaaagggtgaagaacaaatgaccgttaaaatcaacgggaacggtcctgttggtggtatcgttgttgatggcaatgctaaaggtacggtcaaggggtatttacagcacccccatgtgcacttgcctttgaatgataagcataagatcgatgtgaaggcggctgttggaactgatggctttttatctgtgactaaggatcagggggttggggatccattcaccggaacggttgcgttagtttctggtgaattaggcgaagactttacgtattacttagcacagtccgaacagattccatcagctgttggcttgtcggtgtttgtaaatgacgacaattcgattggagttgctggtggctttttggtgcaagtattgccaaatgcgacggatgaagccatcagctcgctagaaaacaagctcaaagacatgccgttagtctcccaattgatgcgtgatggtaagtcaccagaagatattttggatttgttatttgatggtgacgttaaggtattagataaaatgccagttaagtttgaatgcgattgttctaaagaacgatttgccgaagcactaatggctttgcctaagcatgaggttcaagcaatgattgatgaagatcatggtgccacggcagtttgtcatttttgtggggaccagtatcagttcagtgaacgcgaactagaagcagtgctctcacggtccaagggtgacgcttaatgaatcaagagtggcagatcggtgatgtgacgattcccaatcgtgtcgtagtggcaccgatggccggcgtgactaacgcggcctttcgagtaatctgcaaggattttggtgcggggttagtcgtttgtgagatgatttctgatcgcgggatcatgtatcataatcgtaagaccctggaaatgatgtttgttgatccaaaagaacatccaatgagtattcaaatctttggtggttcgaaagcaacactggttcaagccgcccagtttgtcgatcagcagaccaatgctgatattattgatattaatatgggctgtccggtgaataaagtggttaagactgatgcgggcgctaagtggcttttaagtccagataaagtctatgagatggtcgcggctgtgactgctgcggttaataaaccagtgacggtcaagatgcgaactggttgggacgcagagcacgtatatgccgtcgagaatgcgcgggctgccgaacgagctggtgcagctgccgttgcaatgcatggacggactcgtaagcagatgtaccaaggccatgctgattgggacgtgttaaaacgggtggcggatgccctcacgattccattgatgggtaatggtgacgttcagacacctcaagatgctgcgcggatgcttgatgaagtcggggccgatgccgtcatgattggccgggcggtagaaggtaatccgtggatgcttacccagacagtacactatttagcaaccggggagttactaacgccacccacaccgatggctaagatgcaaacggcaatggaacatttgcagcggttagtggttttaaaaggtgcgcggggcggctgtcatgaattccgtgaacaagcgccgtactatctaaaaggcatcccaaggtcggcacggaccaaagtggctttaatggaggcaagctcgttagcagaaatgatgcgcattttaacgcagtttcaggagcagacggcaacttatttggctagtcacgcggtaaagtgaataattaacttgcattttggcggcgtgattgtcaaaattaacatgtagtgattgtttaggtacggaataaatctgtacgctaactagaaatggaggaacactagtggcacgacaagaacagacgatgaacgaccaactgaaggttcgtcgcgaaaaaatggatgaactgcgtgaagaggggattgatccctttggtcaccggttcgaacggactgatttagcccaggacttgcaagacaagtatggggatatggataaggacgagctagacgctaaacaagtggtggcaaccattgctggacggatgctagctaagcgtggtaagggtaaagtcggttttgctgatatctgggatcgctcaggtaagatgcagttatacattcgtaaagatgtagtcggcgaagatacttaccatatcttcaagcgttctgatattggtgatttccttggaattaccggccaagtttttaagacggactttggcgaattaacgattaaagtaactggtttaacgttcttatcaaaggcgttacgaccattgccagataagttccatgggttacagaatgtggaacagatctatcgccaacggtatttggacttgatctctaaccgcgatagctttgatcgtttcttgaagcggacgaagattatttcagcgattcggcatcatttagacgatcaaggcttcacagaagttgagacgccaatgttgcataatcaagctggtggtgcggcagcacggccatttgtgactcaccacaatgcgttgaacattgatctctacttacgaattgcgttggaattacatttgaagcgcctgatcgttggtggcatggaaaaggtttatgagattggtcgggttttccgtaatgaagggatggaccgtgaacataatcctgaatttaccatgatggaaacttatgtcgcctatttcgacttccatgatgtaatggctgagacggaaggtatttttaaagccgcagcgcaagccgtaactgacgatggcattgtcacttatcatgatcaaaaagttgatttcaatcaaccatttaagcaaattcacatggtcgatgcgattaaagaaaagactgggattgatttctggcaaccaatgtcaattgaagatgcacaaaaattggcggatgaacatcacgtgaagtatgaaccatactggaaagttggtcatatcattaatgcgttctttgaagaatttgttgaagacacgttgaatgaaccaacctttgtttatggtcatccagttgaaatttcgccattagctaagaagaatgaagaagatccacggtttactgatcgttttgaactcttcatcttaggtaatgaatacgccaatgcgttcagtgaattgaatgatccaattgaccaacggcaacgtttcgaagctcaggctgcggaacggactgctggtaacgacgaagctgaacatattgatgaagactttgtcgaggcgttggaatacgggatgccgcctactggtgggttaggtatcgggattgatcggttggttatgttaatgacggatgcggactcgattcgtgatgtcttacttttcccaacgatgcgtccagaagaagataaataattagatttaaaacggcagttagcttaggttttcctaagctaactgccgtttttgttgggtcagattgagtaactttagttcggaaagcgatttattgaaaaaaagttagattatttttacccgaacattgttgagacatttggaggctaaacttaagtaaaagcggattttatggtggtggtaggtaggatttgaagtcaattaacatgattatggttttaaataccgtatattatcaaagtggattgattaacatgatattattgactggttatttttgcattttagggcttgcaatttatcaggataattggtaaattagtatacgttgttgaggcgcacaaagcggttagccgcttgcttccaacgaaaattaattataaaaagttgttgacaagatgttgataacttgatatgatgattaagttgcgttgaggtaatcaacgaacgatttagacctttgaaaactgaacaaagtttcgacgaatcaaatgtgtagggtctcttgattttgaatcaagagcaaaacatttgcgaagtcaattcgctagcaaataaattttagtacaacattaaatgagcttt

SEQ ID NO: 719 - DNA, 6176 bp, Unknown
  Metagenome-assembled genome
catacaattgccccttgcttgtcttccgaggcggcgtatttgcgcgcttcaccgattcgattatagcgatataacaagcactgtttagcaattgctgggtaatgaatagcataaaacggtagatcaaaggtgacatcccagaagatgtggcctcgataagcttcaccgtgcaagccacgagcgccgactgaggaatctaattgaccagaagccaaggcggcacttgtcacaagctatggtagatgttaacccgcgtcagtttttggctggtcatatcattatcaatttggatatctgaattctgccaaacgttgctccagaacttttgactgtcggcgagggtgtcattgaccgaagaagcgttcagttccttttgggcgggttgttccaagttggcatcctgagtttggctggtaaatactgtgacacatttttcaaatacatcacggtttctcaggttctacttggatatccaatttttgctggatttgtttatcttcagtttcactaaaattaacttggtgttatcgatactttgctaaaagcttagaattaatcacaaagttaacgtgggacgtcttggtttgaccggttaacgaaatctggttatcgtgggtaaccatgccaatgacgtcgatatggtgttgatcgaaatcctgatagcgctcaacattgccattaataacagtcccgtcaattttgaataagttgaatgctcccagaaaagttgattggttttaattcatacttgatggaataacgatgccaatttgtcatattggcaactttggtagcccgaacttgcaaaatgtggccagttgataatgataatgcaaggtggttgttaaaacaccggttcgcaaatttaggcttcgataaatatcttgaatatcttcttttttaatttcaaacgtttgtttgatgatccaccccaaaactgatgtattgagcattggggaggtttactaatcttcgttgacaacatcccgaccgttaattttggttgtgagttgattgtagacaccagcaacgtacatcccaggtaattatcctggttggcgttcgcttcgacatacgcaccccgcaggccaaagtagccgttaccgattgtcagcatggcctcttgcccatagttacgcttgccgctgtactcaccataataatcaaggtgccacttcaatattccttcctgtttttctgccactgctttttccaaaccaacatcttgaaccttatgcaggttaacgaccggaatattcatcatgttggcaattgctaggccaatatcgatcttttgatgattaataccgatgatcgtgtcagagaattcatagttcaatgaattctcaataattgctgcatcaattggcaacccatgagggcagccttatgttctcaagattatcgccaattgaaaatttggggttgtaggtgatcataaacttcctaaagggggcttattggaattctctgaataattgatttccatgaccccatcacgagcccttatcgcaaacgttctcataacaaaacctcttctcaagtatttccatttgtgaaaatcatctataagttaattctagttcaaattccggtaatcgcaattaattgggggtttgaaagcaatttgagcaagccggctgttttcatttttgctgattttcgagtagatctttgatttctgaaagcaggacttccttgcgatcaacactggcggttttgggctgttttttaactatccgattaatgattttggattgaagtcaatatttgagacaggttttaagagacattcagaaccgcgtttaccttccacaagctcaaataaatcattaatcgtgattaataacttatttgaaccatggctaaattcctttcatgattgttttcgcaacatcattttacagaaatttggccatgggccattctttatttaattagtgttgcacttaaagtgtaaattcaagtgtcaaaaaaatataacactttctataacaaaggtagattgcaaatttaatccgaatttttggacaaattggtcagcataacctgatacggtgtttgccagtcgagtattttaagcggtcgctggttaatttggagtaacgtcgtcgttaaatcttgagcactaatgtgctcaaaacgagtccctttaggataaaaataacgtaaatcccgattaaagcgttcattactaccacgttcagctggcgtatatcaggaataggtcttaataccatattgtgattcaagtgatactagctcactaactaagttcctaaccactttatggtccggtgcacagctttactttggaccggtggcactgagtttagtgagctagtatcacttgaatcacaatatgtaattaagacctttccatgcttatacgccagctgaacgtggtagtaatgaacgctttaatcgaatttacgttatttttatcctaaagggactcgttttgagcacattagtgctcaagatttaacgacgacgttactccaaattaaccagcgaccgcttaaaatactcgactggcaaacaccgtatcagattatgctgacaaatttgtccaaaaattcggattaaatttgcaatctaccaataaagtaaaaaggtctatcctcaattgggtaggcctttttattgtgcaattttaagctagttaacataatgcacagtattcaaagctaaactttgtgaagtctagttaggcctattgtagcagtgtttatagacaactcactgtttgatttagccagtttagctgagtttgtgaaattaggctggtttaagctagattatccaaagcctattttaatcacatttagactttgtgaaattagcttaaactgtcctagttagctggcttgtgattattatttatttattcaatttagttgacttattggtttacccctgctgtaatgcgagggagtgaagtggttgagtgcagagttgtaccctagtcagacggtcaaaataaaatgactatctagctagagtgcaactcacctgttgtaacgctcggtcgttcgggcatcgcttggacaatcagttgcggtattgctaccaaccactagtatcaacctacattctcggttaaacccattaaaaaacgccctaatggacgctgatagcacgtatttagttttgttcggttaccagctactagtggtcaccatgcctaagcatcgttttaccacccgggccgttaatggtcgccctcaccattcatcaccagcctgattgtctaaggccttatgtgatataaccggttgttattgaagtcgcaccggtaaacgtgtccccttaatatttatactctagcttgtcccctagaatggtccgcgagaagcaattgaatgtcagacttgcaatttgagagcctagaccttacaattaatacatggttatttgttgttcccgcgaaattaagaggtcgcggggcttcttttgtgtattcagttattttaggtctggcttaattgctaggccttttttaatacaaggctattgtaacgcatcaatagctatgcgtcaaatccaaagaaaaattataaataataaattacttattttaaattacttatttttaattactaattatttgtgctatactgttctcaatggaggcgatagaatgacttgtaaaaccttgctacacttcaatttcaagggtggtgttggtaagaccacccttagtgttatggacacttatctgctaggcgagctaggtcacaaggtacttttaattgatttagatccgcaagctaatgccactgagattatgagaacgacctatgatgtcaaaactgagccaaatgttgatctatttaatggactgttaaagctagacctaactcattcaatcattgaactaactgacaatgtttcaatgattccagctgattggtcgcttagcttatggccgggtaaagttgaaaagattaagaaccatgaccgcatgctaattctcaaaactttgattgaacagtttaaatcacaatttgagtacattattattgatgttccaccgacactttccatttttactaacaacgctattttagctagtgactatgtatcgttagttttgcagacacagaaacaggcttatacgtccgtcctaaaaacagcacagtatatgtatcagctaaaaaacgactatcatgcaacttttgacgtgtcaggtgtcatactgtacctagttaaacgggatgctaaagttgaccgtgaaatcactaaggcagccactgagtcgtttggtgatgcagtattcataaatcgaatttggcaacaggaacgtgtaaagttgttctcaaatgctggtattaaagatgaagactattgggataagaaggccatcagcatgtatacgatggtattaaaagaggaattacacagaattgaggagataaacaatggctgacgactttttaaataagctagcacaacaagctaaccaacaactaggagacaatgaaagcccgtttaaacagaagaaagaggtaactagaccagtacaagttcgtgagagcacgtataagatggttaaagatatagcctatcataaggacgctaaaatcgttgatgtcattgactctatgctgaaatatgctatcaattcagacgagttcaatgagaataataaataatttaaaattaataatttattatttattttaaaaaactagtaaataattagttttaggtgggatcgttatactattattgtagagataaacaaggaggttaacgcatgaatgaagaagataaaaagtttgaagacttcatccaaggactttatgatactgataaggagccttctgatgaggaatggctagataatattgccagtgcaatggtccctaatgatgccgataaagaaaagagataatgttaagtcttcagaaatttagttaaattagccggtttaagtcggtggtatcatcatgagcaacacgcagataggtcgaacgcccgtaaaaacgctggtcagtcagccttttcgtatgaggaccttaaagggttgcgtaagctggccttttggttatttgtaatcagcatctttatgaattggggctttgttggtgcagttagtttgattgcatgggtagctatgtggtctgttagcctgctattttaaagcaaccttgttaaacaacattattaattgacaattcaatgttatagttataacattaacaataagaaaaaggcccagtgctggatacactgaacccttaacaagtacctaccgtctaaagaacggtggtcttacgacaacaactgattaactattaaccagctctcatctaaaccttggtcagtttggagagctggttttgtgttaatctttttttactagtgccataatggcgactactgcactgataatatttaccgttgtagaaacggtagctactaccaacattgcaatatccattgtttagcctgttcatcaagatttttcacactctggcattctaccatcccctgttctatagtaggcttaaatcgttcctacagcaaaggtgaaatcgtgccaccactctctaaacttaaggtactgttgctattaaaccacctattcaaaatgtttacaacctaaaaacgcggccttctaaacttccctagcttaaatagggcggcttagggggcttttagtttgccctgccaattttactaggatacccctagaacgtctcgcaggccccctaaatggctctcaggcatactccaggctgtgttaacctgcggctgaataaggggggacatgactaggctgaaacattttgttaaacttccttatatcaaggtgtgtaaggaggtggcaatctaatcaattatattggtgtcagctataaagtgacctcacgggaggataatacgagcattctatcgtttgccgagtataattatgccatatacccctataacgtctcacaggacgtcttagaggggtatatggacatgcacgctaaacgacagctatcaatcaccaataaactttcaacatcagttttccgatacaattgcactatagggttctgttgcgaagtttgaaaatcaaacgcgccctctctgaactccaaatatcttaggctgttattcccattaataccttgatttcagtagacaccgaaaagccgaagagcgttccatttcttcgg

SEQ ID NO: 720 - DNA, 159845 bp, Unknown
  Metagenome-assembled genome
ttttctatgcgtaatgagttggcgtccaaaagctgtacggtcaagatagtgaaaggcgcgtacgtataacgatcagtatgatgcagccaacattgcaaatgttcaagcggcgggggatacgtcaacgttatccatttgcacgctatgcaactacggtacaaagcgctgcgaagctgattttgacggccaacagctaaggcggccggataccagttgggcgtattaggactggtgaagggcaggaacaaaactaccctccacagcaaccaatgctgcaacatgcgccttatgcaagaaatcgaaaagttttggttatgggctgatatgtacacgtaggatcatggggctaacaaacaagatgactatcaaggacataaactggttggattgctgcatacccgtaatgttagcggtaagaactggtatgcggctaaccacagcatggcaatggtcatcaacagcaagtccgtatcagctatggtggttttgagtcaggtcaattacagagcaactactaccctgcttaatcagaaccacggtcaaacagactaaataaccgttgccgttccggcccataaccaaacagcaaacaatgaaacacttccggccatattgcttctgccaagtgggtcccgagtcgaaggacctatcactaagactgcggttaagctgcgcacagggcatcaagtaaggccaaatgagattacattttaccggctggaaccacggtcaagacgaaccccccccaaaaaagcatatgtcagggtggctatcgtgggtacgtcaaccacgttttttggtctatggctatttagcacctggccagcaagcaatacgctggaagatggaagagtggcgtttctgacagtattacacagtgaaggagggtgaagttgtgggtgattgtcaacgtaaaacggtctaaatatgatacatagctagtcagaatggttaagaccaatttacacaccactactatcctggccagcgatgggggtgccggtaatggtgcaatatgaggatacaacccaaaaactaatgctggatatccaaaggatgtggcaccaccaaagaaagttgagaccctcgaagaaaagctgaatcccgtgccgacattggtgacaaagcggacaagcccgagcaagtctatcgaagcagccatcaaattgatttctgaccgcggacacagattcaaaatggctaattggcttcttattagtggcttgtcgtcacgttagttttacacgcagaaaagttcatttaggaagggaaaatatgattaaaaaaattagctttaagactgctgatggaagcgtgaatgggaaattgattgtgggcttattagcgttatgatcgtctagtacccaagtctttgccctgtttggcgacattaagtttatggggggggtgttggggggagctgattggtcagccattgttgccgttgttaacatgtataacaatcattggtttggcgtgtgattatgacgttcaaacagtgacagcaccaaccgtttaaaagtgagaggaaatccagtcgaacgcagcagctaaaggttgcttgaacgaatgcaacgccacgtccacagtcgcggtagtgaatagtctgggagcttcgacgcgatcagctcacaagcaggtgaaaagtgtataataatcgtgaacgttctgtcccctatgccttcgcagtgggggattttttggtgattggtgggaccattacgttttcagttgtataactggttgtaacgatgaaagaatgctggtatacagcaaaaatttgatttttaaactacaaaagtgtaatttagataaaataaaagaaaaatcgcccatagcctgtaatttggtcggtgtaggattttttgtaagttacaaaagttgaaaagatgtaacactggaaaaatgaagtaccggcaatataataaaaattgattttaactgtattctggtacggttctggtacagtccctgttaaactactgtcatagaagtaaataatactgttacccttaagtaattgtttacttaacggaacgtcatcagaccacaccctactatggggtgtggtctttttttatctctggatgtggcgttggtgcgaatcacgtgcatgaccacgcatataacgattactgagaatttatacttaggctaagtgttagtgcaatttgatatcaaccaccgtatgattacggtgacttggcgttagaggcgtaaccgtattggattaagcaagtcaaaacaagcccaacagaacgtcgcatagtacgtctgttgggcttgttttaaaatttcacttgggttgaacttttggtcgacagggcactatcacttttgtggctgctgcgtgataggctgaatacgatgatcaatgatcgttagtgactgacctgactagtgccatcagtatagttcaaggtcataccgggctggatattgaaaatatagacattaaaactaacagtattgctaccaactgactgaccacgcatttgaacaccgcgggctaacaattcgttacctttgaaaatgggggtcacttggtagcggacgtagtttttcggactttctttcaaataggccgcaacttggttttcataggtcgtcatttcagggtcattcaaagaacgggttccggtcatgaggttcttgatattgttgttctgccccgttaattgatagccaatcagatgactgcggttgtaaagccaaccgctactgatgcgtttgttatgccaaccagttggtcgaacattcaaggcctcacgttcagctttgggcatcagtgactgatttaagagggcattagcagccgtcacccggttaagtgagtctaaattgccatattgttgccaggcaccctgactcgtactgagctccttagcggtaaatgcgggctgattctgattaatcgtgatcgtttgttgaccgttgtaagttttactagccaacgcattgttacttgggttatggtcagaattgaccttggttggtgctgttgtcgaagttgcgccagcttgcttgttcgtagccttgagcttgtcaatatgttgttgactactcgaaagttttttcgcagcctgctttaagctgctagcagaagcacgattggcagcttgaagtgccgtcagttgcttgtcattattagccgttactaagtgggtcttagtaacggtctttgtcttcacagttggctgagtggattcatcagatgtgccgagaatactaaagctgacgagcaatgcgataatggccggccaactatgccgccaccattggcgcccacggtagcgccgatgtaagcgccagaaccagtacagggttgcaaataataagatggtgccgatcaatgccatgaagtgatcctcctatcgaaatgacttacggaaaccagcggcccgcgccgcgtcttccgtactaaagtaaacggcatttttaccggccatccggtagttttgacccgtttcaacgtgataaattttggaattacggttacccacgatgcgtccagtttgggcggtatcggtatcgccagaaaaattattctgccgactcgtggttgcggtactagtttgagtttgttgactttgagcagctgcttgactgctggccttgaccgcttgcttagattggctagcggctgcgacggccgaagcggactgggcttctgactgggagcgtgattgtgcggccgcttcactagcagctgatttggcggcagcctgtgacgctgattttgatgatgccattgcgtcgtcatgttttgcttttagttgttcggattgacgcttagcctgactagttgcaattgcgagttgggtcgtgtttgaactaagagctttggctgaggccgcgttagcccgactagcggcccttgcttttgcccaggcggctttattagcagcagtccgtttctcaacccgaaccgtcttggttttgacactggtatggttggcggcttgttgattaccagtggtacagccggttaagatgagtagactcgttagtgcaacgacgagtttttttgcatggtgcataagaaattcctccttgtttatgtatcactttaattatacataaacggtaaatgttggtaaagcaagtttggtaactaaaaatcaattaatattggtttatgctggtattaatttttacaattaatcataattagtgctaactactaacacccattcggaataatttagtagcaggtatttaaaatgttcatacggcgacaaatcagacctgtgggggttattaacgacctataacggttgtataaacaggctaagattgcgataatagaacaaacacaccaatgggggaatttttttgaaggcaacgttacagaaaatcgggacggcactcaataaacgcatggggatcatcaaagcattatttgtattctctgtcctgttatttgtgattacggaagtcggcaaaattgcgaaggaagtcagtggcgcgcagttggcgaatgcgcttgcttcgcaaagctggtggcatctgttgagcatggtcgtgattggtattatcgcagtgacaccaatgctgacgtatgacgtcatgattacaaagtttttacccaaccactattcacttggctatatcttaaaagctggatggatcaccaatacatttacgaatatcggtggttttgggggcgtgctgggcgcctcactgcgtgctaacttttataatcgcgaagccactaagaaacaaatcgtgtttgccatttccaagatcgctttgtttttagtttcgggattgtcattatattgtatgatttcactcgtgctagtctatggctttggcattgggaacatgtatggcagttactggatctggctcgtcggtggtgcactgtattttccagccatctttatttttacacgagtcaacgattcggaattcttcgatggccttacgctcggcaacgtcgttcggttattgagtgggtcgtttggtgaatggactggctgtgtgctgttcttcttattaattggaaactttatgggattacccattgattttgcagcggtcgtgccgttattcgtgattgcttcggttgtcggtgaagtgtcaatggtacccggtggtattgggtcattcgacgttttcatgatttttggcctcggtgcggtcggagtttctcgaccagacgcagtcgcatggctcttattttaccggttattctactatattatcccgtttgccatcgggttggtcttattcatccatgacaccggccatcgcttaaacgtgcgcttagcgggtattcctaagcaggcattacaacgtgttgctcagatggtactgacggtttttctctatttttctggttttctgatgttgttgatgtcaacggtccctaactttgcatataacaataaactcttcttacagttttatccgtacacctttttctttattaatcaggccagcagtattattatggccttcttactgattggggtggcgttgggaactgctggccgggtcaaaaaagctttttggccaacggtgattgtcctgctgattgcaattttgaatacgattcgctggctcgtcgtttatgatgcaatttcgatgaaatttgtgattttcttgattgtgattctagcgctagtggctttgtcgcggcatgcttattatcgtgatcggttggctttttcgtgggggcaaacgttgtgggttagctgcgtgtatgtggtgacctttatcttgtatacgattgtgggggtctataacgcgccccaaattcatcatcggcatgcggttcctgaagctctgttcttcccatcacaaaagctctggttatttggggtgattgggttagtcttagcggcaatgattttgattattatgtaccgctactttgcgagtggctataacgcccgattgcgtcaaaagatggatgcggctcgggtcaaacaagtgattgaaacttatggcggcaatgaaatctcacacttggcttatttgaatgataagttagcatattactatcaagtcgatggggtcgatcaactgatcttcttataccagcagaaggctgataaactgattattatgggagagccattcggtaatcaagcggtattacaagctgccttggaacagttattggatgacgcagatagtgacgggtgctcgctagtcttttacgaaattagtgagatgctgacgatgcgcctacacgaaatgggctttgactttatcaaaactggtgaagaagggcacgttaaattggcagactttagtttggctggtaaacggctacggggtgagcgggccctaatgaataagtttacccgtgatcactatgagtttgccatcttgcagccaccgttcagtgccgacgttatggctgaattacgagccgtttcggatagttggttagcaggtgagacggaaaaaggattctcgctcggattttttgatgagcagtatctcaatcaggcacccgtagcggtcgtttatgatcctgaccaccgaattgtcgcgtttgcgaatattatgccgcagggaaatcatcagacgacttcaattgacttaatgcggtcgagcaaatcggcgccatccggcattatggacacggtctttgtgcacctatttgaacaggcgcgtgacgatggctatgcttatttcaatatgggaatggcaccgttatccggtgtaggggtttcacgctacagttttattcaagaaaaaattgctcatttaatttacgaatatggctaccagttatatggttttcagggattacggtcgtacaaagagaagtatgtgaccgagtgggaaccgaagtacattgcgtaccgaaaacgtaattcactaatcttcaccattttacaattgctacaagtcgttaatacccgggtacacaagtctgagcggcaccggccagtatggttgttgaaacgattgaaataactgaatagtatgtcataaagtaagtatcgttaatgacatagcaaaatgccccatcactgcgagaagcaatgatggggcattttatgatgactttagaattcagccgactaatatgatgagggctgaactaattgtggcagaagcactagagctgttttgcgtaggctagattatttagttcgtatacttaggcggtaacacatgtttgaaatcatggaaaccagcgaaaatttcatcaagatcatgcccattaatgaataggtcgaggttagcctcgggggcaaaccctaaatcggcggtcttttgtagcatggcgactagatcgtcgtagaagccgtcgatgttgtagagcgcaatcggcttttggtgaatatccatttgactccaagatagcatttgtaagaattcttcaaaggtgccaaacccgccaggtaaaacgataaaggcgtcagcgaggtgaagcatcttttccttgcgttcggtcatcgtgcgcgtttcgataaaagtcgtgacgtccttaaatgcaagttctcttgcgaccagaaaatgcgggataatcccgataacgcggccaccagcatccatagttgctttggcgactttccccattaaaccatggtcgccaccgccatagacgagttggtaatcattagcggccaagtattgaccgagtgccaccgttttgtcactaaatgcgggatctaaaccagaattagacccacaaaaaacacagatattatgaattgccattctaaactacccccaagataaaattttctagcaaaaatgcggcccggataggcgccgcatttttgtgaactaacgtgttgattaatcgtctggattaccaatatcgtagtcggtgtcttgcattgcttcaacttgacccaagcggtaaccattcccaacttgtgagaagaagtcatggttagaagtccccgttgaaatcccgttcatgacgaccgggttaacgtcttccgcagtatctgggaagagggcatcttggccgagattcatcaaggctttgttggcgttataacgactaaaagtcaagacttcatcagaccaaccaatttgatcgtaaactaaatgaatgtagttttcttcattctcatagagtttgtataagaaatcgaacatccagtctttaaattctgcctgctgcttttcagaacggtctttgaagcctaattggaacttataaccaatgtaagtgccatggacactttcgtcccgcaaaatcaatttaatgatttcggcaacgtttggcaattgattgtgccccaagtagtacagtggcgtatagaaaccagaatagaacaggaaagtttccaaaaagacgtttgcaactttttgcttcaatggatcttcgtcgatgttatcgtaaagcttgtagatccattgggcttttgcttgcaagaattcttcactgtcactccagtcaaaaatttcattaatttcgtccggcgtatttaatgtttcaaaaattgttgaataactctttgcatgaacagattccatgaattggatgttatttagtacggccgtttcatgtgaggttaagacgttgcggcgaagtgcttgcagaccgtcttgtgattgtaacgtatctagcagcgtcaaaccgccgaaaacgtgtcccacgacccaccggtgatcatcatctaattcacgccagtctgccatgtcgttggaaactggaatccgggtgtctaaccaaaattgttcggttaacttttcccaagtacttttatcaattgcatctgaaactcgatcccagttaattgccttatagttgccattactgagcagtttttggtagtaagccaagtctgttgccatttgttatcctcctagagatctaagatactaaattacgcagctttcacattcgttaacaccgacttcgccatcgtcgtccgtaaaggtccgaatataataaatcgatttgatccctttgcggtaggcgtagttccgtaaaatgtttaagtcccgcgtggtcatcttatcagtgcgaccatctttccattcgtataagccagctggaatagttgaccgcatgaagagggtcaagctcattccttggtcaacgtgttgttgagcagccgcatagacatcgataactttacgcatatcagtatcgtatgctgacttataatagttaattgtatcattagataggtaaggagcgggataataaatcttaccaattttcttttcttgtcgttcttcgacccggttgatgattgggtgtaggctggcagtcgtatcgttgatgtacgagattgacccatttggggcgacagccatccggttttgatgatagagaccatcacgcataacggcttctttgagggcttcccaatcagctttggttggaatgaagatactgtcaaacagtgcagcggtcttgtcatattttggttgccaatcttgggtggtgtacttgtcaaagtaagaaccatcggcatacttggatttttcaaaattaacgaaggtttcgtgacgttcacgcgcaatttcgttagaagcttttaaggtccagtagtttaagagtaagaagtagatattggtaaagtcaacggcttctttactgccgtattccatctgattcttcgcgaaaaaggcatggagccccatggcacctaacccaatggtatgggcttgacggttccctttttggatggaaggaacgacgtcgacgttagagtggtcagtaacaaaagttaacgcgcgcaccatggcttcaacagaatgtccaaagtctggagaggtcattaagttaacaatgttagtcgaaccaaggttacaactaatatcagttcccaacttctcatactgttgttggtcatcaattaatgatggggtttgcacttgcatcacttctgagcacaaattactcatcacaattttaccgtcgataggattttcgcggttcgcggtatcaatgttgacgacgtatgggtagccagattcttgttgtaacttgctgatttcattttcaaggtcacgcgccttgatcttagttttacggatgttcgggttcttaaccatattgtcgtattctttggtgacatcgacatatgagaacggtaccccgtattcgcgttcaacgccgtaaggactgaagagatacatatcagcgtcagccttgatcaactcgtaaaacttgtcgggtacggtgacaccgagtgaaagcgtcttgagccgaatcttttcgtcggcgttttccttcttagcagaaagaaaggcaataatatctggatgaaagacactaaggtaaacgaccccggcaccttgacgttgacctaattggttagagtaggagaaactgtcttctaataatttcatgacgggtacgaccccactagcagcgccatcgatatgcttgattggatcaccggcaccccgtaagttgctgaggttaataccgaccccgccaccgatccgagaaagttgtaacgcggagttaatcgtccggccgattgagttcatatcatcggtcgattgaatcaagaagcaagaaatcaattcaccacgccgggcccggccagcattgagaaaactgggggtggctggttgataacgttggtgaacgatttcgtcggccaggtccatcgccaagtcttcattaccatcagcaaagtagagggcgttcattgccacacggtcaataaagttttccaagtaatagtcgccatcatccgtctttaaggcgtattgggcataaaatttgtaagccgccataaacgtcttgaagtggaagtcttgcgaccgcaagtaatcgtaaagtttttcgataaagctaaaatcatacttatcaatggcaggggtttccaaatagtcgtgttcacgtaggtagtcaaagcgcgccttaagactatcaaatttcatcgtgttcggttcaacattttgttcaaggaaagcggcaagtgcctcctgatccttgttgagcggaatctgattgttaacgggaatattgatctcattatttaagtcgtaatacgtgacgtcttttaaatcttttaaggtcataaggaatcctctttctatcagtataattgtggctggcaaaatcgacgacccacaatcagtaggttgatgattgtgggtcgtttatcatattttaaagggtaaaccagctatgtaaccacgcaaaaaagcgtgaacaaactaaacagctaattgttttaaagcatccggacggaagccggcaatgctgtcttcgccattgatttcaacgaccggaacagcatggaaaccttgattcttcaggtaatcgacgtattcaggattcgtattgatgttcttctcttcaaaggcaatattgtgcgccgtgaggaacttcttagtcatcttgcattgcatgcagttgtttttagtaaatacagtaacttttttcatttttcatcatcctaactcgtttttctgataaatttagtatacaacatgtggtgaaaaaaacaatcaaaaaacacaacatctagggtgcggtaaaaatcacaagccctagatgttgtgttagtgtcagcttttaaccgactaaaaagttttttaaattatttgtggttcactcgctgaatcagttatcatagatatagaccagaaatttagaggaaaataaatatgaccaactattattatacacacaatccggatattgtgcatgatgaaaagcaatggaattttgaaatttttaatcactcgtttaaatttacgacggacaacggtgtcttctccaagcgtaccgtggattacggctcacgaacactacttgcagcgtttgatccaactgatttgccagcgggcccaatgctagatttgggaaccggatatggtcccattgggatggcgctcgcgtatcaatcacccgaacgaacggttgatatggtcgatgtgaacgagttagcgctaagcttagcgcgtaaaaatgttgctttgaaccaaattacgaataccaatatttttacgtctgatgtctatcaacaagtgaccgcgactaattacgcggcgattgtcaccaacccaccggtgcgcgcaggtaaggcagtggtggatgcgatgttaacgggggccgtttcacggctagtcgttggtggaacactcaccgtcgttttacagaaaaagcagggcgcaccatctgcgaagaaattgatgcaaacgacctttggtaattgtcaggtgattaagaaggacaaagggtattacatcctacaaagtgtaaaggagggatagtcgtgacggaaccaacagcggaagactggatgcaagaagcattacatgaagcgcggatggcctacttaattggcgaagtgccgattggggccgtgatcgttcaccagggtgaaattattggccgtggtcacaatttacgggagcatggtcaggatgcaacgatgcacgcggaaattattgcgattcaggaagcttgcgaatatttgcatagttggcgattagccgattgtcagctatatgtcaccttggaaccatgtttgatgtgtagtggggctattattaatgcacggctacctgaactctactttggtgcccgtgatcccaaggctggcgccgttcgtagtttgtatcaggtgatggatgatacccggttaaatcatcaagtaacggttcatgaacgcatcttggcacgtccggccggcgagatgttggaaaacttcttccgtgggattcgtaaacggaaaaaggcggctaaaaaagcacgacgtgaagctgctgaaaaaaattaggccgatggctggtaattgtggcgcaaatcatgtattatagtatttgccgcaaggccaaaaggcaagggtggatttacgaatcgtgtcaggtccggaaggaagcagcactaagtttgcttcatcttgtgccttttgtttttatgaaatgtaacagctcttagccattcggttgagagctttttatttaaattaaatattgagtgctagttttgaacgtgctgataggttggtttatttttatttacctattatccatagtagtaatacgttatttgggtgatgcttttcaggctgatagttaaagccactgcttgttgaaggaataactaaacgcctaacaaaggtggttaaaggcctgggcatcgactcgttggcaagtgcgcttagatgcttaatttgtataaccgacactgattgttagtggaagcagcacaaccaggaagctaactgttcaggacgtttaaacaatggcttataataagtaatgataaccaaagtatgactgatgtaagaaaggaagaatcgcatgtatcgggcactatatcgggtttggcgtccccaacgctttgatgagattgtcgggcaacagatgattacccagacactaaaaaatgccattatgacccaccagacgagtcatgcgtatctgtttaccggtccccggggaactgggaaaacgtcggcagcaaagatttttgccaaggcaattaactgtcaccatcttgttgatggggaaccttgcaatgaatgtgagacttgtacggcgattaccaaggggcaactaaatgatgtcatcgaaattgatgcggcttctaataatggcgtggaagagattcgtgatattcgggacaaagcgaagtatgctccaacgcaagcggactataaagtctacattattgatgaagttcatatgttatcgactggcgcgtttaatgcgttgctcaaaacgctagaagaacccccggctaacgttatatttatcttagcgacaacggagccccataagattccattaacgattatttcacggacgcaacggtttgattttcggcggattacagctaaggatagctacgatcggatggtgtacatcctcaatgagaaggatgtgacctatgatgaaaaagcgctacgcgtcattgcagcggctgctgaaggtggaatgcgggatgctttaagtattctggatcaagtaatttcgtttggggataacacggttacgttggatgatgcgttaatggtgacgggaagtgtgaccaagcagttgctggctaactatgtcagtgaggtcaccgaccatgatacgaagccggcactagagacgatgcgacaaatcttacaagaaggtaaagatgcgaaccgtttcattgaagatttgatcagttatacgcgtgacgtgttactctatcaacaggcccctgaaatggtcgatagtgtggcgatgggcgaggatgatcaacaatttgaagcatttgccaagcaaatcgatgctgaagtcctgtaccaaatggtcaagacgttgaacgatattcaacaacaaatgcggttcacgacgcaccccgacgtttatttagaagtgttgacggtcaagttagctcagttggatggtcaagcggccgttcaaccggccgttcaaccggtagctgcggcaacggtcaatcctgaagatcccactgtgcataaactggcacaacaagttgaacagttgcaaagcgaggtcaaaacgttacgttctcaaggtggtagtgtcactaaacccgtaccggctaagccgcggtcgagtaatggcccggttgttaagaaggttaatgtcagtcagatttatcctattctgggagcggcaacgaagaatgatctcattaaggtgcgcgatgtttggactgatttgatgaacattttgagtgtgacgcagcgggccctaatgcacgtggcccaaccagttgcggccagttcagaaggtgttgtggttgcgtttgactatgcgtttgtttatcaaaaagcgattgatgaccagaccttgatcgatgcactcggaaatggtttggatcggctgatgggacaggcacccaagattgtctgtgtgcctaaagaacagtggccacaaattcgtaaggattatttggccactcaccagccaggaggtgcaacatcagagcaacaagcaccggccaaagaaccggtcgttgaagaagctaagaacatgttcggtgatttagttgaagtacagccggactaaagacgaaaggaactgataattatgatgcgtggaatgggcaatatgcaaagtatgatgaaacaaatgaagaagatgcaggcgcaaatgacagccgaacaagcggctttaaatgaacaaaccttcacgggtgcggcgccagacgacatggtcaaagtcacttttactggtgataagaagatgaaggatattacgattaaccctgatgctgttgatcctgatgatgtggatatgttacaggacttagtcgttgctgcggtgaacgacgcgttgactaaggtcgatgaacagacacaaagtacgatgggaaaatatactaagggattacagtaaaaacgaggtaagtacatgcagtatccagaaccaattgctaagttgattgatagttatatgaagttgcccggcattggtggcaagactgcgacgcggctggcgttttatacaattgatatgaacggtgatgacgtcaccgagttcgctaagtcgctgattgcggccaaacgggacctgcatttttgtagtatttgcggtaatatcaccgaagatgatccgtgtgtgatttgtaaggataagtcgcgtgatcaaagcaccgttctggttgttgaagaggccaaggatgtcatggcaatggaaaagattaaggaatacaacgggctgtatcacgtcttacatggggtattgtcacccattgatggcaaaggtccggaagatatcaacattgccagtttattgaaacggctacagcaaaatgaagccatcaaggaagtcattattgccacaaatgccacgcctgaaggtgaagcaacagcgatgtacatctcgcggttagttaagccggcggggatcaaagtgacccgattggcgcacggcttgtcggttggtagtgatattcaatatgcggatgaaatgaccttattcaaagcagttgaaggtcgccaagaaatgtaattggaggtgccaccatgtttaaacgtaaacagaagatcaagcatcccaaggaagtttttgatgaacagttattgtcgaccctgaatgccgctaagttggactgggaccgtgcgaagcagaaccaagaagcggtctatgataataatacgagtgaactagttacgcagaccgccttagcgcgtgctaagtatttatatctgtatcgtgaagcacgtttacgtcaagttcatgggcagacgattcagcgctcggtcattgataaatagactgttagtgatttaagagataacttgtttcaaaataaaaatgtgtgaggcttttgcataatagcctctaggcaaataaataggacgagcaaccggattttgttgttcgtcctatttatttatcaacttgcatctttaaagggctttttacgaagtttagagtcttgcaataacagatgattctttaatggtagcacgttgttcaataatgtaggacatgatgtaagtcgaggaacactgcatccttttctgctctttaggcagttgctctttgtgtgattctttgtagagcatgggacaaggtgtaactgaattatcaaaaagctgggcttttacggaactctattgagtcttaatttggaaagcaagaatcataaaccatttgtgcattggttgcgttctcaatatttgctaaccaatgtggctgttgaagtagctttaccaactgtgataacgctaaaacatgttctgcagcatctattggagcgagtccgataatgacatttattcttttagcgtgcttagtattttcatcgtaaattttaattggtttttttaagaccaatagagacataccaacttttcgaaccccatccgctggtcgtgcatgggctagcattacaccattaccaatgaccatgtaagggccatgttctacagttgatgcaataattgtgtcaatgtagtgtcgattaatatagcctttcttaaataagggagtaaaggcattaataattgcatctttccaactaagatcgtcccgttggctaatcagtatgttatcaagtgagagtagttcttgtaggccaatgctatttgttaatgcagtttctggagttggttggtttttggcgagtaaatttgataacgcagattcaagagctactggattactaatacgagcataatcaccgattatatccattagattggtaacggtcagtgcattgtgagaggatcttttaatgatttttagtgatatcagtgcttggttaatttgttgccattgtatctttgtgggaattggtgcaacgacaattgttggtacagggtaactatctgttaatttaatagtgctaataattagtttaatgtttctggaatgactgtttttaagtttgaaaacgctcataggctccgaaaatttaacattagggtatcgttgacgtaattcttcgtgtagaactttcgaggttccaatgccactagaacaaactacgtcaaccgcgtaatctggtttgttttcttttcgtaatatgcctccgaaataaattgcgacgagtgtaacttcttcatctgatagtctctggtcaattaggtcttcaaagggttttagagaaagacgtgtaaaaaaaatcaattcattgtactgcttcataattatgcttaagctaggttgtttaaacgtaatttgatacttaacacgatagtaagtagataaaagatgtgttaacaagggtacctctaaagattctacagagatttgagagccagaaacatcattaaatcgacgaatgatttgtctaacaataggcgctaatttatgagctagcttattatcgggattaatgtgaataaactgaccgctttttactaagtaggtgatgaacagctgctcgtttacgttataaatctgataatggcataaaaatgcttttgcccagttattaatgatgccaacttgttcagacatattagcatcgttttgttttaattcaaaactatgatttgtgagaagtcggttcagataccaagaaaagaaggttattaggattgttaaagtatcatcactaaaataatttccagtgtccgtttctagtgtacgcagaaaatgtgtaatttcgagagacgtattgggatcaatttttaaggcgctatttattaatgggccgttctcgcctagaactgttaaaaaccaatttcgttgattgcgttccgtacctgttagagaagtaccatttgttcctgaaattatcgtaagaccatagtttagagcagttactttcaaagcttttaaatctgagacagcagtatgatgtgtaatgtgaaagcgtcgttgattattttctaatgaaacatattcgtgattaatcaaggatagcatggttagaagtttccgatcacgctgggagaaaacctgactgattgtttttgaatctgagaattctttcaataaagtgtgctttgtgtcatcagaaagatgataaccaaccccctttacgttttgaatagtgtctaaatcattatcgtctagataatgatttattttttttaaagcgtaaaagaaggttcttcgtgagatatgtaatacttcatgaattcgattgaaatctacgtaggaacttggttgaagtaagagttctaaaatatcttctccgtgcttaatatcattaacttccataggctatatacccccttaacatctagtagtgtaacgattgcactaatttacctgcaattattgcacttgtaagcgcttttatcaagagtagacttaactttgttaaatgaaatgaagtaggaggtgaaaagatgcaattacttgattcaagtttagttcaattggatgtaacggttgacagttggcaatctgcgattagatgtgcagcggagccattagtcaagaataagtttgtgactaaagagtatcctgagcgtgtcattgaaattgctgaaaaggatggtccctatattgtaattgcaccacacatagcgttatcacacgctgctgtatctgatggggccttaaaaaatggtcttggacttactgtcttaactgagccggttaagtttggaaataaggttaatgatccagtaagtcttgtttttacacttagttcagttggcgatgatattcacttaagtcaaatggctgctttagttaatgtgctccaaaaaacaagagtaattgaaaaagtaactcgatctaacgatgttaacgaggttatagatttatttaatgaaaggtgattaattatgaaagttttagtaacgtgtcgcaacggaatgggtaccagtactatgttaacagttcaggttaggaatgttgctagtaaaaatggttgggatgttgattgtgaacatgccagtttagatgcagttggtagttttcgtggggacttaattatttcattaagtgatgttgctaaagagttggaggatgaaggcgtaaaaacaccaattattggtattgacagcttaatggattctaatgaaattgaacgaaagatgacaccgtatattggaaagtaggttataatccatgcttaagttcttaatcagtctattcagtagtccagcaattttactaggtgctgttgcattcatcggtttggttagtcaaaaagggaaagacgcaacggatgttactaaaggaactattaaaacaattgttggtttcttaattttccagattggtgccagcacaatcacgactacgctacaatcatttaatgttttgttcaaagaaggattccatattcatggtgttattgcagcgccagaagctgcaactgcaatggcgcaaggtaagtatgggtttgttgttgcgttaacattgatattaggctttgcaatgaatttagtttttgcacgaattacaccatttaaaaacatctttttcacaggtggtcatagtttgttttttgcttgtgtattagctttaattctcaaatttgaaggattaaatgatctttgggcaatcatatttggtggtgcgattttaggattttgttctacggcgctaccagctctttgtcagccgtttatgcgaaaaatcacaggcggtgatgcacaagcgattggtcattttaacatgattggttatgcaacttctggtttggttgggacgctctttaaaaaacacgcagatgaaaccactgaaaatattaaatttccaaagtttttgtctctatttaaagatttcattatcggtgtggcaatcgtgatgttgattatgttctatatagcaacgtttgccgcgggtcaagttgcaactgctaaaatttctggtggcgttcattggctagtgttcccgttgattcaggctttaacttttactgcggcgatgagtgttctgatgtatggtgttgggatgtttcttgaagaaattacgaatgctttcgttgcaatctcgactaaatacattccaggatcccgccctgcacttgatgtaccaactatttttccatacgctccaacggctgtccttgttggctttattggttcttacgcggccgggttattgggcattgtcattatgaccgtatttcatttttcaacagttattatacctgcagcacatatttgtttcttctctggtggtgcagcgggagtgtttggcaattcaactggtggttggcgtggtgcgttagcaggctcctttgtcatgggactaatgctatccttcttaccactcttactattaccagtactccaacaaatggggattcaaggctcaacatttcctaatgttgattacaatgttattggtattttactcaaacaagtatttagtattttttaaaatgaggtattcatatggatatgcaaaaggcagaaattacaaaagaaattcgcgattatggcattatgtcagttgttcgtgcagacgttcaaacttcactaaatattgctgaggcggggttaaaaggtggtgtaaagctaattgaattaagctttacggttccaacggcgcaggaatcaataaaacaagtcaaaaaaaattttccggagatcattatcggggcagggactgttttagacgcggtcactgctagaatagccatcttaagtgggacggactttatcttatcccctgaatttgataaagatgttgcgttgatttgcaaccgctatcaagttccctacttaccagggtgcaatacggttactgaggctgtagaagcaatgacctatggtgcagcttttattaaagtcttcccaggctcagcgattgacggtccaaagtggattaatactgttaaaacgcctattcccaacatgccaatccttgcttctggcggtggaaattttgataattttaatgattttctcgatgctggcgctgactgtgtggcatttggtggcttgttagctaatgggagtcttcaacagattgaaagtaacgctcataaattaactgaacagttagaggcttacagaaagaacaaagcttaatattaaactaagcaaagcgtccgtgacatgatgtagcctctatacaagtaaatagggtgaaaaactgaattttagttttgaatactcccacataggtggacaagcagacaactaaagcttgtccacctatgtgggagtttttctgatagaatgattcagattttctgggtaaccttttcaatgctcttactggaaattgactgaacgcccagtagtcattattttactaaatactggttcaacgacagtcttatatgatatcaaaagtaggtatggagcatccactaatgaataacaaactaaaatcggtatttatcaatcgtgggtagtactatctaataactttttagcaattcaccgaataaatcatcaaaaccacaattggtagtagccgacccacgtaaaaatcgtgaaaaagtaccctcactagtggtaaccgtattagacaggtactcaaaaatcaagtacaattgctacatataagaaaatagatgggattgggaatgttgacaggaaaattagttacttttgaagggccagacggtgccggcaaaacgtcagctttaaacgcgattgtggccaaattacagccacaattaggggatcgcttagttgtgacgcgtgaaccgggcgggaatcaaatctcagaagcaattcgaaaaatcattttagaccgtcataatacagcgatggacgaccgtacggaagcgttactctatgcggcagcacggcgacaacatatcgtccaaaccattcaaccagcattgcagaacgaccaacttgtcttgtgtgatcgctacatcgatagctcggtcgcttatcagggggccggtcgtggtattggggaacaagcggtttatgatatgaatcagttcgcgaccgcggggctaaccgcagatttaacgttgtattttgacgtagatgctgccgttggattaaaccgcattcaacaacatcgccaaaatgaaattaatcgcttggacgtggaagccttaagtttccatcaccgggtgcaagcagcgtatttgagattactggctgatcatcctgaccgtatcaagcgcgtcgatgcaagtcagccattggaccaagttgtgacgcaggccttagagattatggcgtcacagttaccggcttatgtggcatccaagggaggggaagaccaatgaaattaattattgcaatcgttcaagataaggacagtaaccggttgagcagccagttcattgaagccaatgttcgggccacgaagctctcaacgacggggggcttcctacgttcaggtaataccacttttatgatcggtattgatgatgaccgtgtggatgaagttttagccatgattaaagaaacgagtcatgcgcgggaacagtttatgacaccaccagtcaatctagacgtgacgatggatggcgcagctgcctatccagttgaagttcaagtcggtggtgccacggtctttgttctaccaattgaacaatttcaccaattttaatgaaggatgattattaatggcaacaaccgagtcatttgcgcaaacgttagcggcgaaacagccccgcttattagcggcatttaaacacatcatcgcccagaaccatctggcccacgcgtacttattcgcggggatggaaggcgctggacaaccagaactggcccattggattgcgcaacggttgttctgcctgcatattaatgatggtgaaccagatggcacttgtgaggagtgcgtccggattgctaatgggtcgcaccctgatattgtgacagtggctcccgagggtcagcgaattcacgttgatcaggttcgttacttaaaagctgaattctctaagagtgcggtcgaaggtaaccggaaactgttcatcattaatgatgcggagaagatgacagcgagtgctgccaatagcttattgaagtttattgaggagccaagtggtaacgtcacggccttgttattaacgactaataagcaactgatgctaccaacgattatttcacgaacccaggtgatcgaattcccaccattaaatgcgcaggcgttacagcagacgtttgaacaggccgggattgcgccaaaccaagcacagatgttacggggcctgacaaatagcgtgacccaggcgcaggcgttgctagcggatgattggttaccacaagctgcgcaagcattgtggcggtggtttgaccaggctgttaagggtgacccacggagttttgtggctgtgcaggtcaatttagttggtttggctaaggacgctgatcatcagctggttatgttggatttaattgcggccttgttccaagatctattgcaattacattttgaggtggcaacgacagcgttaacctttggtcagtaccaaaaagaattggccgggttaacggctgaagtcagcgatgagcagttgattgcggcgacagaactagctttaacggccaagcgccagctagctagcaatattagttttcaaaatgtcttagaaggcttaacgttaaagttatggccgatttttcaaacaaacgcttaaataaaggaaaacgagggtgagcgcgtggataagcgtgatttatacgatagtttcggtgagatggaacaacagatgcaacaaatgctagacaaaatggccaagttacgcgccgatatgacaacggtgttagagaaaaacgcggaattggtcattgaaaatgaacatttacgtgaacacatggtcgaaattgaaaatgaattgccgaaaaaagcggctagcacgaccacgctctcaaagtcacggcaaaacttggaaaaactctatgatgagggcttccacgtctgcaaccagttttacggcaaacggcgtgacgatgacgaatcctgcgttttttgtttggaagtcatttatggtgaacgtgaacgcgcatagtcgaaaaagtctgggagtagtcccagactttttgtgcttttcaccacgagtcactcataggaacaagtcacggtcgagaggattgttaggaggacgttttggaaacacaacaaagttttgcagatcatgcgggtatcgggaccttgtacttagtaccgacgccaattggcaacttacaggatatgacttatcgggcagtggcgacgcttaaaacggttgacctaattgccgcagaagatacccggaatacccaaaagttattgaatcattttgaaattacaacgaaacaaattagctttcatgaacataacacccaagaacggattccccagttaattgaaaaattacagacgggcgttaacttagcacaagttagcgatgcggggatgccgtcaatcagtgatcccggcaaagaacttgtggcagcctgcattgccgcgaatattccagtcgtgccactaccaggtgccaatgccggcctgactgcgctgattgcttctggcctagtgccacagccattttatttctacggctttttaccgcgtaagaagaatgaacaaaaagctgatttagctaaattggctcggcgacatgaaacagtggtcttgtacgaatcgccattccgtgttgccaagaccttgaccctcctagcgaccgtctgtgaagggacgcggccaattgtggcgtgccgggaattgactaagcgttacgaggaattcgcgcgtggaaccttggctgaaatggtgacgtgggcgcaggatcatcagttaaagggcgaatttgtccttttgatcggtggtaatccggataaggatgaaccagaaacaacggatgaattggcacagttgccagtcaaagcccaagtcgaagcgttgattgcagccggagataagcccaacgtggccattaagacgattgcgaagcgacgaaatattccccggcaaagcgtttataatcaatttcatgaactaaataccaacgatgaggagtcttgatgaatggcaactttaggcgcaaatgcgagtctttacagtgaacagcaccggattacgtattatgaatgtgaccgcactggtcgcgcaaccttaacgacattaattgatattgccgtactggcatcagaggatcaaagcgacgcccttggtttaacgacggaaatggtgcaaagccatggtgtcggttgggtcgtcacgcaatatgccattgatattacacggatgccccgccaagacgaagtcgttacgattgccgttcggggtagtgcttataatccatattttgcttaccgtgaattttggattcgggacgcagatggtcaacagttggcctatattacgagtatctgggtcatgatgagtcaaacgacccggcgaatcgtaaaaattttaccagaactggtcgcgccgtatcagtcggaagtcgtcaagcgcattccgcgcttgccacgaccgattagttttgaagcgaccgatacaacgattacgaagccgtaccatgtccgcttctttgacattgatcccaaccggcatgttaataatgcacactattttgattggctcgtagatacgctacccgcgacgttcttgcttcaacatgatttagttcacgttgacgttcgctatgaaaatgaagtcaagtacgggcaaacggtgactgctcatgcgaacatcttaccgagcgaagtggccgatcaggtcacgacgagtcatttgatcgaagttgatgatgagaagtgttgtgaggtcacgattcaatggcggactttaccagagccgattcagtaatttgctgggttggtatttacactagtgtgttaatgatgtgatcgtgagcgacttggtcgattagaacgcacgtttttattagagtcgctggcgattcagtatgctatgattaatacatccatacaggggaggttcattatgtcaattttagttttagggggagctggctacattggttctcacatggtcgatcggttagtagaacacggtacggacgtcgtggtcgttgataatttggtcacgggacaccgtgctgctgttaattcggcggccaagttttatcagggtgatttgcgggatgcggattttttgaatcacgtttttgatactgaggacattgaagctgtcgtgcattttgccgccttttcaatcgtaccagaatcaatgagtaagccactgaagtactttgataacaatactggtgggatgatcacgttacttgaaacgatgcaggcccatgatgtgaagcaaatcgtcttctcatcaacggccgctacttatgggacacctaagcagattccaattaaagaaactgatccacagttaccaatcaacccgtatggcgccagcaagttaatgatggaacaaattatgcactgggcggacgttgcctatggtattaagtttgtcgcgttacgttactttaacgttgcgggtgccaagccagatggcagtattggcgaagatcatggccccgaaacacatctggttccaatcattttacaagttgcgcaaggaaaacgcgatgaacttaaaatcttcggcgatgactataatacgccggatgggacgaatgtgcgtgactatgtgcatgttgtcgacttagctgatgcacatatcttggctttgaagtacttggctgcaggaaatgacagtaatgcctttaacctgggttcttcaactggtttctctaacaaacaaatgttagcggctgctcgtgaagttaccgggcaaccaattccagctaagctagcaccacggcggcctggtgatccagactcattggttgcggcgagtgataaggcgcgtgacgtgctaggttggcaaccaaattatgacaatgttaacgatattattgaaacagcgtgggcttggacgcagaagcatcccaatggctacgatgatcgtgactagtatcggttagctgataattgaaagcggctttgaaatctcgtcaatagatttcaaagccgcttttgtggtcgtcaaaaaaggtgcatgtcaggattgagtccttggcacgcaccttttagattgatcaatgcagttagcggtgaagttgttgataatcaccgataattgttaagagtcgttgaatatcagttgtatcaacatcaccgatggtaccaattctgaagctagggatatttgaaaccttcccaggataaatgacgaagccgcgttgcttgatgaactgatagaagtcagcaaaatcaaagtcgacgttcgggtatttgaatgacgtaatgatgggcccttgaatggctggatcaatcactaattcaaaacctagcgcttgtaagccgtcgctaaggagttgttgactagcatggtaacgttggtagcgtggtgtcacgccgccttctgcttgcaattcaatgagtgcttgcgcaaaggcatgtaccacgtgggttggcgaagtgaagcgccattttcctggttgcttggtcatggcttgccattggtcgtagagatctagacaaagtgaacgagcgttgtcagcagtgtgggccaaggtcgcttgttttgcaatgatgaacgcaaaaccgggcacgccttgcacacacttgttggcactactaatcaagtagtcacaatccaattcatcaatgctaatcgggacgccacctaaactggacatggcatcgatgatcgttacgatcccgtgttcatgcatgataggcattaaggcttcgattgggttgagaatcccagttgtcgtttcgctatgaacggttgcgaagtgggtaatctccggatgatcagctaaggttgcttcaatccgaaccggatcgacggcttcatcttcgttgaacacaacgtcgatatgtggaatatcgtaatattctgcaatttgactgatccgatgcccatatgcgccgttaatggcaatcattaaagttgcatcggtccgtggtactgctgtgccaatggtggcctcaacaccaaaactgccgcttccttgtagtaggacggtcgtatagttttctggattggcttgggccatagctaagatttgttgccgaatggtttcggtgacgtgccgatagtcactatcccaagtacaataatcaatttgcattgcgtccttaacactggcagtcgtactgagtggaccgggtgttaggagtaaataaggttgtttcataaaaatcgggctccttgtctgctaatgatcagtggcaaccggttgattgatttgatcaagcaatgccggtaattcagccatcgattgtaaaatgtaatcggcaccagcgcgttgataagcggcagtgacgtgggctcgtcgttcagcttgttcggcggggctaagggcgttgaaggctaactcagaaagtcccatgatgttgctaccatcaataatccctacagagactgcgtcggcgttgttgccttctaagatatcattaacggaatccccaattttcatgacggttgttggatcgatgattgtgagctgttcagctgctaacgcaagcattgccggcgctggtcgaccaacaccaccagtttgttctgaagtgatgttgacggcgggacgatagccttgcttagctgcaatcggtaagaccagagctaacatttcagcgtcatagccggtggtcgtgccatagctgatattgtgagcggtcaaatagtcaattacagctgacatgccgggctttaattgtccgaattcagtcagggagctaagcaagattgccttgaagttgctaaagatttgattgcagtcgtcttcagtcggtaagacttggaaacgcgcctgccagtcgttttgaacggccggtaaatccatgattttatggatatgggtgtacttatctagtcccatatcttggcgaatctcagcttcagagatttgaataccaacgttggcaaaggctttttggaaagccacgatgggcgcccggctgccatagtcaatggtcgtgccggcccagtcaaaaattactgctttaattgtcattgatgaaaactcctttgaatttacttagttgttctttaagtagtggccacgtaaccgcatagaaaccagttcgagcacgattgcgacacccaagagtaggtagacaatcaaaccaacttcatggaaatcgaagtagaaactgccagccatgaagaggtagtaaccgatatcgtcagcaccagctgcagcaccaacggcgaccgcattggcaaagttaatttcaaaccggatgaacgtccagctaagaagtgctggaatgattgacgggagaatggcctgaaaaacaattggccaaaaacccacgccactcgcctttaacgcttaaatcgtatcttgcgaggtttcttcaatactttcagaataagccttaaccaagtacgctacactgtggaaggtcaagccgaccacggcggcactagcacctaatcccatgactacggagtaaattaacacccataaaatcgttggaatggcacgaataaaggccatgactgctttaatactagtagctaaccaactgggtgctaagttacgggcagcaccgacggcaatgaagaaggcgattagcgctcctaacaaagtcgtcaacatcgctaatgaaacactagtcattagggcccgtaagagttgccccagtgtgtcttgaccaacgctagggtgtaagaacatagcattcaggttgagacctaagctatgcaaagcgtcaatgatgttcaggttggcattattgagtgtgactaatgaatagacactgataagcgttaggccaatcataacggctcgcaggattttgcggggccgagtcaccaacgaaatcgaccgggttggtggtgctgacggttgaagtacttgtgttttgggttgactgttttcaatcatgcaattgccctccgaattcgattagatgtcaattctaaaacaatgactaaaatcgcaattaacaaaacaattagaccagcagcgtcatagcggaacgccttaaaatagtagtcaaagagaaaaccaacacccgtacccgtcaagagtccgaccaaggttgcgtcccgtaagttgttttcaatcatgtagagaatccaactagtcaaggtactagcggcttcgggtaacaccccacagaagacacattggaaatagttggcgccaacggcttgcagtgcttgaagcttttcggcatcgaggtcctcaatagtttcagtaaaggcccgtgtcagatagcctagcgtcataaagaacagtgccaagaagcccgtaaagtcactctgtttaaaagaaaacagaagaatcatcgcccaagcgaccaccggaatattacgtaagagtgaagcaccaaaacgaataatccagcggaggacaggcgttggggtggttgtcttagcaccgagaatcgcaaagatcagggcgaagagactagcgaccatggttgatgaaattgccacgagcaaggtccgccacagctgataaagaatcggtcccagataagaaatcgaacgacttgtcggaataaagttggtaaacaaccacattaagcccgctggaatcttactgatcgaagcccacgcctgaaaattaacgagggccatggataagacgtagatgccaattaaaatgagcaaaacaactgataatcgcaaccgacgttgccgaaaaaagcgttgcggtgtcattggattagttttcattggcagccaccgccgttgattggtcaggttggcgataaatgtgctgtaagaccgcgtcgtcaacttcattagtggcgccttcgaaaacgatggccccgctgttaatgccgacgatatggtcggtgtacgccattgcgatatcgacctgatgtagattaatgaggataatcagttgtttttcctttgccaatcgccgtagaatgtccatgacaatggtcgttgatttgggatctagggaagcaatcggttcatcacataaaatcatcttaggatgttgcattaatgcccgtgcgatcccgacccgttgttgttggccaccacttaattgatcgcaacgttggtaggcgtattcttttaaccctacttcgtcgagtagttgtagcgcctcttgtttttcggcgctactgtaaaggccgagcatgccagcaactgttgatttagcgcctaagcggccatgcagaacattttcaagggccgttaacggactgatcagattgtagttttggaaaatcatgccgatatgatgacgaactttgcgtaattcagctttgttcgcttgacgaatgtcagtgtcatcgagcaaaatttgaccactatcatcgcggatcaactgattgatactccgtaaaatagttgttttaccagcaccagacgggccgatgatggcagttacttcgcccggtttagctgtgaagttgactgctttgagcgaatgcttattggaaccatatgttttatctagctgaataaccttgagcattggcaaatcctttcattgtgaactaatggtacgtggtttagtaacctactaacttatgcgttggcgcgtaccacttgtcggtaacattaactaatttggacttttctgatttcttagggaacatcattggtgtcttcgcatttggttcagagaagatctttttgttttgggcaaaggacttcgacgtgaactcagtggcgatcttcttttgatcatccttgctgagggacttggtattgtatacccatgggccttgttgaacaggcatcatggcaatgttaacgaccgacttgccggctaaacttgtaaatggcgcttcggcgttatccttaacagtgaaagttgagccgaccttgtcccatgatcccttggtaacgtttaagtatggcattaaatcagcatcatcaaaggcagcgacatccgcatcccccttgagtaagttgaccgcggaaccctgatgagagccaccatagagcactttactaaagaatgatccgctttgagttaatttatcttggtcagcggttttgatgttgaattcacgtgagatttcagccgttggtactaagaagcctgaagttgaactattggaaacataagacatcttcttgcctttgacgttcttaatactgtacttaccgttttcttcatactttttggcatctttttgttgtaccattaagtaggagttataagtagcgtctttcaaggtacctttagcatcagattgtgcggcaaaaggtacaacatctttgctcttgtggtgtgcttggatataaccgttagcccccatgtatgcgacttgagctttgccggatgcaattgcttggatcgcaacgttatagtcggtcgtggtttgtaatttaaccgtcttacccgttgccttttcaactgcttgcttaatggccgtacgggaaccagcaaaactcttggctgattcgttaggatagaagaccaccgtgatggttttgctgctatccgtactgctaccaccagatttagcactggttccgctagcgcaacctgcgagtcctaaacctaaaaccgaaatgaatgaaagacctaataatgacttactaacttttgacatagtttccaattacctccaagtaattttagttacttgtgtagcataacaaggtattgtaaatgtgcggacaaggattagtgaagtatatgtataagttatgtaaataatatttacattcggttttcaattcagcgattggtaagtatgagtggaaactggtcaggatagttgttgattgtttctggattgaattggttggttactaccgtaaagctttcaaagtaagtaaattatgataagatatgtgaagtaattcaaaatgaggagttttttaaaattatgaagttgttggcgattgatacttcgaatcggccattgagtgtcgcggtattagaagatacccagatcttggccacaacgaccactaatgttggccgtaaccacagtagtacattattaccaattattgaacaagccatggctcaagctaaattggcaccagctgatttagaccggatcgtcgttgctgccggaccagggtcgtatacggggttgcgaattggcgtgacgactgctaaaacacttgcctttacattagataaagccttagttggtgtatcgagtttggtcgtgttagctggcaacattgtgacggaaggccaattagtggcgccgttatttgatgcgcgtcgtgacaacatctttgccgggttatatcggattaagaaccagcgtccagttgccgttatcgctgatcaacatatcagtgtgaccgagtggggccaacgattagctagttatgatgaaccaattacctttgtcggcgcggatgtcgatcaatatgcggatgctttgcagcaatcgttagccaagcagttcgttcgtgcagccccacaacttgacttgccccaagccgtagtactaggtttgatgggtcgaacgctgacacccgtgagtgaaattcataactttgtgccgaactatttgcgtttaacgcaagctgaacgtgattggcaagccaagcacccagaaaaggaacatgcgccctatgttgagaaaatttaaggagtactttcaaaaaatgaccaccggtggcaatcaacgccgccaacgtgtattggccattcaaaatcacatcgttaaagtgggcgaagtcaattactatgtctcacgcgcactgattaccgatgtgcccgagatgctagccattgaacgggccgtatatgcgggacagacaccgtgggatgaaaatgcgtttaagacggaacttcgccgacagagcggtcggttctatattgtgatgcgtcatgaagatcgcctcgtcgctttttgtggttgtgtctttgatgatcgccgccaagatgcacatatcaccaatattgctgtacatcctgatgttcaaggccaaggactaggccattttatgatgcaagtcatgatgaagcgggcgcgtaagttgcattaccaaacggtgacccttgaggttcgttacagtaatacgattgcgcaacaactttaccgcgatttagggtttgaaaagactggtatcaagaaacggtactattttggcgaccatgaagatgctattgatatgacttatcgtattccggtagctacggatgactgaacgacagcttgtcgccagtacgcagcttgacgcgggtcgggccgtccaagtttgttaccagttagcgacattagcatatcccggtggcgcaccttggcggcaagcgacgtttgcggcggacatggcgttaccaacggtacactatgatttattacggtggcaggatgaactgatcgggtttgtcagccgctcaacagtgcttgatgagaccgaaattacgaatattgcaattgatccggcctatcagcgtcaagggcatgcgcggtggttattaacagcctgcttagcacaattatcggcagggtccgtattcctagaagtccgggctagtaatctcgccgcccagcgcttgtatcagcaatgcggctttgaccagattgccacgcgtaaggaatattatcatgatcccgaagaagatgcgtggatcatgcgtaaaatgattaattaaaaggatgggaaccgtggaaaaacaaaacttgattttagcgtttgagtccagttgtgacgagactagtgtggcagtgatcaaagatggccatgagattttatccaacgtgattgcaacgcagattaatagtcacaaacggtttggtggcgtggttcctgaagttgccagccgtcatcatattgaacaaattacaatttgtattgaagccgcacttcaagaggcacacgtgacgtatgctgaccttgatgctgttgccgtgacgtatggccccggtctagtgggggcactgttagtcggtgttaatgcagctaagacagtggcatacgcgcaccaattaccgctgattccagttaaccatatggccgggcacatttatgccgctcggtttgttaagccattcgaatttccgctaatggcactattagtttctggcggtcatactgaattggtctacatgcaagcagatgggcagtttgagattattggtgagacacgtgacgatgcggctggtgaagcttatgataaaatcggtcgggtattgggtgttccatatccggcaggtaaagtcattgacgagatggcacatgcaggtcacgacactttcaaatttccgcgagcaatgattgatgaagataattacgattttagttttagtgggctgaagagtgcgttcatcaatacggtccatcacgcagatcaaattggcgcgactctggataagaacgatttagcggctagctttcaggccagcgtggttgatgttctgatgagtaaaacgttacgagtcctcaaacaatatccagttaagcaattagtcttagccggtggcgttgcagctaatcaggggctacgtgaacggttacaacaagatttaccaaccgcttttcctgacacagaactaatcttagcgcctctaaagttatgcggtgataatggtgccatgattggtgctgcgggctatgttcaatatcagcatcaccaattcggcgacgcggcgctgaatgccgatccaagcttagaatttgattggatgccaggtatgttgaagtaatgaagtagttataaacgggtgtgaaaagtcagtccttttcacacccgttttagtatcttttcattaattatgattaaaagaggatgattcctagaatcaaaaatgaccagcttaagcccgctggaaatagttcaagttagtgtaaacttgcttagttagttcgtcctacaccgacctccaggcatttctgccaattgccggaacgtggtgggcacagatttgagccgaaaaaccacgtctcaaatactggcctttcactaaccaagcacaggacgcttgctaagtgaaatttcaccactgggcattgtcagaaacgccttccagtcgggatagcgttcgaatggctgataggggcgtactcaacttttgctggatttgtcgttgtttttcataaacgttaattttatcaatcaactgtcagattgaaaaggtcttgtgataactcactatttctgaattaccgtagtaataattgaatatttcgaaaaagtggagaaggcactctgatatttgacttaaagggttcagtatcaaaatagccaacgacaaattgtaccgagttcagtggccgttcatcagccattcgagcggcatcccgactggaggggctgggtgacaatgctcagtagccaaattattcttagctggaagtgggttccttccggcttagaataagactcaaatcgacgtcggcttacgttccagcaattgtcacccagccccggaggtcggaatcggacgcgcattgctgacgaacaggaacccacctaaccggcacctttcaatcatgatttatgccgcggataggggcaaaataatagtcgcctcaagaattatattaattcttgaggcgactattatttttatctgatgagtcattggaaaattagctcaattcttctaaagcttcagcttgttcggtccattcggtttcaacttgttcttgttgagtattgatggcttcaagttctttttgtaggtcttgtagtttaccaacatcggccgatacttcaggttgcgccatttcagtttgaatctgtgtggcttgttcatctaaggcagtcatctgttcttccagggcggcaactgagcgctcgagcttgcgcttttcacgttgttgctgcttgctggcttggtaattttgctggcctttggagcggggagcagcagttgtggcactggttgaatccgctgcaccggcttcagcagctttttcggccgcttggctagcagccgcagccgcgatttcagcttgctcttgtttcttgtcgatgtagtagtcgtaatcacctaagaagagttccgtgccttccggagaaacctctacgacactcgtggcgacttggttaatgaagtagcggtcatgtgacacgaacaaaagggtgccgtcaaagtcgttgagggcgacttccaaaacttcacggctatcgatatccaagtggttagttggttcatctaagattaagaagttgtcattttgcatggcaagtttggtcaacagtaaccgggctcgttctccaccagatagggcatgaacgggtttatcaacatcttcaccagtgaagagaaaactgcccaaaatggtacgaatgtctttttcaggagtggtgggatgttcatcccaaagttcaccgaggacggtttttttgtcgtttaaattacgttgctcttgatcgtagtagcccgtaacgacgttggtgccaaaaacggcctggcctttaatgaatggaatctgtcccaaaatactctttaggaaagtcgattttccaataccgttcggtccaacaatggcaatagcttcatgtttcttaatattcaagttgtcgggttccgaaagaatctgaccatcatagcccacggctgcatctttgacggtcaacacaatgttgccgctttgtttagccgcatgaaagccaaagtgggcagtcttctcgtcactatcagggcggtcaaggcggtccatctttgctaactgcttacgccgagcctgggcccgttttgtcgtagaagcacgcacgatgttacgattaacaaagtcttcaagcttgctgatctccgcttgttgcttttcataatgtttccattgtgcttggattcgagccgctttttcttgcacaaactggtcgtagttgccagtgtagtgcaccatttcatggtgtgataagtcatagacttcgttaacgacccggtctaagaaatagcggtcatggctaacgattagcagcgcaccagagtaagactggagatagctttccaaccaagtaagggtttcgacgtccaagtggttcgtcggttcgtcaaggataagcaagtcccgtttttcaagtaacaacttggccaaggccaactgggtcttttgtccaccggatagtgccgtcaccgacttatcgtacacctcggcgtcgaattggaagccgtgcaacacgccccgaatctcagcttggtagccgtacccgtttttttgttgaaattcagtttgaatctgatcataggttttcagggtctgttgataagcctgctcatcattcatgattgcggggtcgctcaattgattttcgagctggtgcatccgtttttcgatggcatgtaactcagcaaagacactactcatttcttcccaaatcgtattgttactatccagtccttggtcttgcgccaagtaaccgattgttaagcccttgcgcattgaaatctggccttcgtccggtaccgtttcgccggcaatcattttaagtaaggttgattttccggccccgtttcgaccgacgagggccacccgagcgtgttcttgaatatccatttgtacgttatcgaacaagacatcggcgccaaaacgccgcataacttgctgtacttgtagtaaaatcacgctttattaagctcctttcacatttaattcgtgacataattgtagcatattgtaacggcctgacccaattattcggaataataagtaattattatttcacaaagtcacgcgttatgctagaatagtgtcagcaaattcacaaacttttaattaggaggacacgtccgaatggcagaaacaaaaattccacgggcaacggcaaaacggttaccgatttattaccgctatttaaatatcttgctagatgcagataagaagcgggtctcatcgaccgagttgtccgaggcggttaaagtagattcagcaacgattcggcgagatttctcgtattttggggcgctcggcaaacgagggtatggatacgatgttgaaacgttacttgcatttttcaaaaagattttaaatcaagacaccttaacgaatgttgctttaattggggtcggtaatttgggccacgccctactgaactttaattttcacaaaaacagtaatgtccgcatttcagcagcatttgatgtcaacgaggcgattgccaatacagtccaaagtggggttccagtgtacccaatgacggagctcaaaaagcaattgatcgaacaacagattgagattgctatcttaacggtgccaaccacggttgttcagaaaattaccgatgacttggttgatgcaaacgtcaaaggaatcatgaactttacgccgttacgaatctccgttcctgagacagtacgggttcagaacgttgatttgaccaacgaattacaaacattgatctacttcattgaacattacggtcagcaattaggtgacaatggtaatgacgatgaaaatgagactgaagattaataactcgctttatctttgaaattaaatggctataaaaaggcttctctgaattattcaggaaagcctttttaacatacttagatcacgaatcattgattgtaacgtataaatattcggtgaaaattaacgttgaaacgctaggttagcgctacctagtaatgatactagtgcagtaagcctaataatgtgggtaacacaaccgatgcgttcattaggatgtgagccgtcatcgatgtttgaatccgaccggtgtgctggtataaccagcagaataataacccgataaaggcatagaggataaagtgaccatccgcatgtgcaaagctaaatagcacactagaaatcaaggccgccccaatctgaccagtaaccgcacttagattgccaaagataactttgcggaagacgatttcttccataatcggggcaccgacaatgatggctaagaagaaagcgggatattgttgcccaacagttaagagggtggtcgtgttggttgacgctgttgactgtcccagtaaagccgtcatttttaaaatgatgacttgaccaacgatgactaggacaagaccgatcaatccccagatgaacgtcatgaaccagttacttggttgtttttcaacaacgttttttgtccgcatgcgactcgccaaccagatgagtaggattgcaccgactaagtagtcgaccgtttgaatcacgaatacttgggcccctagctgatggaaagcagtcacaaggacgctcggtagtgcgtaaataataaagtagatgataagaataaagattgattggcggcgattaaccatcaagtcacgtccttttaaaagtttgatttaagatttattgatacttcaatagtattcattatagtcgatttgacattctttgactaataattgacaaatcacttgcaatcttgaattaaaatgatatagttgacaatgtaattagcacttgaggttgaggagtgctaaaaaagaataaatggagggattcacgtgttaaaaccattaggagatcgcgttatcttgcaacaacaagaagaagaagaacaaacaattggcggtattgtcattgccaataacgctaaggaaaagccccaaagcggtaaggttgttgccgtcaatgacggtcgtgttttagataacgggacaaaagttgaccccagcgtgaaggtcggcgatcaagtattattcgataagtatgccggtaccgaagtcaagtatcaaggtgctaagtatttggtattgcacgaaaaagatatcgttgcaatcgaagactaatccatttaaattgcgcaacttaaaataaattaaattcatgaggtgaatagagataatggctaaagaattaaagttctctgaagatgcacgttcagcgatgctaaaaggtgtcgatcaattagctgacacagttaagtcaacgttaggtcctaagggtcgcaacgttgttttggaacaatcatatggttcaccaacaattactaatgatggtgtaacgattgctaaggcgatcgaattagacgatcatttcgaaaacatgggtgctaagttagtttctgaagttgcttcaaagactaatgacatcgctggtgatgggacgactactgcaacggtcttaacacaatcaatcgttaatgaaggtatgaagaacgttacggccggtgctaaccctgttggcattcgtcgtgggattgaagaagctactaagacggcggttgactcattacacgctatggcacacgaagttaagacgcaagaagatattgcgcaaatcgcttctgtatcttcagcaagtgaagaaactggtaaattgattgccgaagccatggaaaaagttggtcatgacggtgttatcacgattgaagaatcacgtggtgttgatactagtttagacgttgttgaagggatgcaattcgaccgcggctacttatcacaatacatggttactgataatgataagatggaagcggatcttgacaatccatatatcttaattactgataagaagatttcaaacattcaagatatcttaccactattacaatccatcgttgaacaaggcaagccattgttgatcattgctgatgacatttctggtgaagctttaccaaccttagtcttgaacaagatgcgtgggacgtttaacgttgtcgccgttaaggcacccggttttggtgatcggcgtaaggaacaattacaagatatcgctatcttaactggcgggacggttatcactgacgaccttggccttgaattgaaggacacgaccatcgatcaattaggtcaagccaacaaagttacggttactaaggataacaccaccattgttgaaggcgctggttccaaggatgctatctcagaacgggttgaatttatccgtaaccaaatcggtgaaacaacttctgactttgacaaagaaaagttacaagaacgtttagctaaattagctggtggggttgccgttgttcgtgtcggtgccgctactgaaactgaattgaaggaacgtaaataccggattgaagatgctttgaacgcaactcgggccgccgttgaagaaggctttgttgctggtggtggtactgctttgattaacgttatcaaagatgttgctgcattgaaggaaactggtgacgttcaaactgggatcaacattgttaaacgtgctttggaagaaccagttcgccaaatcgctgaaaatgctggtttggaaggctctgttatcgttgaaaagatgaaggaacaaaagccaggtgttggtttcaacgccgcaactgatgaatgggttgacatgatcaaagctggtatcgtggacccaactaaggtaacgcgttctgctttacaaaatgccgcttctgtttcagcccttctcttaacgactgaagccgttgtcgctgaaaaacctgaagaaaatgcaccagctgcaccagccgcaccaaacccaggtatgggcggtatgatgtaaacaaatcgtaacattaagcacttactcggctgagtaagtgcttttttagtgctgttagggtgtgaatcgactagaataaaggtattgatttatccatattagagcggtaggattagtcgttaacgcaaaatgtgggtgcggtgaagcacccgacatttaactggtagtatttggcagggtaaagtagtagaatctactttgactcagtttactttgggataattattttggaataaaggagttattatcatgtggcgttatttaaagcggttagttattgggaaaccgttaaaaaccatggacgagggtgggcaagcactcaccaagttcaaggcactggcgctgctatcgtcagatgcgctatcatcggtggcttacggtactgaacagattacgaccgttttgattacactttcagcggccgcgttgatgtatcaattgtacgtggcggcgcttgtgttagtgctgttgtttgctattacgatgtcgtaccgacaaattattcgggcttatccatctggcggtggcgcctacgtggtggcaagtacgaactgggggcggccagccggattagttgccgggggatcactgctggttgattatatgctgaccgtagcggtttccgtcacttctggtactgaagcaatcacgtcggcgattccggcgctagctaattatcaagtattgattgccgtactgattgtcatcgccatcatggcgttaaatttgcgtggaatgcgcgaatccgcatcattcttaacgtttcccgtttattttttcattattatgattatcggcatgattctatggggcgttatgaatattgcgagtggtaacttaacttaccacgcctccgcagcagttggagcaccggttcaagggatgaccttggtgctgttcttacgggccttttcttccggttcgtcttcgctgactggggtggaagcaatcagtaatgcggtgccaaacttcaaacgaccgaaacgcaagaatgcggcgaacacgttagcaattatgtcattagtcttggccgtcttctttggtggtattacttatttaagttattacttaggcgttaaaccacaagtagacaataccgtcttgtcacaaattgctacggcggtctttggtcacggcttattctactacttgttacaattatcgacggcgttaattctggccgttgcggcaaatactggtttttcagcctttccaattttagcttataacttggctaaagataaatttctaccacatgcttacatggatcgtggggaccgcttgggctactccaatgggattatctcattggcggtcggggcaattgcgttgatctttatctttcatgggaagacgacgcttttgattccactttatgcggtgggggtctttgtcccatttactttgtcgcaatctggtatgattattcattggttccgcgaacgggggcaatggtggtggatgaaggcggcggtaaacttacttggggcgttgatttcgattctcctagtgattttcctattcttgctacatttcggcaatgtttggccatacttaatcgttatgccactcttactgtacatgttctaccgaatccacgtgcactataaccgggttgcggcccagttacgcgtggttgccaaggaaaaagcggcgattcatgattatgacggtgcaacggtgatcgtcctcgtctcgaatgtgacgcgggtaactgctcaagcagtcaactacgcgcgatccatcggagattacgtcattgcgatgcacgtgtcctttgatgagaaccctgaaaaggaacacaagacggcggcagagttcaaagagacctttccagacgtccgtttcgtggacatccattcgtcgtatcggtcgattgcaacaccgacgttacgattctgcgatgtgattgctaaacgagcagcggaacgcaacttctcgacaacggttcttgtcccacaattcgtgccgaagaaaccatggcagaatattttgcataatcaaacgagtctccgattacgagcggtattaaattctcgtgaaaatattattgtttcaacttataattaccatttaaaagaatagtgacttagtattgaaacccggtatagctaccgggtttttatttttgtgtcataatatgagtaactaaggttataatttagatacttaatcagcccagtgaccggcaaatgtgaacgaattgtgttgcctttactaagttttagtgaagcgagttgtcaagcgtcactgggatttgtataattatcgtaatagagtgagaagggagttacgcacaaatgatcagatttgaaatcctagtaagcctagtggcgaccatgatactttctgcgatcttgacgccgtttgtgcggaaacttgcatttaaaattggtgccgtggataaaccaaatgtacgacgggtcaataaaattccaatgccgacaatgggaggcttggctatttttatctcttacaccgttgggacgactgtgttgtatctcatgcaccagtttcccagtcgcatttttttcgcactactcggtggtgagctgatcattattgcgactggtgttatcgatgatatttatgagctaaaaccacggcaaaaaatgttagggattacgttagccgctttggaggtctactttattggtggtatccgaatgacgaccttcacgttcccgttgctggggctgattcactttcagtggctgagtttaccggtgactttactgtggatactggctatcacgaacgcggtgaacttaattgatggactggatgggctagctaccggtgtttcgattatttcgttgagtaccatgggaatcatcgggttgttcttcttgaatgctaatatgttcgtttcgttgttgatttttactttagttgcggcgatgattggctttcttccgtataatttctttccagctagaatttatctcggtgataccggttcgttgtttatcggctttatgacggctgtgttctcattatttggattgaaaaatgtcaccttaatctcagttggtattccggttatgatcctgggagtgccaattacggatacggtgtatgcgatgattcgacggatcctgaataagaagcccatttcgcaagcggataagcatcatttgcaccaccgcttgatgcaattaggattgacccatcgacagactgtgatggtaatttatgggattgcacttattttctcatttatttcattgctctatccgatctcatctatttggggttctgtgttattgacgattggtttattatttgggctagagttattcgttgaagcaatcggattagctggtgacaatcggcaaccgctactggattggatcaaacggaccgtcgcgcgtttgacctccaagagtaatcattaaaaaccaaataaatcattgaaaattattaaagtgttacaggcatctaccgtgtgattagcggtgatgcctgtttttagttggtcatcagttggttcatcaatcttaactttaccaaaactatacaagcaatttacacaatcgtcattcacaatttacaaacgattagtaatattaagcatgttccgaagcaatcaattacgtgtaaccgtcggacggtgatgttgctccatcactagtcgtagcactcctacccagttttgctatgatggttgccgggttggttgcttaattttgatagtcaattgaagaaggggagtttcaattatgaaaaaagcactgacactcggcgcattggcagtaacgatgaccattttactagctggttgcggcagtagctcagccacaagtacgaagagtactagtagcagtagtggtagttccaagactactaagatcgttgcaactggttcaaccgctttacaaccattagtggaacaggctggacaggcttaccagaacgaacatgctaacgtgaccattaacgttcagggtggtggttcaggagcaggcttaagtcaggtggcgaagggttcagtcaatattgggaactctgatttatttgcacaggaacaaaaggggttagacgccaaagggttagttgaccataaagtggctgttgtggggatggcacccgttattaataaggatgccgatgtcactaatatttcaaaagaacaacttatcaagattttccaaggcaagatcactaactggaaagatgttggcggtaaggacgaaaagattaccgtcgttaaccgtgctcaaggtagtgggacccgggcgacgtttgaaaaatggggattagacaacgcgaaggtcgcaactagccaagaacaagattcgaatgggaccgttcaaaaaattgttagcaccacgcctggtgccatcagttacttagcattctcatacgttaagagtgacgttcaggcgctttctattgataacgtcaaaccaaccgaagctaacgtagcgacgaacaagtggaagatttgggcttatgaacacatgtatactaaggggcaaccaactggggagttgaagaacttcttaacttacatgacttctaaagccgttcaaggtagtttagttgagaaattaggatatattccattgacttcgatgaaggttgatcgtggccaatctggtgcaatcactaatttaaaataaataacagacaaaaagtcgagcgatagctcgactttttttatgggccgcaattagtgcaacgcggactttaacaatgaaaaaacaaatcatcggctcaagtgctgggtgttattgttaagacgagttggctgtttcgattttgactgccaatcaaagtttgtgaggctcccaattatatataaccagcaatctagttgccaggcgtagtgaccggaatttctgtaaattgttcaccttgctccgaaaaggtaacttgaccgctcaagaggttagtgatgtcctgctgaatcgttgcaatttcggattgagtgactgcgatgatttgtgtgacttgaacaccgtagtcggtattcagggtcgttagcttattttgttgtaaatagtaggttaaagcatcgacgttacgatagtcgagcgtgatggcgatgcgggtttgtaagattcgctgaaccttaccactgacttcaattgcttgcgcgggggtgccattataagctcggatcagtccaccggcgccaagcttgataccaccaaaataacgggtcacgaccgcaagcacgtcgtgtagctcgttggtcttgagcacttctaagattggtgagcccgcagttccgactggttcaccgtcatcactcatccgctgaatatgatcatcatcaccaagcatgtaggcgaaacagttgtggttggccttaggattatctgctcgaacagcggcaatcttagcttgagcatctacttcgtcactgatgcggtatagatgagcgatgaagcgagactttttgatggtttgttcaaataccgtgtcttgggtgatggtgtagtagggtttagtcaaattaatcggttcctttcgtgaataaatcgttaaatggcgtacttgataactaaggaggtgcgcacaatggaagcacaagtcttatacggtcgtcagctcgcattatctgcaaatgaggctgccgcagtacctgctggcacgcagatactgccagccatgcaggttgatgaacatcaaattatctgtcagcgttgcggcagtcacttggaccgactgcgagcccaattacccaatcagcaatattactgttatcaatgtttaaatttaggtcgagtgagtacactagttaaactctatcatatgccagaaccgaatgcttttgcaacggtcccggtttgcacgtggcaaggaaccctaacgccccagcaagcggactgcgcgcaatcaatcaaagctaacttcatggcgcataaacggcaattattatgggcggtgacgggagctggaaaaactgaaatgctgtttccaggtattgcgtgggcgttagcgcatcagtggcgggtcgccattgcttcaccacgagtcgatgtttgcttagagttagcaccccggctccaggcggcctttgctgatgttcaaattgctgtgctatatggccgcaatcccgctccctatcagtatacgcagctgacgatttgtacgacgcatcaattgctacgttttcgtcaggcgtttgacgtattgatcattgatgaagttgacgcgtttccgtttgctgccaatccccgtttggcgtttgcagtgaatcaggcagctaaggtggagggggccattctttatttgaccacgacgcccagccaaagtttgttgtcccaagttcatcgtggtgagcttgcaatcagttatttaccattgcggtttcaccaacatttattaccggcaattaaggttaagctacagccaaattgggctcggctcttgcaacaaggaaaattaccacgagaccttatccggcaactccaacagtatcaacaacagcaccagcgctttttactatttgttccgcgcatccaacaattagcgccagtgtttgcggtactccaacactattttccccatatgaccggagagacggtgtactcagccgatcctgagcgactgactaaggttcaacaaatgcggaaccagcagtttcaatacttagttacgacgacgatattggaacgaggggtgacgtttccgggaatcgatgtgattgtgcttggtgcggacgacgaagtgttttctacggctgccctcgtccagattgcaggacgggtcggacgcagcagtgagcgtccgactggcctcgtctggtttatttgtcacagtcatagccgcaatatcaaacgcgctcagcgccagattcgggtgatcaatcgaaaggggcgacaattacgtgctagcatgcctactgtgtcacaacattatcacgactaagtttacgttgccctggattcttagctggcagccggttatgcggccggtcgtctgctcggtttgttggcggcaatttgtacgcatcgatcgggcaacggcatgttccaaatgtggacgtgctcaaaagcgaccgcaaccgtgtacagattgtcagtggtggcctgaaatcggtccctttcataacgaggcgttgttcgaatataatgatgcgatgcatgattattttcaacgctataaatttcagggtgattatcaattacgccaagtctttgcgaagatcatgcaacaagcagtggtacaacggtgtgctgagatatgcttagtggtacctgtcacgcccacaacattgcaaacacggggctttaatcaagttgccggctggttagccgcacccctcgcgcccgggttaatgacccaggcaacagcgaagtcagtgccacaatctaagaaagaccggcaagcgcggttgagaacaccacaaccattcaagatggctcctaatacgattttggccggccggcgggtattattagtagatgacatctatactaccggccgaacgatgcgccacgcggcaacgctacttttggaaaacggtgccaagagcgtgacggggctaacgctagcacgttaatttcgagggaaagtggtatttggattgtttattatagcgctttctattataatgaatttaagcaaagtaattaaagagtggtcctttaattactttgggtacacagcaatgtgtgtgaagggagagaagatctatgctaaattttaatattcgcggtgaaaatatcgaagtgacccaagcaattcgggactacgttcaaaaacgggtgggtaagttacagaagtactttgacaataatgttgactcaattgcccatgtcaacttaaaagttcacccagacaagacggctaaagtcgaagtcaccattccacttccctatttagttctccgggcagaagaaacttctcctgatatgtatgctagtgttgatttggttactgacaagttggaacgccaaatccgcaagtataaaactaaggttaaccgcaaatcccgtgaaaagggttataaagcgattgattttgcagcgactgatgaaacagttgccgctgccgacaatgatcaggacgataagttagacgttgtacgtacgaagcgagtggctttaaagccaatggataatgaagaagcgattctgcaaatggatatgctcggccatgacttctttatctacgaagacgcggaaacggacgcaattaacatcgtctatcggcgtaacgatggtcgttacggtttgattgaaaccgacgacaatcactaattttaaaagcgcaacttatgaggactggtcagttgaccagttctttatttttatcccggaacgcccgtataacatattgtgatcatgagagtgacttagcccgcgttagtaagctgaagttcgactcacggcacgtttttgccagcgactcaagacagttaagcaaatattgatagaattaaagaacacgggtcagtgattgttgggctgtggttaaagactaatatttagttaaggatgtaaataaaacggtcgacggtatcggttacataggggcctgtggttttcattgctagtaaataatggtaaaatgacagatggtattttattttgaaatggacaattgaaattaaaattaagattaattatttggagaggatacgtaaatggccaacattttaaaacgctgggttgaaagcgacaagcggactattcggcgtctggataagattgctaataaagttgaagcttatgccgacgaatacggcaagttaagtgatgctgacttgcaagcgaagaccccagaatttcgtgaacggtacaaggagggcgaatcgctcgacgatttgctgcccgaagcatttgcaacggcgcgtgaaggtgcgaagcgggtacttggtttatacccattccacgttcaaatcctcggtggaattgttttgcatcaaggtgacattgctgaaatgaagactggtgaagggaagaccttaacggccactatgccagtttatttgaatgccatctctggtaagggtgttcacgttgtaacagttaatgaatacttatcagcgcgtgatgcgactgaaatgggtgaactgtataactggttagggatgagcgtcggaatcaacggggctgaaaagtcgcctgaagaaaaacgtgccgcttataacgccgatattacttattcgacgaacggtgaaattgggttcgattacttacgtgataacatggtggtctaccgtgaagacatggtgcaacgaccacttaattttgccatcattgatgaagttgactcaatcttaattgatgaagcccggacaccgttgatcatttctggtcaatcagaaggtacaacgggaatgtataagcgggctgaccgttttgctaagacgttgacgaaggatgaagattacaaggttgacttggaatctaagacggtcgcattattagacgaagggattcggaaggctgaaaaatactttggcttggaaaacctttacgatactgataatacggcgttgaaccattacttggatgaagctttgcgtgcgaactacatcatgttgaaagataaagactacgtgatttcagacggtcaggcgttgatcgttgattcctttacggggcggatcatggatggtcggcgcttctcagacgggttacaccaagcaattgaagctaaggaacacgttgagattcaagaagaaaccaagacgatggcgaatatcacgtaccaaaacttattccggatgtacaaaaagttatctgggatgactgggacggccaagacggaacaagaagaattccgcgaaatctataacatggaagttattacgattccaacaaaccgcccgatgattcgtgatgaccgttcagatttgctttacccaacgttacaaagcaaattcaacgcggtcgttaaagaaatcaaacaactccatgaaaagggccaaccaatgttaattgggaccgttgccgtggaaacgtcagaatacttgtcgcatcgcttggatgaggaaaacattccgcacgtggtcttgaacgccaagaaccatgcgaaggaagctgacattgttgcaaacgccggtcaacgtggtgcggttaccattgccaccaacatggctggtcgggggaccgatatcaagttgggacctggtgtcaaagaagtcggggggctcgccgttattgggactgaacgtcatgagtcccgccggattgataaccaattgcggggccgtgctggtcgacaaggtgatcctggtatgtcacaattctacctctcacttgaagacgatttgatgctacggttcggttcagaacgaatcaagaacttcctgcaacggatgaatgttgaagatgatgatgcggttattcaatcacggatgattactcgacaggttgagtccgctcaaaaacgggttgaagggaacaactatgactcccggaagaacgttttacaatatgatgatgttatgcgggctcaacgtgaagtgatttatggcgagcggcaacaagtcattatggaagaaaaatctttgaagcccgttatcatgccaatgatcaagcggaccgttgaacggaccgttcagttacacatgcaaggcgatgccaaggactgggatttagatgcagttgttgactttgcccaagctgctatagtgaaggaagattcaattagtgtggctgacttgaaaggtaagtcgccagcagaggttgaagcttacttgatggaccgggtcgataagatttatgcggacaaggctaaacagctttacgatgcgggtcagatgctagaatttgaaaaagtcgttattctgcgagtggtcgattctcattggacggatcacattgatgcgatggatcaattacggcaatcgatcggtttacggggctatggtcaattgaatccgttagttgaatatcaacgagacggttaccagatgtttgaagaaatggttgcggatattgattatgatacgacgcgactcttcatgaagtctgaaattcgccaaaatattcaacgttaaaatttaacgttagtgctagcgagtctaagactaaggtcttaggctcgttttacagttaaaccagatattaaataattaataaataagttgaaagaagggtcctttgtggaattaagtgaatataaacacctgattgaagaaatgcaaagtggtgtcgacgactttagggggtcgctttgacttagatgctttgaacgaaagcattcaagaaaatgaagctcgaatggccgaacccggtttttgggacgaccaggctgccgcccagaaagtcatcgatgagaataacgtgttgaaaggaaagtatgatacgtttaagcaattagctgatgaagtcggtgacttggcagtcgcttatgagttactgagtgaggaacccgatgctgagatgcaggctgagtttgaaacggactttcagcacgctgaacatgatttacaacagtaccggctcaacttacttttggacggtccgtacgaccgcaataacgctattttagaaatccatcctggagctggtgggaccgaatcccaagattggggtgcgatgctactaagaatgtacacgcgctgggctgcgagtcacaatttcaaagtcgagactgttgactaccaagctggtgatgaggcaggcattaagagtgtgactttattaattagcggccacaatgcttacggttatttgcggtcagaaaaaggggttcatcgtcttgttcggatttcgccgttcgatgcggctggtcggcgccacacatcttttgcgagtgttgatgtgatgcctgagttagatgataccgtggatgttgatattcgacctgaagatttgaagattgacgtttatcgagccagtggggccggtggacaacatgtcaacaagacttcttcagcggttcggattacccacgtgccaacgggaattgtcgttgccagtcaagcgcaacggtcacaattacagaaccgacaaacagcattgaacatgttacgagcgaagttgtacgaacgtgaagaagagaagaaggctaaggaacgggcggccatccaaggtgagcaaatggacattgggtggggctcacaaattcgctcctacgtttttcatccgtatacgatggtcaaggatcaccggactaattatgaatcacatgatgggcaggctgtcatggatggtgatcttgatccgtttatggatgcttacttacaatggaaattagcccagcgtaatccgcaatagattgcacaaatactaaggtgacctatcattgcgcaggtcgtcttagtattttttggctactagtcttataatatagagatattaaagcggtaatagcaggactgacggaattgaaacggcgttggtctccttgggcaaaaatgctatactaacttcagagtttaacgttaggggtcacgcacatgcaggtattaaagatttttgaattgtttcttttacaaccgctagtttggttaggattgctgcgtagttatttaaccgctaaacggcgggtgaagagtgaacggcagcattttcagagtgctatcaacccacaattagttgaagtccaccactttttagtggatggctgtttactaggagttctaatgacaattattagcttggcattgggattagtggtggcccccatctgggtggttatatacgaagtagtggcggccattagcttgatcattattcctggtgcactggtaccagtgaccgcttttggcctcagctggttagtttattggattatgagcccggaattaacgacggtggggggcgctttacaacggcacggtgttgccatgaccagtatgagtggcaatttggtggtgaacggactattgttattagccatcgtgctggcggctacggcggtcttgttacgacactatgattatgagggccgttcaccgcaactacagcccgaccaacgtggaaagcgacttgttcgttaccagtggcaacaattgttggtcttaccagttggggtactggtccccggtgattggttacacgcaactatcagttggtggcctgtgtttatggttggcgagcgctccttcagcattttattgttgcctttattagttgggacgagtgttcgcgtttataagcagctgccacaaattgcatggcggcagttagcggcccgctatggttgggtaacactcgcgagtgttttagttgcaatcattgcccgttttgcagtgctcagcccgcagtggttgctagcattgatgggattaatcgttgtgctaacttggggaatcttagcacagcaccgttatcatgatcgacaccaacagtttcgatattctgatactgaacaaggtgtgcgggtgattgggttacgcccccacacgcccgcggataaattaaatctcgatttaggagatattatcttggaatgtaaccggcaaccagttaatacggaagctgaattttacgcggccctactgaaaagtccgacgtatgttcacctcaaagtgcgcaatcggcaacaggaattaattattaccgaaacggcgatctataatggcgccccacacgagttaggaattgtgttattcactgatcaggaggattaatgaccatggataagattttagtggtagacgacgaaccagctatcgtcacgttattatcatataacttgaagcaggcggggtacgaagttgtgacggcgacggatggtgcggacgcgttgtcattaggcctggcccaatcatttacatgtattttgttagatttgatgttgccgaaactcgatggaatggaagtaacaaaaaagttacgacaagaaaaggttcagacgcctattattattgtgacggctaaaaatgatgagtttgataaagtgttcggcttggaattaggtgcggacgattatataaccaagccgttttcaccccgcgaagtgctcgctcggatcaaagcagttattcggcggacaacgccggacgagcccgtgacaccaccggcacccatgccgcctgctaatcgtgcggtaatgcttgttggtgatttacagattgatcaaaacaaataccgagtcgcgcgcaacgggaaaaatatcagcttgacaccaaaggaatttgaattacttgtgtattttgttgaacgagaaggtcgggttctcagtcgtgatgcgattttaaatcacgtctggggctacgactatgctagtgagacgcggatcgttgatattcacatctcacatttacgtgaaaagattgaagcagatcccaagcagccacggttgatcaggacggtccggggttttggctacgaatttgtgggtgacggccatgcataatcgctggcaacagacgacacggttattgctcatggaaaatgtgttactggttctgatcgtgttggtcgtgttgcagcacttttcgccaattaagtggtcctggcgcctagtcggttgtttagttggtgcttggctggttttggcagtaatcgagggcttgatcgcttggcggcaacaaagtgaacggcagcgcacgatcgaccgtatggaagctaagcttcgtcagatgagtagccagcaatttccaccacatatcttattgccacaatcggaccccttatacagcctagcacaagcggtcaaccagttagagagttatcaaaaaagtcagacgcgccgtgcggaactgcaagaaaaagagttaatgatgattatgcggtacttgcctgtgggagtgatggtcattgaccaccggcgacaggttcaactgtctaatccggcgatgagtgaactattgcaagtctcggttaatacggtggcccacatttataccaaggatattcagctgtacgcgttgactaaattgattgaagatacgattactagtggcaaaaatcaacgggcaacgattacgctgaccccagcgcctaacacgcaggttgtcgaggcttcaaccgtttatatccaaggcaatcgttcacaatttcaaattgtcctgatgttgtatgatatcactgaagtctatatgattgaacaaatgcaggatgattttgtcagcaacgctagccacgagttgaagacgccgattacagccatttccggtttcactgaaacgttgttaagtggtgccaaggatgatccggacacgcttgaccaattcttgcatattattgcggatgaaagtcaacggttgattgatctcattcaggatgttctgtcgctatcgcgaattcgtgctcagaatacgacgatgttaaccttagctccgcttgctgttcgaccattgatcgaacaggaactggctgtagttcagcaggcaatcgaacgtcagcacttaacgatcaataaccaagtcgatgctgatctaatgataacgagcgattcacagaagttgagtcagatcatcaaaaatctgttaacgaatgcaatcaagtataatcgacctcatggtagcgtgacgattgccaccatggtcagtcatcaaacgtggtcgctgatagttaaagatacgggcattggtatcagtgccgatgatcaacagcgtatttttgaacgcttctatcgggcgagtccgtcacgttcacagcaacttgtgagtgggactggactcggattagcgattgttcaagaattggtcaacgcaatgcacggaacaatcgacgttgtcagtcaacggggcgttgggacaactatgacagttacattgccactagctgcgagtgcttccgagcagtagtaaggcgttaagcatacggacagttctgattgtaactggtggtctatcaaatgatgacgtggtgacggtatgagttgtattgctgagtcaaaagatgtcattagttgagaattgaatgtgtcgtaattaagccagacgaattgataacgatttttaaggtaaatgtaaaccttgaaaatcgtttttttgtgcacttttttaattttcctttcataattgggggctaaaagccggtaataattaaaaatatatcgacgtttacacaatctttacaaaactcatataaagcatttacacaaactttgtattattgaatatgagcaatgggtaggaggtatatagttatgagaaaaagtcgggtcatccaattaatcgtgttaatcgcgatcattggactagttggattagggtacacacatcgtgatcgaactagtgccagtgaatcaattaccgcggttggatcaacggccttacagccactggttgaagcagccggtgaacaatacagcagcaaccataccggtgtgtttatcaatgtgcagggtggtggctctggaacgggactcagtcaaattcaggcgggggccgtggcaatcggtaattctgatatttttgccgaagaacagtctggcattacagcgagcaagttaattgatcaccgggtagccgtcgtcggtattgcccccatcgttaataaaaaggcgggcattaccaatttgacgcagcagcaactcattcagatttttactggcaaggtcacgaattggcgtgaagttggtggacgtaatttaccgattacgttaattaaccgtgctcaaggctccggaacccggaagacatttgagcgatacgccttaaagggtaatcagagtgttgattcccaagaacaagattcgtcaggattagctcggtcaattgttgctagtacacctggcgcaattagttatgtggctttttcttacttagacaactcagtccagaccgtcaatgttgatggtattcggccaaccgaaaaaaatgtgcggaataatcgctggtacatctggtcctacgaacatttatatacggggaagcaccccaatcagttaaccaaaaaatttattgattacattttatcaaccgctgttcagcagaagttagtcaagcagttaggttatatttcggtccatgacatgcaagtacagcggaatgcggccggtaaagtttcagttatgaaatgagggagagcgcatggataaaattcgagaaagcttattaaaaaaatcagttgctagtaaaattgaacggcgtggtaaggccattagtctagtttgtctagcgctaattgtcgggattgtctttttgattttctactttgttgcatcacgggggttagcaaccttttttcaaaatcacattaatctatggcaatttctgagtgggacgcagtggaaccccggaacagtcggaacgaatggacaaccagctgtgggggcactaccgatgattgttggatcgtttttgattacgattctttcggccttcattgccacaccgtttgctatcgggacggcggtctttatgaccgaaatttcaccacggcggggggcgaagattctccggccagttacggaactattagttggtattccatccgtagtgtatggatttatcgggctacaagttgtcgtaccgtttgttcgtaatacgtttgggggtagtggctacgggattctttctgggacctttgtgctatttgtcatgatcttaccgaccgtgacgtcaatgacggcggatgcgctgaattcggtaccccgttattaccgagaagcctcgctagctctaggggcgacgcgctggcaaacaatttataaagtcgtcctgcgggcagccattcctggcatgctgactgccgtcgtatttgggatggcccgcgcctttggggaagctctggcggtccaaatggtgattgggaacgcgacgttgttgccgcataacctagtttcaccagccgcaactttgacaagtatcttgacgatgggaatcgggaacactgtcatgggttcattacaaaataatgcattgtggtcattagccatgatcctgttattgatgtccttagtctttaacttagtcattcgctacattggtcgaaaggggaaattaaaccatgaacgctaaacgcatcgataaaattgccactggcgtgctatacggcgtcgcagcctttgtggtcatcatcttagttgccctattgggatacattctgatccaaggggtgcccaaaatttcgtggcattttttaacgtcgccggccctggcttttgaagcgggtggtgggattggcattcagttgtttaactccttctacttactatttttagcgttattgatttcattaccgatttcactgggtgcggggatctatctaaatgaatatgcgccgcaaaatacggtgactggcctgattcggacgaccattgaaattctgagttcattgccatccgtagtcgtggggctgttcggatacttgttctttgtagtgcagttcaagttaggcttctcgattctttccggggcgtttgcgctgaccgtgtttaacttaccgattttaacccggagtattgaggaagcactcgccaatatctcagataatcaacgggaggccggctacgcgttagggctatcacgttgggagacagtgacgaagatcgtagttcccgctgccttaccaagcattttaacgggggtcgtcttgagtgccgggcggatctttggtgaagccgcagctttaatctacactgcgggtcaaagtgcaccagccttggactttggtaactggaatccatttgatatcagtagtccactcagtccactacgtccagccgaaacgttggccgttcatatttggaagatcaactcagaaggaattatgccggacgcgaaagccgtttcggcgggagcttcagccgtattaattattgcggtattgctctttaacttcttagctcgttggcttggcaaacgcttgtacaaacacttaaccgctgaataaaggaggccgttttgatggcagataacacaatgacgacgacacaacgtaacatcatggcgtttgatcctaaagatcatgaaatcgcgctttcaactgaggatttacacgtcttttatggtaaatccgaggctatttcagagggcgatttacagtttgaacgttataagattagtgcgttgattggcccatccggttccggaaagtcaacctacttgcgttcgctaaaccgaatgaatgaccgtattgcaacggttaagggcaaaattatgtatcgcggcttagatattaacagtaatgatattgatgtctatgagatgcgccggcacattggcatggtgtttcaacggcctaatccgtttgccaaatcaatctatgagaatattgcttttgcactccgccagcgcggaatgaacaagaaacaagacttggatgaaattgttgaacggtctttacggcaagcagcgatgtgggaccaagttaaagatgacttaaataaaagtgcgttagctctgtctggcgggcagcaacaacgactctgtattgctcgggcaattgcaatcaagccagacattttactgctcgatgaaccagcgagtgctttggatccagtatcgacaagtcaaattgaagatactttgttagaactaaagcagaattataccattattattgtgacgcataatatgcaacaagcatctcgaattagcgactataccgcgttctttaacctcggcaaagtcctagaatactcagagaccggtgagatttttaccaatcctcaggttgatctgacgaatgactatatttccggaaactttggataggaggaccgttcatgagtacaattttaacgaccgagaacttatcattattttatggtaaaaaagaggccctcaaaggaattaacattgattttgatgataaaggaatcacggctttgattgggccctctggctgtggtaaatccacctttttacgttgcttgaaccggatgaacgatctgattcctaatgtaacgatcacgggtgaggtgaacttcaatggtcacaatatttatgcgcccacgaccgatacggttcaattgcgtaaagaaatcggcatggtgtttcaacagccgaatccctttccattctcaatttatgagaatgtcatttacgggttacggttggcaggagtccatgataaagaacgcttagacgcggcggtagaaaaaagtctgaagcaggctgcaatttgggatgaagttaaggaccggttgcatgccaatgcgctatcattgtctggtgggcaacaacaacgggtttgtatcgcacgcgtcctagccgtcgaacctgatattatccttttagacgaggccactagtgcacttgatccgatatcgagtcggatgattgaagaaaccctattgaatttgcgccaggattacactatcataactgttacgcataacatgcaacaggcgtcacgaatttctgaccgaacggcgtttttcctgaatggtgaattaattgaggtcaacgacacgaaacagattttcatgaatccagttaaacaggaaaccaatgactatatttcaggacgatttggttaggaggaaaaaaacatgcgacgactttttgatgatgaactaaacgatattgatgcaaacttcactgaaatgggaatgatggttagcgagacgattgaaaaggcagtcaaggcgtttatcgaccatgaccgcgacctcgcacaagaaatcattgataatgatgctaaaatcaaccaacgggaagttgaactagaacagaaatcatttgagatgattgcgttataccaacccgtcacttctgatttgcgagaaattgtcaccattttgaaagccgtctctgaattggaacggatggccgattatgcacgtaatattgctcacgctacgattcgggtcaaaggaaatgtgcgcgtccctgaaattgaagcagcgttatcagaaatggggaatcgcgtgcgaaagatggtcgaagagatgttggcagcttacgtcaaaagtgatgatcaggaagcacgccgggtcgcagctaaagacgcaaaagtcggggagatgtatgatcgtattaatgagaaggggatctccaagatggagcgccatcctgagacggtcatcggttccacggattacctgaatgttgcaacttacctaatgcgcatcggggcgttagtaactaatattggtgagtggatcgtgtatttgaatactggtgagattatcgaattgaatccagaaagttctaatttagtgtaactaatcataaataattgcttaaagccggtcgtctagtttgcaaccggcttttacaattagtaagatatggttagataaattgataaggagcgtctaacgatgaaatcaaatacaaaacaaaagttaactaaatctaataatcgcgttttcgccggcgtcctcgggggcattgctgaatatttgaactggaatgcaacgattctacgagtactctacgttattttaaccttggttacccatggctttggtgttttggtatacttagtattaatgacaattatcccaagtaaaccagacaatacgggtttcttcgaacagatgcggcaaagtaccggtattcaagctaaaccgcaagcgcatgggcgcaaagagattcataacgttcatgaagaggatgatccgcgtcactaagattaatggagtgattatacagtgggcttttggaaacgaattttaatcaatacaatcttatttattgcgattgctggcttttttcagagcagttttcacgttgcaagtgtgtggatggctttaattgccagttttgtgcttgcaattttaaacgccgctattaagccgtttttgctgttattatcgttaccgattacgttattgacactcgggctattcagtattgtcatcaatggttttatgcttcagatgacatcctacgttgtgggtaaggccaatttcggcttttcgagttttggcatggcgatggttgtttcgattctcatgtcaattgctaacgtgattgtttccaactttttcgcgaaagacggcgttgatggtgaataaagcgctttaaagtgctaagattagaagatagaaataatccgttttcagtcataaaagtgtggccgcttgaaagggtagcgtaatggcgcgactggacaacgcgggccacacttttttattagtggaacaattaggagggattcttttggcaggaagtgtaaccgttgccgatttggtgaaaaatacgcgcctggatgtgtatcatggcgctgacttattagaaaagaaagatattacaacgagcgacatttcacgtccggggctggcgttgaccggttacttcaactactatcctcgtgaacgagtgcaattgctaggtaaaactgaaaccgcttattcgaaaaatatgagtcatgatgaacgactgatgatttttcgtaagatgtgtcagttaaccacacccgcgttcgtcatttcaacggggttacccgttccagaagaactcgtgcaagccggtgaggaaaatggcgtgccgattttaggaacgaaaatgacatcatcacggattctaagtaatatgacgaattacttggaaggtaaattagctgaacgacaatctgtccacggggtattagttgacatctatggattaggtgtgctgattactggtgattccggtgttgggaagagtgaaacggccctggaattagtcaaacgggggcatcgtttgattgctgatgaccgggtcgatgtctatcaacaggatgaacaaacgcttgtcggtgaagcacccgcaatcttgaatcacttattggagattcgaggtatcggaattattgatgttatgaatctttttggcgctggggctgttcgtcaagataccgacattgaccttatcgtgcaccttgagaattggacgcctgataagcaatttgatagactaggaaatggagaacagaaccggaaattctttgatgttgaagttcctgaaatctcgattccagttaagactggacgtaacctagcaatcattatcgaagcagcggccatgaactttcgggccgagagcatgggctacgatgcgaccaaggtctttgacgataacttgaacaagttgatcaaaacgaattccgtgcatgattctcacaagtaataaggagatggcagtagcgtgaataccgttttaggggcacttaacccaattgcactgcggttaggaccaattcaggtccattggtacggcgtcattattgctagtgccgtcgtcattgcggttgcactagcagtacgtgaaggtcagcgacggggtgttcggcccgatgacatttacgatatgattttatgggcacttccgtttactttaattgcggcgcggacttactatgtgattttccagtggtcatattatcgtcagaatcccggtgaaatcatccgtatctgggatggtggaattgccatctatggtggcttgattggcgccggaattgtggtcattttattctgtcggtcacgctttatcccaacttggctaatgcttgatattgccgcaccaacggtgatcatgggccaaggtattggtcgctggggtaactttatgaatcaggaggcttttggtcgagtgactagtctgagtttcttacaaggcttgcacttacctgattggctgattaaccagatgtatatccgtggcgcgtatcggcaaccaacattcttgtatgagtcggtatgggatctattaggatttgccttactgatgctcacgcgtcatcgcacacattggtataagcagggtgatgtcttcttgacttatgttgcttggtacgcctttggtcgcttcttcacagaagggatgcggactgactcgctcatgttatttaacgttattcgggtctcacaagcgttgtcagtggtactgttctttggtagcattggcttaatgatctggcgccggcgtcacaatccgaataatcgttggtatttagctggttctggtcaaaaggttgtcgcagaaaataagtagattagagggttatttgaatgatgaaaaaaattgccgttttaggtgctggctcatggggtagcattttggcaaatctgttggatgaaaatggccactcagtgcggctctggtcgtactcaccggcccaagtcacagaattaaatgagcaacacacgaatgagcgatacgttcctgattttaaatattcagaaacgttgactgcttattctaatctaacacaggcgattgatggtgcggatgtaatcttgtttgtcgtaccaaccaaagcgattcgcgaagtggcccaacaagtgactgccgtgcttgccaagacccatcagcggccgattattgtgcatgctagcaagggactcgaacaagagacacacaagcggctgtcgcaagttttggcagaagaaattcccgccgaattacgacaagcgatcgttgtcttatcgggccctagtcatgctgaagaagtggcccgccacgatattacgttgattacggcggctagcgccgatgaatctgcagccgaattagtacagcaactcttcatgaatgactatttccgcatttacacgaataccgacgtggttggtgttgaactaggtgcggcgctcaaaaatatcattgccctgggtgctggtgcgctacacggcctgggctatggtgatgacgccaaggcagccttaatgactcgtggtttagctgaaatcagtcggctcggagtggcgttgggcgcagagccgttgacatttatcggtttatccggtgttggcgatttaattgttacggcaactagtgtccattcgcgtaactggcgcgctggtaatgagttaggtgctggtcaggacctcaagacggtgattgataccatgggcatggttattgaaggtatcccgtcaactaaagccgcttacgagcttgcacagcaacaaaatatcgaaatgcccatcactgaagcgatttatgatgtattatataagagtgccgacattaaggaagtcattccacaattgatgcggcgcgaggggaaacctgagattcagtaggaatttccaaactaatttcactatttttaggaggatttatcacatgtcaaaagttagaaaagccgttatcccagcggccggattaggaacacggtttttgcctgctactaaggcgatgcctaaagaaatgttaccaatcgttgataaaccaacgattcagttcattgttgacgaagctcgtaaatcggggatcgaagacattgttatcgtcacgggtaagagcaagcgtagtattgaagattactatgattctaacccagaattagaggataacttacgggctaagcacaaggaagaaatgctcaagctggttcaagaaaccacagacattaacttgtactttatccggcaatcacatccacgtggtttgggcgatgccgttttaacggctaaagctttcgttggtgacgaacctttcgtcgtcatgcttggtgatgatttaatggaagacaaagtaccgttaaccaaacagttaatgaatagctatgacaagacacatgcgtcaacgttagctgttatgaaggttcctcatgaggaagtttctaagtatggggtcatcaatcctgaaagtgaaaaggaaccgggcctatacaacgttaataactttgttgaaaagccatcacctgaagatgcgcctagtgatcttgctatcattggtcgttacttattaacaccagaaatttttgatgttcttgaaaaccaaaaacctggtaagggtgacgaaattcaattgacggatgccattgatacgttgaacaagactcagcgggtctttgcccatgaatttaaggggactcggcacgatgttggctacaagtttggctacttgaagacgacgatcgaatacgggttaactcatccggatgttaaggctgacttgcggacttacatcaaggatcttggtgctaagttatctaaagaagatagcgccgctcctaaaacaacgaagaaaccaactaaataatacttgattaattaaaacaagaggctgtgacataagtctctagaaacaaagcaggtctggaaaaatcttcggatttttccagacctgcttttgatataatagaaaataaaaaaagagcatcggtcgcacccgatactctacgaaaaaattatcctcgaaaggaattcctaattgcaagattatgtcataacagatcaaaccactttgagtattgcccttgacttaccaaccagagagatcatcattctgcccgacgttatcaaataaccagcttgttgagagtttaaactaaaagaattaaccatttggccgtcacgcgcgtggagagtataaaccatcggatgcagctgttaaaactggccagtttagcgttaaacgacttatgcaatttgtcagacagtcgtagaatctgacggtagcccggaaaacaagccagtctgggatgagttagattggccgaccaaattccgtctacaggacggatttgtcgcgtaatgaatttctgatgactggccttgacaaccgatcagctatagtcacagcgtaacgccaaaatatctttcggcaaaatgcatgatgtgatgactgttttcatgtattgatggaaactaatatctagcgagccaacagagtatagcttgtttggaaagaagaactacgatcgatttgacaagatgaatcgcctaggaaaactcgttgtacctttagcgagcttcaatgaaaagcataattgtcggtgaaagttcctgggcaggatagagatgactcgccgaacatgaatatatgattagcaagttgtaggatcactagtagcgtcttaaaagtgtaaggccgatggatagcaactaagcaggttccatccccccgaaccacaccagctcaacacagcaatcgccggactcgttgtaaattaacacaaaaactaagttgagataaagacgcatatataaaagcgtcggtaaacaccaaagcacagcaagcaatctatgcagcgcaaatacaacagcaatacctcaactacacaaacggatcaacgaaatgccacctttagcgggttcaaggaagatccgattgcaaaacggtcattaaaaaccaataaacctgcctaccacgttcaaacaaatcgccacgattaatcattcatacgggatatcggctacttttaggcaaatccacctacacacaaccttaccaccgtttttattgagattgaaccatttaaacatcccaacaatgatgtattaggcatctacacccatcgttaccgaggccggatacggttccgaaagtaatatatcggtacttgcgaagaatgaaacttcggtcacctacccgtttgattcccctaacggcacaatgctaacgaaatagtccgaaatggcaagtgatgaccgctaggtatatgaactgagactaatcatgaaaagatgattatttataatcaaatccgcaaaacgagtccgttaattttactaatgctatcatcgtctgacggactgaataagtatgagattttcccgttgactttaagaatacatctgcccgaaaagtatgatgaaaaatctcaactaatttccaagcggcaggctaacacaaaaggatatcttaaagatttccagtgaactcgaaaatttgggaatagttcaaatccgacaaacaacgaagaaattaactttcagctaccataaaactggtcagatttacgctcaacgtaagatcgatttgagccagttttttttggcaaaagcatgaaggcttacttcacattcaatcgattctcggggactaagtgtattccgacaaaggtcacaaaggaagaccgaatcgtaatactaacttactggcgcttaaacattcatgacactggtccggttaggaccactttaaaaatcaaaggcgtaagacaatggggacgagacaccacaaattcggttcctcgtcccattgcttatacagaggcaagttatgtcaacagacctcttgtgtttatagttaactgctgaataattgcgatcactaattaagcgggccctgtgttcggcttttaatttttgcaataaatggggcttgcccataataataccttggcgtagtgaaattttaaggcagtcgccaatttgtcttcggcaatcgtttatcaacaaccctctagaattaaccggattctgtctgtaaaccgcaataggtccagcccaagaattttaattgaaggggaatcctcggtgtcacgatcttaactgcccaaaagttttgaacaatggcgaatttgatgatttctcctctttcggccgattcagagtaacgtttaaatgtggtcgtaacgtctgttcccgtgccaaccgtcatcaatgctattggtaagccagttaagccccttgtactttacatcatttgttgtttcatcgccgccagttgggggggggggtaaacgtatcttcaccggttcttccgtgatctcgaacgataacatgaaaaccggagatacttttttcatgagcatcaatgactagcgagcagcaatatcatcatttagaaatatgctctgcggattaaagttaattgatactgacacgacccgattttataatgcaactcctaccgtgcctttagtaagctgacttgtacatcgatcgaatattatcgaagctttctggtaaggtccacaccgggtcctgatcattcccacgatagcgatcagcatctcgtagccaatcatgaattattaaatttatctcaactggggctgaactaaaatagcggtacagaagggaactcctagactgaatacgacacgatttgatcttcctatacatactataccaaaaaattaataagtgaaactgtttgacaccatcttttttttgcatgtatcgattagcaattgggctaatgaaatgattggtgctaaactgctggtgaacaatgtaattttctgaaaattataacagtccaattagtggtttaccatgcaaagctggtatggacgatattgtgagaataactgcttgccagcgtctctctgatgtggtttttaaaagtagtttatggtttcatcatgaccggtatttatattaactagagttctgtatttgcgcagtacagcggtaaaaaaatagaatacctatggtataaataaaaattaataattgggagcaaaataaatgagattgttaaacttcgtttgctgtacgcattcggggacctctgcggctgcaacaaattctgaaggatcatccatgaggctacggtcacgattttatgagcgtgatacaatatttcttccttaatcaatgtgtgattctataccgttaatcttcgggggaaaggtcaatcacttggaggatatgtttctattcgtcaccaaaacgtatagccaagttggcggggcaatggttagaacaaacagaacgtgtttaacaattgacgcccagtccgaaagtgaagagccttacaagtggttcgacatgaactccgtaaccagtgttttagggcgatacttaagacttgcgttttaaaatctactatatttggtaatgatagttcacaaaaaaaggtgattattcccatgaactacccaagcaatatttccgccaccaattggaactcatccgtccctacttagaatgacggcacggcgtcaacgaggccctcgaaatatgatctttatgagttgttctgttcattgttctaatgtttttagaacactggggctgtccaatggcggcgagttaccccgatgattttttcctcctcgctggcaaattggtctattactattatcgcgttattggtcctgacgaacgattattgatgaactatcaatcttagatcatgtttaaaacaattgtcatttaccctacggaaaaacagtcacgctacggctagaacatatttcatcataaaattgacgagcacaaagcgttaaatacccgatatactaactgctgagaatcgcggctacgacgagatggtaacgcatatcgcaggcatcaaacgcaaaacaccgcgccacatagcggttgatattaacggcttaccacaagcattcacatcaccacggccaaatgtttccgaccgtacggagccagtgcccatgttagctctaaattctgtggcctttaaacaagcaatttaaatcacttctgctcgatggtggctacactcgatcgaatttttttgccgctgaatctttttacccactaatttaaacaacgccaaccgtcccatggtggcctaaacgcaatgagctcataaagtcgattactggaagtcccaaactctggatcgttgaactatattccttcagttggttggataaatgtcgacgactttggaagaactgtgagcgtaaactcaattcaagtcgtcaaatggttatcttagcgtttctggtattactcctaagaagattttaaacaggttcttatgataaattgattatgacgactggttcaaatgttgcggtcccgccgatttttggaatcgatgagtctaaggtcctattatgcaagacctacagccaagcacaggaaatttaccaaacagcccaagacaatcagcggatcgcaatcattggggcgggttatattggaaccgaattatctgaaagttatgcgaatacacatcatgaagtaacgttattccaatcgcatgatcaaattttgaataattacattagtaaagaaatttcagaccaagcagttcagctattaaaagatcatggcgtgaacgtgctattgaatcaccaagtaactgcctttactggtaatgatgatggtgaacttgtcattgaaaccaatcaaggcgattttaatgctgatttagcaattgtcggaactgggtttgttcccaatacggaactgttacgcggtcaagttgagatggataagcacggtgccattatcatcaatgattacgttcagacctctgacccagatatttacgctgctggtgattcttgtgtcgttaacttcaatccaactggacgttcggcttatacgccattagcaaccaatgcggttcggcagggtgcgttagcgggggccaatgtttttggtaaccagcaacgatatatggggactcaagcgacatcggccatgcaactcttcgatcacacgctggcaaccacggggttaacactggcaatggcgaaattgaatcatattccagctgaacgggtgacttatgagggcaactggcgaccagcttacatgccaagtacggcgaaactgatgattgaattaatttataatccggaaaatcgtaaaattctcggtgctcagttcttaagtgcgcatgaagtggcacagtctgctaatgcgttatcaatcgcgattcaaaatggaaacaccatcgatgatctagcatttgtggatatgttattctcacctaattttgatgaacccttcaattatctgaacctcgtcgcccaacaagcgattgaacaagaacgccaggcaggccgcaatcacccacgaattacggcctatggcgattgggccaagcaaaatgacaaggatttacaatagacgtccaggacgtctgcgttaccttgggtggctggtcgtgttagtgatgctgactgcagttgtcagtgggtgtcggaaacaaactacggttagtacaccacgacatgcgccaagtggatttgtaacgacgacggcctatgcgactaaggtgtcaaagcaacggcgggtaaaactagctgcatttattaaacgaggacttttgacgaagcaagggctttatacgaattatttagatacgcgtaaacggacgactgcaacggccactggtcatgaaatgttgagtgagtcatcggggatgtggctacagtacctggttacgactcgccaatgggcacaatttcggcaattctatcgccagacgaaagcgacctttaatgaaaacgggttgttcagttatcgttatgatccacgtaccaagaagcggtatgcggtcaacgctacgttggacgatttacggataatccgtgcgctacttacttatgatcaagcacatcatactaatcattatcgccagaaagccacgcaacgttatcagaatctggtcaatacaacaatcaaggatgggcacctggtcgattattacgatgttcatgcgcgtaaggcaactacgacgggcagtttagcttactttgatttacgaacacttaagtattttgaacaagatactaagaagggccggagtgcgtataagaagcaattgattgtccttaagggcggttatttaggtgatgtttttcccttgtatgcaaaaagttaccaatggaccactagccaatatagtgatggtaacctgaatacatcagaggctttggaaaccttattgcatttagcagaagttggtcacctaaaagcgactagtcggcgatggctgattcaacgggtcacccaccgtgatttagcaaacggttatacgacaaggggcacggtgagtgttggtggtgaatcagcggccaactatgcgttagcggcgtcgatctttgcgacgctgggtgatgaaaagcattatcaagttgcgatgaataatgtttggcgattgcaggtacagcaagacagttcgccgattaacggtggtattggggatgtcaaaaccaagcaagtgtattcatatagtaatttgacggcgctaaacgcagcgtttaattagagattgaggtaatctttgtgactaagttaaaacaacaattttggcgcgcaacgcggctgtttcaacagctaatgccacccccactactcgcaactttactttgtgctggtttggctgcttatgtggcatttgtaccgcccattaacggactggctgataatggcgatttttatcgggcgatgtataccaatggtatttataagttgctgggaacgcactacaactattttgattttgtaacgcagaaatttggcttgatgaagtactacaacgactatcgatcggtgaacttttcatctcagcccttatttgtgaaagtggctatcggtctcaataaattattttatagtaagacggtatttgatatccggtttatgggtattgtgaatgtgattccttatctgggtggcatttatttattgacggatgctttgacgtatcctgccaagcgttttcgaaattatctgattgcgggattagtcgttctagtatttggtgattcttcatttacattgtatttaaattctttttttgctgagccccaaatgttaggactaactttaatctcattttcagccgtcttactgctagcgcgacaacgatatcggcggcggtggccactcgttgcattgtattttgtttgtacagttctattgataactaacaagtcacaaaacgccccgctagcattgagctttgtggtcgtgacgattgggttactatttttgccacactttaacgcaatgcgtgtgtacttgcttgcgggaatggtcatgatcttgatcacgggtggactgacctataaattgatcggtcaagactttgtggatatcaatacctatcagactttttcgcacggcatcttgacccaaaccgatgatcctagtaaggatcttgctcagaatgggattgatgagcagtatgccttaatgcagtcacaagactactacgctaaacagtttgcgacgattcaagcttctggttcttatgttaagaaaaacttggtttctaagctgggagttggttgggtattaaagtattatgcgactcatctgaagcagtttggcaaattgatggatcttgccgccgccgatgtcatgattactcaagttaaagcggttggggattacacccaagcgtcaggagcacccgcaggaaaacaactaacattctttacaacgtatagtcagattgccggggctttttttccacaaaagtttgcctttaattgtcttctagtagttgcgttagtgatggtttatctggttggtttttataatgatttgcgtcagcagcgaatcgaaggcgtcttgcggtttttcttagtattaggttttttgtcgatttttatttttgtgccaattatttcaatcattggtgatggtgatgcagacttagcaaaacatttatttatggttccggttagcattgatctaattgtcttgctgtttatttcggataccttaaatcaccgtttgtggcatgcctatcgagaggaggaccaagatgcataagcggttatggcagttggtaatcatgggtgtcattatactttgtagctggttattgccgacagagatccacgctcaaacatcagcaacacacgttatgctggtttatgattcgcggaatgtggccaataatgatcaaaccaaaatcgcgatgattcaacgaatcctgaccggtctacacattagcatcaaaacggtggcggccgaagattatcatgctggcgaactacgacactatcaaggcgttattacgctaattaactggccgcagactaagctcaacaatgcagcgtttcaaggatcgtaagcagttcagcggtacgaagctgcatattggcacaaatctgaccgctattgaggcccaacaattgaatgcccaaccggtcaaagtttaccaacaacagttctttcttcagagcaatgatcaacaagttcgccaattattaccatttatgagcagtatgacggcactcacaaagttacccgctaaggccaaaacaatcggctatttgagggcacaatcatcgctaaaacatgaatatccttatggaaccatcgttggtcgatacggttatctaccttatctttcaactggaggttatagtttagtgttagctactcagacaatggcaacattattcggtacccgtagtcattatcaaccattgttaacgattactaaggtaacgccgtattctaatcttaatttgttgaataaactcagtgcgaccttatatcaacaagggattccatttgcggttagcacaacaacggttggcactaatggcaaattcaaagcgtatcaacgctttgccaaagttttacggttaatcgaaaaccgtggtggggttattttcttaaaaacacctgtcgttggtggtgttacggcaagtagcggtcctggactgagcaagttgatggacagttacgtcattcagttagcacagaatcaggtttatccagttggaattagtgcttccgcttattggaaccaggacagggtctaccgccagaacgctttaactaaggcgaatcaggttctcttattacccgatcctaaggtgacgacttatgcccatcaagataatcaaggaacggtatttgatcaggccttttatggggttagtgctaaatcctttgaaacgctgaaatctggtgatcagctcagtaagttagcgctgaattttgccattcccaccgcacttacaatgactatgccagatagtgaaacgagtttacacaatttgactagacaactcagccgaatgaactatcagtggtttgaccctgcacaacaaatgacaacgacgatgctcaagagtggaacagcgacgatcagttatcggcgtggaacgtatttgttaaacggtgcgcccatacaagtgactgataatgcgccagcgacgacaaccttggctgcagtaaaaccagcagaaagttggatgaatcggttctttaaaactcaggggagtgtgttattgattttcttttcggtgacattgggaatttttgttttgtttattgtgattggtcggcgggtttatttgaatatgtttaaacctaagtaggggacggcatcgttgctatcataacgggaggaattaatattagtattttagattattttctattcttggctgtattgtcgatttggggcattctagtcgtgaacgttgtcttaacgattgcgggctatgtgaattatttacaaaaggtgcgacgtcctgaacctcagttaccggtaaaggtaccctttgtctcaattatggtgcccgcgcataacgagggcattgtaatcgtcaaaacgttacagtcgttattgaattttgattatcccaaggatcgttatgaaattattattattaatgataattcggatgataattctgctgaattactggcggaagtgcagtcattgtatccacatcgaaacttgaaagtgatcaatactgataagactaatggtggtaagggaaagtcgaatgcgcttaatattggccttaaacaggcacgtggttcgttgatttcgatttatgatgcggataatacacctcaaagaacggcattacggtatttggtggctgagttaatgagtgatcaacggctagcggcagtgattggtaaatttcgtacgcggaacaagaatgcatcaatactgacgcgctttatcaatattgagacgctatcatttcagtggatggctcaggcgggccgggaaaagttgtttaaattatgcacgatcccggggaccaattatgttattcggcgagatattcttgagaaaattggtggttgggatgttaaagcactggcggaagatacggaaatcagttttcgcgtttatcgaatgggatatcggattcgctttcaacccctagccgttacctgggaacaagaaccccaaactttagatgtgtggtttcatcaacggacacggtgggtcaaaggcaatatttatgtcattttaaaaaacgcacggctacttttcactaaaacggggcggccaattcgatttgacttgttgtactttctatcgatttactttttattaatgacgtcgctgattttgtcagatagtatgttcgtcctttcagtagctggaatcgcacactccgacttggtagggttcagcaatatactatggctaatggccatcatcacatttgtaatcagtacgttcgtgacaattacaacggaaaaaggggaaatgacgattgccaatttaatgattattgtttttatgtacttagtctatagtcagatgtggctggcagtggctgcacatggaatggtggggtatgttcgtgaacaagtttttcatcaacaagcaaagtggtataaaaccaaacggtatcagtaagtggttcttctggttaataggcatgctcgctttattaattgggatgagtagtaatctaagctgtcctatcagtgggcaggcagcgaataatctacaaacttatacgcaaccttttcaaaactcaacaacgacactgtctggtgatgcagttgaggccaatatgtattttattaaaatggattattggcaagtcaaaaaagtgacgattaatctaaatttccaaatttcgcagttggccaatcgggagacatctgacattacgttgtcgttgaacggaacgaagttttactcattccggcccaaaaaggagactggactccaaactagggctatcgaagtcccactgcggttaattcaaggtgaaaatcagttaaagatcagtgggcagatcctgaataaaaaaggccagcaaagttctcaattggtgcagacacctgccaactggttgacgatttacaatggggcgaatgctaactttgagtatcgcttgcaacccccaacaacggctattaaatctttttatgcgcatttttctgggactgataccatcgcgaatgctaattcagtcataacgctgccacatcaagcatcaaacgcagagttgtcagctggcatgtatgcgttaacgggtgaggcgcggaccattaccacagagaatacacagattccggtaacaacggcagataccgcggtggctaaacaggctgattatcagttggtcattgcgacttatcagcatttgcctaaagtgtttcagcagcaacttgatcgtcagcgactgcgagaacatgcagttatcaagacatatacgcatgatggtaaacattatttaattgtgagtgccttcaataccaaattattgcagaaggcaagccggtttattgctaatcaggaattaatgcaggaaacagtagcagatacgaaatacatcagtaacagcacacagacgtttacctctgagctacaatacggtggcaaaaagcaattgacgaccagcgatgattatttgactggcgctaaacatcagtcaagtacttattttgttagtctccctgttgatcggaccaatgctgatggttcgaaaatccggattcattttcgctatgctaagaacctggattttaaacgatcgcttgtaacggtttatgtaaatgattccgctttaggtagtaaaagactcacagcagcgcgtgccaataatgatgagttgaccgttagtctgccgaaaggaaaagcgctagggcatagtttcacgattcgtgtcgcctttgatcttgagatgagtggggcggctcaaagtgataatgcccaaacaccgtgggcgctgattaaggctgattctgaagcgacgattaagtcaaagccagtcgcagctttattatttacgaattatccatatttgtttttgaagaatgcgacctttaaccacattgcagttgttcgaccacgaacgctgactagtgacgattttcaaacgctaactaatatatttaatcttattggaacttatgcgcaaagtaatactggcaatattcagttttatacccatcagcctagtaaaacggtactcaaaaatagcaacgtaattgcgtttgggacgccagctcaaaacgcgtttattcggtctctgaattctaagctgtattttaaatataatcgacattttactgggttcctgtcaaatgagaaacttagtattgagaaaacgtatggtcaaaatattggcactgcccagctgttacgctcaccgtataatcagcgagcgggattgctagttgtaaccgccgcgaagagtagtgatgtctaccgggcgtctactcaaatcaattttcaacggaacattgcccagtatcaaggtgatgcgattgtcgtcgatcacgataataatcattataattatcgttttaagaagcataagacagttaatgatggcgtgaacgccaaaacagttattcagaagaattctaagctagtgatttatttaggtattgcgttgctaatcgtggtgatcattttactggcaggattcctgattatgcgtaaaagtggtttgttagagcgaaaggggcagcaccatgaatgatgatcaacgaacatctatttttgctgacgtttatttgttattatttttagcgcttattagcacgatggccgtactgatggcgttaacccctaatatcacacttaatacgatctatttaggtgtaacgatcattatgattttgatgacttattttttcggtgtggtcactggtctaatggctaacttactatttatctttgctcaggcaatcgtcatgatttatattaattcaacgcatcacgccgtaattccaatgatgatgattttttggttgattatgccgttgcttttgtcagctactttttatggcatgacccggcaattaatacaattgcaagcggccaatgccaagctacgagcagatattatgaaacgaggggcctttgacgaacaaaccaatttgcgaacaactgtcgcatatattcaagatgcacaagtgtttatcgaaacgaatcgacggtttcaattaccggttaccacggttattattcgggtgcgatactataatgaaattcgacggatgatgagtgaacaacaataccgtgatttattgcggttggtctcggatacgattacatcggcaacgcgagataacgatattacctattcccttgatcagaataatccaacgtgggccatcttgttattttcagaccaaccaggcgctcaaattgcagcgaaccgcattaaatctaattttgaaaaaaatttacaacgctcaaccagcctaaattcattagaaatcttattggtggttggtatcgcgagttgggatgcggaaaagatgaagagcccgtatgattttatgaatactggcattaaagaaactgagtatgatgtggcgcgttgatttcggttgtgtacaaacaagatagtcgacaaatgtaaattttgggggtatattaagcgtcataggaatttaagtggaaggggtctttagaaatggcaaagagttacgacgtgattattattggtgcggggcctgccggcatgacagccgccctctatgcttcacgagccaatctatcagtgctactattagatcgcggaatctatggtggacaaatgaataataccgccgcaattgaaaattatccgggcttcaaatctgttttggggccggatttggctaaagacatgtatgaatcagcgacccagtttggtgctgaatacgcgtatggtagcgtcgaatccgttgaagatcgtggcgatgttaaaattgtgacgacggatagcgatacgtttgagactaaggcccttgtcattgggactggttctgaatatcgtaagctgggtgttactggcgaggatacgtatggtggccgcggtgtctcatactgcgcagtttgtgatggagcgtttttccgtaacaagcatgtagttgtcgttggtggcggtgactcagcgattgaggaaggcacttacctgacacagcttgctgataaggtgacggttattcatcgtcgtgaccaattgcgggcacaacaaatcttacaagatcgggcttttgctaatccaaagatggaatttgtttggaatagcaacgtgacggaaatcatcggtgatgataagaaggtcacgggagttaaggttaataataataagactggtgaagacagtgagattgcggtcgatggtgtctttatctatgttggtattaacccaattacgaagccattcagtaatcttgggattactgacgaaaacggctggatcgaaactaatgaccacatggaaaccaaggtccctggtatttttgcagtcggtgatgttcgtaagaaagatttacgccaagttgcgacggcggttggtgaaggcggaactgccggtcaaggcgtttacacttatatcactgctttaggcgacaaagttaacaattaaataaaattaaaaaatgcgtagctgatttaattgagatcagccacgcattttttattggtaaatatagcgttagtcattgtttgacgatgaccaaaggttcgcgaattagtgttgatagggaaatagaagcaattgcttgttagtatacgttgccaggtaaatatcactgacagtatagtgctgggcctgcaattgggtcagtaaccaggcttcatcatgattactagtttcaagcgcatcgaggttgacctgaccatcgacgattattggatacttgacggcgtcgtcgcccacttgggtaatcgtcagttggccgttttgttcaagtacggcccgtttgacgtagcgaatatccgtgataccttccgtacgcaagcgaaacatcagatcgttagcactcatcccatttttgagggccgtgctgacgagtaattgcccatttttaatcaatagctgtggctgtccatcaatcaaacgtttcacgtagcgattgtgatgtgttaggaatcgcaggaccagcactagcagtgtccagatgagaagcactaaaatgtattgtaaaacagtaacgctggtactataaatcatgcccccaacgattgcaccgagaacgtagttttgaacttggtcgagggcgctgattggcgcaaggttacttttaccagatagattgatttgtagaatgatggtcaatagcccgagggccagtttgatcgtcacatcccagtatgaaaacatttattgcccctccttaacataattgattgttgattgaatcggtgtggctttagtcagggtataactgtttccatccgtattgatcgtcacgttatagatatggtcatggactttaatgagcatcccactgctgacagaacttgtattagaccagaccgcggttttacgaacccctttttctttggcgacacgctgcataatttgtgtcacttgtgatttttggttgaaactatttttgattgtctgccattcattaaattgaatgccgacgagcagcaataataataaaaccatgataatgaataagtcgcggtattttaggtctgttttatggcggtaccataaccagctgagtatggcgattattaatataatgatgccgatggctgcgagttggacaagagtatgattgttattttgatggactaagtagttgtatgaataaaaagtcatgatggcctccttataagatttattatagcaagttttgatagtgactgaactaactagcacttcagaatttatgggtattcgcactgatgcgggcccactacgcatttaaaatgcattaattaatggattttcttagtaaattttactttgtaaagtgtgtcaatgttgtatactatttttgtaagcactaacaaatatcggaattggagatggtttttgtgagttggcaggatacttataatacctggaaaaaccaagcgacacttgaaactagtttaaaacaagaattgacgggcatggctggcgatgacgccgccttagaagacgccttttatgaaccaatggaattcggaaccgcggggatgcggggggtacttggacctggtatcaaccggatgaatatttatacggttcgtcaagcaacggaagggttagcacgcttcatggataccttgcctgctgaggttaaggaacgcggggtagcaatcagttttgattcccgccatcattcagaagattttgcgcatgaatctgcgcgagtattgggccaacatggtatcaagtcatacgtttttgaaagcttgcggccaaccccagaactttcatttaccgttcggcatctgcatacttacgcagggatcatgattacggcgagccataatccgaagcaatataatggctacaagatttatggcgaagatggtggtcaaatgccacctaaggaatctgatcttatcacatcatatattcgtaaagttgacgatgtctttgcgattgccgtcgctgatgaacaacaattattagctgataagacggaaaccattattggggatgatgtcgatcaggactacttagctaaggtcaaagaagtgacgatcaatcaaaaactagtggatgaagtcggtaaggacatgaagttagtcttcacaccattacatgggactggccggatgcttggcgaaaaggctttgaagaatgccgggtttaaaaacttcagtgttgttaaggaacaagctgtggctgaccctgaattctcgacggttaaattccctaatcctgaatttcctgaagcctttaagatggccattgatttgggtaaaaaagaaggtgcggatgtcttgattgcggttgatcctgatgctgaccggttagggacagctgttcgtcaacctaatggtgagtatgttctgttgacgggtaatcaaattgccgctgtcttgttacactacatcttgcaagcaaacaaggatgccgggacgttaccgaccaatgcggccgcagttaagtcaattgtttcaagtgaatttgctactaaagtagcggcttcatatggtgtcacgatgatcaatgtcttgaccggtttcaagtatattgctgaacaaatcgaacattttgaagccactggcgaacatacctatatgtttggttttgaagaaagttacggttacttaatcaaaccatttgttcatgacaaggatgcgattcaaaccacagtgcttttagccgaagtagcggcttattataagcaacaaggtaagaacctttatgatggattacaagacttgtttaaggaatacggttacttccgcgaacaaaccacgtccgaagaatttgatggcgttggcggcagcgataagattgcggctctgatgactaagttccgaagcgaagcaccaactgcctttgccggctacgatgtcactgggactgaagacttccagagtcaaacggaaagctttgctgatggccacacggcaccaattgctttgccaaaggcgaatgtcttgaagtatcatttaaatgatggcacttggatcgccattcggccatctggtacggaaccaaagatcaagttctacattggaacgctaggtagtacgttagaagaagctaatgataagttagcgaaatttgaagatgccattcaagcgtttattaaagaataaattggttatttagtcagaagttgtacggcccagctgactagccatgctaagtgataaataacgccttacgaaattttaagttaatttcgtaaggcgttatttagttgttgttcatattagaaattaattcattgtcggatattcaaagttgacggggtcaccgggtaggcgtaataattgcggtttgccatagtaatagccttgtcgaagattaatatcgaagtgactactcaagcgatcatcttcggcgtcttcaatcccctctaagattaaacgcaatccgtattcactactgatggcccgccaaaaatggagcttttgctgaatcttaggatctttgatatcactgcggaagttttgcaacgcaaattttaattcagaagctaatggcaaaatttcttggatactcttgaaatcgttaattccggtaccaacatcatcaagtgaaatttgcataccatgttcgatgaacccccgtaagtgtgggattaacatggtatctggataatccttaggactacgttcctcagttagctcaacgactaatttagcaggatagagctgaacctgactttgaataatggccttcgcaaccgttgtatccatcaattgttcgcgactgatgttgactgcacaataacgaacttttagtccaagaattttagttgttgcaatgagcagatcagaggtaacttgtgaactaattgcggcaaaggattcaggcagacgccagccgtctggggttagttgtttgattagtagttcgtatccgtaaactgtattgttgagtaagttaagttgaggttgtacaaaatagcggtaaattggttccataagtaccatcgccttttataataagtttaaaatcattgaatcgttttaatatcaaccgaatcgctgtatactctaagtatacgtcaacttaaataaatgtttaacttaatccaagttaaattttaacttttaatgaaagctgtggtcgaaacaatgaaagttgccattattggctgtacacatgcggggattgccgccatgaaacaaatcttgaaatattatccgggcactgaaattaccgtctatgaacggcacgcggatatttcatatatgtcttgtgggacttatctacacttagggggtaccatccataatttggatcaagcgttgtacgctaatcctagtgaatttagtgaacaaggtgtgcagatgcggatgcagtatgatgtgatcaatgtgaatgctgataagcatacaattttggctcaaaatttacagacaaaagaattacaaacggatcactatgataagttagtcatggcgacgggttcaatcactgcaatcccggctattccgggcgtagagaatcctaaggtcatgctttgcaaaacatgtgaacaggcccagcaactctacgaagcagctaaacatgcacaccatattgcaatcgttggtggtggctattcgggggtggaacttgctgaggggtacgtgaagtctggacacactgtgacgttgtttcaacggggcccccacttaattaatgagtatcttgatccacaaatttctgagaagatcgaagacttgttaacgacgaaaggcatccaagttagaaccaatgcacaagtgacggcttttagtgatacggctgataatcgactacgagttgcaaccgctgatagtgaagaaatatttgatatggctgttatttgtccgggggtgattccacaatcagagttattggcgggacaggtcaaccgaacgaagcagggggccattgtaacggaccgttatatgggaacctccaacccggatatatttgcggctggcgatgtgacggaagttaactttaatcctacgaaggaacacgcctatatgccattagtctcacatgcaattcggcaaggtgcactggcaggaattaatatctttgataaacgcttaggtgcaattggtacgcaagcgacgactgggatgttgatttttgatcagaccgtggcttgtgcaggtctgaccttaacggcggccaaagcagctaacttcgatgcccaagcagctttttatgaaggcaattatcggccggactttatgcctaccacggcgaaagtcatgattgagttggtttatgatcaacaaacgcggaaggttttgggtggtcaactaatgagtgctcatgaagtttcacaatcagcaaatacgttgtccgtagtgattcataatggtaatacgattgatgaattagccttcatggatatgctattctcacccaactttgatgaaccgtttaattacttgaatttagtagcgcaggctgcagtagatcaggaacatggctatcgtcggaataattaagtttttgcactaattatgttcagaaggtgctggttgttaaaatcaagaacagccagcttagacccgctggaataagttcagattagcgtaaacttgtttggggagtgtgtctgataccgttcttcaggtattgctgccaatcgctgggatggtattcaaaacgaatgtgctatgttaacgtttgttccaagtctaacggagtagatggttcagcgacagattagcttgggttaagcggccgttcatctgccactcgagtggtttcctggaagtcagacgaggacgcgcatatgctgacgggcaacaatccaactaactagcatgttttaataataagtgctggtgaatccataaaaataatgagccaaataaggtgaccgccaaacagtgggtttcataacctgactgtttggcggccacctttatattatttgaaagcgattggtcaagcatagtcgttgggatcggcggctaggggttggtaagcgtccatttcggtgtcgcggtagtcccaccattcgttaacgtagccgacaaagcccgcggcggtcatggcggtgtccagcagctgataatttttttcttgaagtgcggttcgaggagcgtcacggtgagcagctgccgtgaagtcatcgaaggcagttggcattgttaactcactaccatcaggatgggccagggtcaaatctaaggtgacgcctttttggtggctgaaattaggattaggctgggcaacaaattctggatcaggatacacttcaaataaacggcgctgggcgctgacgggccgataagcatcccagactttgagtcgataaccttgttgtttaaccagggcgcttgccttggcgagtttgtgggccgtgccagtgcgaacaatggccgtggtaaagtcgtaaatcacttgatgagtaaagttattagtggtggcataacgcaggtcaacgatgatttcggagtctaagtgttgaatattggtgaaaccagttaaagcttgatccatagtaggtcctccttagaatttagttatgcttattgtatctgattggccgatattttaccgactaaaagggttgcaaatggtgtcaaactttctgctagctttcaatccgggtccctgatatgatggaaagcggtgtaaatttaacaattgattgaagaggtgaggtcgcatggatcgacaaacacgacgcgcaattttaattttagtttttagtgagtttttagtttgtttagggattagtttagttattccagtcatgccgtttattaaaaatgaactgcatttaacggctaccgatatgggaataatgaatgcgctattcgcattggcacaatttgtggcctcacccattattggccgggtttcagacaaagttggtcgcaagcccgtattaacggtagggctagtcttatatatggtctcggaagtactatttgcgctaaccaaccagctgtgggtctttaatatttcccggattgttggtggcttatcagcagcgatggtcgttccgacggcgatggcgttagcatccgatattacgaccaaacgacagcgagctaaagtaattggctggttatcggcggcctttagtggtggcttgattttaggccccggtatcggtggggtattggctggtattagttataagacgccgttctgggttgctggtgcattgggattactcagtgccattgtgctcgtcattctgttgcctgcggatcgtcagattgatcctgatcgcgaagcaattacggccacgacaacgacgaccaatcatccgatgacgcgggcattttggaccgtcccgattattatattatttacgatgattttagtatcttcctttggcttacaggggtttgagagcatttatagtatttacgtgaatgaagtctttcactttagtctgagcaacattgcgttggtcttgactttaaatggtttgatttcgctcttcctacaggtggcactatttgatacctttgtccagcgttggggcgaacggcgggtcattcgggtgtgctttgcagctgcggcgctctgcactatctggattacgcaggctcattcgaaagttgctgtcatggttgcaacgctcgttattttttcggcattcgatcttttgcggcccgctattacgaccctattaacgaaagcaagtgaggccaaccaggggctaatcaatgggcttaacatgtccttaacgagtgttggcaatatcgttggcccaatcatgtcggggatgttactagatatgaattatcactatccatatctagtggtggccggattcttgattgtctcttatttaatggcgtttatgttacgattaccgaaccaggttcattcacatcagcaagtttaatattgcataacagttaagctaatcagcgaaagcgctccgggtttgcgtccccggggcgcttttgttacacttaggccaaattagattgaaggatggtgggctgcaatgggaatgcatcaatattttcagagcttaagtaatttagaaacgattcaacgggccccgggttttttcaagtatcagaatcattcagttgcggcgcattcattcaaagttgccgaagttgcccaatttttaggtgatgtggaagaaaatgccggacaaattgttgattggcgagccctctatgagaaggcgctgaatcacgactataatgagcgttttatcggggatattaagacgcctgtcaagtacgcaacgccgacgctacggacgatgctggcggatgttgagcataaattatcacaaaattttgtgcaaaatgagattccggctgagtttcaggcagcttattcacggcgtctatcagaaggcaaggatgaaacgctagaaggccagatattgtcggtagccgataaaattgacctattgtatgagtcgtttggtgaaattcaaaagggtaatccagaaccagtttttagggatatttatcaagaaagtttaaaaacaattgtcgcgtttaaaaagatgactagtgttcaatatttcttaaaagcagtgctgccagagatgttagcggaaccgttcacgcatcaggatcaattacaggcgctgacgacccagattttaacggccgggccgcaatccgattaatggcgaaagtatgttcgatgtgctaaaattaaatgcgatttgaatgtgatagggaagcgcgggcttgcctattttttatggtgcgacagtaagatttagttatcaatagatgatatgaacgggtgaccgtttaaaaggaggactacgtttgattgatcgggtagataataatcattttgacttagtttcagattaccaaccaacgggcgatcaaccccaagcgatccagcaattaactgctggcattgaatcgggagaaaaagagcagatcttgttgggggcgaccgggaccgggaagacctttacaatttcgaacgtgattgcaaaggtgaataagccaacgttaatcttgtcacataacaagacgttagcgggtcaattatacggggagtttaagaagtttttcccgaacaatgccgttgaatattttgtgagttattacgattattatcagccggaagcgtacgtgccttcgagtgatacctatatcgaaaaggactcggcaatcaacgatgaaatcgataagttacggcactctgcgaccagctcattattggaacgcaacgatgtgatcgtcgtggcatcggtctccagtattttcggtttaggggatcctcacgagtaccaagatcacgtagtctcactgcgagtcggcatggagatcgaccgcaatgatctgttgcgtaaacttgttgatattcaatttgatcgtaacgatattgatttccagcgggggcgttttcgggtccatggtgatgtcgtagaaatctttccggcttcacgggatgaccacgcattgcgcgttgaattctttggcgatgagattgatcgaatccgtgagattgacgccttaaccggtgaaattgtagctgatcgtgaacatgttgcgatcttcccagcgacccactttatgacgaatgatgcgattatggaacacgccatcaagggcattgaagatgagttggatggccgcctgaaagaattgacagccgatggcaaattgttagaggcgcaacgactcaagcagcggacgacctatgatgtcgaaatgctcaaagaaatgggctacactagtggtatcgagaactattcacgttttatggatggccgtaaacctggcgaaccaccgtatacgttactggacttcttcccgaaggactttttgctcgtggtcgatgagtcacacgtgacgatgccccaagttcggggaatgtataatggggaccgagcacgtaaacaaatgctagtcgattatggcttccgtttgccaagtgcgttggacaaccggccattgaaacttgaagaagttgaacagcatattaatcaagtggtttatatgtccgcaacgccgggcccttacgaaatggatcggaccaagcatgtcgtccagcaaattattcgaccaactggtttattggatcctacgattgaggttcgaccgattatgggtcagatcgatgacttagtgggtgaaatcaataagcgcattgaggtcaacgaacgggtctttatcaccacgttaactaagaagatggcggaagatttgaccgactactttaaggatttaggcatcaaggtacggtacttgcacagtgatattaagacgttggaacgaacgcagatcatccgcgacctgcgtctgggcaagttcgatgtgttggtcgggatcaacttgttgcgggaaggaattgacgttcccgaagtttcactagttgcgattttggatgcggataaggaaggtttccttcgtaacgagcgttcgttgatccaaacgattggtcgggcggctcgtaatgagcacggttcagtgattatgtacgctgacaccacgactgattcgatgcaggccgcgatggatgagactgcacgtcgtcgtgccgtacagatgaagtacaatgaagatcatcacatcacgccacatacgattaagaaggccattccagagctaattgcttcgacgaagaccactgaagacgcgggcaagaaggatgacttcttagaaaccgactttgatgatatgacccgtgaacaacaattagatatgattagtaagttggaagaacagatgaagaccgccgctaagaagctcgactttgaacaagccgcaacgctgcgtgatacggtcatggaattgaaagcacaaattagctagcaggttgctggcttgagattgaggaggcctttttttggcaaatgataagattgtcattcacggtgcgcgagcccataatttaaaagatatcgacgttaccatcccgcgcgacaaattagtcgtgattacggggctgtctggctcaggtaagagttcgttagcgttcgataccttgtacgcggaaggacaacgtcgctacgtggaaagtttgtcagcgtacgcgcgtcaattcttaggacagatgcaaaaaccagacgttgattcaattgatgggcttagtccggctatttcgatcgatcagaaaacaacatccaaaaacccgcgctcaacggtcggaaccgttacagaaatcaatgattatttacggttactgtgggcccgagtcggtgaaccgatttgcccgaacgatgggacaccgattgcgagtcaaactgttgaacagatggttgatcggattcagaaattaccggaacgaacgaagttgcagattttatcaccaattgtccgccagaaaaagggcgagcacaaaaagatctttgaaaagatcaagcgtgaaggtttcgtgcgggtccgtgttgatggtgatattcatgatatcagtgaaacttttgaactgaacaagaatcaacaacacacgattgaaatcgtcattgatcggatcgttgtgaagtcaggtgaccgttctcggttatttgattcttttgaagcggcgttgcgattaagtgggggctatgcgattgcggatgtgatcggtggcgaacccattatgttctcagaacattatgcttgtcctatctgtgggtttactgtgggagaacttgaaccacgattattctcgtttaacgcgcctcagggagcttgtccagactgtgaaggtctcggaatcaagctagaagtcgatgaggaccttgtcgtacctgataagtcgctgacattggctgaaggtgcgttagcgccttggaatccaatcagttcacagtattatcctgaaatgttgaagcaagcttgtgaacagttagaaattccgatggatgtgccgtatgaagacttatcaaaagctgatcaacaaacggttttgtatgggtctaacggaaagacgttccatttccactaccagaacgactttggtggtgttcgcgatgttgacgctgtgtttgagggcgttatcaacaatgttgaccgccgctaccacgaaacgaatagtgatttcacccgcgatgtgatgcgaaagtatatgacggaactcacttgtcagacttgtcatgggttccgcttaaatcgcaaggccctgtctgtcaaagttggtggcgaacatatcgggatggtctctgacttagccattggtaaggaactcgatttctttaacgagttgagcttatcagaacaaagtctcgtgattgctaaaccaatcttgaaggaaatccgcgaccggttatcattcttgcaaaatgtgggactggcgtacttaacgctcagccgttctgcacggacgctgtctggtggggaagcccagcgaatccggttagcaacacagatcggatcgaacttgtccggcgtgctctatatcttggatgaaccatcaattggattgcatcagcgggataacgaccgcttgattggttcacttaagaagatgcgcgatctggggaatacgttgatcgtggtcgaacatgatgaagacacgatgcgggccgctgactatatcgtggatatcggcccgggtgccggtgaaaacggtggtgaggtcatggcggccggaacgcccaagcaagtggctcgctcgcggaagtcactgaccggccaatatctatcgggcaaacggtttatcccactacctgaaactcggcgtccgggtaatggtaagaagattcgtatcactggtgcggccgaaaacaacctcaagcaaattgacgttgattttccactaggcgaatttgtcgtggtaacgggggtttccggttctggtaagtcgaccttggttaacgatgttttgaaacgcgtattggcacagaagttgaatcgtaattctgaaaagcctggtaagtataagagtgtcagtggtattaagaatattgaacggttagttaatattgaccaaagtccaatcggccgaacaccacgcagtaatccggccacatatactggtgtctttgacaatattcgtgatttatttgcacaaacgaatgaagctaaattacgtggttacaagaagggccgctttagttttaatactaagggtggtcgttgtgaggcttgtcacggtgacgggattctaaaaattgaaatgaatttcttgcccgatgtctttgtaccttgtgaagtgtgtcatggtaagcaatacaattctgaaacgttggaagttgaatacaaaggcaaaaatattgccgatgttcttcaaatgaccgcttcagaagctgttaagttctttgaaccaattccaaagattcgacggaaactacagaccttggtcgacgttggtttgggctatgttaagttaggccaacccgccacgactttatcaggtggagaagcccaacggatgaagttagcttccgaattgcacaaacaacagtcggggaagaatttctacatcttggacgaaccaacgactgggttgcacagtgaagatattcggcgcttgattggtgtcttggatcggttggtggatgcgggtaataccgtgttaatcatcgagcataatttggatgttgtgaagtcggcggattatttgattgacttgggcccagaaggcggtgacggcggcggaacaatcgttgctactgggacaccagaacaggtcgctgaagtggctgaaagttatactggccaatacttgaagcccgttctagaacgggatcgagcacgtgaagcaactgcacctgctaaataacgggcaatgtgctacacttgagtttgtaatgtaattttaatttagaggagttgtttgtacatggctaaagtagaaagttttacattagatcataccaaggttttagcaccttacgttcgtaaaattacggtggaaaatgggcctaagggtgatgccatcactaattttgatttgcggttagttcaacctaacaagaccgctattgatacggcgggcttacacacgattgaacatatgttggctggattattacgtgatcggatggatggcgtgattgactgctcaccatttggttgtcggactggttttcatttgattacttggggtgaacatgacaccgttgaagttgctaaggcattgaagtcctcattagaattcattgctggcccagctaagtgggaagacgtacaagggacgaccatcgatagctgtgggaattacaaggatcattctttattctcagctaaggaatgggccaagttgattttatcgcaaggaatttcatcggatccatttgtacgcaaagtcgttgaatagaccaaaatataaaaagtaatggtggtgccggccaccaattaaaaagagcctagcttttcataacgaaaagctaggctctttttgctgtttactgacattgtgcgagcttagcggtcctgaatcgtgggaaaacaatctaagattagattaaggtagtgtttcaaaaataacaaaaaatatactgatattggtgaatatctgcataaaaattctatattttagtgaatattgcgcaaataatgaatatatttaaaatattattgaataaagttaaattgggtggtacgatactgtcattgataaaagcaaagataaaaatttcggaggtacaaatcaatggtcaaacaaaatgataaaattattctcgcttattctggtggtttagatacgtcggtcgcaattagttggttgaaggataagggctatgatgttgtggcctgcggaattgatgttggtgaaggcaaggacatggatgcaatcaaagaaaaggccctaaaattaggggctgtttcatcatatatgattgatgctaagcaagaatttgctgaagaatatgcgttaattgctttacaaggtcataccttgtatgaaggtgaatacccgctggtttcagcactttcacgtcctttaattgctaagaagttagtcacattagccaagcaagagcacgctgttgcaattgcccatggctgtactgggaagggtaatgatcaggttcggtttgaggttgccatccacgctcttgcaccggatatcaagatcgaagcgcctgtacgtgattggcactggtcacgggaagaagagatcgattacgctaaggaacacaatattcccgtaccaatcaatttggacagtccttactcgattgacgaaaacttatggggccgggctaatgaatgtggcattctagaagatccatggcagggcgcgcctgccgatgcgtttgaccggacgaaggccttagctgatacgccggatacgccaacgactttggaaatcacttttgaggctggggtgccagttgctttagatggtgaatcacttaacctagctgatttaatcatcaagttggatcagattgctggtgaacatggaattggtcggatcgaccatattgaaaaccggttggtcggtatcaagtcacgggaagtttacgaagcaccagctgcaacggtattgctcaaagcacataaagatttggaagatttgacgtttgagcgtgagttagctcacttcaagccaatcattgaacaaaagcttgcggatacgatctacaacggtctttggttctcaccattgatggaagcgatggttgccttcttaaagcaaactcagcaagtcgtcaatggggtagttcgggtacaactcttcaagggtaacgttattactgaggggcggaagtcacccaactcactatatgatacgaacttggcaacctatacatcagcggattcatttgaccaacaagcggcagttggtttcattaagctatggggcctaccaacgcaagttaatgcccaagtccaagcgaaggctcaggctgaagctaagactgataaggcacacgcctaatgagtacccagaagctatggggtggccggtttaccgaaacgggtgctaagtatgttgatgactttggggcatcaattagctttgaccagttgcttgccgcagaagatattgctggttcactggcacacgttaaaatgttgaagaaaactggtattttgcccgccgctgatgttgatcaaattgttgctggattggaaaccttggctgagcgtcaaaaacaaggtaagttggaattttcaacggtcaacgaagacattcatatgaatattgagtcattattgaccgaagagattgggccggtcgctgggaagttgcacacggcccggtcgcggaatgaccaagttgccacggatttccacttgtacttgaagcatcaattaccactaatattggaccggctacatgaactggaaacagtattggtcgataaagcgagtgaaaacgtggagacggtcatgccggggtacacgcatttgcaacacgcccaacccatctcgtacgcgcactacctgttagcttattaccaaatgttcaagcgggacatggaacgcttcgagtttaacctgaagcataccgatatttcgccattgggagccgctgcacttgctggaacgacttttccaatcgaccgggaatatagtgcgaaactattaggattcagtgaagtctatcataatagtttggatgccgtttctgaccgggacttcgtgcttgagtttctcagcaatgcttcgatcctgatgatgcatctctcacggttttgtgaagaaattgtcagctggagcagttatgaattcaagtacatcagtttgagcgatcagttttcaacgggtagttcgattatgccgcaaaagaagaaccctgacatggccgaattgattcggggcaagtccggccgggtttacggcaacttgatgggattgctaactgtcatgaaagggattccgctcgcttacaataaggatctgcaagaagacaaagaaggggcgtttgatacggtcacgaccgtgttaacgagtctccacgtcttcaccggcatgttggcaacgctgaccgttaatgaagatcggatggctgatgccacgactaacgatttctcaaatgcgaccgaactagccgattaccttgcaaacaaaggaatcccatttcgggaggcccatgccattgcggggaagctcgtcttggatggcttgaaaaaacagcggccgttgcaggatattccactcaaagaatatcagtcaatctcaccgctgatccaagaagatgtctaccatgatttgaacgcaaaagttgcggtggaacggcggcattcgctaggtggtactggttttgatcagattagacaagaattgcaacgggcacaaacgcaattgtcagcctatcaatctgaaaccactgattaattaatgcttatcaatttgaccattgatattatttttaaagatgacctctaagtggcggagactcggcatttagaggccatttttaatgctattgacattttgaaaaagcattaagctaacataaagtctatcagaaaaattggaaactcttacattaactggtaagatggaattaatatcggatatgggagatgttgatgtatgtttaatgatcatcgctgggggtttgattggactgaattcatgacggggatcgttttcttgatcgccgcttactttgtcatcaagcaaccacaagcagcacttttaagtttagtctttttatttgccatcgccgcaattattagcggggtcaccacaatcggtgggtacacaaaactacgccgtgaaacagggttgcgggcaaactttgcccttgtgtttgcgattattgatattttagtggggttattatttttattccacgcaccgactggggtactggtactcggttacgtctttgccttttggttcttgatcgattcgattgaacggctgaccgtagtctcacatctacgcgtctttggaaccgggtattttgttctatctttaatcttggatattattagtttggcattgggaatcttattagtaatcaatccaatggttgctgtgattagtttcaacgtactggttagtttctactttgcagtttttggcatcaacgcaatcttgattgcttttgctcggcgtaactagcttggcagtattgactcgttagcgatacttggcgctcactattggtggtgtcagggtgttgttaaggggtcttttttttgcgcgttaatgtaatactgtttggaatcaaatggcgggtcgaagtggcacgtcagtagaaatgacacacccggtgtgttatactaccaacaatatggactagagggggccaatacagcatggcagaatcattacaactagtaattatttctgggatgagcggtgccggtaagacggttgcggttcaaagctttgaagacctgggctatttttgcattgacaatatgccaccagcgttattaccgaagttctcagaattagttgaggagtcgggtaaaataaagaaagtagcgttagtgattgatttacgctcgcgggctttttacgacgaaattatggatatgttggctaacttagacaacacggactttgtgtcgacccggattctgtttttagatgcttccaacgaagaattagtgtcacgttataaagagacgcggcgttcccatccattagccatggaaggtcgcgtcatggatggcgtgcgcaaagaacgagaattattggcgccattgaaagatcgggcttcatacgtcattgatacgtcgacgttgacaccacgtgaattacgcgaatcgatttttgataaattcgaaacggatcaggatgagacttttcatattgaaatgctatcattcggttttaaatacggactcccgattgatgcagatatcgttatggatgtgcgcttcttgcctaatccatactacattcctgaattaaagaagctgacgggactagataaacctgtggcggattacgttatgcagcaaccagctacggaagctttctaccagcagttcttgagtatgctggaaagcattatgcccggctatgaagccgagggcaagagtagtttgacgattgcgattggctgtacgggcggtcaacaccggtccgttgccttgacgcaacgtatcggtgaagcgctggctaagcactacaaggtgcacatcagtcatcgtgatattgagaaacgaaaggaaactgttaatcgctcatgagaaaatacacatttaagacccagcggcctaaaattgtggtgattggtggagggaccggtttgccggttgttctgaacggcttgcgtaagcaggcagtcgatattaccgcagtggtgacggtggctgatgatggtgggtcatccggcattattcgcaattacgttaacgtggttccacctggtgatattcgtaatgtaatggtggcgttgtcgagttggccggatttgtataaagatatttttcagtatcgtttccagggtgatgatcaattttttgcaggtcatgcgattggtaatttaattattgcggcactaacggaaatgaaatctggggtgtttgacgcggtgcaggaattatcaaatatgatgcaagtagatggtcatgtttacccggcagccaacgaggcactcacgctacatggtaagtttagtgacggtaccgagttagtaggtgaagccgaaattaccgcggcccataagtcattggaacgcgtttgggtcactgacaagaatggtaaggaaccacaagcagttcaaccagttattgatgcgattatggcggcagatcagattgttttggggcccggtagtttgtttaccagtattctaccgaacctaacgattggaaatattggtcgggccgtctgtgagtctgatgcagaagtggtttatatttgtaatattatgactcaaaaaggtgaaacggataatttctccgatgctgatcatgtacgggtcttaaaccgccatttggggcagaactttattaatacggtgttagttaacaccgaaaaagtgccagaagattacatggattttcataagtttaacgaagtttcaaagcaagtgagtcatgacttccgggggttacgtgaacaaaactgtcgcgtaatctcatcgaacttcttgaaactccgtgataatggggcctttcatgatggcgaccaagttgtcgctgaattaatgaatctagtcggtcattccgacgttttcagataagggggtcgtggcatgtcatacgccagtgacgttaagaaagaattgactaacctcgctgtccatcgcgagaatgctaaggctgaattaatggctttgattcgaatgaatggggcgatcagcattgctaatcatcacttcattttgaatattcagacggaaaatccggccatcgcgcggcgtatttaccggctactcaaacaattttatgacgtcgatagtgaattgattgttcggcgcaaaatgaaattaaataagaataatttgtacatcgtacgattgaagaccggtacggacatggtactcgctgatttgggtatcttaaaggattatcaaatcgttgaagtggcaccaactgaagtgttaacggatgatgctgcggtgcgttcttatttgcgtggcgcctttttagcgggcggttcggttaataatcctgaaacttcccggtatcatttggaaatttactcactgtatgaggaacataatcatatgatctccgagatgatgaatcagtatggcttgaattcacgaacgactgatcggcgtggtggttttattacgtacatcaaggaagcggaaaaaattgccgacttcttgtcattggttggtgcgaccaatgccatgcttaagtttgaagatattcgaatcatgcgggacatgcgtaactcggtcaatcggttggttaactgtgagaacgccaacatggataaggttgccaatgcctctagcaaacagattgaaaatattttattgatcgatgctacggtgggattacaacagttaccaccaaaattacaagaagtcgctgttgcccggttggaacatcgtgaagttagcctcaaggaactaggaacccttgttccgggcgggccgatttctaagtctggaatcaatcatcggctgcgtaaaatcaatcaatttgcggaacaattacaaaaagatgcttagttgtcgataaggatggcttaagcatgagttttgttgaaaagcttgctaaccattttagatggtgttagcggcttttttgggttgaaatggattgattgtcgttcgccatactcgaaaagcacttgacaaaagtaagtgcaactatttatactgaacacatcttattgaaatcggagagacgtaattatgcaaaaatcaacaatgcaaatgatgatgtgctgcccatgttgtgaatcaaacaacatggctatttgcgttgaattacaagcgtctctgcatcaaaaataacgggattgagctcaaatcgttaattttgaaacgcctgcttggaatctgacgagattctgaacaggcgttttttgttacaaccgatgggaataagtagatcaacacatcaaaatgggaatgtaaaggggcgagaagtttgaagaagcgatcagtgttagcagtggtaatgagcctagtattagtgacggtgctggctgcgtgtgggaagcacaatagccagtcttctggtaatggcaagtatgcaagtagtcaggttttaaacttgtcgtaccctagttcattggattcaatcgatatttccaatatgtcgggatatggcagtacgggtaatatttttgaaagcttataccggttaggaaagaatggtagcattacaccgggattagctaagtccactaaggtttcaaaggatggcaagacgtatacctttacgattcgcaatgcgaagtggagcgatggttcgaagataaccgcgcaagactttgtctattcttggaaacggaccgtcaccccagcaactaagtcacagtatgcctacctcttctcaggggtgaagaatgcggatgaaattgtcgctgggaaaaagtcaccaagtacattgggcgtcaaggcgcaaggcgaacatacttttattgtgactcttgacaagccaattacttattttaagaagttaatgacctacccgttgtttggaccaattagtgagaaagcggtcaaaaaatggggtagcaaatatgccactaaggctcagtacatgctctacagtgggccgtttaagttgactggctggactggaactaataatagctggcagtttgtaaaaaataatcagtactgggataagaaagctgtccacctacaaaagatcaactacacggtcaatgagagtactacgacaacattgaacttgttccaagaaaagaaacttgatctaacgcaattagcgagtgaacaagttaagaatatgaagagcagttctgattataccacgtacccttattctatcaccgcgtttctggtttataatttccaagacagtaatgcgacaatcaaaaaggcgctcaataacgctaagattcgtcaagcaatttcattgtcgatcaatcgcaagacgttagtaaagaatgtgattggtgacgcatcaacggtctcaaagacgtttgttcctcaggatttagttaaagacgctaaaactggtaaggattttgcagatgaatcaacggttaagaattcaacgtcatataacaaagcgctggcacaaaagttatggaaacaaggccttaaggaaacgggaattaagaaattgtccattcagttattagcttctaatgacgaacctaataagccgatttcacaatacttgaaatcagcattagaaaagaatctcgatggtatgacggtcaacttatccaacattccatcaaaggtagcttcaagtcgtgctcaaagtggtgattttgacctttatctcagtggttggggtgctgatttcaacgacccaatctcgcacttgcaaattatgactaataatagtggttataattacggaaaatataacagcagcacgtacaatgcgttggttaacaaggcccaaaaccaggatgctaatgatactagtgctcgttggcaagatatgatcaacgctgagaagacgatcatgaaggaccaaggaattacgccattgtatcagacggtatactcttatttacaaaatccaaaggtaaagggtattattcataatactgctgggacacagtggaattataagtatgcttatattgccaaataattaactgattgagggacgttcatggtaactggtcgtttagctgttaccttagtaggagcgccaggtccatacgttgccttgatcaaaacaaaatagcggtccatttcgacttgtcagagtgtcttgacgaatcgaagtggaccgcttatttatttcgacgaatggttctacagtgcttgagttgtcacgcaagacaactacactgattggtctatgctggtgttacgtcgttaaccacgtacttgattggctgatgttgggccatcgcaatcacattctccgcgacaatggtagccatgccatcgcgagcttcgaccgttgcgttgccaagatgaggtgtcaaaatgacgttgttcatcgtggccaaaccaggtgtgacttgcggttcatgttcgtagacgtcgagtgcagcgccagcaatttgatgttgttgcagcgccgtcacaagtgcttgctcgtcgacaattggcccccgtgcggcgttgatgaggagcgccgtggacttcattttgctaaaagcagcgttatcgattagatgggttgtttgtgtggtaagcggcaggtgtaaagtgacgatgtcggcatgctgtaaaagttcatcctgggagacaaaggttgcgccaagttgcgtttcacggctaatcggtaggcggtggtgttggctgtataagatgggcatgtcaaaggcgtgtaatcgtttggcaacggcttgaccaatttggccaaggcctaagatgccgagtgtcttgccttgtaagttgtggccgagaaagaacagtggcgcccaaccgttaaagccgctagttcgcattaagtgatcgccttccacgatacgatgcgctaggctgataatcaaaccgaccgttgattcagcggttgcgaccgccgaaacgtttggcgtgttcgtgactggaatctggcgcttagctgctgccgcgatatcgatgttattagtgccagcaccaaaattagcaatcagtttaaggtgtggggcgtggtctaagacatcttgatctacttgagttgagagtggggtaatcaaaaagtcggcatcagcgactcgacggatgagttccgcgtgactgatcaggttatcgccggtataagtatcaatgactaactgactttgtaaaagtaacgtattagcttgggctggaagctgaccagcaataaagacttttgtcattatagagactcctttttacttttaagttcaaggacaagtaatattgtccgggtagtaatccctgcttatgtgcagtatgggctattgcaaaacgaatgacaagaaaacgagcaaaaaaactgggccaacgtctagttagcccagtcaaagatattagcttattttaatttgttgttttccataatatcatcgatcaaaccgtagtctttagcctcttgtgcgcttaagtagttatcacgttcagtatcatggttcaacttttcaacggattgtcccgagttgtcagctaaaatctggttgatctttttacgagtcttcaagatttcttccgcaacaatttcaatttccgtttgttgaccttgagcaccaccagatggttggtgaatcaagatttcagagttaggtaaagcaaaacgcttgcccttagtaccagatgaagctaagacgctagccatggaagcagccatccccataacgatggtttgaacatcagatttgatgaagttcatcgtatcgtagattgctaagccggcagtaacgacaccacctggtgagttgatatagagatagatgtccttacctgaatcttgggcatccaagaagagtagttgggcaataatggcgtttgccatgttatcttcaatgggaccggataacataatgatacggtcctttaatagtcgtgaatagatgtcataagcacgttcgccacgtgatgactgttcaataactgtaggaactggatacatgatttgttagcctcctaaggttgcattatttgattagctgattgctaatataaatgtagtttaccgctaaggtcagtgaaggtcaaaagaaaaacctcaaaaacagaattccgtttatgcagttaacgtggtatacttaggtttctatcataatacggcttgagattgggtgaacccaatctctttttttcgacgattttagttagtaggccttggattaagtgttgcgtctaccttggcttgaaaacgatgttctcttataataatgattcaagattaagcagtaatgaacttgcatattcagcactaatgtggtgatttaaaagtagtcgacccgcataattttattatcgcgatagtaggtgaatcaatttactgatagtgacccacaacgatgagtctaatagaagttggaaattcgcacgtgagccgacatattaaacgacttgaccttgttgctggactcaagttgctcgcaacgaattaatcagtatcggatgcatgaatgaaatttaccatgattaaaacgattctataatataataacaattgtagtaattattatttgaatagtgtaagtttagctgttattaaatctactaaacgactacactggtatatggtttacttgaactgattactttttgattatttttacttggacgagcgggtataggtactattactgaccccgaaaggatattacttgttgtttggtttaaattaagttaccatatggagatgtgactggtatagtccagtagttgtcacttaaataaatgcacaaaaaaagctgagaatcatttctcagctactgatgcgcccggagggaatcgaacccccatctcaagaaccggaatcttacgtgctatccattacaccacgggcgcctaaacaacatattatattctagcgaataatggataaaaacacaagggttttacataaaaatttattcagggaggtatttttatggcactgggaccaggatttcgccagcaacagcggcaatcacagaagttagcgatgacccagcgactacaacaatccattcagatgttgcagtttaatgtggaagaactaagagattttctaacgcaaaaagcattagaaaacccattgatcgatgtggatacaaattggaataataatcacgccagtttgaacgcagccaaaaatgtaaccactaaggcggatttcattgagcgtgtgtcgacctctaatcagcattcgttatttgaatacttgttggatcagattcacctaacgatgcgtgatacccatttgcgtcagattgtcctttatttaattgagtacgttgacgtgaatggttatttgcggattgatgagaggcaggttcggcaagaaactaaggcaacgccaattgagttgttggatgcaattaccttattacaacaacttgatccgccgggtgttggggcccggagcttgcaagaagcgctgatgttgcagacagaaaatgatgaccatgcaccgaacttagcctatattgtcttagaagaaagttttgacgagctggttaatcgacaatgggacttgttggctaagaagtatcaggtgacgcttgcggacatttcaagtatttatgattatgtgcgaacactaacacccgtacccggtgcggcaatcgggcaggagacgaccgggtacatctttcccgatttagtggtgacgaatcagggaggccagctggcattgcgaaccgcatccatggctcaaccggtggttaaattccgcagtcggtattatcagcagatggggcagcatgatgatcaggaagttacggaatatttgaaagaaaagaaaagtgagtatgactggattgctaacagtttgcagcaacgcgaggcaaccatttttcgagtgggaacggccattatcgagcgtcaagcagacttcttcttggaaaaaacgacggatttacggccactattgttacgagatgttgcccaacagttaaaagtgcatgaatcaacaatcagtcgaagtattaatggaaagtacattcaaacggacttcggtatgtttgaacttaaacgtttctttaccaaagcggtcagtaaacgtcccactggtggcaaaatcgtttcggccgacagtgttcaacaccgaattgtgaccttgatcgaacaggaaaataaagaaaaaccgctttcagaccaaaaaattgttcagattcttaatgcggaaaatgtcgaactttctcggcggacagtggcgaaatatcgcgaaaatcttaatattccgtcgtcatcaaggcgaaaacaatacttgagaaccgaacgataatttaacgcgccatttggaccagtcggttataagtttaattggggtttcatttgcaaccaccttatgaacctgttataattcatgttgtggtaagagaggtatgcaacattgatttcttagtgaatttgcgttgtgtgctttgttttttgaagtctttgggtcgcttttcgacatagctggaccagacccgtcccactagagagcaggttggatgccatgcattcagatattcaatggattgaggcaattgccccagatatggttgacatgctgagtcgtcgttacttagtattaagaaccattaattggatggccccagttggacgtcggctattagctcagacgttaggtgttagcgaacggacgttacggaccgaaacggatacattgcggaagctagatttgatcatgacaaacaaatcgggcatgcaagttacccagcaaggtcaagacgtgttagtaggcctaagtcattttatggatgagctaatgggcattcgccagaaagaacgacagttggcgcaatactttaatattaagcgttgcatcatcgtttctggtgattccgatcgacagttgaaagttattgggaccatgggcgaagaagtgaaccagctattacagcaattattgccggaagggcgtaatattattgctgttatgggtgggcataccatggaacatgtggcaagtcacttaactaataaattaggtgataaacgtgatttgttatttgttccggcgcgtggtggtgttggtgaatcggttgcgattcaagcaaataccatcgcgtcacaaatggcacaacatactggcggtaagttccgctcgttgtttgtaccagaacaggtcagtgaacgaacgtatgaaccactcctcaaagaaccaagtattcaagaggtgctggcgattatcgggcaagctaacgtggtcgtgcatagtatcggtgaagccatttcaatggcccatcgccggaatatgtctgaggatcagatcaaggtgttacgcagtcgtgaagcgattggtgaagcctttggttacttctttgataagaagggtaacgtggtctaccgaattccacggattggtttgcaaatcggagaactggcccatcgggagattatactcgccattgcgggtggggcttcaaaagccaccgcaattgccgcgtatatgaagaacattgcacctaaacagacgtgtttgatcacggatgagggtgcggctaacttgattttaaaaaagtaatcttctatagtgaagttgctttttaaaataaaactatttttatttccacaaggaggaaattctagtatgtctgtaaaaattggtattaatggtttcggacgtatcggtcgtttagcattccgtcgtatcttagaacttggtgaaaagtcaagtgatatcgaagttgttgctattaacgatttaacttcacctgcattgttggctcatcttttgaagtatgactcaactcatggtactttgaacgctgacgtttcagcaaccgacgattcaatcgttgttaacggtaagaactaccgtgtttatgctgaaccacaagcacaaaatattccttgggttaagaacgacggtgttgacttcgttctcgaatgtactggtttctacacttcaaaggctaagtcacaagctcacttggacgctggtgcaaagcgtgtcttgatttctgctcctgctggctcagacttgaagaccatcgtttacaacgttaacgatgacatcttgactgcagatgaccgtatcgtttctgctggttcatgtactactaactgccttgcaccattagcattctttgaaaacaaagaattcggtatcaaggttggtactatgactactatccatgcttacacttcaactcaaatgttacttgacggccctgtacgtggtggtaacttccgtgctgcccgtgctgccggtgtaaacactattcctcattcaactggtgctgctaaggctcttggcttagttatcccagaattgaacggtaaattacaaggccatgcacaacgtgttggtgttgttgatggttcattaactgaattagttgctatcttagacaagaaagttactgctgacgaagttaacgccgcaatcaagaagcatactgaaggtaacgaatcatttggttacaacgatgacgaaatcgtttcatctgatgttatcggtactactttcggttcaatcttcgatcctactcaaacagaagttacttctgatggtgacaaccaattagttaagactgttgcttggtacgataacgaatacggcttcacttgccaaatggtacgtactttattgaagttcgccactctctaatatttgattagatagttaagaactttaaaaccgcatatggttttgacggcggggggaggcaaaactcctcttgccgtttttttaatttcagcagtcacgaattctaggaggattttaacattggctaaattaatcgtttcagatttagatgttaaagataaaaaagttttaattcgtgtcgactttaatgttccaattaaagacggcaaaattggtgacgacaaccggatcgtcgctgccttaccaacgatcaaatacgtgattgaacatgatggcaaagccatcttattctcacatttaggtcggattaagagcgaagacgacaagaagggcttaagcttacgtcctgttgcagaacgtctttcaaacttattaaacaagcctgttaccttcgtacctgttactgaaggcgaacaacttgaaactgccatcaacaacatgaacgacggtgacgtcttagttgttgaaaacactcgttttgaagacgttgttaacggcgaacaagttaaacgcgaatctggtaacgatcctgaattaggcaagtactgggcttcacttggtgatgtctacgtcaacgatgctttcgggactgctcaccggagccatgcttctaacgttgggattgcttcaaacatggatcaagttgccgctggtttcttaatggaaaaggaaatcaagttcttaggtgacgcggttgacaatcctaagcacccattcgttgctatcttaggtggtgccaaggtttctgataagatcggtgttatcgatcacttaatcagcaaagctgacaagatcatcatcggtggtgggatgacttatacgttctatgctgctaaaggcatgggcattggtaactcacttgttgaaaaagacaagattgaattggctaagtcaatcatcgaaaaagctggcgacaagttagtcttacctagcgactcaatcgttgctgaaaagtttgataacgatgttcctagcaaggttgttgaaggttcaattcctgatggctacatggccttagatattggtcctaagtcaatcgaagaattcgaagatgttttacgcgacgctaagaccgttgtttggaacggaccaatgggtgtcttcgaaatgagcaactacgccaagggtacgcttgaaattggtaagttcttaggaaccttatcagacgcaacgaccatcgttggtggtggggactcaactgccgctgttaagcaacttggcgttggcgacaagttaacccacatttctactggtggcggtgcttcacttgaataccttgaaggtaaggaattacctggtattgctgctatttctgaaaaataatctgttctccgaaaggaaggtttatcgtgcgtacacctattattgccggtaactggaaaatgaacaaaacagctagcgaagctttagctttcgttaatgctgttaaggatcaattaccagatccatcaaaagttgaatcagtcgttgctgccccagcccttttcttacaggaaatggttgaagctgccaagggttctgatttaaagattgctgctgaaaatgcttattttgaagatgctggggcatttactggtgaaacttcaccagctgccttagctgacttaggcgttgattacgttgttattggtcattcagaacgtcgcggttatttccacgaaactgacgaagacattaacaaaaaggcacacgctatcttcaagaacggcatgaagccaatcatttgctgtggcgaatcattagaacaacgtgaagccggcgaagcagaatcatgggtttcaggccaaatcaaggctgctttgaaagacttatcagctgaccaagtaagttcattggttattgcctacgaaccaatctgggccatcggtactggtaagactgctacgagtgaccaagctgaagaaatttgtgcggttgttcgtaagactgttgctgacctttactcacaagaagttgctgataaagttcggattcaatacggtggtagtgttaaaccagccaacgttaacgaattaatgggcaaagatgatatcgacggtggtttagtcggtggtgcttcattacaacctgattcattcttggaacttgttaattatcaaaataactaataatagttattgcaagttgattgacaaacttctacaataagtgtgaaacaaataacaagccaattttaaggagagaaattaatgtctattattacagatatttatgctcgcgaagtcttagactcacgtggtaacccaactgttgaagttgaactttatactgaaagtggcgcatttggccgcggtatcgttccttcaggtgcctcaactggtgaacatgaagccgttgaattacgtgacggtgacaagagccgtttcatgggcaagggtgttactaaagccgttgacaatgttaacaagttaattgctaaggaaattgttggttacgatgtaactgaccaacgtgccattgaccaagctatgatcaagttagatggtactcctaacaaagctaagttaggcgctaacgctatcttaggtgtttccattgccgctgcacgtgctgctgctgacgaacttgaaatgcctttatacaactaccttggcggattcaacgctcacgttttaccaacaccaatgatgaacgttatcaatggtggggcccacgccaacaacgacgttgacttccaagaattcatgatcatgcctgttggcgcttcttcagttaaagaagctatccggatgggttcagaaactttccacaacttgaaagcgatcttgaacgaacgcggttactcaactgccgttggtgacgaaggtggttttgcgcctgacttgaagaacaacgaagaaccattcgaaatcttagttgaagctatcgaacgtgccggttacaagcctggtaaggatattgccattgcctttgactgtgccgcttcagaattctacaacgaagaaactggcaagtacgacttaaagggtgaaggcgaaaatggtcaatcatttactgccgaagaattcgttgacttacttgacagcattgttgacaagtacccaatcgtttctatcgaagatcctttggatgaaaacaactgggaagactggcaaatggcaactaccaagcttggtaagaaagttcaaatcgttggtgacgacttattcgttacgaacacggactaccttgcaaagggtatcaagatgggcgttgctaactcaatcttaatcaaggttaaccaaattggtactttaactgaaactgttgaagctatcgaaatggctaaagaagctggctacactgccatcgtttctcaccgttctggtgaaactgaagacacgaccattgctgacttagttgtcgcaatgaacgctggccaaatcaagactggttcaatgagccgtactgaacggattgctaaatacaatcaattaatgcggatcgaagaccaacttgaaagcacttcagaatacaaaggtatccacggtttctacaacttagacgaagctgcacggaacaccattactagcaagtaatttgaagttctaatgaaaacgtcgttccgatgggacggcgtttttattatacataatttaaggaacatctgtttgagtttagggtctagggacggacgagtcgtggtagaatagaaacatgcgtattttgagtaaggagcgagcagaatggatgactttcagcaacaaattaatgagtggtctgattggcaaggactgcaactgaatgccggtgcttttgaaccggtgattcaaaaaatttatgccagtgaaaatgagccttataaaacgccagaacccgttgcggataagttggccgcccgctttacggtcggacccacccaaatcgcgatttttccacccagtgaggttatcccccaaactcgggcctattatcaggcggaacgttttggactgacccggatggctcgattgagcttgggtgctccgcgtctattgcatgcgggcttcatttttgataagtaccagttctactacgtgatttatcagccactacaaggtctgacgctaactgaattttgcgcaacggctaagccccttgctaagtcaacactggggcgccagattgggacgatgttgacgcgacttaatactgaagttcctgcatttgggccaaccgctgcccaatcaaccgagtgggatacactgggccccgactttgttgccgagcgtacggcctggctacaagtacacaccgtaacgcctaatcaatttgttcatggcaatctagtgggtgggaatttaattgtgactagtggtgaattaggtttacagcgattcagtgccgcccatcaagctgcaaaacaaacggaattagtcccgctaattttgcaagcatttaatgatgatactgacttattggctggatttaaggaaacttatcaaactgacgacttagaaaaggatctgttattaggtttgttattacgcgtagatggaccacagcagattcaggcattacatcctggagcgcccgtgacgttagcggccgtccagcaagtgattgcacaacgattatcatgattaagagggggaactcatggtggcacagcggccgcacattgcaaaacaacattttgactttacacggttcagctcgattggccgggcattaattgtcggtgtgattgctgggatcgtggttagtatttttcgtttcagcatcgagcagggactgaggttcgttcaatgggtgtacgcacaaattcatacaaattggctactgctctttccatggataggcttgtctgtggctgtggcgttctttgtgggttggttagttaagaatgaaccgaatattaaagggtctggcattccacaagttgagggtcaattagctggcgagcttgattatagttggtggtcagtgctctggcgcaagtttgtcggtggtattctgggcattggttctggactgtttctcggccgcgaaggcccctcgattcaattgggagctacgattggtcagggtgtcgcgtcgaaactcaaacagacgggatcagatcgacgctccttgattgccggtggtgcagcagctggcctttcagcggccttcaacgcaccgattgccagtacgttatttgttctggaagaggtttatcataatttttcaccaatcatttggaccaccgcattagttagtgcgatggccagtaattttatttcgctcaatttttttggccttgtaccagtattacacattccgtacggccataaccttccgttgagtcaatatggcaatctgattgggctcgggatttttctcggtattttcggttatctatatcaaaacgtgacgctgacgatgccaaattggtatgccaagttgcggttgcccagttggttggatggcttggtgccatttttactggtgattccgattggattaatttggccgcagctattaggaggcggcaatgctgttattttgaatttggccgcagtaacgccagcgttactcgccttgttaggaattttcgtgttacggtttaccttttctaccatttcatatggatctggtttgccggggggcatcttcttgccaatcttgtcactgggcgccatcttaggtgcaatctatgcccagttcatggttgccgttggttggatgccgacgaacttgattccgaactttattatttttgcaatggctggatactttgccggcattggtaaagcaccgtttaccgcaattttattgattactgaaatggtcgggacactacaccacttgatgccattagcagtcgtttcgatgacggcctacttagtcgtggatctcttaggcggcgctccgatttatgaggctttgctagagaagttaattcagccgcggttaccggaacatagcggtatccaggatcggttagaattgccgatctttgaaggctctaagttagagggccatcaagttcgtgattttaaatggccagcagagtcattattgattgctattcgccgcggggagcgtcaagtgatcccgcatggcgacaccttgatgcgggctggtgataccttaattatcttgactgaccgggataaccgtgcgtgggtgcgccatcaaatcgcacatttaacggtcgcgacgccctgagcactaaacaaagcaacgaattgttcaggatactggaaaaataaggcaaaatatgttaaattgttatagacatagcggaggctttaggaggcacatttcttgtataatttattgttaacgttaatactggttgtttccgttttgattatcattgcggtgatgatgcaaccatccaaaactaatgatgccatgtcttcattaaccggtggtgctgatgacttgtttgccaagcagaagccccgcggttttgaagcgttcatgcagaaggtaaccgtggtattaggaatcgcattctttatcctggcgttagctctagcatggtactcatcgaagtaattgaccgtcctcctgtgatttcaggaggcttttttttaaggtggtgtaatgatgctgaaacaaccggaaccgtttttctttgaacatggccaacatgccgtcattttattgcacgcctatgcgggaagtgccaatgatgtgcggatgttagcacgagcattagaacgggaagattatacagtttatggcccccaattcagtggacacgcgactgatgatccacgagatattctcgcacagacgccggcgcaatggtggcaagatacgcaacaagcaatatcatttatgcggcaaaaaggctatactaaaattagtatctttggcttatcattaggtggtatttttgcgacggcggccttggagcgtgatcctcagttgctaggtggtggcacgtttagttcaccactatttgctggtaatcgtagtgacgttgctgaaatgtttatcacgctgagtcaccatcaactggcgcacagtcaattttcaattgccgagcgtgaacagatcttaatgacgttgccggaactggttcagcggcaattgcaggcagtcaatacctttactacgacagaggttacgagtcacctcagcgctgtgacccaacctttcttcattggtcagggtgggcaagatgaattaattgatgcgacggtggcgcgacaattacgtgatcaattaccacaagtaccagttgattttcattggtatgctgatgctggacacgtgattaccgtcaacagtgcgcatcaccaattggaacaagatgttttaacatatttaaaaactatttataaatgaggtaaataatgtcagaagcaaacttacaagaacaaatcctgacttttttgcaagctcatcccgatcgcacgtatagtgttgaacaactaacggatgaattgcattttacaggcgcaacggcgtttacttttctagtaaaggaacttgcgaatatggaacgtaaaaaattagttagtaccgatgatcatgatcatttcaagctggtccaggaaacgaagactgttgaaggttcatttcatggtaatgacaagggctttggtttcgttcgttacgatcccgatttgcctgatatttacattaatccggacaacacgcagtttgccattaccggtgacgatgttgcggttgaaatcattcgaccagcccgtcccggttccgaccgcggccctgaaggtaaaattgtcagcatcgttaaacggaactatacccagattgtcggtgcgtatacaccaagtacggatgaagacgggattattggttctgtggaaattaaggataagaaattatccaaatatcagttattaatcactgatcagggcttacaccccactgagggggaagtcatcattgctgaagtggctgcttatcctgacgctcagcatccaacgcggatgattgggattgccaagcaggtcattgggagtgttgatgatcctgggatggacgtcttacaagtggtctaccaacacgacgtcccatcagtgtttccagaagaagtgacggatgaagccaaccggattccggattacgtgactgatgaagaaaaagttggtcgggtcgacattacggaccagccattagtaacgattgatggcgccgaatctaaagacttggatgacgcggttgttgcttggcgcttgccaaatgggaacttccatctaggcgttcacattgcggatgttagccattatgtcaccgagaactctgagttagaccgggaagcattcaaacgtgggacgtcagtttacttaactgaccgtgtgattccaatgttgccacggcggctatcaaacgggatttgttccttaaatcctgatgttgaacgattagccatgagttgtgagatggagattgatcaaacgggggaaatcgttaaccataagattttccaaagtgtgattcggtcacacgcccggatgacttatgacgctgttaatcagattctcgaagcccatgaccccaagactcgtgaaaagtacgcggacttggtcgacatgtttgatacgatgggcgacttacaccgtatcttgtacaagcatcggcggcatcgtggtgcgatcgattttgatgataacgaagctaaaattatcgttgacgaagccggtcatccaattgacattcaattacgggtacgtggcttagctgaacgaatgatcgaaagtttcatgttggcagccaacgaaacggttgcaaaaaactatagtcaacttaaggtaccgtttatctaccgggtacatgaaacgcctgatagtgaccggatgcttagtttctttgaattcgtcactaactttggtgtcagtgtcaaggggagttctaaggatgttaagccgaagatgcttcaagacgttttgaagaaggttgctggtaagcccgaagaagccatggtctcagtcatgatgctgcggagcatgaagcaggcccgatacgctgaccagtcgcttggtcactttgggttggcggcaccgtattatactcactttacgtcaccaattcggcggtatccagatatgatggttcatcgtttgattcgccattatgctgaaaacggcactggtgaagaagcccgggcacgttatcgggataacctaccaaatattgcggaaacgacttctgatcatgaacggcgggggattgatactgaacgcgacgttgattcgatgaagaaggctgaatatatggctgatcacgttggtgagacgtttgaagccgttgttgattccgttatgaaattcggtctgtttgttgaactagaaaataccgttgaaggcttagttcatatcagtacgatggacgacgactactacgaatacgttgaaaaacaattagcgttggttggccgtaagacgaaacggacatttagaatcggccagcccgtcaaagttcaactaatgcgggtcgataaggatcaacgagaagtcgactttaagttattgaatcctgaagaagcgccaaagactgatttattgccaaagcgggaacatcatgataactatcgtggtaataaccggcgtggtggcaataacggtaactaccggcgaaatgggaacaataataaccggaataacgaccatcgtggtggcaacaacaataaccatcgtaatggcaatagcaatggtcgccggaacaataataatcataatagcaacaataataatcataatagcaacaataataatcatagtactaacaacaatcggcggtcatcaactgatcgtcggcgttaatttttaagtaaggggatgtgcggcaatggccaaacaacacggtaagcacccagataccgccctcgctcaaaatcggaaagcacgccatgactacgctgttgaggaaacctatgaagctggcattgcgctgacggggacggaaatcaaatccgttcgcgatcggcgggtcaacttaaaggatggtttcgttcaagttcgcaacggtgaagcctggatgcaaaacgttcacattagtccgtttaaagagggtaaccgttataacgttgacccgttgcggtcccggaaacttttgttgcacaagaaagaaatcagtaagctaggtgcagcaacgatgactaagggtgtgacgattattccacttaagatgtatctcaagcatggatttgcgaaagtcttaattggagtcgctcacgggaaacgggaatacgacaaacggcaagatatcaagaaacgcgaacaacagcgtcaaatcgaccgggttatgaaacattactaggcatcgattacgttagcgttgcatcgctgcaccatacaacgagtatggcagcgtcataaaaaggtcttccaagaattaattcgattcttggaagaccttttttagtatgtgttgttggtggttctgtgccgtggacggacgacggcaagcatatattttatatgtactgatgtagtgctcactgttataaatgttctagatactagcaaaatagttatcaggctataaatattttgcgaaaggtcgggtacaagcacttgcgacttagtcggtaattatgttagcatataattgtattgatagttaaacgcgttatttattaattgattcaataaatataattgatgctaaactttggagaatgttattattctgatattaatcagatttagtataactcaaattgataataagttaattttgatatgatttattgcatggattcttggggggacatgtatgaatagatttataacgagcaagcagcattataaaatgtataaaaagggacgtttctgggtatttgctggtattaccgtggctacctttactctgaatccactgataagtcgagcagatacggaaacgacgaccgcagccaccgcagctacgaccactgctggggcatcctcatcatccaactcacaggttttaaggactactacgactagtacaacaggggcaacgactcagtctagtgcgacggcgattaatgcggcaacaacaaatactagtgctcaaaaaaaacaggcggttagtggcaccactactgactcaaagactgaacaaccggttacggcagtaggagaaaatgaaaacgcaaccagtaatctcagtacctctgattcggcatcagcaagcagtcaggctaaaactggttctggcgacagtttggaccaaacgtcaaacagctcagtaagtgtcgcatcgagttcacagaaagtcacaacacaaaattctgattatcaaaatgatcaaggaacgggctctgagagtggcattcaatctaatgtgacggacacggtggtggctgatgaatcactacaaactaatcgttcaagtgtcgcatcgccaagtactagcacaatggccagtattagtgactcagactcgaaagattctaatgaaactgaaaaagttgtggattcagaaactagtccgatagctgtaactgccacaactaatacaattacgacgactaacgataaagtccagttaaatcgggcactattagcgcgagccgccacacccgcaactgttgtctcaactgggactctgggaacaagtgcctggcagtacacagatgatggtgtgttgacgattcatgctggtgattggaccggagtaggtgatgtcagcgacgtaccgggggattttggcagtgagttaacgaaagtagtgattgatggtccaattaatgcggggactgatactagttatatgttccggtataatccaaatttggccagtattgatggccttgaaaatctggatacttcgaaagtcactgacttttcaatgatgtttatgggaactaagattgctgacttttcaggattagcgcattggaatgtcagttctggtacgtcctttgactctatgttcgccagtgactcgcgagttcaatcttatgatttaagtcagtggcagttgaatacggttcaaccagtgagcttaaaaagaatgttttcatttaacacggccttgatcagtattgttctaagtacttggaatgtgcggatggtcacggatatagatgggttattcaatggagataagagtttaacaacggcggatttacatggctggaacttgttgaatgttacagcgttgtcatcgatgtttttaaatgataccaatctcactgatcttgatataacgggctggcagacgggcagtacgttaactagtactaagtttatgtttgagggaacccctggattaaaggcaatcaacattgcgagtttggacatgtctaactttgcagcagtcactgaagctgatatgaataaggaacctgcagatcatgatatgtttttgaatcaagatagtagcgggaatccgttgcccatgaacctaaacgcattaacggttgggtcaaaaacatatttagtcggtagttcattgccagacattccaactggaactggctataccggtaaatgggtcaatcaagctgatgccacccagacgtatacgtcgagtgagttaatggctttgtataatggcgtcgataatccagccgatacaatcacttgggtctgggaaactagcccatcctatgctgtttcacgtccaagaatgtaaccggattaattgccgggccgaagacgacgtggcgagttgccgatagtgttgcaacattaaaagatgtgaatgggactgatatttatgcgaccgctgacacagtcgtcaaagtgattagcgtgaacggcgatactgctgtaacgacggtcgacactcaaactaccggtacctatcaagttgacttgcagtatacggatgcgtatggcaaagtatggcagcaaactagtacggttgcggtagcggtaaatcaaggcaaactagttggtaaaccgttgacgatcaaaatgggtgctaagccaacgtatacgattaatgatttaatcgacacggataactcccgcaatgcggccggcgataagctaagtgccgacgaactcgcgacggctacggttacaggcttggatacgagtaaagctggcacacaaacggttacactggcgtatacggatgatgctactggcatggttcacacgacaaccactacggtgacgatggtcgcaactaaggccgacttaacaatgcgtaatagtaccatcattaaaggacccaaaaactcgagttgggactaccgccagtatgttacgagtgtcactgattttgatgggaatccggttagtttagacggacttaacattgtggttgatcagcaacctgatttaacgcagattgggtcgcaaactgtcacactcacgtatacggatacgttgggcaatgtcatcagcgtcccaactcaagtaacagtcgttgcttctcgggcacaagttacaaccaaggcgccgttaacgatttggcccagtgaggttgctcaattaaaagtcgccgatttggtgacaatcacggctgccaacgggaaccccgtcgatactagcaccgacctaacagatgtcacaatgagttcaattgacacgagcaagggtggcgcgcagaccgttactattacttatacggatgaagctggcaatctagtgacagcttatgccaaagtaacggttgaccaatcagatttgaagaccaagctaacgaatccaattgcggggcctaaagctaaatgggactatctagctggtttggaatgggtcaaggatgcaaatggaaagttgcttgataatctcgcaaccgctgatattaaagtcgttactgaacctgatttaagtgttgcgatggtcggccatgaccaaacggtgacactcagttatacggatgagttgggcaaagaacacttagtcactgcggttgtcaacacggtggcttcgaaggcgaagattacggctgtcagcgaccagatcatcatacctgatgaagccaaaaagctgacggccaccgacctggtcagtgagttaattgatgcggcgggaaataaagccacgaattttgacgatgtgacgatgagtggttttgatgctaaagctatcgggccacaaactgtgacactgatgtatacggatgcgtatggtaaccaaacgactgattcgacaacagtcaccgtggatttcgccacaatcactggtcaagcgacacacccaattgccggtccaaccgcgacttgggattaccgtgacagcgtcactcaagttatcgatgccaacggaaagataattgatgtcggcgatgctgacattacagccatgacgccggatttaactccggcaaaggtgggcaagcctcagacggttacgttgacctatactgacagtctgggtaaagttcacacaaccgacgtgattgtaacgacgacgctttcagaggcgaagatcacggctgttgctgaccagattatcatacctgatgaagccaaaaagctgacggcaactgacctggtcagcgagttaattgatgcggcgggaaacaaaatcacgaattttgatggtgtgacgatgagtggttttgatgctcaagctatcgggccacaaaccgtgacactgacgtattcggatgcgtatggtaaccaaacaactgattcgacgactgtaaccgtggattccgcaacgctaacgcttcagaatcacactcaagtggcaggacctaaggcgacttggaattatgctgataacatcaaagccatcactgattctaaggggcagtcgctaacattaagcgatgccaagattacggtcgtgcaacgtccagatttaagtgtggctggaacttataaaattgtacttgaatatactgatgatttagggcaagcgcacacagagactgccgatgttgaagtgacggcttcaaaagcggccattactgccgtttctaagcaggtgattttggcagaaaaagcgaccatggtaactgcgtcgtcactagtgtcgacactgtacgatgcggatggcgttcaaatttataattttgatgatgtgacgatgagtggctttaatgctaaagctatcggaccacaaacagtaacgttagcgtatacggacgcgtatggcaatcaaacgactgtttcgacgactgtaaccgtggatttcgcaacgctaacgcttcaaaatcacactcaagtggcgggatctaaggcgacttggaactatgctgataacatcaaagccgtcactgattctaagggacaatcgctaacattaagcaatgctaagattacggtcgttcaacatccagatttaagtgtggctggtacgtatccaatcgtgattgaatataccgatgatttaggacaagtacacacaaagactgccaatgtcgaagccacggcttcaaaagcgtccattactgccgtttccaagcaagtaattttagcggaaaacgcgaacatggtaactgcgtcgtcgctagtgtcggcactgtacgatgtggatggctttcaaattcataattttgatgatgtgacgatgagcggttttgatgctcaagctatcgggccacaaaccgtgacgttaacgtatacagacgcgtatggcaatcagatgactgattcgacgactgtgatcgtggatttagccacaatcactggtcaagcgacgcatccaattgccggtccagcggcgacttgggattatcgtgacagtgtcactcaagttatcgatgccaacggaaagacaattgatgtcgatactgctgacattacagccacaacgcctaatttaactctggcaaaggctggcaagccacagacggtcatgttgacctatactgacagtctgggtaaggtccacacgaccgacgtgattgtaacgacgacgctttcaaaggcgaagattacggctgttgctgaccaggttatttggcctgatcaagctaaacaactgacggcaacggacttagttgatcgtttatacgatgctgaaggccatctgattacaaattacgacaatgtcgaaatgagtgtgctggattccaagttagcggggcagcaacgtttgacgttgacttacacggatgttgcgggtaatcaatccgtcgcgtatgccaatgtgacagtcgaccaggcaaagctagtgacaaaaccaagtacggtaattgccggcccgacggcaacgtggagttacgaagccggtattagtcagctgacgaatgcagctgggcaacttattaccgtccaaccggggacaattaaagtgttgaacaggccagatctgaatgttgattcagtcgggcaacaacagctgatcacactgatttatacggatgagctcgggaaatcccagtcggtcacggcaatggtgacagctgaggcctcacaagctacgttaacggccaagaaagcagttatcctgcaaccggatgccgcggcaaaactaacggctaatgaccttgtaacgagcttaacggacgcctctggacaagcggtgactgattatcaaatcgttcagatgtctaagctagacgcgactcggccaggtgttcaacccgtctcattaacttatacggatgcggctggtaacgaagtaagtaccgttgtaaaagtaacggttgatcaggccaagatggagagtcagaaccggactcaaatctggggaccaagtatgacttgggattatcggcaacaattggcaactgttacggattcgcaagggcatcagttgaatcctgatcaagctaaaattacggtcataaccggcccgcaactgacggctaaaatgatcgataagccgcaaacggtcaccttgatgtacacggatgatctgcaacagacgcatactgtgtcagccactttgaccttaacggcatcacaggcggcactcgtgccacgtccggcacagattgtatgggccaaagatgcggggcaactgacgccagccaactttttgcaaacgattaccggcgcggatggcactcaagtgtcgtctttgaccaatgtcaagatgagtgcggtcgatgccagccagcctggtgcccaaacggtgactctaacgtataccgatgattacggcaacgaggtgacaacaactgcccaagtgacggttgatcaagccgccttaacgacccaaaccgctcgaccggttgccgggccgactgcccattgggattatcagacgaactttaaaaccgtgacgaatgctgccggtgaagtgattaatgtcggtgatgccaatcttaaagtcttgacaggcccggacttgagtacagccatggtggggcggcctcaagtcgttacgttcagttacactgatgaattaggattgacccaaaccaccacggcggaggtcacaacagtcgcctcacgggcgcacatgacgactagtgctgatcaggtgatctggcctgcagttgtcggaaaattaacggttgcggatctagtcactggtttaacggacgcctggggccagactagtcaaaattatcaaagtgttacgatgacgaccatcaatgctcaacaggctgggaaacaacaagtcaccctgacatatactgatgaggtgggcaacgtaaaaactgcgactacgacggtgacagtcgaccaagcagcattaacgactcagccacaaacggtcatcgcgggtccgactgccaagtgggattatcatcagggtattggaacgattactgatggtatgggccagccgattgcggtcaataatgccgctattacagtcgtggcgatgccagacttaacggttgcccatattgggcagccacaaactgtgcaactggtttacacggactcgctgggacaacaacaaacggcgttggtccaagtgacaaccgttgccacgcaggctaaaatcagtacgcggccagttaccgtgattgccggccctaagacgacctggtcactgaatgatagtgttgactggtcaacgagtttggcagcggatggcacgttgctgacagcggcgcagcgccagcgggtgactgtagatggtaccttgaacttacggcgggccagcaattacccactgacactaagttacatggaccgtgcgggtaatttgattactgtcacgacgagcatcaatgtattggctagtcaggcccagctacaagtgcgtgatagtcagttgaccgttggaaacgcttggactgctcaggataattttgaacgtgcaaccgatgcccagggccaagcactgacattagccgatatcgcggtcgatggtacggtcaacacgcaacgcgctggccagtacacgttgacttaccactatactgatgttgccggtaatcagttaactaaaacggctgtggtgaccgttgtcttgccggaagatgatcacattaacacgaccgaccctgacaacaatgatcatggtgagacgactaaccctgacaacaatgatcatgcaggtatcgctgatcctagtgaaacaccgaagccgagtgagcgacctaacgattcggatggtcataccgtcgactggggcgttgatgatcggattacgacaaagcaacaaccggccgcggctactcgtgcacagactaaggtcaagacgaccgctgagccagctctaccggccaacaatgagcatactagcgcagccaaagcagcagcgacacctgtgacacgagtaactgacacgactgctgacacactgccacagacgggcgagcgcgaccgctcagcacaacaaggcgcggtagtactcggattaacgggattattagggttaatgggattaggacgtcggcggcatacgcatgaggattaagcgtacgattggcgtgttaagttcatcgattagctaaaattgatagcgatttcttgcaacggaccgattcattttgaattggtccgttttgttaactgctgctgtttggacttaacggctggttgcgcgggttgatgaatctagtgtcaagtattcagttaagcagtgattaatgcttgaacaaaattttaaaacataaaaagggggtactttcatcagaatctttgctagaaatgactatttactttattttattaagtaaacagctgatgatagcgacatcattaaagctaaattaaaaaagtataaaaaattgaattggtcgcgagacatgaattatgttatattttatgacataccgttccggtaaactatttgaggaggtctcgtcgatgagaaagtggcaagttgcagttgtcatgttgttagcagcgttgggaagctggtttgcgattggtacccaggcccaggctaagacgtatacgattgcgacggatacaacctttgcgccgttcgaatttcaggtcaagggtggtaagtataagggaattgatatcgatattttgaaggcaattgccaaaaaagaaaatttcaattataaattaaaagcgcttagtttcggtgccgctgttcagcagcttagtgcgaaccaagttgatggggtaattgccggaatgaatattacggctgaacggaagcagacgtttgatttttcagacgcttactatacttccggggtggtcatggctgtggctaaagatagcaaggtcaaaacgtttaaagatttgaaaggtaagaccgtggcccttaaaacggggacagctggtgcaacctatgcgaagtcgattcagagcaagtacggcttcaaaatcaagtatttcaatgactcgaataacatgtataacgatgttaaggtcggcaactcggctgcttgttttgaagactatcccgtgatgtcatacggaatcaagaatggcatcgcgttgaagattgtttccaagcaacacgaggccggcgactatggtttcgcagttaaaaaaggtaaaaacgcggaactgttaaagaaatttaacgcgggtctcaaagcgattaaagcggatggtacttacaaaaagatcattaacaagtacttgaagtctagtgaagcatccttaacgggtgaagacgcaagcagtcggacctttattggcttgttcacccaaaacttggatacgattggctcagggttatggatgaccttggaattaacggttatttcaattattttagcgacgatactcggactgattcttggggtcttaggcgttatgccgggtaaacttggtccggccatctccagtacgattatttatattttccgtgggatgccattgatggtgttggccttctttatttacattgggttcccagacctgattgggcacggctttaagattcccgcgttcgttgctgggatgattacgttgatgcttaacgaaggggcctataccggagcctttgttaaggggggctttgccgcggtcgacgatggtcaaatggaggcggcccgttcactcgggttgccatactggacggctatgcgcaaggttattatgccccaaggaattcgaatcatgattccgtcgttcattaaccaatttattatcacgctgaaggatacgtcaattctatccgttattgggatcgttgaattaacccaaactgggacgttgattattgcccggaacttcgaaggctttaagatttggttaatgattgcgattatttatctgattatcattacgttattaacatggttatctaactgggttcaaaggaggattaactaagcatggcgaaagtaattgtcaaagatttgcataaaagctacggcgataacgaagtcttgaaagggttaaaccttgaagttcaagataacgaagtagtctgcatgattggaccatctggttctggtaagagtacgtttttacgctgcttaaatgacttggaagttccaacacaagggcaagttgtcattagcggttacgatctttctgacaaggggactaacattaatttggtccgtgaaaatattgggatggtgttccaacactttaacttatttccacacctatcagtgttacaaaatattaccttagcaccgactcaactcaaaaaggaaagtcaacaggaagctgagaaaacggcgcgtgacttacttgctacggtcggcttgtccgataaggcggatgccatgcctaagtccttgtctggtgggcaaaagcagcgggtggccatcgctcgagcgctagccatgcatccgaaaatcatgttgtttgatgaaccaacttcagcactggatcccgaaatggtcggggatgtgttggatgttatgaagaaattagccgcagatggtatgacgatgattgtggtcacgcacgaaatgggctttgccaaggaagtggccgaccgggtcgtctttatggcggatgggttgattcaagaaacggggaagcctgaggatgtattcgaacacccacaaagtccccggttacaagatttcttacaaaaagtgatcaacgtttaagtatcggctggtcataataaaataacccgtaaaataggcgcgctaagaattggtttaattcttggcgcgcctattctgtagtaacgtgcttgcatagcagatgaagcggtgttgctctgaggacgattaactagtgaataccgtgatatgggcaacttgatcggcacgtcaactttgatagggtgttaagctggcaaactagttatgccaacttaactaaaaacaacggtcatcccgaaacaggggtggccgttgttttatggctagttctatttagtgttggggcaccttattacggggtgtcaatgtataattactttcaccaaagctaacattgagtccctttttcgcaactggtgtccgcgcgcggttggtcggcttttgccagtgatccaggatcgccgcaatgcaaatacacagtggttctgtggattgatcagtaattgctaattcaaatgcttcaccgttagtggtgacaactggtcgcatcgtcatgattaattcagtaccatgataaacgcggtagttttcggcactcaagcttcccatgataatccagcgaagcttgcgaacatagagcatttcatgccagaagcccagcgttttactaatagaaccgacgttttgacggttatagtataaatcgaattttggcaacaatccgagggttgtttgtcgaatttcggcaagtagctcaccttggatcgcgtataaactgagcgcgtcttggcgccgcccccaccgaccaactaagagatagtgagattggttgtgcgcatcgcgaacaatccgggcaccttgggcgaagctattgcggctgaaatataatttacgcatcttcaacctccgttttccggaaactattgtttggcaagcacttctaagattgctttgccgacaccatcgttgacatttgtatcagtgatatagcgggccagctgtttgacttcgggactggcattacccatagcgtaacttacgccagctaattcgagcatggagacgtcattattattatcaccaatcgccatgacatcgctcattggggtattcagcatattcgcatagcgctcgactgcaatccctttttgcgcattaatattattgatttcgatatttgatgcggatgaagatgtgattttgagggacgaatgttttgccagaatttcatcactaaggggttttagcttagcgggcccttcttcgctgaaagcgataatcttcatgacatgcttagttggatcatccaataactcgttatagttgtccacgtaattgatgtccataagttctaagcgggctgacgcgagcgataccgcaattttgaacgttgtatctggattcaggttagttaggagatgtgcaatttgttcgattcgcttggctttactgttagagtaaataccatcgttgcctacgacttcaaaatagtaaccttgtgaggttagcgtgtgaaaaacggtgcgggccacgctattggttatgggcaccatgtcgagcattttgccagaagcgtcgtatacttcggcaccgtttaacgtaatcaaaggtgccgtgatgccttgagcggccagtagtggctgagcttcagaaaatcggcggccggtggagacgataaagtgcacgccttgctgttgtgcttgacggatggcattagcgttaaaatcggaaacgaccatttcattgttgagtaacgttccgtccatatcagaggcgataatcgaaatcatgttgtcacatccttagttgttttaataattacattctaacatgtttacgtctgaatacagaattattatcattagtggttttggttatgatacaataaaacgagaggtgttaaggatgaaagcgtttattcacacggactggtgggacgtcttaaaaccagagtttgagaagccgtattaccaccaattacacgaatttttgaaaaatgaataccgaacgaaaaatattcacccagatatgtataatatttttcaggcctttgaatggacgccatttgctgacacgaaggtcgttattttaggtcaggatccgtatcatggtcctggtcaggcacacggactgagtttttcagtgttaccgggcgtggcagtgcccccatcactagtcaatatctataaagaattgcaaaatgatgttgggtgtacgcccgtcaaccacggttacttggaaagttgggccaagcagggagtcttgttattgaactccgtgctgactgttcaaaatggtgtggccttttcacacgctggtaagggctgggaacgacttacggacgttgccattcagcgtttatcggaacgatcgacgccggttgtctttatcttgtggggtaaggcggctcggtccaagattaagctgattgatacccagacgaatgtcgtgctacaagcacctcatccgagtccgctttcagcttatcgcggattctttgggtccaaaccattttcaaaaacgaacattgcgttaacatccttcggcgaacagccaatcaattggcagttaccagagcacgtcaatcttgagcattaattaatttattggagggttatcacatggatttatttgagtcattagcacaaaaaattactggtaaagatcaaacaattgttttccctgaaggaactgaaccccgaattgtcggtgcggcagcgcgattagctgcagacggcttggttaagccgattgttttaggtgcaacggacaaagttcaggctgtggctaacgatttgaatgcggatttaacaggcgttcaagtccttgatcctgcgacatacccggctgaagataagcaagcaatgcttgatgccctcgttgaacggcggaaaggtaagaatacgccagaacaagcggctaaaatgctggaagatgaaaactactttggcacgatgctcgtttatatgggcaaagcggatgggatggtttcaggtgcaatccatccaactggtgatacggtacggccagcgttacaaattattaagaccaagcccggttcacaccgaatctcgggtgcatttatcatgcaaaagggtgaggaacgctacgtctttgctgactgtgccatcaatattgatcccgatgccgatacgttagcggaaattgccactcagagtgcggctactgctaaggtcttcgatattgacccgaaagttgcgatgctcagcttctcaactaagggttcggctaagggtgaaatggtcactaaagtgcaagaagcaacggccaaggcgcaagctgctgaaccggaattggctatcgatggtgaacttcaatttgacgcggccttcgttgaaaaagttggtttgcaaaaggctcctggttccaaagtagctggtcatgccaatgtctttgtatttccagagcttcagtctggtaatattggctataagattgcgcaacgatttggtcattttgaagcggtgggtcctgtcttgcaaggcctgaacaagccggtctccgacttgtcacgtggatgcagtgaagaagacgtttataaggttgcgattattacagcagcccaaggattagcttaaacggtcacttagtttgttaaacgagggaaacttcagagcttgtactttgaagtttccttcgttttttctataataagaacagttaatttggatgaggagttggaagaatatggaatcaatcacggtaacgtcgccggaagcaaccatggcaatcggggccaaacttggccaattagtgcaacctggtgatttaatcttactagatggtgatttaggtgctggtaagacaacttttacaaaggggttagcaaaaagcctgggcattcctaataacgttaagagtccgacttttacgctcatccgggaatatcgtcaggggcgactaccgctctatcatatggatgtttaccgcttggaagatggcggtgcggaagatttaggcttagatgaatactttgatggtgatggcgttagtgttgtggaatggtcacagtttattgccgacctcttaccgacgacttacttgcgaattgcaattagccgggacactgatgccgatgaccagcgggtaataaccttcaagcccattggtgaacactatcaacgactggttgatcaattgaaggagtgacaaccatggcagaagaagttgttgatgtacggcctgctgaagtcgcggatgcagcacaattattagcgctactagctcagcttggacgtgaaagtaatactttcactgttgatgaaggcattgaggatttgagtgaaacggatgaacaggcgcaaattgagcgtatcaatggcacaacgaccaacattattttcgttgcgacattagattcacggttgattggtgtgagcaccgtgcaagctagtacggattttagtgcggcgcaaggtgaagttggcgtagcggtacttaaagaattttggggcatgggtctggggactgctttgattgaggaagtcttagattgggcgcgtaactatagctcattggaacgcctcgtgttgacggtccagttacgaaatgtgcgtgccgtgaagctgtaccagcatcttgggttcgaaaattgtacggcaacgagctatgatgtcgttgacccaaccggcaaacgggttccagctattgatatgggaatctgggtttgaaatccgggattcgctgaactgacggcaaacaggttctgatagtagatgggccggaatttaagcgttgacgaaccaggtctaaccggcgacggcttgtgaatgattggctcatctcccagtcggttgggggaattgataagctgtctacgagtattgataatcggtagcgatgcgtaaacaaaaaagtccagcatcttattgctggacttgcataaatttaattttaaccctgaacgcgaacgaaaggtttgagttgctcagttccaaaagcttgcgcttcggtgagtaaaatgttggcgcaagctaggctgtcatctagtgcattatgatgatgctgcaggtcgatatccagtgcttgacagactgtatccagcttgtgattaggcaattctggatagaaccgttgactggtcttgacggtatccatggataggtactccggcgcgctgatgccgtagtgggcaagcgtattgcgtaacacaccaatatcaaaaggcgcgttgtgcgcaattacgaggcggtcgcgttggaagaatggtgcaatgtgttgccaaacgtctggaaacttgggcgcgtctgcgacatctgcttcatgaatcccatgaatttggacgttccgccagaaaaaatcgctctctggtttgatgagtgtgtaaaattcatcgctgatttggttattacggacaaccgttagcgccagtgaacaagcactgtcgcgtttcgcgttcgccgtttcaaagtccattgcgacaaagttcaaagttgccaccaccgtttctaaagaataggattatcgtacaaagaatctcgttaattttcaagttaatggttcggaaggataatatcgagttccactggacagtgatcggaaccaaaaatttcattatgaatgcgggcgtttaggagctgactgtctaattgctgtgacgtaataaagtagtcaattcgccaaccagaattgttgtcacgtgcatgcccacgataactccaccatgagtaaatgtcggtttggtcaggatagaaatgccggaatgtgtcggtatagcccgctgcaaggaggcggtcaaacttggtccgttcttcgtcagtgaagccggcactatggtgattgctacgccagttcttcaagtcgatgttttcgtgggccacgttaagatcaccacaaaagatcaacggcttgttggcactcaaactgttaatatatgtgagaaaagcatcttcccactgttgccgatagtcgagacgttttaattcaccgcctgaattaggagtgtaacacgtcaagacgtagtagtccgcatattcaagggtgatgacgcgaccttcgtcatcgaattctggtacaccgataccataagttacattgagcggctcgtgtttggtaaaaatcgccgtacccgaataacccttgcgctcggcatagttccagtattgataataacctgggaagtccagttcaatttggcccgcctgtaatttcgtttcttgtacacagaaaaagtcggcatcgagctcattaaaagtcatgacaaagccgtgtttgacagcagcacgcagtccattaacgttccaagagataagtttcacgtgagtttcagacctttcaagtaatttactcatattgtaacacggcagccactggttattttaatgacaattgaatcagtgcgccgtgattaaagccagacacggcggatagatgtgcgatagggtgacaaagcatgctggtgtctttggttggcctagtttcagcgcgtccgagcgggtatctttggctttcagtgatggcacgtttttccagctaacaatcactggcatgaattggacgctgaatgatttaaatcagtgtgccacggagcaatcagtagtagctaaaagaagattgatgataaaattggaggaatatcgatgttaaaaattggggtcattggtttaggtaacattgctcaaaaggcgtatttacccgtcatggcggcgatgcaagaccagtatgaatttcatctaacgacgcgtaatccggaaaaacgagcacaactagcgacgatgtatgggtttcaacacacccatgcgacccttgaggaattaatggcagttaaaccggcggccgtatttgtgcatactcccacagacacgcatgcagcaatcatcaagcagttgttattagctgggattcacgtttatgtcgataagccagtcgcgactgatcttcaggtggtccaaagtttgtatgatttggctgcggcgcggcacctgttattgacttgtgggtttaatcggcgttttgctccttttaatcagcaattgaaggcattgcctgacaaacggatgttagtggctgaaaaagttcgcgaagtgggtagtcaagatcctgaaacggcggttttcgacctgatgatccacatggtcgatacggggctattcttgttagatgaaccacttgaacacactagtggtcggttgacgacgacggcaactggcgcgttggcgcaaggctatttgacggtgcagacggctcatgagcaattagaagttatcacgaatatgtacggtggggtcaatctggaacaagtgacagtccaaacgacggggcaacgtgcgtctgtgactgatttaagtactaaaaccgtgatgacgacggcaacaactaccacgacggcttttccggattggacaccgacattggaaaagcgaggatttgcaccgctgatccgtgcttttctgacggcggtaacaacgcacgggcctaatccagtcgacccaactggcgcaattaccagtcacgcggtgtgccgtcatttattaagtgattaaaaagtgctaaaattaactgataggcttacaaatttcaacctgattatatcgtttcaatagcgtttcaatgctgcggtgcttgatacgtcggcctaaattaaaaacgctatgcggttaaagtgattattaacgtaagtgaattaaatcgaaacacgaaaggaacttttcaccatgaccaaagatgtcttggccacttttccagccatcgaaattaaaaaaaatgaatcactaagtcattatacgaatactaaaacaggcggtcccgccgattacgttgcgtttccaaagtcaatcagcgaaacgaaagctctgattacgtttgccaatgagcaaaatttaccactaaccgtgattggtaatgccagtaatttgattgtcaaagatggtggtatccgtggattaacgatcattctcacccgcatgaagcaaattcatgcgagtggcaccaaagttgttgctgaagcgggtgccgcaattattgcgacgactaaggttgcttgtggggctagcttgactggtctcgaattcgcagctgggattcccggtagtgtcgggggtgcgattttcatgaatgccggtgcgtacggcggcgaaatgagtgaagttgttgaaacggtgacggttttgacgccagcgggtcagcttaaaaccctggatcatgacgaattagattttggctatcgccacagtacgatccaggactatgatgatattgtcgtatcggtgacgtttggtctcaagccaggtaatcagactaagattcaagcgcggatggacgaattgaatacgttgcgagcagccaaacaaccgttggaatggccatcatgcgggagtgtttttaagcgaccaactgggtattttactggtaaactgattcatgatgctggcttacagggccatcgaatcggtggtgctgaagtttctaagaaacacgcgggttttattatcaatgtcgatcacgctacagcgaccgattatatggatatgattcactacgtccagaaagttgtatttgaacggtttggcgtccatcttcagacggaagtccggatcattggtgaagacgtcgttcaaggttagttatgtcaatttaacaaagggggcaaccactagatgccgattatcgaattagtgattttactggcatgtttagtgctgctgtcgaatgtattgagccactatctagtcgcaatcccggtcagtttaattcaagtcgggctgggtctgggagtggctttattattaaatgtacaggtaaaattgcaaacggattggtttatgctcgtctttattgcgcccatgctgtacaacgatggcagagaatttccaaaacaggaattatgggaactacgcggggcaatttttgcgaatgcaatcgtcctcgtctttattaccaccattctcggtggctttttgattcacgtattgatcccaacgattccgctcgctgttggaatcgcgttggcggccattttatcgccaactgatccgattgccgtgcagtcgatctcggaaggggtcaagttacctaaagaaattttgcacttggtcagtggcgaaagcctgattaatgatgcgagtgggttaattgggttcaaatatgcgttagcagcagcggttaccggtacgtttgtactcggtgaagctgttggggatttcttctatattagtctggtcggtttggccgttgggctggcgctgatcacgatcattcaactcattcgggacgtgttacgacgagagggtatcaacgatatcgtgttcaacgtggtgttacagattctcacgccgtttgcaatttatttcattgctgaagaatggttccacgcgtccggtgttgtcgccgttgttgcggccggggtattatcgcacttgcaaaattcacatgaaagtgaagatgcgccggaattacgattagtgacggaacgggtctggaacgtggttgtttacttattgaatgggatcgtcttcctgattcttggtattgaattgccggcagcaacgcaagcaaccattaaaggcgcgcatacaaatacgtttcatgcggtctttgacgttttaatcgtctgggggattttgttactgattcgggttgcttggacatacgcttacatgttgttcaactggttacgacatcacaagaaggccaaacctagtctcagaattgcagcattgtccggtttatcaggtgtgcggggggccattacgatggctggggtcttcacgattccaaccgtggtggcctcgggcaaagcctttccggaacgtgcgctcgtactgttcattgcggctggagtcatcattgtaagtttagttgctgctgcggctattttgccattgatggcggccaaatcactcccctttgttactcggggatccagtccggatgaagacgacgcggtcttggcagacggaacggatgacggtgatgatagcagtgggcaattaccacagttaacatacaagcaagcccgcatttatatcttacagttagcgattcaaaatattgaagaacatcggcggccagctaaccaacgtgcggcctatgatttgatcctggaccagcagtttcagattcggcgtctagaagtggcgtcgcagactgcggatgagttggcgccgatgctgacagatgaattggaacttcgcttagtggcactgaatggtgaacgggcagcagttagagaaatgattgccaataaacaaactagtaagttagctggacaggtctacttgcggcgtgtcgatcggcgcgaacaacgtttcttacaggcgacacatcgacaggggcttccgacactgcgctcattacggttgttgttgacgcgtgcaatgcaagggattcgactatggttagcacctggcgatagcgaagaattacgagtggcgttgttggatattcagcgtgaagcttctaaagctgctattaaagcgttgtcgcagtatctcaaacgggccaacgttgatgagcaacagtttgatcgccaggctctgtatcacttgatcgttcattaccggaatcgcatcgagaatgcgaaaaatgatcacacgttatcacgtgatgattatgaacaacagctgcatggactacgcatcaagagtcttggtgccgaacgtgcgggtgtacagcatttgttagagagtggacaaattagtttacgcaccgcggcaaagttacggcagttcattaattactcggagaacttattgatgctcaatgatattgaggccgatgaagattagttaactttttagattgtaaatcagtagttctaggttataatgatgttagagtagtattgacggtgaatggttaggtttgcaaattaatcattacttaagcggacgaataagggcagccttacagggggaaacatcattatgacagaatcagaaattcatgaacgcttcgtggacacttatatgcatattttaaaatatgtcggggacttcgtttcagtgccgacccggccgtataagataacgtttgaggcctacacggttatgcggatgattgcaacaagtgaggagccgctgacgttggtcaagattgcgaaagagcagcgggtttcacggagtgcgattgcacgtcaaatcaacgtgttattagatttgaagtacattgaacaaaccacgaatacgcatgatcgccgaatcaagtacttatcgttaacacctgctggtcataaagtggaacaggaaatcaccacggcttccgaggaacgttttcatcaatgggtccaagtctatggtgaaaaacgggcaagcgatacgttgcgttatatcaacgatgcggaacaaaaggctaccgaactgggtttcagtggcttcagtgggttgcatgataagcgggggcggcataccgaatatagtgatcctaagacgaagaattagctaatatttagttaataataagaaacaccgtttgaaccgattatcaaatcagttcaaacggtgtttttgattacgctaggacttatccggtgtttgatgaggaaccgttggcatcgtgaatcgccaagccgcgtagatgaggagttgaagtaaccacatcatcaagacaaaagcgagcatctttagcgaccacatttcaactaattgtttcacaatgtactgtggcgtaattagtaagtagatggagtgcagtcggaggaatcggccaacgtagacaccgacactagcaaataggaagagtgcggcacagatgataccacaactagcagggagtcgctggaagtgtaaacgttgggtcagttgctgggcaattcggtcaacgccccaggtaccaatgattgtagacaccatcattggcccaaccaagtaagcgaaatcccgccacatcggtaagtcgaagcgcaagagaccgttgatgccatacggcttcaataggctgaggtggaataaatcagtcattaagtacggtgcattcggatagaaaagcaaccaaatgaccgcaatcagccaaaataatagcgggctacgtcggggtgtcagccaaaaactcagctcgatcgggacataagccaaaattgaattaagtaatagaaaatggaacgcgccgtgcaagtcgactgctgcgaagatgaaaaatccccagaatgtgagtcgcacaaaccaccgctgtaacttagtcatttagtcacttcccttctggtactaattctaacagaaatattaatcaagcaatattaaataacatcaagcttaatatttattcaaaatctagctaaaaagcgcaggctctgctgaaatcgcaccgcgagaaccgggttgccgtgctataatgtgaaagtaaatgattttcatgaggaggagactaatgactttcaattggagcggtttgttgaccttacaaaactttgtccgactccttgacattcttgcggtatggtttgtcatttatgagctgattgtgttgctaaggggcactaaagccgtacaactgtttcgcgggatcgttgtcattgcgattattaaagctgtgagtgttttgattggtctggacacggtatcgtggattatggaccaaattattaactgggcagtcattgcaatggttattatattccagcccgaaattcggcgaggattggagcatttagggcgtggctccatgtttgcgcgtggtaagcgtcagaatgaagatgaagagcggatgattgccgaactggataaggccatccaatatatggctaaacggcgaattggcgctttaatgtcgattaagatggacacgggtcttgaggattatatcgagactgggatcgcattagatgctgatatcaccggcgaattattaattaatatctttattccaaatacgccgttacatgacggtgccgttattattcaagataatcaaatcaaggttgcggcggcgtacttgccattatctgaaagcaatctgattcctaaagagttaggaactcggcaccgtgccgcggtcggaatcagtgaggtaacggatgccctcaccatcgttatttcggaagaaaccggtgaagtgtcgattactaaggacaatgagctgatgcgggggatgacgcgtgaaaattacttacggtatttccgccaagtcttactaacgcctgaggattcaaccaagcaaaacgcgcttcaaaattggtttggacgagttttcggaggaggtccccgaaaatgaaaaaatttatgaatagcaattggtcaatgcggctactagcactgctgtgtgcgttggtgctcttcgcctacgttaattcgttaaagacaacgcataacgccagtattttgacgaatagttcatcgaaaacgacattgacatctaaccgtaaagtgaccattagcgcgcccttagaactgaacgtgaatagtacgaaatattttgtaacgggctatcccgaaaatattaaagttacgatcgaagggccgtctgctttagtcacaactacggctaacacgcagaattttaaagtttatgctaatttatctaagttggcagttgggcggcacagtgtcaaagtcgaagtcgatggcttgaataaagaattgagttatggacttagtcaaaagtacattcatgttaatattcaaccacgacgaacggctacttataaggtcagcgcagacttcaataaagccaacgtagcagatggttatgaagttggatcggcacggctcggaacatcatctgtcaaagttacgggcgccgtcagcgaagttagcaaagtcgcgaaagtcgttgcggtcgttaataccaacaagaatttagagaaatccgtgaaccagcaggctatcattgaagcattagatgccaacggtcaaaatttgaacgttgtcttgacgccttcgaccacgtcggtgtatattcccattacgcaggcgacaacgacgaaagatgtgccaatcgatttgaaagccagtggcaagaccgcggcggacaccagttattcattctcatctgacacgaagtcagtgacggttactggcacgaaggcggcattggcgaagttgaagtctttgccagtcaatgttgatgtgacgaatgttgattcaaccacgactaagacggtcgatgtttcgactagcgatgaggatgggatctcgtcagttagcccaacgtcggtcaaagtaaaaattacagttaaaaatgattaatcatgacacttttgaaatgaggtaaattataatgaaatattttggtactgatggtgttcggggaattgcaaattcaggcttaacacctgaaatggcttttcgtttaggtcgtgctggtggctacgtattgacggaacatgcggaaaacaagagtacgcaaccacgcgttttagttgcacgcgatacccggatttcgggccaaatgctggaagaagccttgattgccggcttgctttcagccggaattgaagttttacgtctcggtgtaattacgacgccaggagtggcctacttagtacggatccaagatgctgacgcgggtgtcatgatctcggcttctcacaatccagttgaagataacgggatcaagttcttcggtggcgacggcttcaagttgtctgatgccaaggaagaagaaatcgaagaattactggatcaaacgaaagacactttaccacggccagcagcggaaggtctggggacagttgctgattttccagagggtaatcttaaatattcacaattcttggaacaaacgattccagatgacttaagcggcattcatttggctgtcgatggtgccaatggttctaccagtaacttagtttcccggatctttgcggatttgaacgtggaatttgatacgatggctacggcaccagatggattgaacatcaacaaaggggtcggctcaacgcatcccgaagcattatctaaattcgtcgttgaaaaaggcgctcaagttggtttagcctttgatggggacggtgatcgttgtatcgcagtcgatgaacttggaaacattattgacggtgacaagattatgtacatctgtggaaaattcctcagtgaacgaggcaagttgaagcaggatacagtcgtcacaacggtcatgagtaacctgggcttatacaaggccttagaagcagctggtttgcacagcaagcagacccaagttggtgaccgctacgttgtcgaagagatgttgaaggacggctataaccttggtggtgaacaatctggtcacgtggtcttcttagactttaatacgacgggtgatggcatgttgactggaattcagttattgcacgtcatgaaggaaacgggtaagaagctttctgaattagccgccgaagtgacgacttacccacaaaagttagtgaatgttaaggttcaagacaagaaagccgctttgaacaatgataagatcaaggcagttatcaaggacgttgaagatgaaatggccggtgatggtcgcgtcttggtacggccttctggaacccaagatttattgcgggtcatggcagaagcgaagaccgacgaactggttagcgcttatgtagatcggatcgtcgatgtggtcaaagctgaagttggcattgaataattaagtgatcagaccgatcatcaaaaaagtcgttactcttagagttgcgacttttttgttgccatgaaacgcacggtcattgctaaatgcggttggcgcggtggcaacgcggttaactggcgactgtcaggagacccagtgcctcccaaaccaatttgaccgcaaaaaagttacaaaaaattcgaaaattcgtgatgcccttgatttataagcgtttgagattggtatacacgctaactaacacgtataccaatataatatattgttgacttttattacatgtaacggtaaagttaacttgtttctaggaaatataccaatcggaggttagactagaccaattgttaattggttaaagcggaatagcgccaggactttagaatctaaagttgacgaggatgacgtttatcgataatcgacgggtgacgtcagggactgcactctacaggtcaattacaaaaaccgactgtgaggttggtgacagatatattgaccacgcagctagaaacaattcaaacagtaaaggaagattaatttatgtgtggaattgttggtgtaacgggtaaagatagtgcagtatcaatcttattgaacggattggaaaagttggaataccggggctatgattcagctggtatctatgtcaatgatcaagatggtcatgactatttagttaaggaaaagggtcggatcgatgacttacgtaaagaagtaggcgaagctgttcatggttcgaccgggattgggcatactcgctgggcgactcacggtgaaccgagtgttgccaatgcgcatcctcaagtttctgcggatggccgcttctacttagttcacaatggcgtgatcgaaaactttgaagacttaaaacagacttatttaagtgacgtgacttttaagtctcaaacagatacagaagtcattgttcaattagtcgatcggtttgtcaccaaggaaggcttgagtacgttggccgctttccgtaagacgttagggctactcggccattcttcatatgggttcttactgatggataaggaagatcctgacaccttatacgtcgcaaagaataagagtccattattaattggggtcggcgaaggctttaacgtggtctgctcagatagtttagcgatgttagaccaaacgaaagatttcttggaattacatgatggcgaaatcgtggtcgttaaacctgatgaaattaaaatcacgaaccaggccggtgaaccagttgaacggaagccattccatgtcgacattgacgcagctcaagctgacaagggaacttatccattctacatgttaaaagaaatcgatgaacaaccgaatgtgatgcggaagctgtcccaagtttatcttaatgatgcgggtgatccaatcatcaatgatgacttgttaacagctcttaaagcagccgatcgactatacattgtggctgctgggactagttatcatgctggtctggttggtgcaaagttatttgaatcgttggctaacgtgccaactgaagtgcacgtttcttcagaatttgcatacaaccaaccattattatcagcacatccattcttcatcttcttgacccagtctggtgaaactgctgatagtcgtgaagtgttattgaatgtgaacgatcaacatttcccaagcttgaccatcacgaacgtgccaaactcaacgctatcgcgcgaagcaacgtacacgttgttattgcatgccggcccagaaattgcggttgcttcaaccaaagcctataccgcacagattgccttacaagccatcttagctaaggcgttaggtgtggccgttgaccaaccagctgcaacagctttcgacgtaaaacagcagttggcgttagtcgctaatgggatgcaaagcttagttgatgaaaaggctacttttgaaaagattgctaagagtgccttattgaatacgccaaacgccttttatattggtcggggactggattacgccgtctcattagaaacggccttgaaactcaaggaaatctcttacgttcaagctgaaggtttcgcatctggtgaattaaagcacggtacgattgctttgattgaaaaggataccccagtgattgggattattacgcaaaagaataccgctgggttgacccgctccaacttacaagaagttgctgcacggggagctaagacagttactatcgtcaccgatagtttagctaaagatggtgacacggttatcttgccaacggttgatgaacgattaacggctttgcttagtgttgttcctggtcagttattggcctactatacgagcttaaacaagggcttagatgtggacaaaccacggaaccttgccaagagtgtgaccgttgaataatttaaagtaagtgtgtgggcaccaagaaacgtcaccgttcgattacggtggcgttttttgattgcccacaaagcttttgcataatttttaactgctgatattcataaggctattgtgaaagttgacgatcttttggtatgataaagtaagcggttgcgataacacaactaaataattagactattggggatgaatggtcatgctgaaatataaatattttgcacagccaattaataaccttggaaccaaccgaacaatcttgtatgagttattattacgacagtgggatgagaggcaacaaacttggcgaataccagcgacctttgaaatagcgccaacagaattgattcaattgctggattgcgctattcaagaattaaataaccatcatgtttccatcaatttaacggcgcgtcagtttgctaatcctgactttcaagttgcaattagtcactatgtgcagacgcatttgttaccacgagaactaactgttgagctagttgcgacacctgagctaagtgagttacagcaattaagtgttgggtaccgggcagctggtatattacttgcttttgatgatgttggttctgataacctattccaacagatcaaaatgatgttgccatatgtgaatacggttaaattcgcgttacaaaatatgcgaccgctggggaccccaactacggatgcaattgtttcgacgctcaaattttggtttgataaggcggaggaacagcaaatgctatttacctttgaaggcattgaatcagcggctgatgttcaactggctaatcatctaggcattacgcgagggcaaggatattattttgccaaaccgcaactacccgcgacatttatggcatgacaatagtggtatgctacaatagtattcgtagcaatgtaactgagtgtcatgttgatgtttaatcggctgaatcacatgacgagacgaggccgattttgttagtaaatgataaaagatggggtggctacttgtggcaatcaatttaattgcaactgacttgaatggaacattattgcatcaagatcagcgttttgacaaagaacggtttaaacgggttttggcgcagttacgggcgataaacgtttccctagtactttcgtccggtaaccaatatgcccatcttagacagttatttaaagatgttatggcggataatcttatcgttgttgctgaaaatggggcgtcgatttatgcccaagaccgcttgatctttgatggtagtctttcagcagaccagcaacgaaagtttgtgactgttgatcgttaccagccactattcaaagacgcatacgtaatcttagttggtagccatgggtcgtatactgagttaggagcacctgataagttagtagcgatggcccgtcagttttatgatcatttacacttggttgcggatctggccactgttgatgataccgttaaaaaaatcagtatctcaacgtcaccggaccaggctgctgatctggtggcacgagctaatgattattttgatggcgagttacgtgcgcatgatagtgggtatggcgtcgtagatttggttgatcagcgggtcggaaaattaccagcaattcaattcttggcgactaaacttgggttaactgcagctaatgtgatggccttcggtgatggggcgaatgatgtcccattattgcgatatgcagcgcacagttatgcgatgtgcaacgcaccggcggacattcaagccgcagcaaaacacgtgacggccctggataatgaacatgatggggtattagcaaccattgaacaagagttgttaaataattaaaagcctataactagtcagtaaaaagctgagctatcgaatgaacatcgttattcgatagctcagctttttgggtcctattaaagtgattgattagggtagaagaattgatgaatgccataagtgttgagcgaaactaaacgctgctttagttcagccaaagttagtcctaaatcaccattaaaatagagccggaaaaaggttaaattgttgtggatcaaaaagcttgaacagaccttagcatcgattgcagataaatgatagtttgtttgaatcgtcgttgtaagccctgctaccacggcagcgtggattttccgagacaaaaaactgtaatcatcattcaacaaaatgactcggtgaaaagcttcagattggcgaaaataggtcactaagcgatcaaagattaagccgggttggctaatgtttttcttgaaaccttgcgggtcaatgagtgctagaatcttatcagcaccttcttgaacgaacgtttccgctaaatcgtcaatggaatcgaaatgtaaatagaaagttttgcggttgatattagcgacacttgtgagctccttaacagtaatatcacgatagcgcggatactttaaagcaagcgtccgaaaagcctctttcagcgcagtctgggtgcgctgaacacgtaagtcagtagctggcataatctgattctccttattaattacatttgatggggtggtcattattaaaccgccgctaaatgtactagtcgttaagccacatgtgggtattattatcataatagcacttattttgatagttaactcgtcctgagtcatgacagattaactcgcgcaacgtgcataatagcatatgcgcctagtaggtaaatggtaatgaggccatgtccgtcgactaaaatgggttaggagattttcgttcagtcaatggtatggtgtaacgcattattagtgagtcaaaaaagctcccagtagtttgcattctgggaggtcaatttgaatcattcttgagtggttagacgtcgtaaatattagaaaaacgataggccgtttggtaggttacaggaatattaggttcgataatgatactgccaaattccttgtggtgaatagcatccggtaatttttgtgcttgcagggaaagaccaagttgagaacgcatcggtttaccgccattgagtcgataacgatcatcacggtaattagttgcactggaaaccacgactgccggagcgttcgttcgcatcgtgactttgcgtccactgatgcgatctagtaattctacttgtggatatggggtgtcgtttaagacgaagccgtgatggagcccgcccttgatgttagcaacctggggtccaacctcgactgggtcacgaaaatcaaatggggtgtcggtgacccatggcaacttaccagttggaataccgtgtttgtttaacgcggcgtactcgtctgcattgattttaagaacatggtggtcaatgaggcgttccgcatccccacttagattgaagtaggtatggttgctggggttgaataaggttgttttatcacttttaccagtgtagctaatagtaaatttaccgtcgttatctaatacgaaattagccgtgatcgtcattgtcccgggatagccgttctcaccgtccaaggtaatatattgcatgacgagtccaacttgatcactagtgtgcagtttacgttctaaaaaccatggttcaaatgaaatttgaggcatattaccaccgtttagatgattttcgcccgcattttgagttaagtcatactgccgccaccgggcatttttgatgatccccgcaacccgagcgatggttgcaccgaaaaaagattgataggtgatgtagtcggcgccgtcgtcaaatcccaagacaatatttgcaaaattaccatctttatcatgggttttgatcgcggtgactgtggcgccccagtccataatagtgacgctcatatgatgattgttcactaatgtataataattaatcccgttttcctgatgctcgattattttcataatgccctcactcccatagctgcctgacatgttaccgcctacttttagtatatttcattcttaaagggaatgcgaataataacccagcaagtgttaatgcgagagtgacagggttagttgctagtgaagtcaatttaaataaccagtgtaaataattataattgattgttgataataattaaaattatctaggttgagaagtttgttttaaatcttggtaattgtgaatggtaccaatctattaaataaggtgaattaattaactttgtgcaagtaaagacggcaatttagtggcgaacatggctggctgagggtgttagaaaaagattaatgagtaaatagaaataatttatctatttattttgactaactgttgacaacgcttacaatatcgcttattcttagtttgtaaggtatttaattaccttctaatcaattctctttctctcttatgccgaccactatctgcttggatagtggttttttgagtgaaattagcgaattgatggcggaccagatgaagataaggctctcttgtaatttttgaagattgatgtttactcagaaaaaggagtgctcggctgatggtagcattttggggctgactgagttagtttagtgttcatcaagtacaggtgattaggcataccaagcctgatcacctggcaattactggtcagttttgacacgactgccaaccccgcttatactaaaatgtgaagtgagggattgcagttgaaaaaccatgaagtattagacttaattcaagaaataacacgtaatgatgggacctcatacatggagatcggaaacatgttgatgaatggccgcgctgagttagcagctgaacgtggttttattaagcaagtgcggatattacaactaaacattccgcattccacgcatgttgccaagtatgagcaatatattaatgaaacatttacgattcccgatgaaacgatggatcattgggaagaatggacaaaaacacctgacatgcaagctgaggtcgatctgattttgaaagaaaatcatattggctaaaagctgttagccaaagtctagcgcaggagtgtgagtttatcaaacggcggttgttttttagtaggcgttggctcaaaagttgaactttcagaatgtcaattctctaagctcagcttttttgtttggatcatgtaattgactgattgtggtgatttaattgcgggtgcgtggtgggggaaaataacttacaaacgctagtatcagtgttattatcaataagcatgtttaaggaggctcgttattaaatgaagaatggggcattgctacaatttattcaaagtcatttccagacccgttttcgttttcgtaacgcgtttgagacccaattgactgttcagattttaagtcgattaattggcgaacatccggaaagtttgttattgactcggcgagatgttgaagcgttggcaggctgctcattggacgcgccggcactacagcgagaatattttccgcagcgtgcgatgacactgttagaaatggcgttagatgagctggttacgttaagtgttatcatacaccaggatcagggcaggacccgttatcccttatttcggagcgtacagcttgatcaagtgtgtcaacgaattgtgtttaacttgaacctggacgtgttgccacaattaacggactggtcacgggaattacaacaagaacaggagcgattttaagtgacaaagagtgtgattgaaaccttacaggaccatcgaacgcggcgacaatttaccactgaaccaattagtgatgcgcaattcgcgcaaatcatcacaacggcacaacaaatgccgactagccaatatttacaggcatacagtttgattgagatcactcagcctgcactacggcaacaattggccacgattacgacgatgccaacggttggtgaaaacggccgtttattagttgtggttgcggaccaacaccgcaacgtcaagctagcaccgggcgcaacgacgcgtcgggcactgagtgaatttgaccgctttgctggtagtattgaagatgccacgctgattacagcggcgatggtgatggtcgctgaaagcatgggtcttggtagcgttgtacttggatcaattaacaacgacacgcaggcggtgattgacgcactgcacttgccggacttgacgttacccgtctttgggttgcagttagggcacccagcggatgttcctgaaaagaaacctcgattagggttgcccgctgtgttgtttcaagatacctatgctgagcctgcgagttatcaggcggagttggaccggtttgatggcgttttgaatcagtattatcaacatcggagtagtcacgcccgtacggaacacttagcgcacatgacgcaggaagcgacccactcagcggccaaacggcgagagtttttgacaatcgctaggcagcagggctttttgccggaattagaccaataatcgttaccataacactaataattagaatggctgaacgaaaaataaccgttaatgtaacgctcccatgtcgctattagctgacatgggagattttttggtacctgggaggacgaatcttaacattaaaataagattagatattgttatttttactaattataatataattaattctgagacgatgtttactaagcaggcccgggctgcgttgcagattcgagtgaaagctgagtcgatccttattctgatgtgtgatagtaacattgttgcaaggcttgaaaggggcggataatgtgatcaatgccaacttcagaaaactcgtcttagggcgagcagtgggtaacgctggtgacagcatctacatgattgccatgaactggttcattctccaattgaccaacagtgcgttgtggatcggcatcatgaatgtggctattgttttaccgggcgtgttgttgtttctgtttggtgacagtatcgaccgacattctaaacgccgattattagtcgcggttgaattttcacagttagtgatcgtggtcatgctaattggattagttgcgttacatattaagttgccaggtatctatgtcgggctggtattcgtcgcggccctttttggatcactagcttatccgattcaagatacattagtaccgctgctcgttgagccagaccagctagttcaagcacaagcggacatgtcaattgcctacaagggaacggattacgtgttcaacgcgctgtctggatttttgatcagcctctgctcagtgctcggtgttttaatcatggatgcagccacgtttgtcgttaccgttgccacttttaggcggatcaaactcgctgaaccccgtcagcaacacacgcgggaaaagtccttgtatctcaaccagattttggttggtttcaaaattatcagcactgatccgctgctgcgtttattgacgtttgcgagcgtcgtcatgaatttcttctttggcggtttgaatacgtacgtcgttttatttgggcggcatttcggtgactcgatctactacggtattttggagtcgatgtcagccgttggaatattattagggatgacggtagtctactgacagttaaaaaagttgaccgttcggcagtcttacctcatcggcaactttgggcgcgcgttattcatgatcttgacagtagtgtcgtacaaccagttctggctgtttgccatcatttacttactgagctttgtctttcaaggactgacgcaagtatttgagacaccgatgattcaagcgatggtcggttcagaccaactcgggaaggtaatgacctgcttttatacgctggtttccgtgaccttaccgctgggttcgctagcgttttctttcctagctgaccgctttgatttacggctattcttattactatttgccctcttttatgccggcatattcctgctatttctagccagtcacgccttcaaaaaagtagacgaactacaattatcataaaccccacgcgatattcattaatctgtcatcaatcatgattaaaacgtgccaagtttttaagttcaaaagcaaccagcttagacccgctggaaaaagttcaggttagcgtaaacttgcttagttagtgtgtcctatgccgacttccaggcatttctgccaattgccggaacgtggtgggcacagatttaagccgaagcccacgtcttaaatactggcctttcactaaccaagcacaagacgcttgctaagtgaaatttcaccactgggcattgtcagaaacgccttccagtcgg

SEQ ID NO: 721 - DNA, 5589 bp, Unknown
  Metagenome-assembled genome
tctggttcggtgactccgggtttctcgggttcggtagtcccaggtttttctggttcggtgactccgggtttctcgggttcggtagtcccaggtttctctggttcggtgactccgggtttctcgggttcggtagtcccaggtttttccggttcagtaactcctggttcctcatcttcatcgggatctgttggttccgaaatacctggattttcgggaacgtccggttcggtgactggccgtgaaatcgtggctgtcgcggatcccttgttgccgttcttgtcagtataggtgacattattttcaaaagttgcgtcgccagtgggttcgttagtcttagtttggtaggtcaaagctaactctgacgtaaacgaccctgtggcattaaacgtcaattgattaccattcacgctcgtattgacgggaataatattacctgtctcatcgcgtaggacggcgctgccattgacatacgtttggttcggactcaacgtatcaacaaaggtgggatcgacgagctgattgttattaggcaagacacgaattgtccagttgatccgccgtggattagcttcgtcagcccattcagctgatttctctaataaaattggggctaagttaccaggatgactaggaacggttccgaaggcgtccaattgaacaaaccctttccgattacgtggtctggtttgataggcctgattaaatgtgacgagacccgtatgtgcgccggcagcaatgaagaaggttccgatggtacctgcagtggttcctttcattggaaaagcctcgtcatgcggaatacgaacgttttcggggacttggaaagccatcgtgtcgcccgccttgatcttgaggttatcagggatgcgccagttgtaattgactgtgtattcttggtcttctggcaattgtgcatcgtgagccattatcttgcccttactatctttgataaccgcactattaacatcgttgcccgttgcttcaattacgttgcgggcctgactaactaagggtggcccgaacatcaaaaagaaaattccagtaagtgctaataataaccatcgccattttttgcgcatggtaatcgcctccattaagatatacccatacattaccaccgttgtacataaaaatcgctgacaaaacaccgtttgctagcttaactaacggtatgcggccagatttagcagacttttttgtgattgcgttattaactgatatgtgatgttttaggataccagaaaagacaccatttgccatcccatccaagggacgtaagggtgtccgaatcctgttaaattagaagtgtggcgtgcttcaggttgattggcagcacgcctcgatgaattgatcagttgccgtacaagaactggatgatgagtaagtcgacctgtggattgatatgcaacattgagtggctggcggtcaggggactaccgtgaatgatttgggtttttggtgaccaaccagctgccaataattgatggctgaatttaagtacggcttgtaaattgacgccgccatcaccacttgtatgccaaacatggccggcaatattcaatatcggcaaggaccgtggtaaccggtttaactgctgagtggtcaagcccggataggtcgagccaatggtcacaaacttattgatttgtgcgcgctgggggacttgcgctgtcagataatcaaagatgatattacctccagatgagtgaccgacagcattgtagcgggtcacgtggtagcgttttgcgagcccttgcatgacagtagcaaactgccgagcttgacgtttcgcatgatgattatcggcaaagataacctgaatcgttgggttgtttttttagtggtccgaactgttggacggtcacgtggccggcgtgactaacatggacgaccaatcctttcgtcatcaggtgtgccgcggttaagcggtgcacaaagccgtcggtagaaaatgcgcgcgcgtaatcgccaccgacgaagatggtcggaatactcgtttgggcgacccgcgtttttcgtaatggggtcaagcgatgttgccaataggatccaatccctacgaccagggccgcactaataatggccatgattttaataattttaattcgtcgcatcactgatccacctcgcctttgaatcctattatagtcgaattagtaaaaattgcttttgcaaaccttcgccgaatccactagaatgagaagcaataagtctacatagaagagagctgggaaacgatgagtgcagaatatgatttaacaattattggtggtggcccggtcggcatgtttgcagccttctatgctggtatgcgtaatgcacgggttcagttattagaaagtctccccgaattagggggtcaggttcaggctttgtatcctgagaagatcattcatgacgttgcgggatatccggcaatcaagggccgcgaactggtggcacaacttgaaaagcaactcacacaatttccaattgacattcaattggcgagcccggtgacggatgtcacgggagcgatgggtgatttcacgattaccacggcgagtggacagcagtcacattccaaagcgattatcgtagcgactgggagtggggcttttgaaccccggcgcttagcagtcgataatgcggctgaatttgagaataagcaattattctaccacattccaagtgtcaagcaatttgcggatcgaacggtactagttgcgggtggtggcgactcagccatcgatatggccttgatgcttgaacccgttgctaagcacgtttatatcatgcatcggcgtgatcggttccgtgggatggaacacaatgtggacttgttaaaagcgtcttccgttgaaatcaagacgccatttttgattaagcaacttgcagagacggctaccggacagttacagctgacgatgaaagaggttcgcggcacaactgaagaaacattggccgttgatgatttgattgttaactatggctttatcgcggataataaagtcatccgaaactggcacgtgaccccaaccatggcccaccgactcatcaccgttgatacggagatgaataccgacgtacctgggattgcggctattggtgatacggtgacttacgcgggcaagttaggcttgattgccagtggcttcggggaagctcctaacgcggtcaatcagttaatgatgaccttgtatcccgaacgacggagtccactgcatagtacgaccgtgtttgaaaaaatgtaagtttaaaagagctgcgatataactggcgctatacaagcaaatgggacgagaaaccgaatcttggcttctcgtcctatttgcttgttcctttaagaacccgctttattggcggcctgttgtaccatgaagtggtagaaaggcaaatgtttttttcaatctagatagctttggtgtgtcttaaaataaaaaaacaaccggtcgctccgactaaacttttacaatgtataagtttgtacaaaaaaatacacaaaatttactgaaaattgataacgataaagaaacgctgttgttaagtgtcaacgccgatgtgaaaatgtcgttttttgccgattaaaaaatgctgttttttaccgataaagtttacagtgtctcactgctcctttctttattttgtgcgttgaaacctgataaatcaggtcctccggaattatccttctttcaattaaatgatcttcattcgatatgatcgaccagttattcggaaactttagcgtgatgaaccacgcgatctaaaatggcgtagctaacatcttatctgaaaagtcgttccccacttagaaagcgaatattagtggtgtaatggtgactttccgttatcgtcctttcaattaactgaaaaaacagcttttagcgcccactgactccaattggaagataaccaatctcatcaatgattagaatttgaaaacgggcatccggcgtagcacttcttcgtcgcgccttgaactgtgcttttgaagcgttgttgtagaggtcgctacatcgaataacctgcgttgaaattacttgttacaccctcaacttccatggcggtgggctaggtgagttttacgacaccggaggtgccgacaaccaaaacgttttgattctcttgggtgatcttattgatcccaagtcactcaattatcccttggttaatccgcggattgataactaaagtcaaagtacagctaacgttttttacatatggaaaggggctgtttaattctcaaattaatcttttttgttcccggtatttaagctcaccgttgtcacattcgaataaggcatcactcaggacttgggtgcttccatcttgatgatccaataggtagccgtaaatgttttcggcgtaaacgttaactttataattgtctaaggttggtgtagtagaacgcttggtaattggccattttttctcactcatttcatcaaacatcttcaggttcggtcgacgtattaacatcaatgactcggtcatacattcttataaaggtctgatcggacaatctttccatttcatcgcgaaggtaagtaaatcttttcagtgaaataggggtgagaaacgaattattctccgttatcattcaaatgtataggtctgtcatcgtgtttttttacggttttcgtcaatatatcttattggggacggagtatttccgatttttgaaagacaacatgattccttgcataacgtccttgcgatggtttggctggccataggcatgcgaagtaagtcgtgatcaaatcatgtcgagatactctttttcttatcaagcaataaaaataaggcggaatttgagtcgcctgagacttctcatgattcagctgatcacacgtcaaatggacgatctcgggggggctaagtctagggctcttcaactcgtggtttaacctttgttcgctgagtaatttctggccagcgcctcaactttcctttggttttgtggccgaaggtcgacaagcattgcttgaaaccacgcgtccttagcgtagtcaacaacggttcattaaatccggcttaccaaattactttatgattgatcggacgacaacctttgttgtcaaccagatttttcttttcggcacaccccggtcccggtttgccaaaagcttagttaagcaatcaaaaaaggtaatttgggctgcgactgaaggaaaatttcatgtatttcattcgcgagttaccatctaaaacatataagaagatgttgcctttgacaatctctccagccgagacggtaaccaacgttaatcttctttccaatcaactgggctgaaagccctggcgaggtttcaatccggatagtggctttttcgtgccggcttttatcatggttcgacaactagtctctgagaatactttgcttttccttgatagccacgtttattgatacaagtagcaataaaattgccgttgccgaaacagcctctctagaacttttctcaatctttggtttttttgcgatatcgtcaaagttactctgcgcctaagggttgtggctgctcatcggggggcgtaagccctaaatgtagatctttttaccgttcgtgatcaacaccgatacgccgaccaattgtcagcgaagttgggctt

SEQ ID NO: 722 - DNA, 352097 bp, Unknown
  Metagenome-assembled genome
ttcgtagagtatcgggtgcgaccgatgctctttttttattttctattatatcaaaagcaggtctggaaaaatccgaagatttttccagacctgctttgtttctagagacttatgtcacagcctctaactcaaatgaacgctattggtttgctttgtctgaaatcgtggtgaacgtcatcgcggctaagaagtcggcaattcgttgcgttggctgcttaaagaattcagcgggtgtcccgtcgaacagaattttgccatcttcaacaaataggatcttatccgcaactgcgcgggcaaattccatgttgtgagtgacgataatcatggaatcttcttcctgagcgagggctagtagaacgcggagcacaccagcttcgagttcggggtctagcgcactagttggctcatctaacaagatgaattcgggatccatcgctaacgagcgcgcaatcgcgacccgttgttgttgcccaccggataattgttcggggtaggcgtcggccttatcttgcaagccgacccgggccaacaattctagcgcggactttttagccgtcgcggaatccttttttaagacttgcacggggccttccatgacatttttaacaacgctgagatggggaaacagattataaccttgaaagaccatcccagttttgcgtcgaatattgagaattgttttattagtcaacggcttagtaaagtcgatagtttcgtcattgaagtggtataaaccttgttcgggccgttcaagcaaatttagtgaccgcagtaaggttgatttaccagaacccgaggggccaacgatgacggtcgtctggtgttctttaaattcagtattgatatcggttaacgcctggtgattgccaaacgtcttatttaagtgttctaatttgatcattcgacaacctcctaattaagtggccgtaagtaacgtgacgtccgtttttccaagtagccttgtagccagctgagaatcgtacatagaattgcgtatagggcagcaaccagggagtacatcacaagtggttgataattttgagcagcaatttgttggctgacttcgaacatttcaataatcgtgattgaagcggccaaggaggtgtccttgactaagctaataaaactattggatagtggcggtagtgagactcgcgcagcttgcggcaaaataattcgtttgagtacttgtgacttggtcatgccaatcgagtaggccgcttcccactgaccttgaggaatggagagaatggctgctcgaatcgtttccgcacagtaagccccggtgttcagtgaaaaagtggcaatcccagcagtccaggggtcgagctggaccccatttggaaagagccctttgattttaaggtagggaagcccgaaatagacgataaagagttgtactagcagtggggtactccgaaagagccagacgtagaagttagcgatggcttttagaattaaaaaccaaccacgacgagtcgaaatcttgacgagggccgtgaaaatcgcaagtatcaaaccgagaataaacgaaataatggcaatcggaatggtatattttaaacccgctgcagcaatttgcggcgttgatgtgacaatgatgtgccagattgaatccatagggagcctcctgtaacaaattagaatttggtgctatgtatcccgccataatagcgggcaatggtacgttacttatcagtaacgttaccaccaaaatacttattggacaatttctttaacgtgccgtccttacgtaattcttggattgctttcgagatttgtttttgcatcttagggtgttgcttagtgacgatggccccgattttctgtgaggcaatgtgatcgccggaatcaatcagcttaatgttagccttcggattctgcttgaagtaagcatagaaggattcacgagaattaatagtcccagcgacgcggccttgtgagacgaggtcgatcgactgttggaaactatcggttggggtgatggttgcacctaaacgtttagcatccgttgcgttattgctagtcgttgtttcggcaactttcttacccttaatatcggtaatcttactaatcgatgagttcttcttgacggctaattgtgatttagaataaatgtaaggggtcgagaagagatacttcttctttcgggccgccgtttcggacatgttattcatgacaacgtcgaatttgtttgtgtctaaaccagctactaacgaatcgaacttcgttggtacaaatttagcttttagtcccatcttcttggcaacggctttcccgaggtcaacttcaaaaccagttaatttaccgtctttacggtagctatatggttgaaaagtgccttctaagccaatcgtcaacgtccccgatttttgcaatccgaggtcgttagactttgaactgctgctagtgttactaccacaggcggtcaatgtaactgctaaacctaacccaagcactgcaacgcttaattttttaacccatgacttcatgattcacactcctagaaatttttcacaacactcctagtttatccgaaaatgaagctgttaacaaaaaataagcattgagtgtcgcaaacggaccaatgcttatttcataatcggctagtatagcgttagtgtagcgaatcagagaaggactgtcaaacccttttttatcagtaaaagcgacgcaagcgcgggtgctcaaactgatacagtataaatggtcgtaaagcgtacggcttatttgatgtggatcctgatataaaaagtgctaatattcaggagcacgaccactcattacagctgacagatgtaatcaaaaaatgcgactaatcgcaattattacggttagtcgcatgatgagtgggtcaagttagaattggggtgcgaacgatgctgctggaacaattactggtgccggttgtaagatgtggccaaggcgtttaattcccagcgtaatcgtttcgacgtcgagactggtgaaattcaaccggaacccgtttttaaccttgcgacttgcgaattggcaagcggatggcacataggcaacgtgtgcttgcggtaaaacaacgtcattgagcaaggttttagcatcaattccttctggcaaggttacccagatgaagaagcccccattaggacgggtgtagtggacattttgcgggaagtattgatcgagtgcggctaacatcgcgtcacgtttaatccggtatgaagtactaatagttgcaacgtgatcgtcgatgtcgtgttgatctaggtagctgttgatagcagccagtgttacatttggcgattgaacatcgattgcggatttcagtccgaccaattcgtgcatgattgcgtcgtcagcaacaatccagcctgttcgcaaggccggggagagaatctttgagaaacttgagataaagatgacgcggccttcagtatcgtagtgtttgatagccggaatattttgaccactataacggaggtcccggtacgggctgtcttccaaaataatgacgtcgtactgattggcaagggcaacgagtgcttgacgacgtttggcactcatcgtcgtacccgttggattgtggaagtcaggaatcgtgtaaatcaatttgatctcaggatgagctttcaaggttttacgaagttgacgaatattcatcccattatcatcaactggaatttcgtagtaagtcggttcgtaagtgtcgaaggcggctaaagcccccatgtaagtcgggccttcgacgaccatggcatctccatggttcaacatgagcttcgccacgaggtcgatggcttgctgaccaccttgggtcatcatgacattgtcggcactaacttgaacgtcagcatgagtcgccattcgatctgcaattttttggcgtaatgccggcaacccttgagttgatgagtattggaaaatgccttgaccatcgtgttcaatagcatcacgataggcttgctttaagtcgttgtcagggaataagtgctgatctggaaaaccaccagcgaaggaaatgttttccgggtttgcactattcttgaagacctcatctaggtcggaagtgtcattgtttaacacgcgatttgcaaataattttttcataataattttcccccactcagttttttgtacttaaactgttttctttgattatcaatatgataaaataaagcttgtaattagtaaaactcaactttttcaataataagtgaaataaattcacctaagagaggtaaatcattatggcaaacttcgcatatgaagtcttttcaacggtcgttgcccaacacacattctatcaagcggccgctacgcttaacgttacgccaagtgcggtcagtcattcgatcaatcagttggaaaaagaactgggttttccactattcatccgtaaccgttcaggcgttgaacttactagtgatgggcggcaggttttaccctatgttcaagagattctgaatacggaaagtaacttgcgacaagttgccgataatattcaaggattgcactctggatcggtacggatcggcggtttcagtagtgtctgtatcaactggttaccccgaattattcgcgaatttaatcataaatatcctgatattaagatttcagtcatgcaaggtaactttaatgaaataaccaactgggccaagatcggtactatcgatattgggtttacgtcgatgccagtcaatgagaacttattagtgcattcactgatcaatgatccaatctattgtgtgacgcccgctgattttatcccagaaaatggtgaattcattacgactgatgacgttgcggataagaactttattctacaacaaagcgattatgaccgggacaccaagctagcactggaccactaccacgttactaataactttttacgattctcgattgatgatcaatctattatttcaatggtagaatccggtttaggcatgggcattttgcctcagctagcactacggaagctaactggagatgttaacacgttttcctttgccgaaccttataatcgtgagattgccttagttgccaacaaaacccaggcggccgctccttcaacggctatcatgattcgtgctattaaacagtttttgaccaaggagtatccggatcagatgttatggcagtagcaaagttaggcagagcgttggcgtagccagcacagacttcagtggcattgagcatgtttcgggaagccactcgaaaggtagatgaacgaccgcctaactggtgcaattagtcgttaaattattatttactactaagaactttgaacaaatgttaatgggacatcaactgttttgaatacctcagtataaagatcatggaacagtcgtaattctattatcagactgacagttatatggcaaagtcgctgtcgctaaaatagccacggccaattcatcagaaacggaatacgcacatgtccgccattcgaacgctatcccgactggaaggcgttgtaggacgcgctcaaccaggcagggttggcactaacttaaacttttttcagcggacttaagctggctgcttttaacgttaaaggcttactacgaccagatcgcacaattaaagctaaaaatagccgcttttccagtagaccaagttggttgtcaggaaaggtggctattaatcttttagatatgttttagataagcactctgagcaaaaatgatggctaggtcgattggacgggtgaaatcagtttataaacgtttgaatcgtattaccgatttgatggttgttgagtaagccggattgggtgcgccatgagcgcaacactttttgttgatagacctttaccactggcttgaagatagattgaccagccagggcactttgcagtggtaggggttggtcagctttgatggcttttccagcgacaatcaatacctgcatcttggaatcaatggtatggcggtgtgcaatcaatttagctagtgtggccgtttgcgacttggcggcaaccggcgtcgtttggcgacgattgttactttggcggctggcgccgttaaatggggtggccatcagtacaaggtgttgtggtgataagcttgttgttgtgtgttcgacatagttagtggcagtgagaccgccacgaccgtaactgacaaggttaaaccggcgaaatttaaactgctggcgggcggcggttaggagttgctttaataaatgcgtttgtcggtttgaatcaaggttcttgggcagttgcacttgtatgtaggggcggttgtcactgtcgagcaattgccctttaaatgtcacggtccccgtcgctgtaattttggcggtgaccagtgtctgagtggcgctactgttttgaatatgggcagttaattgctgaatctgattgtgagttaagtggtcatctagtaagagcaccattggaatacgttcagtagaagtcactgttatggtggtgaccggttttgacttgtggatttgttgttgccaaagcatggtaccaccgatcattgctagcagaactactagccaggtagcgcctgtcaatacttgttttgtcgttgctttcatatttcccgttactccatatctccaaataaactgcacttttaatgtaagccactcacagtcaacttgcaactgtttatacacacttttagatagcaaaagtcccgaccaagtaaatttggtcgggactccttaaaggtatcagtcatgtgctccgaatagggcagagactgatgctttaagatcacatatggtactcaaaaagcatcaccccctttcattaattgtccgtagtttagtcccatttaatggtcaggtcaactaattagttcgcaaacggactaaacgcggtataatagaattccttggcaggggcactccgcggttgcggggtacttaacgactgaattttcagttgtcatcaagtcagttcatcattggtttattattcaaaatgggagctgatagaaaaagttcgattcaatgacgaatcgaacttttttgatcagaaagcatgaattacgtgtaaattttaatacgagaaaatagactggagttcttactggtttgattgattatgcaaccaagcgtgtgattgccaaaggatactaaccagtagaagcaaaaggccaattaacgaaattatagcgcccaatcgtaatccgggtgtatgatattgtaatttgactttatgctgaccagcgggaatttttgcaccaacgaaacctgtattaacaacttgagtcttagttggtttgtcatcaactgttaagtgccaaccagttgaatatggaatcgaggtagttaatacgctggcagtttgtgcttgagtgcgacccgtaatggtgttgttagttaccttttgttgtttaaggccgtgcttttgaatggccttgatttgacgctggtagcgccccttaaatccaactgccattaattttacatgatggatttttagttcaggcacttgactaaaacgaacggtcacgattcttcgtaaatgacttgaatagcctaaatttaaaataacacgttttcgaatcgaataattcgaaagattagttggtgattgttgtgaaaagttgttacttcgataagcgattgatgcggataaatagtaaccgctgagttgccaatcagtatgaagtgcctggcgaaactgttgaatcttagctaatgttgtattggggcgattagcaaatacggcattagccgcattattttgcaaaaattgattcaacgtaggtttgaccattgtcataccgctaacctctaaatataactctttattttgccacttttcaggatgatcaagaattaaatcataggtcaattgatgtccctgacaatcactaactaattgatgtagaccatctttgttagtggtttgattgtcattaacaatttttttattagtagtgactaatttctggcttagtcggcttgaagagttgactggcctgtcggtaacattcctaactttaacggtataggggacagtggtggctattttttgaggttgcacttgtttaacaccagttattggcttatcagtaatcggcgcttgtatcattgcttgctctttatcaacagcatttaatcgttgatatttggctgcgctaatctgagcgttttgcgtggatactaatggtaaaaagttgtcattaacaaaaacgatagttccggttttgttagataatccaccggccactggttgatctttaaatatacgcacgtgcccatcgttgttttttaaagcatgatagcctacgggaatatttttagggtcataacggtctgctagttcaaatatataacggacccccagaaggttgcgtgttgttgtccgaccatcagctgtgcttagtggtgaattaggatcggcctcttgattgccaattgactgtgaaaattggctaatacttctattctgtactgagaaataggatgcaatatcatgggtgccgagcaacattgagatgtttttctttccagaagcagctcctctagcatagaatccaggggttaatgtagttcgatagaaattatcattacgcggtaaagctttttgagcaccatccaaatatttattaatccaactcgtggcacttccacgatatagttgttgtggattggcaactccggaactggtcatagttgcaccaaatccagtattaattagattaagacatagcagagtgaaacagccaattatcagtgttaagcggcttaaatgcatcgcacttgacccgataaaccaggtgattaagacgaatagtaatatatatgatattaggtcgcgcgcactaacgttaaaagtaaaaccatttacgacccaaataattataattaagccaacactggcgcctagaaatagtcggtaatcccaactatcaagttttttccagtcatcgatgagtcgcattgtaagaacgctgaacagcaaagtgcttaataatagccaacgattggagggcgaagatagaacgttgaatgtggctgcaacagctggaagtaataggcctactaataaaataatgagtagactatttaagtcccatcgttgtttaaaatgacgtaacgaatgtaaaatagctaaccaagttaggctactgatacctaaaatgacccaaaacggcatcccatcactatttaaaaccaaattgggtagcgcaatataataacttaatgggtagagcgataatccgttgacaaattggccacctgtacgtgtcgagtgcaacatggcgaggacggtcggaataactaacactgctgcacacgctacaccgactaaaacagcgcttaataagtggtaaatcaattgccaaaatcgtgtatacgtttttgtttgacgatattgttgccaataacgccagattgtgtaaataacgctcccgagtgctaatacgtaagcaaagtaaacgttactggcaaccgtgattgcaattactattgccaggggccaccatgattttcctctgaatactcgctcaattccccaacataataatgggaaaaagatgaggggtaataagaagaagggatgatgcatgccgatgtgaagtgcaaaagcagtgaaggtatatgttaaagaaccaattaaaagacttaagcggctaaagtgccatatcctagcaaatgttaaaaaagctaggcccgtagcatataagcgaatcaaaatcagaaactgatatgcaaattcaattttagtagttggaaatagagcgactaagtagttgaatggatcgccgacaacgtaatacgcaaaagtcgtcatttgatcggctcctaggccaagattccaagaccatccaaataatgattgtgtgccaattcccttaagcattttttggaatgctgttagtattggcaaatgctgtgaaatcccatctactgtccaaatcaaagaccgtccgtccagaaatagtggactataaatgatgcaagttaaaataataaaggctactgtataagtaatccaaactggtactttccccaaatgacgcatgaaattctcctttgtatattggcataaagttttaaaaagattaactaaaaataattgaatgcaaccaacatagagatatagtcaatctcaatgattcccgggttgtaacaacaaaagtctattatctgccaagtaactggtgattttcaactgttatttaatgatttgaggtatttattaactgataatgatttattaaattggcccttgattgatacaatgactttgaattacgagtacttgcggtgagaaatataggtaaattgaatcatgatactttaattttacagattataatgtgtgggttttattattgctattagtttgtaacttaacgacttagagaatactcagatagattactaagttaataaattaattctagtcacaataagttaacggttaatcaagatgggcctaaattttcgatctctgattagcagaattactaaaatttagaatgaaattgggcagacataactaaaattcccacggttaccagcactatctggacggggcctttcaataaattggtacggcctaattaagaacttaagcttttctttaaaaagtgctaccgcaagtgcgtattaaatggtaaattaatagaagtagttttgtcatatttcttacattcatagggaagagggattattcacatggtctttaacttggtagttaatattattgggattgtggtttttattgccattgcctacttattctccaagcaaaagcacgccattaactggcgttcagttggtgtcatgttagtactagaagtcttattggcatggttcttaacgggttcacaagtcggtgtcgacgcggttaaagcagcggcagatggcttcacttggctcgtcaatgtatcatacgatgggatcgcctttgcgttagctagttgggttaacgttaagtcgatggacttcgtcactagttcattattaccaatcttgttgattgtgccattattcgatattttgacctatattggcgtattaccatggattatcaaatgggttggccggggcttagcttacattactggtcaaccaaagttcgaatcattcttcgttgttgaaatgatgttcttgggcaacacggaagctcttgctgtttcgcagttacaattgaagcagatgaaggcacaacgaaacttgacgattgcgatgatgtcaatgagttgtgtgacggcatcgatcttaggggcttacattaagatgatgcctggtcaattcattttgacggcggtgccaatgaacgtcttaaacgctgcgattattgctgcaatcttgaatccggtcgaagttaagccggaagaagataccattgcgaaaatctcaggtagtgcggctgttgaagaaactactgccaccactgaaacgagcggttctgaagaattagctaatgaacaagttaaggaagctaaaccagctcgcgaaccattcttctctttcttgggtgattcaatcttaggcgctggtcgcttgattttgattattgctgctaacgttattgctttcgtagcgttagccaaattaattgataagttgttaggtttaatcaatagcaatttatcacttgaaaacatctttggggttgtcatgttcccatttgcatggttacttggctttaacccaagtgatgctttccaaatggcttcatatatgggaacgaaattagtgactaacgaattcgttgtcatgggtgaagtttccagcaaagttaacgattttgcaccgcatttccgggcagtcttaacggtcttcttaacgtccttcgcgaacttctcaacgattgggatgattattggagctttcaagggaatcgttgatcgtgaaaagaacgatttgatttcacggaatgttggttacatgctattatctgggatcctggtctccttactatcagccggtgtcgttgggttgttcgtttggtagtcggtgatataatttaatcttgaattaaacgtaagagtgtcagctattcggctggcctcttttttattaatgaatcatcgggtcatacttttatccggtgtcgtttttaacggtgagatgttcaaggcagttcatgaatttgactagaaaaattgcaaactagaatagctgtcaatgatggctgtaaaagcagacttttcaagggttattgcgattttaacagcggggctgtgcattgattttaagtgttatttacgttaaagttatgaggtgacgtgaaacattgagttgtttcacaaaaagaggacgaatgtgacccctttaaggagagctattactaatgaatccagaagaatttaaacaagcgttagcccaacacgagattgcgctgacggcaaaacaattggcacaatttgcgctgtattttcaactattggtcacgactaataagcagttcaacctgaccacgatcacagcggaaccagaagtttatcttaaacatttttacgattcactcacgccagcattctacgttcctgcgctgcgtgatcaaccgctcacgatttgtgatgttggcgctggagctggtttcccgtcgattccgctcaaaattgcgttcccacagttacaagtgacgatcgttgattcattgaataagcgaatcaattttttaaatgatctagtccaacaattagccttaacgggcgtgcaaacgttccatgatcgcgccgaaacgtttgctggcaagaagtctgctcaccgggaaagctacgatatcgtgacagctcgggcagtagcgcgcctatcagtattgagcgaactctgcctaccactcgttaaagttggcggccagatgattgcattgaaagcagccaatgcccgtactgaaacggctgaagggacatacgccgttcaacaattagggggccaaattgctcaggacgaggcctttagtttgcccgtgactgctgatccgcgccatatcattgttattgataagaagaagccgtcaccgaagcggtatccacgcaagccggggacaccggcgaaacagccgttaacggcaccaatgtaaggtgggaggtaatttcaatggcattttcattatttggttctaatcgtgataaacataaaaccgaggcggccacgacccccacggagcaacaaattgtccgtattccggtcactgccattatccccaaccggtttcaaccccggcaagtcttcgatgaaactggtattgctgaattggctgctacgattgcggatcacggcttgttgcagccaattgtcttgcgggaatacgaaccgcagaaatacgaaattattgctggtgagcggcggttccgcgctatttcttcacttcattgggcggatgtgccggccatcattcaaaagatggatgatggtgaaaccgcgtcaatggcgctgatcgagaatttacagcgacaagatttaacggccattgaagaggctcgggcctaccaagaactgatggaactcaaccaattgacgcaatcggcgctagcgaaagaattgggcaaaagtcagtcgttagttgcgaataagttgcgattgttgaagttagcacagccggttcaaacggcgttgttgcagcgacaaatcagcgaacggcacggccgcgcactactcaacttggctgtggagcaacaggctgcggttttgaaacgggtgcttgctgatcaattgacggtcaaagaaacagaacagctagtggcgaagacccaaacgccgccgaagcccaaacgcaaacgtgcacgggggttgaccggcgatacgcgaattgctgtgaatacgatcaaaaaatcaattaagatggtaactgatgccggcttacccgtgaagacccatgaagaggatacggatgacgggtatcggattacgattgaaattccaaaaaatcaaccaaggggtgatcaataattatgggaaccgtaattgcactcgctaaccaaaaaggtggcgttggcaagacaaccacgagtattaatctcggggctagtctggtcgaattaggccaaaaagttttattaattgacacggatgcgcaagggaatgcgaccagtggtttaggtgttcaaaagtcgaccatcgaacgtgaaatctatgacgttttaatcaatgacgttcccattaaagaaaccattatcccaacgagtcataagggtttagatatcgttccggctacaattcagctttctggggcagaaatcgaactgacaccgatgatggcacgtgagacccgcttacgtgatgccatcgatgacgtgaaggatgattatgattatattttgatcgattgtccaccgtcgttaggcttgctgaccattaatgcgtttacggcttgtgattcgattttgattccggttcaaagcgagtactatgctttggaagggctgagtcagttattgaatacgatcaagctcgtacaaaaacattttaataaacagttgcgaattgaaggcgtgctattgactatgtacgatgcccgtaccaatctcggagcccaggtcaacgaagaagttcggaaatactttaaggacgccgtctataagacgattattccccgcaatgtgcggttatctgaagcacctagccacggcctatcgattgtcgattatgatgcccgttcgaaaggtgcgcaagtctacttagctctagcaaaggaagtgttggccgctcatggcaagtaaagataaagataataaggcgctgggacgcggtattggagctctgtttgccgatgttaacgaaccagctagtgaagaagccgtggttgatctagatcttaaggatattcatgccaatccgtaccaaccccggcgaacttttgatcagacggcacttaaggagctcgccagctcgattgaaaagtccggcgttttccagccaatcattgtacgacaaccggatgccgagctgaataaatatgaaatcattgctggtgaacggcgttttcgggcgtcgaagctcgctcatcaaacgactattccagccattgtccgtgatgttaccgaagaacaaatgatggaagtagcggtgcttgaaaatctacaacgggaagatttaactccgcttgaagaagctgcggcctacgattcgttgatgaagaagctgaagttgacgcaggcggaagtctcaaagcgcctaggcaagagtcggccatatattgctaattatttgcggttattgggcttgccagatggggtcaaacagtatatccaaaagggccaactgtccatgggccaggctcgaacgcttttgtctttgaaggataaaaccaagttagcgccattagcgaagcgcgtcgtgaaggataacatgacggtccgtcagttggaacaaatcgtggcgcgttataacggcgagtccaaggagccggccaaaaaagttgcacccaagaagtcaccgtacatccgtgcgagtgaagaacaattacaagagaagtttgggacggccgtttcgattcaaactaaggcgaacaaagctgatcaagggaaaattgaaattccgtacttgtcaaatgaagatttgacacggattttagaaattctcagtattgatttaaattaattaatttataaaggggcgttgcgcatgtatgatttaggtgatattgtcgagatgaaaaaggcgcatccgtgtggtgtcaatcgctgggaaattacccggatgggcgctgacattaagattaaatgtacgggatgtggtcacgtggtcatgatgccgcgtcgtgagttcaataaaaaactcaaaaaggtattagaaagcaaagccgatcaagcttaattattaaaaaaggaagagtgaataaccgatatggcacttacagcaggtatcgttgggttaccaaacgttggtaaatccacattgtttaacgcaattacgaaggcgggcgccgaaatggccaactatccatttgcgacgattgaccccaacgttgggatggttgaagttcccgacaaacgactagaccgaattcaagaaatcatccccgcaaagaaggtcgttcccacgacttttgaatttacggatatcgccgggatcgtcaagggtgctagtaagggtgaaggacttgggaacaagttccttgaaaacatccgccaagttgacgcaattgtgcacgtggtccgggcctttgatgatgacaatatcacccatgtgacgggtaaagtcgatccgcaagatgatattgaaacaattaatctagaattgagtttagcggacttagaagctgttgataagcgtttggctaaagtgcaacgggctgctaaggggagcgataaagaagctaaggctgagctcgctgttttgcaaaagatcaaacctgccttggaagccggcaaacccgtgcgttcactagaattcaacgaagatgaccaacaaatcgtcaagggcttattcttattaacgtctaagccagtgctgtatgtagccaatattgccgaagatgacatggccgatccagaaaactctaagtatttccaagtggttgcggactatgctaagcaagaaggagcccaagccattggtgttgctgctgaaactgaagaagaaattgccgaactagatgatgacgacaaggccgactttttagcagctgaaggcgttgaagagcctggcttaaataagctgattcgggcttcttacaagctattaggactggaaaccttcttcacggctggtggtaaggaaacccgggcttggacgtttaaacgcggtactaaggcccctcaagcagcgggaattattcactctgattttgaacgtggatttattcgggctgaagtgatgtcttacgatgctttggatgaagccggttcagaagcaaaggtcaaggaaaatggtaagctgcgtttggaaggtaaggactatgtcatgcaagatggcgacatcgtcgaattccgcttcaacgtttaagctgaaaggagcaattgtatagtgagtgagagcgaaacttcaaagacacctaggaacgccgcggccggggccaagcaggctcaagccgcagaacggccagttcacgaagcgactgagttgacgaagcgcaatgctgaatatatgcgtcagatgcgcaagtcacttgatgccacagcgttgagtggtgagaaaaagacggcagttctgaatgaaatgacgtctacattgttagcggaacaaggtcggggaaccacggctcgtcaattatacgggaccgttcaagaacggaccgaagagattgtgaatccaaaaaagacaccggtagaacgtcaaaaggcgaactattgggtcacggcgctggacaatggcttgatgctattcatgattttctgcttaatgtacgggatcatgggcttcatcggcacgaacgctactaagaattcagctggtgccaacgggatcaccgctattctgattacgtccgccattggtggtttgggcgttgctaagttattcgaatacttaatgcctgctaaagatggcaagaaagtttcgttatggaagaaaatcgcgtggtcagtactggctatcatcgtttggatgttagtctttacaaccatgtcaatgattcaaggaccattgaacccggtcttaccaggaatcgcgtacttgatcattgccgtcgtcgtcttcttcgcccggatgtggttgaagcggcgctttaatattacgacgagcatgttttaggctcggactgaaagacaagctgatggcgtgcattggcttgtctttttgtcgattgcaagtggtcattgcttgttattcacctagttagcttttaaactggtgatacggatgtaatgactgaatgaaagttgtgtgtgaagtacgctcggcccaacctggaacattcggttgggcgttacaggcttaaaataagaactttctgaaaatctgcgcaaccccttgcatttatcgcgatgttttgttacctttacagataaaaataaaaacataaggagctaacgttcaatgtctaattgggatacaaagtttggaaaaaagggttatacgttcgatgatgtactattaattccggccgaaagtcatgttttaccgaatgaagtcaatttaggtgttaaacttgccgataatttacagctgaatattccaattattagtgcgggaatggatactgtttcagaatccgcaatgggaatcgcgatggccaaccaaggtggcttagctgttatccataagaacttaagcattgaagcgcaggctgaagaagttaagaagatcaaagcggtcgttaaggatgatgatcacccacacgctgccgttgatgccaacaatcacttgttggccgttgcggctgttggggtcactagtgatacctttgaccgggctgaagccctatttgccgctggtgcggacgccatcgttattgatacggctcatggtcattccgctggtgtgcttcggaagatcaaggaaattcgggcccacttccctaagcagacattgattgctggtaacgttgcgacggcagaaggcacgcgtgctttatttgaagctggtgttgatgttgttaaagtggggattggccctggttcaatctgtacgacccggattgtcgctggtgtcggggtgccacaattaacagcggtttatgattctgccagcgttgctcgcgaatacggcaaagctatcattgctgatggtgggatcaagtattccggtgatatcgttaaggccctcgctgctggtggcaacgccgtgatgcttgggagtatgttagccggaacagccgaagcaccgggtgaggttgtctttgacgatggccgtcaatacaagttctatcggggcatgggttccgttggggcgatgtcacaagctcatggttcgtctgaccggtacttccaaggcggcgtgaacgaagcgaacaagttagttccagaaggtgttgaaggacgtgtgccattcaaaggcagcgttgatgatattatcttccaaatgttaggtggtttacgttctggcatgggctacgttggcgctaaagacattgatgccttgatcgaaaacgcccagtttgttgaaatctctggcgctgggctccgcgaatcacatccacatgaaattcaaattacaaagaatgcaccgaactattcagtcaacggttaaaatgacgatatcgtatgagtcagtctgattggtttagttgaataagcatcaagtaagcgtagaacatcaactttgttctatgctttttttgtctggtgagtaccagcggaaaatataggcagatgtaacgttcgtgtagattgaccgtagtgcttctttcttgttaggacgttgatactagctctgtacacgattgtgttacttattaagttcattagatttttaatgatatcgtggtattagtgatgcaaagaaaggggctaatataaatgaagtatcggttaataggggtaggtgcgagtctagtcatcgcagtcatgttaacagggtgtcaagcgaaggctacgacattggtcaagtcagatgctggccaggtcacacaagcggaagtatttaaacaaattgaaaaccaggcgacgacgcaacaggctgttcaagaattgactctaaacaaagtccttaatcaacgatatcatgtttcacaagctgaagtaactgctaaattaaaagcattcaaacggcaggcaggcgcaaattatcacatgattttagaacgtaatcatgtcactgaaccgcgtttaaaatcgcaaatcaaagcgaatttattgatggagaaagccattagtgctaagtatccagtgactaaagcacaactaaaaaaagcccgagcagcttatatgccaatgacaacggttcaacacattgcgacggccaatgagaagcaagcgcaaaaaattattgctgaactgaatgcgggtgctagctttgattcgcaagtgcgaaaatatcagaataatcgacaagcgcacacaactgctggaaaattagcgcagtttgacagttataatcaaactctagcaccagcaattgtacaggctacagccaaactacgagtgggacactatgtcacgaaaccggtcaaaacagttatggaaactgccgacacgaaagacaaaccaacttatgaaattatcaacgttgtcagtcgtcgatctaagactgcggctgtaactgatgatagcggtaagcggattgatgtgacaaattatttgcgtgaaaaaatccagcaacagcggatgatggacaagcagacgcaagttgcgacgattcggtcagttttcaaagcggcccacgttaaggtagttgatgcccatttcgcaccagcgtttaatgattatttaaccacccaaaatagctaacaatagaatcatcagcaatgatgtgatgattatgaacgcgtctcttaacctgtcatgggttaaaaggcgcgttttcgttaggtactgatgattaattgcgctatgatggacttattaaaacgtattgtaccagtttagtgaggtgccaaattcaacatattaagtaggtgagtagatgcaacggtttcagtcacgccatttattccagttacgagaaattggcttgggcttaacctgtatcggtggctttattgacgcatacacattcatccaacggggtggtgtcttagcagctggtcaaacgggtaatttgatttttctcagtgttgatgtggcacagtggaatttaccgggtgtgttgactaaattagcaacagtcctcttttttacactaggtgtaattgttgtgggtatactgaaacaatggttgggcgcgcgatcacactactggcgcttgcccgttttggtggcagagctggttgtttgtttaatggtcggcatgctaccagcgactgttagtaatgcgatggtggtcccaccactcgcattcgtgatggcgatgcagacgacagccttcagcgcaatcgccggccacggctataataacgtgttctctactggtaatctcaagaaggcaacgatcgcgctgacgaattattggttgacaggcgtgcgcacggagcttgacactggtttagtgtattgggaattagtgttgagctttgctacgggcgcgattgtttcggcgatattgcagcggtggtggacattacggacgatatgggttgcggcgggattattgattttagtaggtggatactatacttggttattagttcaccgtacggcaaatgacgcggaatagttgcgttttctctaaaatcaatcgttaactgccaagcccggccgcttttttggtaaaataaaaacagaattatttaaggagaaaaataagatgaaaattttagtagtcgatgacgacaaagaaattgcacaactattagaaatttatattaaaaacgaaggctatgaaccaattagcgcctataatggccgtgaagctttgactaaattaaatacgaatcctgatattgcgttaatgattttggatatcatgatgcctgaaatggatgggattgaggtcatcaaagaagtacggaaagattcccaacttccaatcctagtcttgtcggccaagactggtgatatggacaagattcagggcttgattacgggagctgacgattacgtcaccaagccattcaatccgcttgaaattatggcacgggtcaagtcactattacgacgttctgaaaataacgtgacgactaccgagcctgatattttggacattggaccgttaacgatcaataaagattcgcacgaagttaaaacgttgacgggtaaggatattcaattaaccgcgttagaatttggtattttgtatttgctcgcaagtcatcctaaccgagtcttttcagctgatgatatttttgaacgtgtttggcagcaagaaagtattgtctcagctaagaccgtgatggtgcacgtgagtcatttgcgggataagatcgaagaagccacggatggagaaaaagtcattcagaccgtttggggcgttggctataagattgaatcgcgttaagagtgagggttagcttttgaaattaacgggacgcgaaaaaagtgaattattttttgaaggggtagtgacggtgattttgctactccttttaaacttgtcgatcgtagtactgatcaacagtacgattgcgcataatccggggttacagagcggtattttccaaattaaacgatcgattaccattggtcccaataactaccagctatggagttatgaaaacatctttattggactgatgctgattgcggacggtttcgtattatattggcgattaattcgacgatacaaacagatgcagttacgacatattattagtgagttgcattatattgcggccggccactttgaccatcggattgactttaatctgactggtgatacacaacgagtcgttgaaagtgttaatgccttagtagactcggcaatccactcgatggacgaggaacgggaaattgagcggtctaaggatgcgttaattacgaatgtcagtcatgatattcgaacgccgttgacgtcaattatcggctatttaggcttaattgagaacaaacagtaccaatcagaagaggatttaattaaatatgcgcatattgcctatttgaaggcaacacaaatgaagtcactggttgaagatctgtttgaatatacgaaatcacggcagacagagacaccgttggccattaatcggttaaacttgacggccatgttagaacagttagcggcaagctttgagctggaagcgaacaagaagcatctgaagattgaagtagaaagtggcacgcagcctatttacattgaagccgatgctgaaaagctggggcgggtcttcagcaatttgatcactaatgcgtttaaatatggaactggtgctaaaaacgtagtattacaagctgaacaacgtggtgaagaagtcgtgattcacgtcacgaatgatggtcagcgtattccagctgagtcgttgggacgcttatttgaacggttttatcgggttgaagaatcgcgttctaaggcgaccgggggttctggactgggcttagcgattgcccaaagtatcgtggatcaccacggtggctatatttatgcgcaaagtgatgatgagcagacaagttttgttattcatttgccagttaaacatgaccacccattaacaaaaaaacaatcggatatgataaattaacttgtttccacagacataattatttaaactaaaactagcattagcaattaagaaagggataattgagaaatgagatttgcgggaaagttaaagaaagttatgattgccctcgttgcggcagtcacgtttagtacagctggtttaggcattgcgggggctgacctccaggcccaagcagccagtacaccatcgatctctgcgaaagccgccattgcggttgacgcgtcgaccggtcagatcctgtatgataagaacagtagtaagccaatggcgatcgcatcaatgacgaagatgttaagtacatatttagtgcttaaggcgatccatgaaggtaagttgtcttggaatcaaaaaatcagtgttagcaaggcagtcgctaagatgagccaaaacacggaatatgcgaacgtaccgttattatcaacgaagacgtattcagtgcggcaattatataacgcgactgaaatctattccgctaacgccgctatcacagccttgggtgacgcggtagccgggacgccccataagtttgttagcttgatgcggaagacggctaaatcatgggggatcacggacgctaccattattaatgccagtggattaaccaataaagaggttggcagcacaattgggtacagtaacgttgccgccagtgctgaaaacgaaatgtcagcacaagatgttgctaccgttgcgcaaaagctattatcagattacccagaagttttaaagacttctagcattgcccatgcttggtttgaaaagggcactagttcagcaaccaagatggataaccgaaactacatgctcaaaggattagttaaacattactccgcacttcctgtggatggtttgaagactgggacttccactaaggctgggaatgccttcactgggaccgttaagtttagcaatggtaaccggatcattacggtcgtcatgcatgccggtgccgctaacgatagtgggacggaacgtttcactcaaacggctgaaatcatgtcatatgtttaccacaactacacgactacgacgattaacaagaatggcaagatcaatggtgtgaaagccgttgatgtccaagatgggaagtccttaacgtcgcaactcgtttcaaatagtggtgcaaccaagatttacttgccaaccgggacggatgctagtgccgttactggtaaggtcagcttgaagaagtcggcgacaaccgatggtaaattacaagcacccgttaagaatggcaagactgtaggtactgttaacttgaacctaagcaagaaagctatcaaggtagttgacagaacgactagcaagaatatgaccatcaatgtaacgcctaagaagtccatcgacaaagcaaatatctttgtacggatgtggcgcggggttaagagctggttcaactaaattatagcagttagtgtattagattctgtgggtgcattagcttagtaaacgctacgagatatttcttaaaagatatattcctctttgagtaggcaagctagtaattgagacttgcctgctcaaggaggatttttttgttggcaatagtgattcatgacaggcaactaatgaccagggctgtgccactgatttagctaattaaaaataattagcatccagagtaatttcaaaaaggcactgtcaaggatgaccaagttgaacggctgcggatgttatgataaaaagagtattaatagtcttcatttggcgatgctaaaaaagcaacgtttaaatcgggataattatgaggtgctttgttaaaaattattccctaaattaggccgtgtgcctatcttagtcactacttcgactattcgctacaagcgttccagtttgagcgttctttctttttttgctaatatttgaatgctagctttgcggataaattgcgattccatttatgtagaatttgttagcatgatccacgattaactgtataatgaagactgataacagtagttaaaccgaatggagtgaaagtcacctatgagcgtatcattacgaacttcaaccatgtcagatttacccattattgtagatatttacaatcaaacgattcccagtcatcaagtgacggctgatcttaaaccagttacggttgagcaacgtcgaaattggtttttgagtcatacccctgaacactatccgctgtgggttgttgtaaaggacgactcagtggtcggttgggttagtctgtcaccattttatggacgggcagcgtatgcaaagacgactgaaatttcagtttatttggatcgcagtgttcaaggacagggaatcggtagccaggttttgacattagttcctaaacaattacctgtgttgggattaacaacgattatcgcttatattttttcaagtaatattccaagcattaagctgttcaaaaagtttgggtacgaacagtgggggtttctgccagaagtcgctgaattaggtggccgaccgaatgacttagtgattctgggacaacatttcaagtaaaaaatggtattgataccgcttacatacacttaaaaacttaacaaggtgtaggattgcaataaaaaacatgttaaaattaagtccgagtgtctaagtaatttgacgctcgctgttgttgctagaattctttactggtatggtactggaggcattcttggtgaaaaagaacgagccaaattggttagtggtattacgaacagtaatgccacttgggcttagctatattcccatcgggttagcttgtggggttttattgcatgcggccgggttcaaccatctactgacggcgttaatttcggtaatggtcttttccggtggcgcccaatttttaattgcatcgatgctgacaattaatgcaccgatgacaaccattattttgatgatgtttttcttggagttacggtacgccttattaggttccagcttatcgcgctatctgaaggggcaatcattaccgttcatttttacgtttgcgttttcgatgaatgatgaaaattacgcggtcaactatttaaagtttgcgacggacaagcattggaagccatcgcaggccttaatggtcgaacactattcgttattattttggacggtaagtaatattattggtagtttgattggcagtgcattgacgattaatctccaagtggtggattttgcgctgacggcactattcatttatatggcaattatgcaaactaagagccgtttgattatcttagtggcagttttgtctggcgttctaacgataggttttctggtcttaatgaagagtacgctgggcctagtggtgtcaacactactcgcgtcgttgaccggttactttattgaacgttacttgttggcacataagccagaaagtcatttactctataaggttcacgatcctactggccaaacagccatggaagaatctgacaagtagggcacagaggggtttttcttatgcaatcagtcagctcaatgagtagtatggaccatttttggttggtcattttttgtgcgtgtgtggctttcataccacgctttttcccgctactgttctttacgaagcggaagatcccagaatggtttaatgaatggatgcggttcgtacccgtctcactattcacggcgttagttgttaaaagtgtctttatcgatagtaagtacgcagtgatcacttctggcaatctggggatgattatttctgctattctcgttggatttgtggcttatcgcacgcgttcaatgactttatcagtggtgattggtctagtctcagtgatgatttttgtgttactaattcatatttagattttgttggaactgggtgacccggttcttttttattatgatgaaaagaggatacgttgatggtatggttattggttttcttacccggattattggctggtctggtccaagggttaacgggctttggtgcggccatcgtcatgatgatctttttaccacagttgtttccgattgctcaaagtgcggccgtggcgggcgttattatggcagccagtgtcataacattagtttggcgttatcatcagcatatccactttcgtcagattattgtgccgtttatcgtttatgccagtgtggcggcctattcggtacatcttggtcaagttttagatgtgcaattattgcgacggttattaggtgcgctgttagtttcgttagccgggtactttagtctgagcaaacgtgcggcgaatcaggcttatccgtggtggttagccggtctcttcatgattatttcggggttcttcaatgggttattcggtattggcggcccgctgatggccctttattttctatcacttgccgatacgactgcggattacttgggaaatttgcagactttctttttgatcgatgtggtctatatttcgacagtccgcgtactgaacggtattctgacgccagtcttgctcccccatattatgattggtatggtaggtgcggtcattgggacggcgctggcggcacgaatcctgccgcggctacccatgacgacagtccggcatttgatctacttgttcattggacttagtggcgggtattatttgattgcgccagtttagaacgaggtatttatcaccttcattacgagttgattttagtggtcaggcgcaatgcgtttggccttttttgatggtgcaaatcgtccaagtgttaaaaaatattttcagaaagcagcggtagcacttcgacaatctgtcttcggttataaacgagttaatcccaatgtataaatttaatattattaatttaataatcaagaatttgccagctacagctggaacagcgcttatctgttttgggagcagacgtggatgcgtaagatagtgccgttgagcgtacctgactgtagcttcttaatcggccttgcgcacggttctaaagttgaacaaccgggattgaaatatttattgttgaagattttttattttaacgatgcttaattacaggtgctacatagctgaaaaaagcattggcttattggtttccttttagtatagttttattctaagaactgctaaattggggagatatatgaatagctacagacgaattcaagttattgcagggatttacttgctgatatacattgcggcactttacttttcgacgggggttcaggttggatttaagctggatagtaatcagctcactgggtatgtgagttgtgggctgttgctggccgtaattatggggtcagagtttggcaaacgattaaggataaaaaagctattttcaattttgatactagttagctgtttgattattctagggataactagattcaatgttgtgagttttaacgaggccttctggtactttatcttatttgttcgatacatcccgttcattgtattgattgaaaccatcatctttatctttgacctagattgagcaaaccaggccctaatgagcattcaactcattagggcctggtcttttagtattctagaacctggttatgccgaacttttagttggcgtgagtctgccataggacattagtgtggatgttggcaactacgctaatcttcgtcggtaatcgtgcctagaccgtattgataaagtagttcatcagtacgattaagatcaaagcgctgactaagtgcgaagatgaccagagcatcccattcatccttagcataaaggacggcgtaaccagttcgcttgagcatcgtgttaagctcggtcagggtcagttgaaaaccgaatccgagggcgatgatgcgagcccggttaggtcggcgcttgccatcgaagtactggtaaccgatcgagggcgttagattagcgcgccgaatgacttggcttttagtgacgtgtttgatttgaataagctcggcgaggtattccgccggattggtacgaataaaactagtggccatatttgtcataaattggtcggcctcacttgcatgtttgatttcgttaaatagttccttagttgcgcgttctaccacggttagtgcccccctaatactccttcttaattagtattagtgtaccagaaactactgtaatttaaaggtcaaatgccgatcactgaagtagctgggattgtagatgagttcaacggacccatctgctttggcttgaccagtcatggtaccactgacagagccaccagcggtcaggtcaccactatctaattggttattttcatcaatgttgatctcatctaggctagtttggttaccggcggccttgattttaaagtcaaacgggttatagctgactttatctctaccgctatttttcaatgttacggtgaccgtataatattgattgccagttttaggctgaacatcattgagcgtcgttgcggttttaacattattaaccgttacttgcacgtgatcgatggtggctgtctgcccgactttataaatcgtatttgccggggtttccttagcggtggacttgctagcgctggtctttttggtcgtcgctgcttgtgagtttttaccgtcttgtggagaattgacgaggctgatgacaaagaagatgccaaggagaatcaggacccacgcccaccatttttgataccaagctttcgttttttgcatgagcttacctactttcttagtgctaagccgcccgcaataacaatgagcagaccgcttagaatcccgaagaagctgacaaagacgaagttaagaatcccacaaaggatgatcaaccagcccattaaaacgtgattgcgattaatcatgacacctaaaataatcgcgaggacagagacaataatgcagccaacgccaagattgctgaccccagccgatccgctggtttctaaagcactaccgatgccgccgatggtcatcgccagtaagccggcaatgataccgaagataccgccaataattcctaaaactaattcggctgttcgcgaatggggtgcgactggtgtgacttcgttattctgatattttgacattgtaattcctccaaaagtatggttatgataaaagttagtaattttgataaaaaggggggtgtcacggtgttaccgattgttcaagcaatgcaattgttaagtacggctggttatgaaccactaggaccattagttgcgcaacgcgagtttccgttactggttaagaagcaacaggttgtttcggtagctaaactagtaaatcctgataatattcctgttctacagcgtttgaagcagcagccaattccccgaatgccccggatcgaagcattattaacggcggctgattgcattgtaagtgttgagaccttaattaatggtcaaacactagcggatcgattggcaacacaaggaccgttttcccccgaaatgacggtgcgcgtcgcacaagaattgttgataacgctacaggcgttggggcaacaacaaattgtgcatcgggaccttaaactaagtaacgtgatgtgttatcgggatcactactatttgattgacgtcaacgcagcacgacaatatcatgctgagcaagacagtgatactcgtttattaggcacgatcggttttgccgcacctgaaaactatggcttcgcccaaacggatcaacggagcgatctatattcgttaggggtcgttctaaactgtttgttgactggtcaagagccgagcgggccgttagatacaacgacactgacacaggattcaacatgggccccgattattatgaaggccacggccctagacccacagcaacgatatcaaagtgcgactgcaatgttagcagcgttacctggtcatgagcattatcggccgcaccgtcaatcaatgattaagcgaatacaggcccggcaatggtggccgaaagtcaaacgacctttacaaatcagtttgtggggcctctacatcttgctcgtagttgcgaccattggtgctggctttgataacacgacttggcccgcccgcgtcgatttttggaccgagggttttatgattatcggggcgccactgattgcgcactatgccaatcagtggctaaaacaccattggtcggtattacgctggcaccgatatcggtggtggttacgagtagcagaagccatcttcatatttttgatgttaggccgtaacggctagtgtacgtaggctggttaaccaattactagtacgataaatagcataaccgtttagttatcaaaaggcttatgcaaaatgcataattttctgactgcggtgttgataacgttgcgactgcgttggcgcgacgactgaattcgactgggtaagactttactcagtcgaattttgatttagaggtcaggaaagtggttgaaaataatcctgaaaactgttgatgtgttttcaggattatttgaggagacgattgtatttatggtacaatgctagtcgttgacgtttgataatataaatatatctaattaaatataagaaaggaatattttgtcgaaatggatttaaagcaaagcgatggttggcgatacttagctgggtggagcttcattctattaatggtggcgagtgccacattgcaacatgatgcggaaatcattttacccgaaatcggtgctctgacagccgggacgtgggtttatcgtaagacggcgtggactcggcaacccttaaagttattcttagtaccatctggaactgcaattattggcttcttagtcaatcaactaccttggtcgtacgccctcaaagtgcttgtcggtctattactgatgctattattattgaaggggttaaaatcgaatttggcgccagcctttgctactggcttactgccaattatcattaatgcaacgcactggacctttatcgtagccatctttttctggactatttgcctgatgattggggcttggattcaacgaccgcgatcaatctcacgggtaaccgaagcttctgctagtcgctggcaaatgctcggctttatcagcctagtttttgtctgggtgggtattgtttggctagcgggacagtcccagatggccgcaatcccacccgtgatcgtcgttttctttgaagcggctcaacagtctgaatatacggtaacgaccgcacttaagcagtggcttgcattgtcggctgctgctagtattggggtcggcattcacctattgattgcttcgtggctattaacgacggtcattgccttaccacttgtgtatttgtggttacgggcgcttaacttacaattgccagcagcgtatgcctttccactattagccttagtgttaccagccaatatgtttaacaaactaccgacatccgccggtttagcggccgctttcttcctaggatcgttactcatctaccatcagatcttgggttgggtacgcatggcggtgactgaaagctagttgtcagtcattcctgaaaaatggtcaaaaaaataccaactatttcgaaataatcgagatagttggtattttggcatttaattaagctttattgattcggttatccgcatacatgtatttccgggtcattggtaaggttcgtgatgaagcacctttagttacgaggtactgcatgacgtcaatgttaccagactggaaggaagcggcacaggcttgtaggtagagatcccacatgcgagtgaagcgcacgcccatcttttcttcgatggcagcgcgcttagcgttaaagtttttatcccagatttcagtcgtccgttggtaatggcgacggagggtttcaacgtcagcgacttgtaagccggcgtcaacaatgtgttgtaagttttcggtcatcccaggaacgtagccacctgggaaaatgtacttatctaaccaaccgttagtggcgccaccttgttgccgggtgatgccgtgcaataaggcaacgccgtcagctttaagatagtggttaacgcgttcaaagtacattgctaagttgtccttaccgacgtgttcgaacatcccaacactggtaatgtagtcgaaagtttcgtcgccaagttcacggtaatcttgtaaccggacttcagcaacatcactgaggccttcatccttgatgcgttgagcaactaggttatattgttcttgtgataacgtgaccccgacgacttttaagccgtattctttagcggcagtcaacatcaacgtaccccaaccgcaaccaatgtctagtaaggtcttgccaggttgtgggttgagcttttgaatgatgtgatgaaccttatgaatctgggcttcttctaatgtatcagtgtcatgtttgaagtaagcacaagaataggtcatggttggatcaagccacatcttgtagaagtcgttacccacatcgtaatggctttggatgtcttgttgactcttcttttcagagtgagattgtttaggcatgaacttcttgaacttagaattgttgaagaaactttctgccgattcataggccgattcaattaatttttgaatactgccatcaatttcaatcttgccatccatataagcttcaccaagggcaattgaagcgttcttggtaatttcacgcattggaatggcttctttaaaagtcaccgtgacttctggtgtgccttcaccataagtttcactacttccatcccagtagttgactgtgacgggcatattgaatgagtggcttagaagggtgtggtaaaaggttttttctagcattgcaataaggatcctttcttcgtaaaatacactaattattatacgcttatgaaaacagttttgtaagcacaacgaatcgcgacctgattcgtaaacatgttataataaattaattacaaaatcagttgatgggggtgtcgtgatgaaaagatggatgtggatcgtgtttgcagtaattatcgctgtgggggttggtagttattcatatacgcggtaccgtctgcaggaagactcatacacggctgaaatgcgaactggtgagcgggcactgcaagcgcggaattatacgttagcggagacgagttttacacatgcgaccagaacgaaagctagtagtactgaggcgcaacggtatttaacccagacccagacttatgtggctggtcaagaagcattggctgcgcggaaatttgacgtggctaaacgtgactttatgacggttaagacgaccaagcacggtgcagttacgttaattaatcaggcccaagaacaacttgccttaataaaaaaagtgcaacaaaaacgcaagacttatcaacaacagtatcagaaagctgctgagctgaataaagcgaatgagtttacggattctaacgttgtaattgctaagttattgcaggataaggcgtttaagcaacgttactatcaggatattcggaaaaatgtgttggatttacagaaacaaaataatgcgtcactcaagacattgaccggttcagcaccggtgatcccgagtgcggcacaagcggttacggggatgaccggaagtcagcaacaaacgcaacgcacgccagccactaaacagcaggtggctgcttcatcatcaacttcctcagctaaccattcgatgggctcgtcagctgcagctaacaacagttatggtgacagtcaagtgcagacgactcgtgctgagttgactgcgcaagggctcgacggcagtagttatagtgatgcccaaattcgtgctattctgcaacgagcagcggcacaacacctctcactggcgcaagctgcccaaacgatgaattatagctctgatcagattcaggcaacgcgtgcggagctagcgcaagctggatttaatgctagtcagtatacggatgcccaaatcgaggccattttacaacaagccagtttacaacatatgtctctggcgcaagcagcgaggtcgttgcagtaatataaacaatttaataacagtatggaagtccacttaacaatcatcgataaaacacctacttttaggtgtcaatcggtgatttttttataaaaactgttatagaatgtaggagtaaggacggaaagttttcgttcttgatattttggttctacgggggcggtcattttatatcggtattggcctttttttaacgttcatatgtcaaaatgggtataaaattgactattttgtgtactatttttgtttgatgctatagaatattaacagattagggggttaaggtgcccgttgatgattgaattaatggcagaccaaattaacatgatttggtaaagtagttcgattgtcaatggtgggcatcgaaattcagtatgattattaataaacatgtaatgcgcagtacgaatgaaaagcaagttctgcagcaggttattaacgaaggaccgattagccggagccagatttcacggaacttgagtttgaataaagtgacggtttcagatatttataatcagctactgcggacccagttcatcaaggaaattggctgtggtgtcagcacgaaaaacggcggtcgtaaaccagtgatggctgagctgaacgtgaactatggttttgtggccagcattgacgtgacggctgacgcagtcaaacttatgtattcacggttgaatggtaaaattttgcactttcaaagctttaagacgagcgatatgacgttgacggatgtcattgatttgattgaagatcaattacggaacgttgatgactatggtacgattcatggtctgatgggggtcgccattgcgctggatgggattatttatgagaataaaatcctcaagacatcgatcaagggactaacacactttgatctagcaaagtatttacgtgataagctacggattccggtagttctggaaaagaaagctaacttaacggccgtttttgaacgtgatttccatgacaatgagattttcgataacgtggtttcagtagtcgttcgcgatcaaattcatgcgggaatcgtggctgattcgcgactatattctggtcatgaaggcgaagcaggtgaagtggggactgctttgttagaagatcggcacgttgaggaccacttggcatccgttaacgattatgcttctgaaaaagccttgtgggctcggttgaaggccatcaagcatgttgatcgattagatttaacgacggtcaagcatgactacatcaatcatgatccggaagtgacaaaggtcttcgatgactttgtttactatctatctaaagtgattgcgaatgtttccacggcgttcgcgccagatgtggttgtgttgaacacgaccgttctagaaatcttgccacaactattgactaatgttcgggagagcacggccaagctaacttcgccaagtcggcaagttccgatcattgcaaccaagaacgtacagtcggcggccttgttgggtggcgcctcagttattattcaccaagcattaggattagagagcttaaagatgcagttctcataagtcattaagtgtttatttaaacgaacgtgtgaagtttatcgagtgattagtgataaacttgacacgttttttgtcgattcacaacggccttttaatttttattgctgagactttccgttagaataggagtaagggatagtagaggggtggatgttgtggaattttggtcacagttaatacgaaatgtgcgctggcggcgcgcctgcgtattggcgttgattgtgttaacgctatacttggcatcaagtatgatgagtatcattttattaacgtttatttttacgttcttagtgacgcggttagttcgggcagttcggcggtgggtgaagattccaccgacgatcattgtcctagtggtctacgcactagtcattcttggaatttactttgctgtatcgatttatttaccgcagttgatcaaacaaacttttttgacgtttgaatcagtctatcggttttatcagaacccatcacatgatactaaccaagtgttgacgtgggtgacatcgtattttcaagagtcggatatactcaaacaattgaagggcggtatttcagttgtgttccagtatattactaatattggtaatatgggactaaccttcttcttgtcatttattttgagcttcttctttacgattgaggatcatcagatgcgggtcttcacgaagcgctttttgaccagtacgtttggctggttctttcaagacgtccatttctttgccaaaaagtttgtgaatagctttggcgttgttttggaagcgcagttcttgattgcgattgtcaatacggtgattacggtagccttcatggcaatcttgaagatgcctcaactgattagcttgggattaatgatctttattttaagtctgattccagtcgctggggtgattatttcagtcgtaccgctgagcttgattgcctattcggttggcggtttgcgctacgtggtctatatgctcttaatgattttggttgtgcacgccttagaagcctatgtcttgaatcccaagtttatgtcgagtcgcacggagctgcccattttttatacgtttgtcgtattactagtgagtgagcgtctgtttggtgtctggggactgatcgtcggtgtaccgatttttaactttattttggacatcatcggcgtgaaaccggttcaccggccgcgacctaacattaatctgaaaaaaacgattactttccacccggattctgaaaataagcgctgatattgttttgatttttcgctttttcagtgtaaaatagggtgagtaaataacttaagaaagaggtcattaactgctatggcaaaattagtattgattcgtcacggtcaaagtgaatggaacttatctaaccaatttactggttgggttgacgttgatttaagcgaaaagggtgttgaagaagctaaggctgctggtcaaaaagttaaagaagcaggcttagaattcgattacgcctttacttcagttttgactcgtgccatcaagactttgcactatgtgcttgaagaatccgaccaactctggattccagaaaccaagacttggcgtttaaacgaacgtcattatggtgcattacaaggattgaacaagaaggaaaccgctgaaaaatacggtgacgaccaagttcatatctggcgtcgttcttatgatgttttacctccattattgagtgccgatgatgaaggttcagccgttaacgatcgtcgttacgctgacttagaccctaacatcgtccctggtggcgaaaacttgaaggttaccttggaacgcgttatgcctttctgggaagaccaaatcgcacctaagttattagacggcaagaatgtaatcattgctgcccacggtaactcattacgtgccttaagcaagtacatcgaacaaatcagtgatgatgatatcatggaccttgaaatggctactggcgaaccagttgtctatgactttgatgaaaagttaaaggttcttggtaaggaaaagttaggcaaataatttaatagttatttactagttttttggagcactccgctgtctcaggggagtgcttttttgggcgctgagggccgataagagtaatttctggaaataagaccagctcccaaaacggcagaatgagaataaagcagagaattggagttaaagctaaatatgagtgaaaaagtagcagcagatgaagtgacacaacgtgaaatgatccggattattggtttgttccgcaagcaaggtttcaaggggaactacctgagttttcaacatgtggctgatgaaggtgccgcgtacttcgtggtcatgggtgacgaaaacaatggtaaccagggcttgttcaaagctaacttattgactggtgacgtggcgttccagtacatgttggatgaggaccatgtggtaagtaaatagataccggataattagtataaaagcgtaatcgttaattttcatgatgaaagaggctatatctgtcgtagcctcttttttgtgtatcgagttttatgaatgttaatttaaaaactggtatacttacgtataataattaggttgaaatggatgtgcactacgttatcgtatagctatgttttatgaagctgtatttaaccataaaataagtaaaaaagataagttcagacaagcttgaaatatgagcttggtgcgggttgcacagtgtaattaacagaattactgagctggacaaaacaagcgaaaaagataagctgagataaggttagataagcttgaaatatgaagcttggtgcggggttcactttagtgccagccagagattttcatctttggatttttttaactcaactatctgattgtacctaatgtcagctattctttttctgtaagaatagttctgataacatgccgtaaaggcaggtaccaagaataaagatggcccaaaatatatcggtagtggattcaaatccatgactgtaatgcatcaggacaggaataaagagaagtaaagaaatccagaatctaaagctacgataaaaatttttttgaaatttaaatttcatttttattgcctccaaaatgttttaccatacactaatgctgatggagatattagtccaatcattaatgtttaaagagatggttaacgaatcttcacagtgacagttagttgttaaagatttcaaacagcaaaataaattttctttgaagttaagtcgccattttttaatgttcttctatgcttactatttatcagcacttctggatgatttgtatcataatttctattatataaagtacccccttgagttgaagtaaatccagactcaggggggtattatgttttcagctaaaataaagcaacaagttttaagtaaatatctccagggaaattcgtccctgttacttatgaaagaatatggtatcaaaggaagtgcgacgatttatcagtggctcactcaatttgaaatttttggcattcaaggattagagaattgtcgtaggaagacattttatgactattcctttaaaatcaaggttatcaaatggtgacaagaacatcatgcctcatatccagtaacggtaacccatttcagattgaagcaaccgatgatggcttgggactgggaacgaagactgattgagggacgtcttaagccatccaaaggatggtctttaaaaatgacagataaatctaaacaatctaagacattgaaacaacttcaggaagaaaacgagcttttacgaatccggttagcatacttggaaaaactcgaagccttggcacagaaaaaatctcaaaccaagaaaaagccagctaatcactgagctaaggcgtgaattcaatgttaaattagttgtggttttaaaagcagtatacatgccgaatagtagttactacgatgcacttcaccgtaaatatcaatcaggatcatcaacgttaatcacaaggcagtactttgtattatgcgtgaaaataatctcctttgtcaggcattcaatcgtcgaacgaagaaatataactcttataaaggaactgttggtacagttgaccataaccgtttaaaccgtcgttttaaaacggattgtccatttcaaaaaatcgttactgatgtaacggaattccgttaggggaatcaaacaatcaacgaacgtgcatactttacagcttatattgacctttataacggagaaattcttgaatgggccattggtcgtagaccaacggtagccttcatcacacgcccccttgaacgattagtggcacgacgttcgggcttaccataccgtatgcaattcattaggatcaggggcttcagtatcagaactgtcggtacgtgaatattttgcgacaagctcgcgttttccaaagcatgagctgcaaggccacatgcctagataatgtggtagctgaaagtatctttcacattcttaaagttggcacggttcacaattagcagcttagaaattcactccaatttatggggttcacttcagttgtgttttttatataaggttactgaagaaacgaagttagagcggtattcagccgactaattgaatcgagatttttaacaagaatttaagctcaatatctgcggaaaactacaatttcttaataaaggctcttgaaataccagataagaaactagcacacttgatcttatttgtgagtataattgacttatcaggttaacttggaggttgatggcatgcaagtgagtcaattgtcaacgccgatgtgaaaatgtcgttttttgccgattaaaaaatgctgttttttaccgataaagtttacagtgtctcactgctcctttctttattttgtgcgttgaaacctgataaatccggaattatcctctctttttcaattaaatgatctttcattcgatatgatcgaccagtgattcggataactttagcgtgatgaaccaagcgatctaaaatggcgttgctaactcttatctgaaaaggcgtttccccacttagaaagcggaatatttagtggtgataatggttgatttccgttcgtacgtcctttcaattaactgaaaacagcttagcgcccacgactcaattggaagataaccaatctcatcaatgattgaatttgaaaacgggcataccggcgtacacttcttcgctccgccttgaacttgtgctgtttaagcttgttgatgaggtcgctacatcgaataaactgcgttgaatttccttgtttacaccttcaattccaatggcggtggtaggtgagttttaccgacaccgaggtgccgacaacaaaacgttttgattctcttgggtgaatcttagtgatcccaagtcctcaattatcccttggtattcccggttgataactaagtcaaagtcagctaactttttttcatatgaaagcggctagtttaattctcaaattaatctttttttgttcccggtattaagctcagccgttgtcaattcgatagcatcactcaaggacttgggtgcttcatcttgatgatccaataggtagcctaatgttcggcgaaacgatctaactttaattgtctaaggttggtgtataaagcttggtaattggccattttcctcactccatttctcaaacatctaatcttcaggtttcggtcggacgtaatcacaatgactcggtcatcacgattcttctaaaggtctgatcggacactctcttccagtcatcgcgaaggtaagtaaatcttttcagtgaaatagggtgagaacgaattaaattctccgttatataaatgtatagagtattgtcatcgtgtttaatttgtacggtttcgtcaatatatcttatggggacggagtatttccgattttgaaagacaatcattgattccttgcaacttccttgcgatggtttggctggcataggcatcgagtaagtcgtatcaaaatcatgagatactctttttctttatcaagcaataataaggcggaatttgagtcgcctgagaacttctcatgattcagctgatccacgtcaaatggacgatctcggctaagtctagcggctcttcaaactcgtggttgtaaactttgattcgctgagtagttctggccagcgcctcaacctttccttgggtttggtggccgaaacggcgacaagcaatgggcttgaaaccacgtccttagcgtattcaacgaaggttcacattaaataccggcttaccaaaattacttttatgatgatcgacgacaaccttttgttgtcaaaaccagatttctttcgcacacccccggtttgcccaaaaggcattattaagcaatcaaaaaggtaatttgggggctggcgactgaaggagaactttggcatgtattgtcattcgcgataccctaaaaacatatagaagatgttgcctttgacaatctctccaggccgagaaaccaacgttaaatcttctttccaatcaagcctgggctgacaagcacctgcgaggttcatccgggatagtggcttttttcgttgctgcttttcgatggttcgacaatagtctctgagaattactttgctttccttgatagccccgttctttgaataaagtaactaaattgccgttgccgaacgcttctagaaccttttcttcaatcgtttttcgataatcgtcaagttttactccgcacgccgtaagggtttgggggctgctcatctgggggcgtagccactaaattgtagtatctttttaccgttcgtggatcaacacgtatcgcgccgaccatttcagcgaaggttgggctttattttgtcataattatattgctggagtgcaaacaacctcccacacggctcctcaacatctaaacgcatttcagttcctccaaatttgagatgcgtttattttaccgtaaaaaaatgttggaaaaccgacattttctaatcggtattttccaacattttacaaccgttgctgatatcaatatcaagatttacgtgttcagcgaacaatcaatagtatttacgatgcttttaaacggttaatttgcgaaaaagaatattcaaaaattacagtgaccgaattggctaagatggcccagatcaacaaaaaaacattttatcggtattatccgactttagatgatttactgattgaattacagacgcgatactctcaagcctatctaaaagagattggtaatttacaatatccacgagatctagcaaaaagtgtggaagcttttttcacctattccgctactcagggtgaggcatatgatcgaattacgacgtgctcagtggggtcttacgttggcattcggcaacaaatgatcaacgaagtcatgactaaaacttggggccagtcccaggagtttaatcagcttgcggattggaaacaaagaattttactagattttgtggagcagacgggactgaaggtttatacaacttgggttgcaactggtaagaaagaaccccttgaagcagttattagcgctgctaccgaattaatgcaaggcggtgtagaacagtatttaaaattagagcagtgagtcaattttcagtttgagtatgagtataagggtcgagattgttaaaaatacagtctcggcccttattttgtatattgaaagaattttgacgattttggaagcctactagcgattaatgtgtactctaaggatgtttattacttgattcacgttttaatggacgaaaaaataatcaaattgatatattttatgcgccaaattcagaaaaagtgtggcataagtcccgcttttaaaaatactgcccattttttagtgacggaatccatcgcataatgaatccatcagcaacgaaataacggaggctattaaatgacagttaaaattaatgaagaacgggcagttgctcgtgttgttcaccaacaagttcagggaatgttagaaaaaaatcttgaattgcttgatcaggtaatcgcaccaaatgctaagttagtgcacatcacaggaactgttcaaagcaaggctgaatggctacaacagattagacttggacgcatgcactactttagtagtcatgaggttttgtttcaagtggttgtaaaagggaagcaggcgcaagtagtcatgcgtaacgagttggatgcacgcatctatggattccggaatacgtggcctttgcaatccaaggtcgagttagttaagggaccacacggctggcaaattattgcctcacacgcgtcgatgtattagaaggagaaatgatgacaaaaagaagaatggcaatcgcaacgattgcgttgttaattgcgaattttatgggtggcttagatgctaccattgttaatactgcattaccggcaattaccagtgatttaaatgggattcgcctgattggctggatcagctcaatctttttattagggacagcagttacgacggttttatggggccgagtgggtgaattgattggtaataagctcaccttccaaatttcggttgtgctatttatcattagttcggtagttggtggtttgtctactaatatggtcatgttaattattgcccgagcctttatgggaattggcgctggtggaatggtttccatcccatttatcatttatgcggacttatatgaaaatcctgctgaacgagcacgagccttgggatgggtcacggcgttttatacgttatccaccgttgtcggtcccttgattggtggctggctcgtagacacattgtcttggcattgggtattctttattaacttacccattggaattatctcactcctgttattgcaattctcttaccgtgagagtgagcatgaagctactcaaaaacgatttgattatttaggatcaggactgttgattgtaaccctgattgttttactgtttgctagtgacgcaatcgctccaaatttaactcaagcgttggttttactggtaattggtttgatcttaatggttattttttaccaagttgaaaaacggcaaaaaaatgcattggtacccactgaattactgaaaaattggcgtatccaatcgcaaaatgtcatcatgtttctgattaacggtttcttcatcggttatagtgtctacgcaccaatgtggtcacagggactgttaggtactagtgccacgttaggtggtttgacccagattgctggttcgatcctattattggtggggacaaggtatactgctcatttgatggtaaaaatgccgtataaacgaatcgttatgtttggaatccttagtgttttactatcagcattatcgatggtgatggcgacccaatttgcgccttattggtggttattagttagtggtggctttaatggtttgggaatgggcttatcgtttacaccaatgcaagtttcactacaggatggcgttcgacgagatctaattagtgtttcaacaactttcgggttgttattcagaacacttggtcaaacgtttatgtcttcaatttttggtgcgattttgagcattagtactgctagccagattggtgggaaaattacgacgcagatgatcaataagttaacggatgcaagttcggcacgctcgttaccacagaacttgttaccacagctccgcaccattttatttaatggtatgcatttaattatggtgattggtttgattttggtggtcattgcgtttgtaattaatctgactcgcaaagaacctgccaagcaaccacggtaaaatattttaagcgtcggttatgagttaagcgtggcatatgtctcaatttttaaaacattgaccatttttatataagccaatttacgcgataatcaaggtgtaatcaagaaaggaagtcccaaatatgatggatattcaagaagtttcagatcggttagctttaaagcaggttgttgatttattttcaaattactcagacactaaagaaaatgagaagcaggttcaactctttttaccaaacggtaaagtaaatattattaatgatggtaaagttacgtttacgctgaatgggcgtcaggaaattctgaacgctttcagttcttcaatggacgattactcagctgtctttcatatgagtggacaacaaaccgttagtttcacggacgcaacccatgcggatggcattgcttataattacgttacgctggttaaaaccaatgagcaaggtcaaacggtgacgactaatgaaggggtccgttatcaagataagtacggaaaagtcgatggtcagtggtatattgcagaacggaattctaacttcatttggcatacggaggacgtgaaataaatgaaaaaaggtttaattattggtgcaaccggatcaattggtagtgccgcacgtaaaatattgttagcaaaaacggacgtacagttgactttatattcgcgccgtgcagaccggttaaagttgatagttgatcgtgaaacggcggtggcagggagtgtcactgatgatgatcaactagatcaagcgattaaaggacaggactttgtttttgtcgcattaaatggtgatatggatagctttgcagctcatattatctcagcgatggaacgcaatggcattcaacgattaatttttattacaacgatgggaatttatcaggaaattccagcgtggttaggtgattcgccggaaccttaccacaatccgattttaaaatcgtttcggcaggcagctgaccgtattgaacaatcagatttaaactacacaattattcgtcctggttggtacaataacgggccaatcaattatgaaattacgcaaaagggcgaatcattcggtggtcatgacgtttcacgcgatagcattgccgattacgtcatgaaactaattacggaaccagcgctcgacaaccgagctagcgttggaatcaataccccagaataggagcagctaatatgaaaaaagaaatcacattaaataatggtttgaaaatgccagtattaggattcggagtcttccaaatccccgattttgaagaatgtaagcaagcagtcttgactgctttaaaacaaggttaccggttgatcgatacggcagctgcgtatggcaatgaacgagcggtcggcgccgccattcgtgagagtggcatcgcccgtgaagaaatttttgtaacgactaagttatgagttatgggtccaagatgcgggttatgagcaaacacaagccgctatccagccctcacttacacgtcttggacttgattatattgatttatacttgatccaccaaccgctaggcgatgtttatggttcatggcgagcaatggaagctgcttaccacgatggtcaattaaaggcactgggagtggccaactttgaaaatgaccggttacaagatttgattatgcataatgaagtcaaacccacagtcgatcagattgaacttcacccattttatcaacaaccacaacgggttcagtggttattgaatcatgacatcgtaccggaagcctggggcccatttgcagaaggcaagaagggaattttcacaaactcagccattcaagaaattgctgaagcacatgggaagacgaacggtcagattattttgaaatggttgaaccagcgtaatattgtggtgattcctaaatccgtgcatgcagcccgcattgttgagaattctcaaatatttgattttgagttaactcaagacgagatgcaacaaatgacaaaattagacgagggcacgagcctatttggcaacatgcatgatcctgaaacggtagcgcaattgggtggctttaagtttgactattaattggcggtgatacgtaagaaatcaaaaactgcttaagaccaacttgttgactggtgaagtagcgtttaaatctgtattggctgaggagcacgtgataagttcaaattaatgattgatagtgagcacgattactgattctagtcattgtgctttttactgtaaaacgtgtaactatcaacttttcagctaatcgttacgcgtttggcaggcttcgtattattactggatatgaacaggtgtgtttactgggatatgctcgtacatccacttagcatccgaaatggacaagcggacgcaaccatgtgaatcggaccttttgccgagtaaggctgccttgctggcaatatagtgatcggatgcgtctactggaaccgagtgaaagaggtagacgccgtgatccttaaatgagacccagtaattggcaccttcgttcaagctagcattgtaaaaatgcaggccgcgttcaggttggataacgaaatcgcctttgggagttgcatttgcaccgggtttaccggtagtggcaagcattgtgtacaggagcttattgccagctttcaggtagacccgctgttttgcaacggagacatcaatcctcaagttgggataattttgcacattcggataaggatggttggattcagaagggccgtgccaatcaaccggggttgccgttgcagcggctgttttatggctgacactacttttacgcgttttagatttagtatggcttgaattagagtggcttgtactggcagcttgagccctagttgcttcgaaagcaaaactatttctaaccatacttctaatcccaaatagtagcactattccggaaaaagataaggttagatatagaataaactttgttgttagtttcatgtaatcatactccttaattttacattactgcatagcggagggtgccagagccagaaatgtattgtaaccaagtgtaaccgtcagcagtaatctgggcgttataaataacagagtcaccggggtagtagaccccaactattgacgctgacgttgatggtgcagttcggatgttggtttgttgagtaaaggtaaaagtacccgaaatattgttggtattgtattgtgctgaggtgccactcattgcaacgtaacgcgtattgccagagccggaaagatactgtaaccagatatatccctcagcgttaacttgacctgtgtaagtaactgaatcaccaggatagtaagtaccgacaacgggtgccgatagtgaaggtgcagtccgaatgtttgtgttctcagtaaatgtataagtgccagatacatttctcataggattggttggcgtatatgtcgatgttgacggaatacttatcgtacttggcaaagcaacgtaatggattgcaccggtactagcaagatattataaccaagtatatccttcagctttaatctgacctgtgtaattaaccacgtccccaggataataaacaccaatgataggtgcagataaggatggttctgtctggatattcgaattctgaataaaggtataagtgccggacctgtggttaccggtggttgtagttgtcgaaccagtattgcccgtaaaggcttcttgatcccattcctgcagatcgtaatcttgaatggcattaattaatgaagtggcatagttaggtgccgttgcgtagccatcgttttgcaaatcccatgcaacggtcgaataattttttactccaagcaaattacggtaacgagaattttgattaaggaatgcgccatgatcaacaatactagttgcccagtctgggtattttcgaaaggtagcctcaatcgttacgtcttcgccatttaaatattctgttgttggcatttcaatagaatgaccatgatatgagcctttgattccaaataaattatgaccttgaactgataatgtggattttcctcaaccactttcgagtaatgcttgtgctccagaaatggatggtagaatatgatattgtgaccacccaatcattgcaccaggtttaattgcaatgaaaaagttttttacataatttggaacgccttgttcaacgtcatcgcgaagtaaagcaacattaggaagtgtgaagcgtaaaaattgacctggtttaaacgaaaatgaactatgtactgtaaatggtcgaacatggatagaattagttgtaacgggtgtcggggatgtgataggggctgaatcatcaataaattgcgtgctatgactaggaatagctggtgctgctaccgttgtcggagtatttgcaatagttgacttgatgttgtcggtgaaactgacattggattttgctggtatatatggtgccgtactggctacggaggtagccgcgctattacttgtagttgctgtctcatttgaatttagcttaccagtagtggatttagatatttgtttgcttgctgtagttgtggaaatattactagtggctgaactggcctgctggctagtagtagttgctgttgaaaattgatgggttgctgaagacacgttagtagcactgttagccgtaattgtactaattgatgatacttctgaggtagcacctgaagttgcggctttaactttagtggtactaggacttgatgtttgatcagctttcccttgtacaggctttgctaatataattcctaaaacactgctcattacgacaatagaactgagttcgacaatcttatgactagtgttcttgttatacgtactccattttttcataaaatattcctccaatttctgtgcgataaatgaaaaaatcacaacagccacgtgattatttccacgagttgaatcctagcacctggttattcggatggaaacgtcaaattaaatgaatagttgtaagtaaggttcgtcttgatgattatagcgggtgtaaactgacttgcttgggtaactgtggattttttgagactgatacggtgtggaaaaatcatagtcaggaaagtttccaaattaatttagggtcgcagtcttttagggtgggcgctaagtggtagtgatgtgattgttggcagtaaagtggtagccgtgtaggtataataagactaacgaccattgcttgcacctttaacgcgtgactactgaaagtaccaatgttttgtggcgatggcgataaaaacaacggttattagaggttgctcaacgcggacttgctgattggcgaatgtttacgttataagccaaacacaaataaaccagcaaataccaatgtccctgattattcaggacatcggtatttgctggtttttaaattagatgaataacaaaattagttaatcaacatattgcgcgtagtcgatccctagtcgcttggcgattccggtaacttctgcgagtgtcttgtcatcaatctcgatgccgttagctgaccggtcttgatacgcggcagcttccttatcgccggcaacgatgactggtttgccgggaacggatggtaggtcgcgaatggcttgcaagtaagctgaaaacttagcaataatggcatccttatcaccaaagattgaagggtcgatggcgacaaagctctgacaagggcccacggaaaggtcgtccggagtaatttcgttggaggtgttgcccattgaaaggattgctgtgaaaacctcgacgatgacaccgagaccgaaccctttgtggctaccggtgtcttcggtaacgccacctaatggagctaaaccaacattggaatctaaatcacggagggcatccaagtctttggtatcgttatggctattaacgggcgtttcgccatccttagcgacccataatgcgggcatatctttacctaatttacgataaacttcaattttaccttgtggcaccgtcgttgtggccgcgtcgaagataaatgtgttcgggttggctggcatggcaaaggcaattgggttggtgccgaccaatgctttggtagcatgagtgggtaacatcgctgaacgtgaattgcacgacgacaggccaatcagaccttcttcggcagccatgttggcatagtaacctgcaataccatagtgaccggagttacgagtcgtaacgataccgataccgtgttgttttgctttttcaatggctaggcgcatgctatagataccgttcaattgacccaagccaaagtgcgcgtcaacgaccgcactaacatcggtttctttaacaacttctggccgattatgtacgcgaatcttaccgttacgaatgaagtcgtcatacatgatcattcgctggacgccatgggattcaatgccaatcaaatcggtgtagatcaacatgtgggcgacttcttggctttcttcttcggtaaagccgtaacctttgtaaatattgtaaatcagttgttcaatttttttgctattgtatcgttttaccattacattcaccacgttatttgaaatagacttaagtgacagccctgtatattataatatgataataataaggactttgaatgtcaattgaattttaataatcctttaatcgtaaactaattaaaagtgtcatcatataacaggtcaacctgagtcttcaaagcgcatggaattgaggtcagactaactcaaagctaatgccgggtcatatggcacggaccaatcataaattaggtataactaaaggggtcatcaataaagtgtgccgttaactgatggcctgtttagggtggccctcattagtagctggcgatgaattggacgaaataaattgtggctgcgacgttggctgatgctagcgctgagaccgcgaaattgcggtttaggtattgctggtcaatgtgcagactagaatggtaagttaaattatttgcgaatggttgcagttgttgcacacgtgcttgtggataagttaaaggaattagatgacaaatcggtaattagttgggactaatgactgtaaatgttaataacatgacttatttgtgggtaagtgcatgagtatctggggataagtaaggaaaatgaggataattgtggtgaatccagccatccacagtgcataacttttatgatgtagaagttatcaacagatttattagatatgatgtgaaattgattactgggttaagcggaaaaatgagtgtcgtaacataatgtgaaatggtttggcatattaagctgtcccgaaagcaatgctttaaggaaaattacttgaattttcaacaggtcgctgacaaagcgtatcgttctttgctattatatttgcttattgaaccgatcagcaaccctggcatagtagtcgcataaaactgaaaacatttgacaaaagaacgactcataagcgctaatttatcccatatctatcccaaaagatagtacctattaataaaaatggtacttacattatgccttagtatcatctatagtagcagatactttaaagctaatgaatggagcgatagtaatatgaaaaaaattattgttaatgaatatggttcagttgatgttctgcaagaagttgtcgcactgaagccggttccaggagaaaaagatgtgttgattaaagttgccgcaataggagtcaatgatccagatatcgtgatgcgcaagtacggcccgtttccaacgatgccggcggagtttcggccgacgttgccgcacatgctaggtggcgatttttctggaattgttgagcaagttggtgctgaagtcaccaagtttcaggtcggtgatcatgtgatgggctatactaaacgggggacgtatgcgcaatacatcgtgcttgatcaagacgattcgctatcgcaagtccctgaccagctagacttgattccacttgggggactttacttaacggcattaacagcttggagcgccattatgaagaatgggcacttgcaagccgggcaaaaagtgttaattcatggtggcgctggtggtgttggtagtatggcaatccagattgctaaggccgcgggcgcaactgtaattactacggctcgttcgtagcataacgcttatctaaaaggtataggtgcggatcaaatcattgattatcaaactgaagattttacagaattagttcacgacgttgatcttgtggtgaatttgacgggcgcacaaaccttagccgctagttaccaggtggtgaaacggggtggccgcttggtctcggttaacggggtgccagataagaaacaagcagcagcgcttggaattacggcagtctatgcacttggcgatctttcagaggatgctcgcaaggctattcttgacttgtatcagcaaggtcaattaacggtcactgtttcgaaggcctacccatttacgctcgccgcggtcaaacaggcccatcttgattttgaacagggtggtaatcaaggtaaacgggtaattgtctttgaccaggaaacgaccaatgtttagctggttttatcgtgagcggacgcgcttacccgagcagttacccagataagacactagaagtgggcaatgacacgaatcagcgtgcagccgcgcactaatctgttctaaactagtattagtaaagaaataaaatagctatctagacaaatacggtatcatgaacgacggtggccggacaatctttagtataatagtggttatcagttaacgtcgtacgattgattaattatgaacagggatagtaaatattatgaatgaatcggtatcggatgaaaactttttggattgtccatttgccagtgttcaaaaagtcgttcgcggaaaatggagcatggttattctgtatttccttagtcagcgggtcttgcgttttggtgaactcaatcgcaaggtttatccaccggtgtcaccaaaggttgaatattcactcaccccattaggagagaagttcttgcctgttttgaatgctttggagaacttggcggtagactatcaggattaccaagcttaattaagtgaaatcggttaagaacgagcatgctccggtttattcacggcactaattgtcgtcataaaaattaaaaaacgagatccagcgacgtcttcatacgtgcttggatctcgtttttaggtagaactaagtgactatcgagcccagagttgggtcgaatggcgatgtcacttggccttgaaccgcataactaaaatgataatattgcttttaaattctgaaagctaatgaacaactcttctttgaaacttttattgggaatattgttttatttaatacgcatgatttatctatccaagaaggtgtctgcattatgcggcagaatttggcgcgagtgttgacgttgttttaactgacaagattagtttttggaaaaacttagccgaacggattaccatatttttgacagtattggtaaaattctaagcggtatagatcgatagttcgggttagttcttcactagattgaaaatgaattagttgtaaaacggcggcagtaaatgccagtgccgctgtgccgttagctgtgactagattcttgtcgctaatgacttgctgttcatgaaagtcggctgagttttgatagttaggataattgtgccacatcgccagtgaattgccggtatgctgataaccagttaaaaaaccgttttgggctaagtaatctaccgcaccacagattgcgccaactggttttgaggcattgaggtgttgctgaactagtgaatataataatgaattattgatattccaagagttaccaccaattaggattaataagtcaatagttggtaaacaatccagttgatagtcaactttagtggtgaagccaccaattgacgtaaccaatggtgttgttgaagtcgttttaacttgccagtcagtgctttgatttaattgactagctagataagaagcttcccaatctgcgtattgatctagcattagaaataatgcagttttcatgttgacctccagaggaaaatatattttcagaaccgaatatgttatccttaattataggaacgtacgttctaaaaagcaagtgcatgattaaatgttggagggcagtaaatgagcaaacaatccgtaattcttgagttaattagaacacatatttgctatacaccacgggtctttcaacgtattaataagaaattagccgttaatttaagcgaagttgaaattaaagatttagtcaatcatattctgatacaaccagatgaaatcaaaaggtgtgggaaaaattattatatccgaagccgtaaagcgcggatagaactaacagttaatgctggtaattatcgcttaattacagccagtaaatacacagaagtcgacggcttttaattaataaaacagctaaaagtaatgaaaatattagtgaatccgtgtggtggttgagtattttggcaatggaaaatgggtttgacttggatgatgcagtgaagtgcttcttacgaaataaagcggaatacttaaaaagttaattaatgttagctgagaataattacaggagtgcagaacattttaaaagcaataaaatcccctcatcaggctagtgcggaagtctagctgatggggggatgtgtatttattttgacgtgatttaattacgagctgccaccgattttacgagttaaacagcttataaccagtattgattgataactagtttaaattaagcgttgtatcaaatgtcttataagcgttatcgtcgtcataatcgtcagtatcataactagcatcccattttagacgaatactagtgatgtctttaacactggatagttttgacaaaacaaagtataggttaccgtcagaatcggtaccgctgtttaaatcaccgtcaaaatcatcgctatccatgtcggcttcgacttgttgaccgtcgttagtgctgagtttggcctgggtcggataggctgaaatatcttgcccagcatggatactcatgtgaacttttacgacgccgttaaaatctttcttgtcattgccgctaccgctagtataagtgccatcagttttgtagaccgtgactttatcgattttaaatgtggatttcgcccagctactgtcggtaaatgaggtactgtaagctttttggtcggcaatatcgatgtcgtcatcaccaatagtgatactgtcagaatctgattctgaatctgagtcatagtccgtgctatcgctagattcttcactatcgctatcgctgtaactgtcgtcagagttagttgtagctgacttggaagttgtcgttagagcagcgtccatggcagtatcacgggccgttatgttaatgagagcggcgtatcccaatgtcaataagactagcaggcaccaagtccaccatttgtgtgtccaaggttttggttggctagctaaacggtcgaaacgttttccagctggttcagagcgttggcataggaaaacaatgattaaaatggggccgacaagtggaagcagatagaaccataaataatgcgctgatcgattagagtcgtgaagtcgccgcgcactggctgtgaattgcatcactgaagtccaaaccatgagcgctgaaaaaatcaataacagcacggtttgtaaaacattaacgtgtaatgggctgaggataaaagctggataactgtatgctctgataccaagtacgatggttaaaactagggaaattaggaccaaatctaagtaaagccaccaatattgaggccgcgtaatccgttgtgaccaagtaaaggtttgacgcattcctagctttagtgcggtccacatattgacatgttctggttgattaggtgtgttgtgctgctcggaagtaatggtgttctgatcttcagtggaagcgactttgtcctgagttgcgccacaaaaagggcaaaaggtcgcgttagtaggaatcgcttttccacagttaatacaatactttgtttctgacatcgatgttcctcctggagtacttatactaggcgaaatgttatgaatataagtagaattttattatatggccgagtgaatgattatggcagccgaaaacaagcatatcataactagttaaaaatattaacaaaatattaatactaaattcatattttgttcaataatagacttaaatagttatttatttgctttgttgaaaactaaaagcggtaactctaagcctcagtaaaataacaatgaaatagagattaactttgaacgggagcaacgttgaactatcgatcctgagttcaaaagtagaaatggtctacttccggacggccattatgaacaaagctgattaattgagttatcactcaacggtatcatccgtgattaagtaatagtttgaaaactataagactcctgaaggcatgccaattatatggtgtgctttttgtttttgctatttatggtgttcaaacgatgtatctatattgttatttgctgcttagattagtagtctaaaagaacgagatgcgagtattttacatttgttttttgaacatagtaggtgaaatatagaatgtttatctttctttgaatcatacatttctacctaacaagcaaatttgcacaaagtatgactgaaaatattgcactttttaaaaatgatagcgtttgcaataatgagcagtgtaggagggattaagccatggctgacaaacttactaatcaagaaagacgacttctacaagtgttagcagaaggatcacactatttatctactgaaagtttagcggcatcgttacaggtttcacgacgctcggtctataactacttgaataatgtttcaagaaaattaattagtgtcggtattgaaccaccacgaaatgttaatggatcagggtactacttaacacgtgacagtaaattatatgttaaagatttaataaatggaaaagatggtgaacctgataagcgagtgcatcgtgtgcagttcacagatcgacgaaatattttattattagcactatttgttggagaacgtgatattacaatctcgcaacttatgaatattacaggtgtcgctcgtaatactgtgatttcagacttgtcgagagttcgaaaagaacttggcgaaaaccggattgaattagttggcacgaaggatggacactcactaaggggacaagagcttacgatccgtaactattttcaagttcattttaccgctttaattgatggctatgattgggtccagaaatatcaagcggataattcattctttgcgggcaaagatacggttggacttaatacgatgttaaatgactggatgcatctggttgagcggcaaagcgagcgggcattttccgatgatgccatcagaatgattgagttttattatgcgtttgtcttaaagcgtattctgtcaggatgttttatcccacaagatacatttccaagcaatatagatgatcgaagagagctacgaaacaaaaaagaatttggactagctagtaatttgttagctcaagtgggcgttgaagttggaagccatgattcagaggctttatatcttgaaagcttgttattgagtggacaattacattctgttgagccggatgagcgagacaatgttaagactaaagtttataaggctgcaattgaggtcgttgagagtttccagcagattacaggtttttcattttatgatcgtcgtcaattaacaagtgagctatatgttcatttactctctacttattatcgagtgaaatatcatcgacaatatcgagacggcatggtgaaagcaattgaagagaattatccagatatttatacctatactgagttatcaattcgcccatttgagaaattaaacaattatccattgaatgaaaatgagttgtcattgattgctatctattttgggtcgcaaatgtatcaagatgaatcgcacttgggatcagctttactggtttgttcaacaggacttggaacttcaagaatgctgaaggtacaacttgaatcggcgttcaaaggtttaaaatttgtaggaccaattacgaaacgcaattataatagcctgactcaaatatctgagagtgttgtgctttccacaataccacttgataagaaaaatagagaagtactagtgctacatcctatcatgaatgatcgggaaataaatgaattaacaaaacaacttgctgttcaagggattgtaatgccgactttgtcgcctaataaaatttcagccttgttagatgtaatttctgataatgcgaagattataaatcagactggtttaattacaggtattaaagaagtgcttagcttttctgttaaaccatattctaaatatgagagggggtatcaaccgttgttaagtgaactgattaataaaaatacaatccagtttgcaactgccagtcatttagattggcagcaagcaattgcattagcaacattaccacttctcagcagtggtaatgttgaacaaagctatattgatgcgatgattcgaaacgtttatagcaatggaccttacattaatattggtgatcgaattgcattcgcacacgcaagaccagaagagggtgtcaataaactcggaatggcattgttatgcttagatgaaccaattgaattattggataatcagcaccgaattcagttaatttttgttttagcagcatcaaatgatcgctcacacttaaaagcgttggcagaattggccagtatgcttggagataagaaccgtttaaagcagttattagatgctagaaaggttagtgaagttgagagcgttattgcggaaggagaaaaacagttatgaaaacattagcagctgtatgtagcaccggacttggttcaagttttatggttgatatgaacatggcagatattgttaagggattaggtctagaagaccgtgttaaaacgacccatatggatatggggagtgccaatgaaaattctgctgatcatttctttgttggtaaggatttagcggatgcggctaagaacgtgtttagaatcttttcaagagtattcgcaggaaggctaagctaatcatcatcttactggtgttcagctttcgctcacaattgcgccagaggcgccgatattttcctagccagctaaaaactgagttagttcgaccaacccagcagtctgcgttgaagccagtgggcaactatgggggaacgctgccataaggaatacactcgtagttttaaggcaataagcctgcagcgttaatcaattgacctgaaacatgatgaggctaaaggtgttaccgtaaccaccatcgccttactgcgttgaaggccatgtcaaactgtgatttgtttaacgccagtagcgcattgtgcgccatcacatgctcagaagacacattggcggttgtcacatggactgccatcggcagcccgattgagatctacagcaagatggcgcttaatcccatcaccttttaccaccatcgtagccactactttcagcagatgaggtcttcttgacactttgagcatctagatgatgaatgactgtaaaaagaaactgaacgcttctgagccaaccgattgatggttgcgacaattttttttaaaaccttatcagtaaggagttgactactagcaggaagacatggcggttggtctagacttaaagtcacacataatatatagacggttccctcatttaggaagcaatcatgggtaaatagcgccaaaacgacccttatttcaaggtatacagcagggcaccaaaagatctcagttaaatcaacctgtacttggcttagttccgcttacgtatgccttctagatctgtcgtctgatagatttcaaaaaattgttcacgagagatgtcgctactataatggtgtgcaaagcttttcatggattaaaaactcctgtttttgatctaatttaactaaaatcaaatcgaatgtcaaagtatccaaacacgttctaaggatcgtcttggaattgataaagtgactgttctagacagtattattgataaagaggaattgaagactaaggttacgacatatttaaaagatgcaggtattgaaaataaataggaggtattgtttacgatgcaagctacattaaatgccattattagtattgttcgtacaccagctattttggttggattaattgctattctaggacaggcattacaaaagaagtccttttctgacacagtcagcagtggaattaagaccttcattggtttcttagttttgagcggtggtgctggtattgtcagcacttcattagcgccgatgagcaagatgtttatgcatgcttttggtgttcagggagttgttcctaataatgaagccgtcgtggcaaccgttttagtcgaatatgggacagcaacggctttaattatgttggtaagtatgattgttaatgtaatcttggcacgatttagtcattttaaatacatctacctttcaggccacgtaatgttgtatatggctgcaatgcttgcagttattatgcaagtagcaggttttggattcgctacagaagtgttattcggaggtcttattttaggaatttgggatacagttagccctgctttggtacaaccgtttctacgtgaagtaacaggtggcaatacagtggcgttagcacataccggtgattttggttatgcgtttgctggattaatcgctaagtttactggtgacaagcgtaagtcaactgaagacttaaatattccaaagagtgtatcgtttctacgtgattcaacggttgcaattaccattacaatggccgttatttacattattttggctttgtttgccgggccagaatttgttggaaaaatgagttcagggatgaattatattgtatttgccttaattcaggccggaacttttgcaggtggtgtttacgttattcttgcaggtgtgcggttaattttaaatgaaattattcctgcatttaaggggatttcggaaaatctggtgcctaactctgtaccagcactagattgcccaattattttcccatatgcgccaaacgcaacgattgttggcttttttgctagctttattggcggagttgttagtatgttcattatgattggcttacacacagttattgtcattccgggtgttgttgcacactttatgtgcggtgctacttcttgtgtcattggcaatgctgttgggggacggcgtggcgcaattattggcgcattttctcaaggtattttaatcagctttcttccattagccttactaccggttcttggaaaaattggtttaggtggtgcaaccttctcagatgctgactttggtgtgattggttctttgattggctggtcgggtgttaacggtggcgttgtaatgattattgccgcgattgttatttcgctcatcttatttattgttgcttcgattattgcaagtaaacatagcgctgataagaccgggcaaaataaggctaatgcctagataataattcttttcttctgagtattcttattaataaggtggtagaaaaatgagttttgatgaaatggatacaaaagcagtcaatgcgattcgagcacttagtattgatatgattgaacatgctgaatccgggcaccccggtatgccgcttgatgccgcgccgatggcttatgtcacgtataaaaagcatttacggattgatcctaaacatccaaattggccaaatcgcgatcgatttgtattatctgctgggcacagttcgtcgatgttgtacgcgatgctatatttggcaggttatggtataaccgtagatgatttgaaaaacttcaggcgtcttgatagtttgacaccaggacatccagaattgattacacctggtgttgatgcggccactggaccgcttggacaaggccttggtatggctgttgggatggcaatggccagcaaacatttaggaactaagtataatgttgatgacatcaaaattttaaatagccgtgtctatgtaattgccagtgatggggacttaatggaaggaatcagtcatgaatcggcaagtttggcaggccatttgaaactgaataatttgattgttatgtatgattcaaatgacgtaacgttagacgcacaggcaagtaaaacgttgggcgatgatgcaggagaacgatttaaggcatatggctggaattatttgcgggttgaagatggcaataatctagatgagattgacaatgctctaaaactagctgaggctgaacaggaacgaccgacgattattgaagttaaaacggttttggggtatggatcgccacatgcaggtgaaaacactgttcatggaaatccacttacagctggtgaatgtcgacagacaatgcatgatttgggctgggattatgaaccatttgaagttcctgatgaagttcatcaacgttatgccgaaattttgcaagaaggacaacaacgatatgtatcatggcaaaacgaattgcataagcttaaaaaggtaaacgaagagctggcacaaaattttgaagttaatttttctaatcaagccgctacgggagatatcagtttacaatacaatgctggtgatacagaggctgtgcgaatgacggtgcataaactcattcagaaatcagctcatacgccattgaatttttggggcggctcggcagatttgtccagtagtaataaaacttattttgagaatgatgatggttttgaaccaggtcagtatcaaaataaaaatgtgttttatggtgtacgagaatttgcacaagcagcagctgtaaacggaataacgttatttgggggaagtagaacgtttgggagtacattctttgtctttagtgattatatgaaaaatgcgattcgtatggcagctttgcaaagaattcctgcaatcttcgcgtttagtcatgattcaattgcgctagggcaagatgggcctacgcatcaaccagttgaacaattggatggattacgtgcgatgccagggttgactgtatttcggccagcagatgcgattgaaacacagtcagtatgggactatgcattaaataaaaatcatggaccagtggtgattgcaatgtcacgccaagcacttccagtacttgaaggttcattaaagtatgcaaaagagtgtgttaaaaggggtggttatattgtatcaccgtctggtgtaagcaattcagatgggataataattgcaacgggttcagaagtaagtatttcaatagaggctcaaaccaaattgaaaaggcaaaatatcaatgtagaagtagtttccatgccaagtactgagctgtttttacaacaacctaaatcatatcgagataaggtgcttgatccgaccgttagaaatcgcatgtcagtagagatgggctctactcaatcttggtatcgattcactggtcttgatggtgtcaatatcggtttggaccactttggggctagtgggccggttgatgaaattattcaaagatttgggttttcctcagagaatattgctcaaacttatttacaacattttcgtggatagttatattcaattcgaagttgaatgatataatattaagcatgtaatttttaaaatggcatggagtccgtataggatactatgccattttaaatttttgtgtgaaataataggtgatcatctgacctatgtcattacttttggattctattcagggctgcttggggaatgtctttttgattaactttttcccagttaatcacttgttggcgtttgtcattataaccgactttgagataagcgtgcatcttgagtgagcgtggtaggacgctatcaaaagtgagctctttcttaacaccattgtcgctgtatccaggttgtgagtaatgatagtagacatagggcttgccggaatcatctttcccggttttacgttcacctttagtcgtgatttgagtatagtatgtttttgttccgtaatttgagtggtaccagttgaaaccgagaccaactggtactaatacgataatagtgatgattagtcccaaaatccccgcttttttcattaataatccctccaaatgattaattgaaatctgatattaatcataagagatataagaaacggtggatagcagtttatgcaatgctaaacgaaaaacaagtaattaaataaaaaattaaaaataagtcaatcattcggatggtagcttgttggaaagctaagactattcgatagacagtggaataaaaaaatttgacatttttaatgtaaaggcttacattgttatttgtagataaataaattagacatgtaactggtaatgcaggcaggatctaaaaaagtaacgggcttagtccggataactttttaggtcctgttttttgtcgttaggagtgattaagatggattttaatgatagtgcacaggcaattattttaaacgtcggtggagaaaagaatattaactcgctgattcattgttcgactaggttgcgttttacattgaatgattttgctaaggcagatttggaaaaattgaaaacggttgatggcgttcttggcgctgttattgccggtggtcaatgtcaggtaatcattggtaatgatgttgttgagatgtttgatgcggttcaggcattgttaggcaacagtacacagcaaaatactgccaggggacccaagcaatcatggggaaaagttgtccttgattttatcattggtgtctttcaaccgttagtaccagcaattgctggtggtgggattttaaaggccgtgttaatgctgttggccatgtttggttggatcagtgataagagccaaacttatcaaatcctgaacctagttggtggagcgccgttgtatctactgccaattctagtagcaattacaacggctcagaaacttaaagtaaacccgcttgtggcagtgtcaacagtcggtgtgttgatattaccagacttagtagcaatgctgactaaaggaactactttgtttggattacacgttacgaatgttacttatagttcgcaagtatttcccgcaattttatgcgttttgttttatgcattaatggaacgtttctttacaaagtattcacctaaaccaatccgaattttctttgtgcccatgatgtcaatgctgattacggcaccaattacgctactattccttggaccattgggttatgttgttggggaaggttttgtcagtgttattttattcctaaatacgcatctaggctgggtagcgacagcattattagccggtgttctaccattcatggtcgcaactggcatgcacaaaccgatgattccatacgttgtgtcgacgtttagtacagttggcaaagaatcattgtatttacctgcatcattggcacacaacatttcagaaagcggaacatgttttgcaattacacttcgtaccaaggataccaaactacgagcggttgcgctttctgctggaatttcggcgctgtttggtatcactgaacctgcactgtacggggttaccttacaacacaaacgagcactcatcagtgttattactggtggcgtgattgggggtgcctacgttggaattgccggtttatctggctttacgattgtgggacctggattagcgagtctaccgatgtttgtagataaaagtaatccagctaatttaattcatgctctgataggatttggaatctcattcgttgtttcatttgttatcggtctaattatctggaagaatgatgaggagattagttctgcaagcgatactggcgaagcaacgacaactgtagttgctgaagatttgatggcaccagttgccggaaagattttatcgttagctgatgttcctgatgatgttttttcacaaggactaatcggtcaagggatcgccgttgaaccaagtgaaggaagcttaattgcacccacagatggtaccattgagatggtttatgagaccaaacacgcattaggcatgcgtacggataatggggcagagctactgtttcacattggcctggatactgtccagttaaatggaaagtattttgaatctcacgtgcaagttggacaacatgtccaagcgggtgagttacttgagacttttgatgtggctaagatcaaagcggccggatacaaccctattactatgatggttgtgactaaccaagatagttataccgttgctgttgatgagagtaatgaaacacttgataatcaatctgttatgaatattgcaaagttaggagtttagctaatgggattacgaaaagatttcttatggggtggcgcgatagctgccaatcaagtagaaggtgcatggaatatcgatggaaaagggttatcagttgcggatgttgcgacgtataagcccaatgtggatgttaaagattatcgcaaacaggttggtgttacaaagtctgatattgagaaagcaatccaagatacagatactaagtactatcctaaacgacgtggtattgatttttatcaccgttaccccgaagacttggaattatttcatgaaatgggatttaaagcattgcgtttatccattgcctggacacggatatttccaacaggtgaggaatttgagcccaaccaagctggtttagactactataaagcaatgtttaataagatgcatgagttaggaattgaaccaattgtgacattatcacattatgaaatgccacttgcattagcgtctaaatataatggttgggaaaatcgcaaagtcattgatttatttgttcgtttttgtaaagtttgttttgaaacttacaagaatgatgttaaatattggctgacattcaatgaaattgatagcgttacgcgtcatccatttacttcagccggtattattcctgatcagactgataatttgttacaagcagagtatcaggcattccatcatcaattcgtggcgtctgcgctggtaacaaaatcttgtcacgaagttatccctggtagtcaggtgggatgtatgctaacaaaattgacagattacccgaattcatctgatccgcgtgatgtgttagcatcattcaataaaaatacaatgaattattttccagcagatgttcaagtatttggtgaatatccacccctagtattgaactacttcaaaaaacagaaaattcacattgatatgactgcatcagacctggaaattttgaaggaaaatactgtagactttgtaacgtttagttactatatgtcactagtatcatcatatgatgaaaataatttgacgttgacgactggtaatacgattgttggtggtaagaatccacatttgccggttacggaatggggatggacagttgatccggttggcttaagaatttcgttgttacagttatatgatcgctatcacaagccgttaatgattgttgaaaacggaatgggtgctaaagacgaattaacagcggatcagaaaattcatgatgactatcgcatcaaatatttccgtgcgcatttcaatgaaatgattaaggcagtggacgccggtgttgatttattaggttacactagctgggccccgattgatttagtaagtgcttcaacttcgcaaatgtctaagcggtatggttttatttatgtagacgaagatgacttaggtaatggttcgcttaagcgttatcgcaaagattcttttacatggtatcaaaaggtaattcagacaaatggaactagtctagattagtgaaggtgtggtgatcaaatgctacggattaaaaaggtgctaaactccagcgtcgttttggttaccgatgaacatgaccaggagtttatcttgttaggtaaggggattggttatgggaaaaaaccaggtgctgtgattatggatggcgattttaatcaggttttcgtggcatcaccagatccaaacgtagaacaattactggcaacaatcgcgtcatcgtcaccgcaattgattgagattactcagacaattgttagtgaggcgactgagcagcttcagagtaagttgagtgatacgttgtatgttgctttgcttgatcatttgaaatttactcttgaacgtgttgctaaagggattgttataaccaatcgagtttattgggaaattaagacatactatagccatgaatttgagattggccagttagcagttagattagttaatcgggcgtttaaaactgacttttcggagcaagaggctgcaaatatcgctgcacacattattaatgccgaaaacggaactgatgagcgtaaggatgcattaaaggctggccaattgattggacggatcattaacatcgtcaagtatcagactggtggaatagtcaatgaacatgatttaaattatcagcggtgtgtggtacatgtaaaatttttagttgaacgggctattgcgggagaactgttggatgatgcagatccggcaatggtagctatagtcaaaagtcaaaattcacgtgcttttgcaattgctggaaaggtagctgcatacatgagtatgaagtttaagatgccactgccagatgaagaagtgatgctaatggctatgcagattcaaagattattgccataggttagtctggcatactaactaaattattatattagaatacataccatttcgaatgaggggtgaggtggtatgtatttttgtgaataagtctggctatataacaagttataaatgattcgtgattgacaatttataacttgttttttgttagaagaattttaattataaaaatatttattaacggtgtaactagtttgcatggacactctatggagatttgtaacctagattgttagtatagaagtaaatgtgtattgaacggggaatctaaataatgagaaagaaaaaatatattagtcagcgtacacgtgcaactcatacctattctttttatcgtcagcgtcggaatgatcctaattggcgggctgattacctggcggctcgggtatgccgacaacgtcatattttgatcagtcttattattatcttagtcttaatattaattggggttattggatatagaaatcgagtagtgacattgttgaatgggtcagaaacaacatctcaagtaactacagtgaaaaatgctagtggggaagactcaattaaagattttaccaaacaatcggtttctaacgagcaaactaaaacaatagataatgtgcaaaaaacagtaacgattagtgattatcaaagatattcagcttattctggcgaatatggaagtgaaacacaaacctgttcacttgattttgcaacgggtgagctaatgaccactggaccacaaaaacaacaagttttttattttgataaagtcatgttgcatcctgataaaagtctagtcatcaacatgcatggcaattatcattataatgcttatgatggtaagggtgaacggtatagattggttcacctgagtgtcttatttgcaccccgtgatcagaaaattacacaaaattggcagactggaaagtcacttgaggatggtactaatacggctgtcaatcgattctcgattgcgttgtcaaatgatggcggtaaagtgtttcaaatgtcaccagcgtatacagcatttgagactaatcaaactaaaggtgatacattagcagtaatttattccgaagctaattgagaagagctattttagacttaatataactatcgtaattatcttcaatacatctcaatatggattaatttcatgtgaagtagcagttgtagttagttagtaatactttcaatgtttcaaactaagtatttaagctaagttagcttgttttaaagtgccgttagttccagaactaaattggtttccagtataatacgctagtagatattatttaacggttatttaatatttgtacttcaatctgaatagggcagtttatgctaaatcgatataggaaaaatcattatggtaatgcaagggggaataatgatgaagacagatatcattttacgggttgtgcttggcttgctgtttacttgcttaggctgttttcaaatttttgctgtgagacggtattttcgccagttaaaactgcacggaaacgctgaaacgtccgcttttgcaccgctggctttgtggagcgcctttgtaattggcttgatttttattttcgttggcatagctgcgggctttgggttgatttaactaatatttgttgggattactaaaaacaccataaacaaagtgcactgcggataatcgtagtgcactttgtttatggtgttttgaattaaaaatatgatttgatggttacgataatatgattttattcatcaatttccggcgccgacccaagctctgcctgaatcatccagattttcttttcaattgcggttttgagaccaatgaaaatatcttgggtactgaagtctttttcaacatcggatacttcaatgccgtgttggtaaaggtcttccaagtaacgatagccatcaactaagtgtgcgaggcgttctggggtggttttgtcccattcaccaggccagtcttgaatcttagtgttttcggccatttcttttaaggtcgagtaaggactgccatcaagcgcaatcagccgttcagaaatgacatcgagttggctgtcaatttcttccatgaactcatccatcaaggggtgcaacttcaaaaagttgggtccacgcatgtaccaatgcgtctgatggataatcattgacatctggctcaaatcggcaacgagttgatttaatactgctttggttttcgtatatttcattagattgatctcctttcgatatggttattataacttagtggtagcttaatctgaaacgttatacactggcaaattaagttatttatagcccgtagaattaagtcgttttgaaaagatgggggcgttatatggtggtaattagtgctaacaaaaacgaccaccgtatgggtggccgtttgggtatcttaatcagtgtcgaattagacttattcccgtttcttgaacttagctgccagtcctagccaacctaatccagtaaataaagcggccaagataccacccagtgttgcgccgtgttcagattgctcactggtttgcggtaattggcccgaattgtgcgtagcaactgttgctggtgcttgctgttttcctggttgagccagggcactgactggtgcaatcggtgttggctgtggactagtcgttggcgacgattgtgaagtcgtagtgccttgtgacacgggcgcttttgccagcaatgaactccctggctgtggtgccgggtttggctgcggcaccgggctcggttgtggtgccgggtttggttgtggtgccgggctcggttgaggtgtagggctcggttgcggcgttggttcaggctgaggtgctggtgtcggctgtggttcgggcacaggttctggttccggacccggcgtcggttgttcaggcccactcggctccggcgtgtaagtgtaaacgacgtgctgggcggtggtgccaaaggtcccgatcgttggaccgacaactttgttgaagacgtagcctggaattgacaactgttcagtttgataattttgaccaaagtcaccacttaaaacaatatccgcgtgaagtggctttccatccgcatcttgataactaacggtgacgggcagtactgcttgtttttcatagacgtaaaggacatgctgcggttccttggtaaagctaccggtcgcgttagttggtgtcttgatgagttgatagcctggaatctctagcgctttagtctcatacgctgcgccgatttcaccagtgtgggtgatatcaggttgtaaggttttaccatcttcgtcttgataactggcagtcaccggctgtggaatctgcttggtatagatgtaggtgacttgttgcggttccttggtaaaggtaccagttgcgttgccgatagtcttaactaagtcgtagtctggaatctctagcgccttagtctcatacgctgcgccaatttcaccagtgtgggtgatatcaggttgtaaggctttgccatcttcgtcttgatagctggcagtcaccggctgtgggacttgttttgtataaatgtagataacgtgctgcggttcagctgtaaacgtgccggccgcgttgtcaggtgtttttgtgagatcgtagcccgcgatttcgagcggcttggtcgtgtatggatcaccagccaaaccgttgcaagtcgtgtctggctgcagggtctttccttgttcatcctgatagctgaccgtcacaggggctccagctgttttatcataaacgtaagtgaccgcttgcggttccgcactgaaagtaccttgtggggcgccttgggtctcgacgtgggtgtagttcgtaatatcagccggggtgctttgataatcttcaccaacgaggccggtcaattcttccgaatcgcgcagagcggcaccgttacgatcgatatggtgaatggttactggggccgctttggctgctaatacatagggctgaaagacatggaacaccggtgaactgccatctgagccttgagcaaccaaataaaagtttttatcatttgggacaacgttgatgctgacgccattagtgacgaactgaccgttggcatcaccagtgaagcctggaatctgtggtactaactgattgaatgtcaacccaccttgaccgtcgggtaccacgttactcaggtcaccattcacggcttttcccgcgccgttgaagtagaaccggtagtagaattggccgttaggagttagttgaactggtttcaaaatggcggcttgcgatttaaggacagcttgctgcccgtttggtaaataaaagcggttctttaaggttgcactggtcgtgtcttgatcgacataaacgagcggttctagaattgtctgcccaagataagtagttgtcttgaggttcggtaagtctttaaagactgacaaatcagcaatatggttgtaagcgacgtccagttcttgtaggtttgtcaaatgcgcaatcggcgataaatcactgacacggttatgctgaatattcagcacagttaatttggtcagaccggccaatggtgaaatgtcagtcacgtcgccgttataataaccgccaagtgcgttgagaccgttattgagccaaatggttttcaggttcgtcgcgtattgcagcccttccaaggagtatggtgtgtgaccatcaatataagtgttttccccatagaattgggttaataattgcatatcatctttagtaatatcgttaacagatttaaactgatggtcggggagcttcaatgcttgtaactcgcgtaaaacggcttcttgaaggtgcttgttcggcatccaagtatcaatagattcagttggcgtcgtcgctgcggtcggcacgactgtaccaacactagtcgcgggcttttcagctgtcgttgccgctgaagcagcttctgcgttagcttgttcggcatattcggaataggtactggaagctaagctattaataacactggtaatttgaaaagtagtcgctgccgaagtcgcggtgctagcgggaacagtcgcatgcgaagtgtcaggtgttgcggcgctttcgacactagcagcactagcgtcggcggaatacgtgctggcagcgatactattgacggcgctggttatcacgctagccgaggcggcgcttgccgcactagctgccatcttagcaccactagtgggtgcagacgagctgctcgaaatagcactcgtcattggatgaataacctctgaaccgtcagatatctggcttgtacttgtagtgcttgctgcggctaatttttctgagctagtctcactggaagtcgaaagcggcactgactcggcagcactatcagttgtcatcacactagtaggagccgtgctgttggctgccgtactattagtgacgcttggtgcagcggcactagccgtctcggcgactgaagttggtacgggcatacttgcagagctagcaggggtcgttgaatgaattacaccagaactgacagtttgctggcttgtactcatagccttgttgggtgtactactttcagcactagttagactggaactagcattaggcgttgctgttgtgtctgttggatacttagtggtcgcagagctggccatggccgccgaagttgggatcaggttattggtgcttgctgcctcggtcacacttgaactaggttcggcggcgtgaccacttgtcgctgaagtgctagccattgctgacatcaatgagccactagtagccgttgatttcacgggcattgctgcggtactagttgctacaggactactggttgtagtactgccagttgcgctactaccagttgtcgatgttaaggtaacttgactgccggatagcgggttagtcggcgctgtttgctggacagtaggcgcagtggtggtgggtgctgttgtcgaatcagtggccgcaaaggcgtcttgattggtcaaaataatgctggccaaaatcgtggccgcaatcccagtaattaagtgccactttggtgggttattagtgataatttttcgcttgttcaaaataatcatactccttttgatgattgatttagtcataagcacactaaattagttaaagtgtagcaccattattttggcgggtctagccagtttggtggacgtcttgtcacttagttgtgaatggctggatgccggtgcttttcaaaatcatgaaacaaaccgttatttgacggtacttaacgccgatgttgagctgagttagaacggatggacattaagaagtgcacgcttttagcgctgaaatgcttgtttttttaaagtttggtggttcgcaaaggcaagttggtaaacttgcctaagaatggcgctcaagccagagctaccgattaacttgcgaggttgcggtgaaattggtagtcactaaactgcccatcagcgtatcaatgtgaagacagcgtaaaacgacctttccggataaattctgggaaggtcgttataggtttataaataaggaattaatgactaacgattgactgctggtgcgtgtattgcgccgcgtgccgaccggaattgcgtccagagtagaaggcgtagccaacacaggttccaggcatgttaggaccatacgtatcaccagttagtccagcggcgtcgttgccagcagcgtatagaccggtgatcggctgaccagtagtgtctaaaacttcattattagtggttactttgagaccgcccatggtacaaaaggcaccaacattgagttcaaagccgtaaaatggaccttgcgaaactttaacgagatattcaggattcttgccgaaatcatcgtcttgaccattatcacaatattggttgtaagtttgaatggaatgggtgacttgatcaacaggtaggtgcattttggtcgccagtgcttcaatcgtattggctttaaaaataaatggtttattggcggccacggctgcatcgatttcagcctggagtttcgtcattttttcgccccgccgaacgtaaacacctaagcccatgaagttcccgtcctgagccattttgttgatcacaccttggtcgagaatgctgaatacttggttttgggtgtagagcgcgttgccggcgtatgagaagttataaacgacagcttcatcgacaaatcgttccccatgttcgtttagccagagcaacggttgctggccggccgctgtttccatctgggaggccatgtacttaaaggaaggttcgctcggatctttgaggtaaccgccaaagagcatcgccatccccgtgccatattgttgtgcaccggcttgccacgctagccgaagaccgtcaccagttcctttacctgaactaactggaattaagcggcgcgtgtcatagtgggtcagtttctgcatcatgtcgggattattgaggtaaccaccggtagcaagaatgactgcggccgtattgatgacttgggtctcattagtggcggcactttgaatcgttacaccggtaattgcaccgtcagtggcttgatgtagcgtgatggcggtcgtggaagtcagtagttcgacccccagcttttgtgcttgtggttgtaaagcgtcatgtaagacagcttggcccattcctttataaatatgccacgtggcttcgccggcacccattgcttgtacgccttcgtattcgacaccttgatctttaagccattgcaccgtgttggcgctatcgtccaagtaacgacgccagattcgagaatcagcgcgatatttagaatagtcgacttcttcttttaaaacgtcagtggcggaaacgttgatgttttgggccttttgtaagtatgagtcgacggcaaagagaccctcagtgtaattgctgctaccgccagtatggcgtcctttttcgagtaataacacggacgcgccgtgttgtgcggcttctagggctgccgctgttcctgctgctccggtaccaacgacgacaatatcgtatgaatcatgttttgctaacgtcatgtcaattcctccaaactgatttgttatctaatgagcatttgacggctaaattcaccattactataatgaagtaaccgctatcacaccctcatcataacgggggtatggtggttagcaaacagacaatttggttcggcaggcgaatcaatcgtgcggatggagttgaaaaaatggatcttgaccggctacagacgttcttaaaagttgttcagtatggtagttttcagcaagtggctgcccgtgaatatcgttcacagcggacagtatcaaagcaaatgacccagttagaaaatgaattgaaagtgacgttatttgaccgtggacagaacagaattcaattgactcctcaggggcggttattttgggcatctgctcaggatattgtgaacaactatacgacggccttgacggagttacgtcaatttaatgttcctactgatcaaatcttacgagtcggttatttctcagcctttgagcagcggctcctattaccggccttatacgatttaaagcaacagcattcggagctgcaactcgttgttcgccaaggtagtaacgagcatctggcgcagcaagtagctgatggttcacttgatttagcactatcgattaattatggccgtcccgccgttactccagaatcacagttaaccgctgtcccaatttatcataatcaaatggtgattggggtgagccggctaaatccactgagtcgattgtcacaattgccaccgagtgcgttggcgactttgcccattttatattacagtccagaaagctcaacatttttattagaaagttttttggctagtgccccgtttattcaagactatgagcagattcggcgagtatctagtgcagaacagatgcacttgttagttgcgttgaaccaagctttggcattctatcctgcggggttagtgccaactaagcatgatgaacaagtcgcgtatttgccgattacggatgctgcgcaacaaggctatgacatcgtggcgttattaaaatcaaaccggtcccggccgttgatagccaaattggtacagcggttaaaggcgaacgcgaaatctgacgagtagaagattaacctcacggtgagaaggtactgatacggtgagcttgcttaagtaaaaggaccggctgagattgcaggcctgtaaaaattcagtgactccgttataataaaaccattgttctcaaactaatgaatttatacaggaaagtgggcccaacatgtttcaagatattcaaccacacgttttaaaaaatcagaatgatcagcagcgggcacctcggtcgggcgattatatcttaattggtcgtcaacaacaggtgcttttaatgaatggaaccttgcccaagtacgaagatatcgatgcggattacgcgtttagccctgaccagtatcagtatttgctggctgtcgatcaggcggcctttttctgggtcgatgttgatgcggttgcgaatgataactataccgttggcaccactcgagggttccgagacctaacaccggcctggttggctttcagtagtgcgacggctgcccatttggcttggtggtatgatacgaagcggttctgcgggcattgcggccaaccattacatccaggcgctacggaacggtcactggtgtgtgcagcgtgtggtcagacgatttatccgacgattatgcctgcgattattgttggcgtgacgaatggtgataaaattttgatgaccaagtttttatccggctacaatcatttttcactgatttcaggttataccgaaattggtgagacctttgaagataccgttcgccgggaagtctttgaagaagtcggccttgaagttcataatattcggtacttcggtagccaaccgtgggcgccatcacactccttactggccggctattttgcggaccttaatgagaacgtggcaattgagctagagacggacgaactatcgaaagcccaatggttccagcgtgaccaaattcctcataatgatacgaacacgagcctgacatggacgatgattgaagcatttcggcatcatcaggagaagtagaattatgctacattataccgaaaattaaacggaagtttttaataagatagcgtactgagaattgaaagctaaattcttggtacgctattttgatgtgatggtcgagtctaaggcgactttcctacaaacaaccattatttaaaacgatggtagtgacgatataagcagttatttagtgggctatgagatcatagcttgaagtcaattaatgctagtgtcataaagtgtggttactttacaagatgggctaaactgataataatcaatattagttatattaattaaaaaagggtgaagcagaatggcactacttatttcgactggtgtgttagtggttgtggcaatggttagtattgtaattaaccgtcgttggctcccacgactatcggtcaactatgtgagcatgtttattggagcggggattgcggttatcccgttcttaaatggccttatcgaaaagttcaattcagatatttttattggactgattgtagcaccattattatattttgaaggccagaatacgcggctgaatttagttggtcgtcacgtacgagaaattgtgagtcttacagttggcatggtgattttatgtgcagtcatggctggactcggcactagcctgctagcgggtgttggactaccattagcctttatcttggctgctatcagtacaccaactgacgcaacggctactgagtcggtgacgatgggccgggtgctaccgcagcgtgaacagactagtttgaaattagaatcattgtttaatgatgcttcgggaatcattctgctaaacatggctattctgtggtatattaacggttatattaattattcgcagaccttatgggatttcgtctatgcagctggtggagggattgcttttggtggccttgtaagcggcttaattgtttatattcgacaattaatgttgcgctctaaacttaattttattaataacacgtataataatggtactccgttaaaagtgatttatttaatgacaccatttgtgttgtactttggtgctgaagcacttggtgtttccggtatcattgctgttgtatttgcgggattagttcataatgctgaaggggagcggagtgcattagccaatcctcagctcgccagtgatatttatcaattaattggcctattgagcgatattttaaatagtgtggtctttattgtattgggaattatgttattgcggaccgcgttggatcattccgtctcttataatggatcactgatctggattgtaattggtgttattttatacgtggccaatctattagcacgttatggttacgttcgacttattcatcatgtccctaatcgagaagcgtgggtatttgctttggggggcattcatggtgctgtgacgtttgcgttggcctttaccgttgcggaaactcaagttaaaacgactgatttcaatttagtcttgatgtctgaaagcttattgattattttgagcttattagtaccaacgattgtttttcgctggctattgccgaaaattaagactgatacggatggtgcggccaaaatggcggtgattagagaacagatgattgaagctggagttcatgatttgtggcaaatgccgatttcacaagaatttaaagctgcggtgacgtttgacctacgttcacagaatggacacacgacagttcgacagtttatttcggaatggcgtcggatggtccaacatcctgaatatactgctgatgaaatgcgtgaactaatggttatttatcgacaagtatttcaaacggaacgcgattatttgcagcgacaatacgatgcgacacatgccattagcgaagacttgtttaaccgcttgtatcatgaaattacgatggctgagatggttgttctggaatatggtgtgaagtaagcgggataatccaagattggtgtggcaagtcgaaatattgattggtgatcgtctcaaatgtaaaggcaccccaatacttattcactgtgaataagtattggggtgcctttttaagactagaaacctgcaattaaatagttggtaataaatattaagttggctgtcagtgtttaaatcaataagggggaatttttgttgattgccagaacttgatggggatattgcaagcgagtgtgattagttgtttggaaagttcggcaatgccaccacttgattcatccggggactgatattgtgcatgatgtcaaatatggtcattaggatgtcagtcaaaacaatgactcgccggcgagtgtcataataaaaattaatgctgggttgtttaaacgtgaaaaccaacgtctgattggctgcattgcaagggctagtttcacccgattgattgaaacccagaaatcaacggatggtctaacttgattaaaggcttaaaattgcattaaaaacactttgtggcagcttaatcgtatttttggacgcgcggcgtttattagcgctttgccgtcgtagtaggaccgcttttttggaagtactgtgttgttcgccgttcaccgctgcatttttacgcaatggtgggacatcgacgcgggcgataaccttaccttcaacacgtgcttggacgggtgtgggatatagttgccgtggaaccgtcgtcttcagattggcgaccaattgctgcgtcatgttgggggcgtcttcacgatggacgatgaaggtcaacgcatctacgggcgcatagttgatatcaacttcaactttgactagatcactgacttcattagccataaaggcggtgcttaaactcgcaaagccatgtgagactgattttagttctgagaaaaagtggtaggcgatttctgacaagggtatcttgagacttgcaacaatcaagtccccgctgtttgccaagtcgatcaaggtccctttatgctgttccgcaagctttaatacggcatttagattgtcagcaggcatcgtgatctcggctttcataaagggttcagtcacttctttaatgagactgaatgccggaaactgaacgggattattgacgatcacttgctgaccattggtgagtgtaacgtggtaagtcacattgggagccgttgttagcacgtcgaccccgtactcatcgtggagtcgttcacgaatgatttggaggtgaaaggttcctagaaatccgcaacggaagccaacgccaagcgcctcggatcgttcttcaacataggtaaatgacgggtcgttcaagttcaatttttgaacggcttccttaagtgccggatagtcattattcttaggatataagcccgcgaagaccattgatttggctggttggtagccggctagcggccgctgcgtgggggtggcgacggacgtcagcgtatcaccaacacggacttttcgtggatctttaataccagtgaccacgtaaccgacgtcaccagcgcttagcgattcttgggggtgcatttgaggcgcgaagacaccaatggccttgccgttaaaatcctgttgtccttgcattaagcacagtgcttgttgtgatttgagctgaccatcaatcagtcggacataggcaatgacaccttgatatgggtcatacaacgaatcaaagactaaagctttcagcggctggtgtaagtcgccttggggagctggcaaccgctgcttgatggcttccaagacggccggcacgccttgcccggttttagcggagatttgcaagacttgctcgggtgtgaaagctgagtcgaggtcgttcaattgggccaacgcagcgtcaatatccgcagagggcagatcaactttattgagaactggtatcaaggttaattgacgttgtttggcaattcggtaattggcaatggtctgcgcttgaacgccctgagtggcgtctactaataggatggcaccctcggtagcagccaagcttttagccacttcgtaattgaaatcaacgtgaccaggggtgtcaattaagttatattcatattcttgaccatcatcggcctgatagtaattccgaactgtacgtgctttgacagtcacgccatgagcctgttcaacggtcatatcgtctaataattgggcgtgctgttcacgcgcactgacggtctgggtcagcgacatgatttgatccgccaacgttgatttaccgtgatcaatgtgggcgatgatggcgaagttacggatatgggattgtttcatttgtgcgaaaactccttcaaatattgggtcaagtagtaacgaatttgttgttgggcctccggtatgagtcgaatttcgaagtcgggataatcaacggataatttatgatgattaaagctggtcaaagccgccatatttatgagcccactgataatgccactttgaataatgaacaggtggctaaattgggactggtctaataagtggtctgtttggataacgagttgttgtcctaagcgttgactggcgcgatacagggcctcacgttgtgtgatggtttcctgcatgttagctttgccttctaggattggtccacgaatggcattcaatcgaatcagaacgctatgttcttcaattaattggcgagtttgggtggtcagccacgcgataaagtcgtcagctgatagtggtggttgctgggctaagtcggtcgtgagttgggtaaagtattgttgatagtcttccaataaaatcgtcatgaacaagtcttctttggtcgtgaaatagcgaaaagtcgcccccttagagctaccgacggcttccgcaatttgctgcatggtgatttcgggatagctcctatgggcaaataaattaatggcagccgtcatgatggcttgacgcttggctgctttttgactgggcgtatagatattagccatgtcggatcctcctaatttaaaaatgaccgatggttatctttgaaccagaatacgccaaaaataaccacgggtcaagattgaagtggtgagtgctgggctaagtcggtcttgagttgtgtaaagtaccgctgatagtcttccaataagagcgtcatgaacgagtcttctttggtcgtaaactaacaaaaggtcgttccttttaatatttaattattaaatatatggtattaattatagtttctattggaataagttcggagttaaagggagagcagagctgcattatttagtgggatttatcattacaactggcaatgattagataactaggcaggttgggtgattaaaagcgctatgtgtagtttgcgaatattttggaaagtgataatcaggccgaatattaatggtgtccatccggtttattcggtctaactgtcacgtaagccttctggattaacaggggtggataaatgcaataaatacgttaaaatttttaaccattataaaataataatgttataattatacggtaaacaggggaaacaatactgtctgttatctattgttgataataagggtatcagcgcgatattaaatttatttttataatcaaactgtggatgaaaggttaacggctgagccgttagtctctaataaagggcgataatgattaagaaacggtgcaaaaagacgccagtacggatcagaagtccaaaatagcctgcgttatattgtaactaccgtgcaggctaatcgttggcaaggccggttaccaccgactagtgagcaagtgtgccaatggttactagttgcattaggtgttctactactgggactgttattgattgctagttagggtaactataaatgtgagcgctatcaatgactgaagttaaaagattacgctgtcacatagaattgctgattaaaaggagatggtcgggtgcggcgaatatgtaaagtattaatggtaattatcagtattattttaggaagtagtgcgccattgaatatggcaataccaccgttattggcgctggccgcgccggacactagtagttcttcgacgatgagtagcagcgcaattagcaaagttactgataccaatgtgatggccgtgagtgcggatgtgacgagtacaacagacacgtctgatacgagtagctctgacagtacgtcggcgactagtaccacgacgggtaatgataccactgagacggcagacacggcagtggaatctggaactgttgggacggtagcatggaccattgacgacgcaggggtgttaacgcttagtggtggtagctttgctgatttaactggtaaacgttcgccttggtatgattatgcttcatcgattacgaatataaagattacggatgaaattacggtcacaacggcttcgaattatggatacttgtttgctagcctcgctaacgtagcaacagtcacaggttgaaataagctttcgatgagtggtgtaactagtacccagtctattttttatcgtgatagcaagttaacttcagtcgattttggacagaccgatttttcaacagtgactactatggaatcaatgtttgaagggtgtagcgtgttaactaaagtaaatactacgaactggaatgtcagtcatgtaaagagttttaagagaacattttacatgtgtggaaaactcactatgcttgatgtgagtaactgggatgtaacacaagtaactaatttagacagtacattttctggctgttcttcactgcctgagttagatgtcagtcgctggaatactgctaatgtgacaacactagcgtctacattttatagttgttcttcagtaaagataataaacgcaagtggttgggatacggcacgagtaaccgatatgactgctacttttatgaactgtactttggcaactgaacttaatgttagtggttgggatacagcgaaggtaactagcatgtctcgaatgtttttttattgtgaaaatgtcatccaactagacgtttctggatggatcacttcccaagtaacttcactggggagtatgtttcaaaactgttctaaagtagtaacgctggatgttggtacttgggatactagtaaggttacggatatgtcatttttatttggaggctgcagttctttaacgactttaaatcttgaaaaatgggatactggttctgtaacaactctttattccaccttttataactgttctgggttgactagtttgctggttgatacttgggatactagtaaagttacaaattgtttttggacgtttggtggttgctcatcattaacaactctcaatcttcgtagctgggatcttcaatctgctaccgccagttacgggaatttttttaatggttcaaaaaaattacagcatttgacactaggtcctaattttacgtttcataatgataagacgatgtacttgccggagccaagcaaacaactaccatacaatgggacgtggcaaaggaacaatgatgatccaacctatacgtcggcggaactaatgactaattatgatggcgcaaccatggcggggacctataactgggttaagacaagtggaacggtgcttgtcaaatacgtagacggcgatggtgttgaaattgcggatgaagagacgtcatccgggacatcgggtgatgcttaccaaacaacggccaaaacgattgatggttatacgcttcatgcaacgccaactaatgcaactggaacgtatgacgcttcgacgattacagtaacctatgtgtacgatggtaacttattcttcaattcgtcaccaacaatgctcgattttggcagtcatacaatatcgggaacaactgaaacttatgcgcctactctggataagacacttgcggttcagaacaatgggcaaataagttcaacctggaatttgactgcagaactcgatagttcaggctttgtgggagcggacactggaaaaatgttgttggctacattatattaccagaccgatgatggaaaaatgaccttgtcacctggggtagccgtacaagtctactcacagacaacgactgatcataaaagtgttgatatttcggaacattggtccagcaacttaggattgctactagaagtcccaaatggggctgccatggctgacacataccaaggcacgatttcatggcgtttgaataataccgtggccaataattaattagtgattcatagttaaaaacacagcttagtttgaaaggaagcgtattgtaatgaagaaattcgttttgggattaatgatttctgcaggacttttgggagccacaacggttgtggctaatgctgatacgactggttcttcgaccggtgatgtaacatttactgggggaacattgtcaatgagtgttgacgctactcatttagctttcggtagcaacacgattagctccagtgatcccaccttagccacttcatcgacaccaaccgttacggtaagtgacttacgtgggaccagtgcaggctggaccttaacggttgctcaggggcaacaattcaatacagctcttaatgggactggttcatcgctgattaatgctgctttgacagttgcgggtactgagagtgattcggcagtgacaaatggcagtactacgttaacgccggggacaacttctgccgcgggtgcagctgggaccgtcgcttctgctaagaatgggactggtaacggggcatcaacggtgacatttagtgattctaagctggctgttcctgggaaaacgactaaattagctacggggtacacaaccacgttaacttggaatttaaacgacacaccaggtaactaatccgggtgaacaattagccgatgttggctacggccaatgtcgatacataatctgagaaaaaggcggggttaaagtgcagaaacgattgcgattatctttgggaatgttattggcggttgtcgctagtctattaatgatgggacaagtagcctctgctgatcagggcgttggttttgaaatcacgccagtccagtctagcagtcaggtcgataagcgtctctcttactttgatttgaagttaaaaccgcgacaaacacaaaccgttgcggtcaaaattcataatacggctagtgagcccattacgatcaatataggtatcgctaaggccacgacaaatattaatggggttgtggaatacaaacatacgaataatcgcagtgcgaatttgccgtatgatattagcaaattagtgacaactgatgaaccacaagtcaagctggctaaggggcaagtcaagacggtcaagtttcaaattaagatgccggcccaaagttatcaaggcattttagcaggtgggataactttcctgaaaaaggccacggcaactgatactaaaaaggccgtggcagtcaataatcaatacgcttatactgaagctgtaattttgcatggtagtaaagacctaacgaccaatcagctgacgatgaataagattacggtcaaacagctcaatgggcgcaatgctattaattttccgttagtcaaccatacggcggcttacttaaataaagtacaaactaacatcaagatttatcatcggggtggcagtcaagttgtctaccatcaaaagttagcgaacggccagatggcacctaattcaatctataaattgccattgcagacaggagaaaaagcgctagcagctggtaaatacacggccgtcgtgaaagttacttccaaaaagcaacactggcaatttaagcagaattttgtgattacaaagggccaggcggataccttgaataagacagcggttttgaagcaagggcctaactggtggttgtatatcgggattgggttattactgttattattgattatcctagtgatctggtatatttggcgcaaacagaagaaaattaaatcgttagagaaacagttagctgaaaagaaccgtcaagatagtgaatcataatcaagacgcaagtgcagtttaatcgattagcacagattaacaattaacatgaatagtggatatcaagggcgtttttggaatgtaatattctgaagatgctctttttgaattgtttgatataaaacagaaattaacgaacattgagtgactagtaaccacctggaaaataccggcatactattaaagtaatgttgcgaggattagatgttttggcgatatttataattaatgtataaatgttgttggagaatatggttctatgtttatctaaaatagttatagtatatatcatgactataggtgctgaattgaagttgagttctcagtaaagtgttgttatatcaaaactttggtgaccattgattattaggtttactgttagtaaaaggtgtatactgattgataacattagatatatagggtattaatactgttataactaattgaaaatgtttcggggtagatataatgcaaagacgacgcttacaacgagcacaattaacagaaaaacgaacttataaaatgtataaaaaaggacgcctgtggttaattgccgggttgagtactttcactttgggtgctagtctgctaccgatgacggggcgggcagacacgactagtacgcctgctgagaaacaggggacgaggacagagacaactggcaaccaaatcacattggctagtaagtcggttggtagtagttcgatggccaatgatggcgaagaaaaaactaataacagtcaggtagagacgagtagtgaagctagtaatgttactgcatcgactgaagctaagtcaacggaatcaacgactcagactgtggttgattccaccgtgactagtacggctactgaaacaacacgtgcaaacggtgctactaatcagaccagcaaaatgtccatagtcgatacgacgtctaacaacacagaacagaatcaagcagtaggtggtacaacagacagtacggcaagtaccgcaactattgaggatcaagctaaggccgccaacagagcaaccactgatggcaagataaatacggctacagtagctacgaaaacaactacaactgccagttatgcaaccgcggatattagtacgaataccattcgcagtgcgcaaaagctagcacgagctactgtggccaccgttgcgacagtaaattcagcgactaagacgtatgatggtaagatagatacaccaaatcgctatacgattacgctaactgacggaactaaggcgccctcagattgggctgtaacgagtactgcgaatgtttatacggttactgacttaacggacgttgatacgtccaagtttggatcgagtgttggaacatacacattggcactctcaacggctggaattactaagctagctgaagctaatagtagtgcggatataacggctgctaacgtggtgacaggaacactaacaatcaagcaagctccggtaccgactgcgataattaccattggttcagctagtattgactatggggatgctaaaccaagtacgtatacaattacggtgccgagtcagtatgcagttcccagcacctggacgttagctagttcggctactgatggaacgactaatacttatatgattgcaagttctagtggcgatgttatagttcccacagcaacccaatctggaacgtatcagcttgtgttgtcagatcaaggcttgacagctttacaacaggctaatcctaatgctgctattactgctgatacgattattgctggtagtttagttattgcggcacatgacattattacgatgggtgcgacgacaattgtcgttaataaaacgactagtacggttccggtgacggtcaatagtcgtactattgtggttccaacaggttggacaattcgttacgatgatattcagactgatgcgattgtgtatgacgtccccgtttccgatacgacatattcggaagcggttaatactgctgtggttgataaatacaccattacattgactgatgatacgatagaaacattagctaaccttaacagcagtacgacttttaatagtacgacggttggtaagggcgtagtgcttgtcaaggctagtgccgcagttgccatctcacctgcaaactatggcgcgcaggctagtgccgaaactccggtaacagggctgacaatttcacatgcccgaacaaagggaattgatttagcatatggtcaggcgctgtatttgatcttgccgcttattaatatgaatccatcaggaatgactgtggctaatcttactgattatgttattattccatctggttttaaggttgctactaatagtgaaggagctattaacatagcgactgatccaagtagtgtgttaacgtctgctattgaagcaatgatgacgaaaaatgatgtgacctatcaggggttaaaggtgacccaactgacagactacaggggtcgccaaacatttaaaattcattttgataaaaccactgtttatgacggtggtgcatttgcaacgctaaaatatgcattattaccggtcattgctgttcaaaacactggggtgactagtggtttaattggtaatcaagtttcaagcccggattcggcggtggtttatgttactgatgattctaatgaaaataatggtagttattcgttgaatttgcaaaattatactaatattgacagtgtcgctgatgcattaggaattgcggatgctgtcacgattggtagtggtttcacaagttacctatatcattacacgctatcggccaaaacgattaccgatacttatagtttagtaggaaacgatggcacgtcattaggcgaagtaacttttacgggcgacagtggtaagacgtatgtaccgatgactaaattacccatgacaattacacaaaatggcgtgacgtattatttgaacactagtgcagtttcgttaactcagacatattctggtgatagtaattcaaattacacagttacttaccagcgctacgtcacaacgacgactgatactgcggccaagataacgattgcaccagcttcaaaagtctatgataacaacgccacgactgatccaagtcgctatacggtatacttgccaactgaatatacggccccaagcgattggactgctgatagcgcggcgacggctgtggatgggacgacggcgtaccaagtcagtaccgactaccttaacaccactgcaatcgatcaaaacgtgggcacttacgctgtcacgctgaatagcgccgggatggcagccttatccgctgctaatccagatttcttgattgcaggcgatgtgaatgttggtgggactctgacgattactcaacgtccagtgacgattactttgccggatacgattctgtgggccaatggtcaggaacaaaatattacgccggtcattactggtgttgttgcggtgcaaagtttggattacacgttaacgtcagggttaactgatccggacacgacaaccattacggccacgctgacgaatgccgctgctaatagtaattataaattgacgaattcacctagtggtcagttgacggtgggcgccgtaacggttgtctatcagtatgggtaccgcgacaaagcggggacgctacacgtggtaacaacggctaatggaacggcgacgcacgggactgatgttaccgctaaggactatttgagctacaccacgagtgatacgactgctacgcatgccaaaactggttatacgttacaaccagaaagtaccggttaccaagccgatggcactctagcggacgttggtgggcaggtcgtgtacacctatttagcgaacaccgaaaagattgcggtcgtttacgtcgaccaagataagaacaacgtgattttaaaacagattcccctcagtgggagctttggcacacccacgaattatacgacagcgcaggacattgcggcgtatgaaaaattaggctacgtgttagcttcggataaggtcccagcgccgcttgagtttgatcaggatactgaacagacctactacgtatacctgaaacatggcaccatcacggcgacggttgatcagccaggtaacgtggccgttagtgatttgatgaagaccagtcagcgaacgattcattacgtttatgctgataacacacccacggacttagcggatgtgcttcaaacggtcacgtatacgcgcacggcaacggtggatgcggtggatagaacggtcctttcgtacggtaattggacgaccaatgtgaatagctatccggccattgagtcgccgaccattactggttacacggcggatcaaacaaccatcgcggcggctgtacccgctagcatgggcgagactacggaaacaacggtccgatacagcgttaattctgaaacgatccgggttcaatttgtcgatggaactacggataaccaagtcttaagttatattgatttgaatgggaaatacggtgatgctgccgactatacggtcactgctgatatcgcgaagtatgcaaaattaggctatgaaccagttaactcggacttgcctgatcagctgatttataagcagaatacccaagtttatacggttacactagcgcatcgtcacgtgacggtcagcgttgatcatccgggccaacctggtcaggccatcgatgctgattatccagccggtcctaaatatccggcaggcactggtcgtgattcgttggaacaaacagtgactcggacgattacgtatcaatatgcgtcaggtgaatcagcggctgaaacggttaaccagtcggtcacgttcaatcgcacggcaactttcgacatggcaacgggtaagcagctgacttacggtgactggacagtggcacctggtcagtcagcactattggccgcggtcacgtcaccaacgattacaggttatcaagccagtgttacagaagtcgaagcagcgtcggtcactagtcacgataagccgcacttgattgcaatcacgtacacggccaaatcacagaccgcaaccgttgcgtttgtggatgtaacgagtggtaaaacactacctacgatggtagtaactggtgcttatggcactacgaatagttattcgcccgtttcacaaattgctgcgtatgaacaactgggctatcgattagtttcgaataatgttccgacgactggtatcacctttgatcaaaatgacgtcattaagtcatacacggtcaagctagcgcatcaaatgacgacggtcacgccaactaagcctggtcaaccaggtcaaccagttgattccgctcatccagaagggcccaagtacccagctggtactgggcttaaagatttaacaactagtgttcagcgagtcattacctatatttacaatgatggtcaaactgcggcgccaaccgtcacgcaaacggtcagttttgagcgcaaggcgacctttgaccaagtgacaaaggtggtgacgtatatggattggcgtacacctgaatcagcgttgacgggggcatacgcagtcgttgaatcgccaataattgctggctacaccccgaacgcaacccgtgttgctagtgtaactgtcagtgccaaagatactgagtcgcgacaaacggttacttaccaagcaaatctggaaacggcgatggtgacttatgtcgatgccacgacgggccaccgactgggtacaagcgtgacgttaaccggacgattcggtacgcaagcggattatcaaccaacgacaatgattgcgcagtatacccaggcaggctatgtcttgatggggagtgattatccggcaacgggtgttacttttaatcaggcgggcgtcgttcagaagtatacggtgtacttggctcataacaaaatcgtgattacggcaccagatcagctcaccaaaacgatcacgcaaacggttcactatcaggatcaggctaggcacacgcttcaagctgatacgatccggacgctgacgttcacgcgttctgggattgaagatgcggtgactggtgtggcaacgtatcgtgactgggcaccgaccgggttgaactttacagccatatctgcgccaacaattgcgaaataccatgcgttgacggcgaccactcaggccgtagccatcacggctgctagtgctgatgatgtccaaacgctaacatatgcgctggacgtcccaacatcgataaagccaggtaagccgacaacatcggacgatttaatcaagccaacgacgaaaccaatcacggctgctaaaccaacgcaactcactaagccggcaatggttgtgaaggctgttcaagccacaactggcaaccagacgccagctaaatcgacaaggacgttggtatcgagtcgcattaaggctgtcaaaacagctccggtatcagcagtcatcaagccgggaagtaaagtaacggagccggctcacaaggctcaagcagatacaacgagtcgattgccacagactggtgaaacgcggtggtctgaaatggctgctgaaacactaggactaacactagcaacattattgctgggctttggtggcttgaagcgtaagcggcatgaaaagtaatgaatttttttaactgtgcataacaaaaaacgcttaacatcctagcattggcgaaaagtcaatgggaatagggcttgttaagtgttttttgttgtgtttaagtatcaatggattgatgttcaaagtagtcgattttagttgccaataactgatcgattgcttccagatgccggatgcgatcccgaatgacttgttggtactgcttgaaagcgactacttttgcttgaccatctagtgctagatgggctggtgtcaatagacttaaatcgagatctaagtcccgaaatattttaatgagttggagtgtttccaagtttttgtgggaatattgacggtaattgtattggtttcgctgaacatcaggcagaatgccaaggtgctcgtaatatcgtaacgcatccttagtcattccagtcatcgcggtgacttccttcgtagtgaagtaatgctgttgctcaggaattttaaacgttaacaagagcgtctccttaatattgagaactgagtctccataagtcgttggccttagagcgagtgtactgcttagataaccgaacttgacgtaggcggtcatcgtagaagtgtccacttgtgtgagtgagttcgggagcagtagctaaccatgcaccaatcggggaatttttgcgagagaaactttcacccagtatccgaccagccaaacgactcacccaactaccgccagcaccaaagttagaatctgggacatagccggggtggaaaatgttgattgtcacgttggttgctgttaagcgttcactgagagctaacgtgagtagtacgcgcgcagcagtggcctgggctgtgacggtcatggcattgtacttggatgtggccggggcgtcaaagtctggaagactcactttagcatggttaatcacgaatggcagggcaccaaccaatagaatgcgcgcttggtcactgtgctttagcaacggtaacaaggcttgaatggtccaaaaatgggtgaggtaatttaaaactaggttcaaatcataaccatctgccgataaatgtcgctcaggtagcatcacaccaatactattgagtagaatatcgatgtgatccgtcatggctgcaagctgatgagcaaattgttgaacaccagttttggtactcagatcggccaaagccaattggacagcttgattgccagttgcttgactaatatcggcttgagcctgtcgtcctttgtcagcccgactgccaacgataatcacatgatagttttggttggcaaggtcaattgcggtgtgtttaccaacgccagaagtcccaccaataataacagctaattttgattgcatgtcagtcactccttcaattcgatgattatgcgcaagtataaactatggggtcgacccgatagcaagcattaaattaattatgacgtgcagtagttattggcgatttaaaacataatcagcagagttcttctatgctttaaacctatgaatgtgtatttaacataagcatttcacatatatagtgaacgctcgtatactgaatttaacttaataagggagggacgcatcatcaaagcaaagtatttagatcaagattatctgcaaacaattcagccaattgtcgatgctaatcagcgccgcattcaagcgttgaatgtaacccgggaaccaagtgaaattcgtgaacgtcttgcggagataacgggtcaaactatcgatatttcagtcgagattcgcgtgccactgtggacagactatgggcggaatttaaaaatcggcaaacgtgtttttattaatgataatgttcagatcactgatttaggcgggattgaattagcggatgacgtgctgattggtccgggtgcgatgttactatccgttaatcacccgttagatcctgctaagcggcatgcggttgaagttcagccaattcacattgaacgaaatgcctggattggtgctggtgccaaggtattagctggcgtcacagttggtgaaaatgctgttgtgggtgccggcgcagttgtgacaaaatcagtgccagcaaatacggtggtggccggcgtccctgctaaagtaattaaaacaattgagcaagtagattaacggaggttttataaagatgagtattaaaggtaaagtggttgttattacgggtgcgtccagcggtattggtgccgccacggccaagttgttagcggctaaaggcgctaaagttgtattgggggcgcgtcgagaagagcggttacaggccttgagtcaagcgattggtgacaacgcggtctatcaagtaactgatgtaacagatcggcaacaagttcgcgctttgattgacttggccgtttccaagtttgggcgtgtcgatgtgctatataataatgccggtacgatgccccagggtaatctgagtgaccgtgaatacgataagtggcagatgatgttgaacgtgaatattatgggggttttgaatggaattggtgaagtattgccaatcatgcaaaagcaacatgatggtttgattatcgcaacggattcagttgccggacacgttgtttatcccgcatcagcggtgtataacgggactaagtatgcggtccgggccattatggaaggcttgcggcaggaagaaaaggaacacggaattcgttcaaccatcgtgtcgccaggtgcagttcggacggagttggtcaatacgatcggcaatacgcaaattcaggccggtatcagtgagctgatgaatgcggacgatcgtcaaggattggctttaaatccggaagatattgctaacgcggtattatttgcgatcgatcagcctaaacacgtcgccattagtgaagtgttagtacggccagcacaacaggaagtttaatcattaaatcaagtgatttaaatagtcgcggcttatctctaagataggtcgcgactattttgataggtgctactgattagataagtctacatgtggagtggataataacgttaaatacaacgacatttttagacaagtgtcgctatcgtgaatagtatggatactttgttgctgtctttgcgctgtgatcatcgttaagatagaaggcaacgaaagcctcgaattaggtgtgtcacaagtattgaatattgaggattaactaaaatagtgcatatgagcggagatggttattgatgaaagtgtttataacaggtggtacgggatttgtaggtagtgcggttgtacaagaattagtcgctaatggttttgaggtcgtcggactagctcgttctgagacgagcgctcaaaaactcattagttggggggctcagcctgtacgcggaagtttgactagtttgtcaacgttggcgacggctgctgctcaggcagatgccattattcatttgggctttaacaatgattttcggcatttttttcaggctggtgcaatggatcggcgggccattgaaactatggggcgtgccattagtgggactaataagccgttggtcgttacgtatgggacgacgggcattagaaagcatgtcgagacggagcatgaagtcgcggatactgggctactcaaatggctcacaccgagaaaatctgagatcgtcgcacgtcagttaatggctcaaaatatcaatgcgtttgtcgtacgcttatcaccggctgttcatagtgcgggtgataagggctttactagaacagtgattgagcgtgctaaaaaaagccaccgtgctgagtactttggcttagaaacacatgcttggagtgctgttcatcggttagatgcggcgcacttgttttatttagtcacgatgtatggccttgagcatccaacaactaacgagcgcgttttcaacgcagttgccgaggaatcgatcacaaccgcggccattgcgcgtacgattagtcgtaagttaaatgttccattaaaggctaagtataatccactgagttttggcgacacagcgatgctttacctaatcaattgtccgacctccagtcagcttacacgacaaatattaggttgggttccagtacaaccagatttattaactgatattagtagttcacggtattaagtgggttactaaaaatattgtccaaggtagccgtatccgtgaatatattataaggcgcattgcccacggttatccataaggtgagtcccttgatacggccaacagctagaaaccggactagtcgttgatcatcgtcaacagtatctttacacagatggattagataattcaggaatgcatcgcgaaaggcgtcatcgttaaattgatgacgcaatgtttcttgaaaacgcgcattgccgaatgagttgagcatttcaaaaggatgtgtgaagatctggtcaatagttagcttcgattgctgccgcttttgttcaaatagggcttccaataaatcgtactgatcttgaaagtgcttgtaaaaagttgaccgatggactaacgctgcatccgaaatatcttgaacggtgatttttcgaaagggcttgtcactcagcaggttttcatatgccagtagaatcgtggcctgcatccgttgatttctttgattagccattacgaatacctcctcgaaatttaatagaatacgattagtataacctgtccggtgtgccgatacaaagatgtggtgtaagcatttgaaattcagagcgcttataagcatgtgccctgcggcggtatagtcaagggactagaattggtaagccaaccaaatattttaatgattaatcgtaaaaaaacgagtgcaatagttggtatgttcatgcatacgacacgattgcactcgttttaaggtttatttatctccgcactaacaggtaaataaaatatggcgctccaatcaatgcgacgagcacgccggctggcagttcagtggtcgtggtgattagttttcctaaggtatcggcagcgagtaataacgtactccctaacagaccagctaacggcagctgatagcgttgtcgggaccccacgattcgtcgtgccaggttgggggtaatcaggccaatgaaactgataccgccactaatggcgacactgacgccggctaacatggcggccacgctaatcaatcccaattgttggcgtttcaagttgattcccaatgtttgggcagtggtcgtaccgagtgtaaaagcgtcgagaacgggtaattgaatgaatagaataccactaccgactgccagccatggaagcgcccagccgatataagaccaatcagtgccccacaaactaccggccaaccaattcatgacaaattgatagttatcaggtgataattttagtgtcatcaacaccattaaggctgaaaaacagccggacaaggcgacgccgaccagtaacaggcgcttagacgagatccctcgttgacgctgattcgctaataaaaaaatcagggccgtacttaaccacgccccagctaacgcaacgataggtaaactcagcgttaacgaagcgttggtgcctgcaccaataatgagtaacataacggctagtccagcgccgttattaattccgagtagactagggtcggccattggattgttggtgaccgtttgtaagacgttaccggataatgccagggcccagccaaccatgatagcgagcacgatccgtggtaagcgaaagttgactaagactagcatgtcggtcgcattaccgcgaccagttaaaattcccagcagagcgggccagctgatggtcattgtacccgtactaaggttgagaatcgctagtccgagcatgctagcagttaagagcagtgaccaaataattaagcgacgattagggctcatgctttcatcggctcctttcgtgcaaggtagatgaagcacggtaccccgattaaggagataatgatgccaaagggcgtttcatgtggcggattaactagccgtgcaatcaaatccgcaccgaccgtcagtgttgcaccaaggatcaacgttaatggcatgctattgcggtaattagcgcccgctaaccaacgcgccatgtggggaatcatcaggccaacaaaagtaatcgtgccaactaatgccactgagatcccggataaaatgacggcacagatgagagctaggcctcgcagtaatgggagacttttccctaaactctgtgcattgtcgtcagtaagataggctaagtttagttgcggtgcgagtagtagggtcagtagcaatcccaagactagtcctggaccgagaaactttaattgtgtccagctgacggcacccaggccaccgaaataccagaacgcgaggtcctgtttgagctgcaacacaagggccagcccttcgctcagagctgttaataggctactgattgcaatcccagcgagtaccagaatcgtgggatcgagttgaacatggcgggcggtgctgatactgaaaatcagtccggcactggctgccgcaccaataatggcccaaccagtcgtttgtaaagttgataactttggaaaaaaggctaaacacagcgttagcattaagcccgctcccgcgttaatccccagtaagcctgaatccgctaacgggttacgcgtcactgcttgcattagggcgccgctaccagcaagagctgccccaatcaacgccgctccaaggacgcggggcacacgaatgtgccggataatttgttgatcaagattgccagtgtgtgtggtcgtcagggcgtgccagacggtggccgtacgcatctggtcagcgccaaatcgcaaactgagccccatgacgagaatgagtacgccggtactaagtgccagccacccccaatatctggacgttgacttcatgcgggggccacttcctgacagccgttataggtcaaaatcagtggggtaccgtggtagtcaacgagggtggcatcaatattgaaaattgtttttaagttagcggccgtcatgacggtggacacgggaccgtgggccaaaacgtgaccgtccttgagcgcgattaattggtcagagatgcgagccgcatggttcaagtcgtgtaatgccataatgatagttcggtgggcctgttcgttgagctttttgacgagttgcatcacttctaattggtgagtcaaatctaagtaggtggtgggttcatccagaataatcgtgtcagtatcttgagcaacggccatggcgatccatgcccgttgacgttgtccgccagaaagggtgcttaggggccgttggcgtaaatcttggaggctggcctgagtgagcgcccattcgattttttgatggtcagttgtggtgagcccacttaacggccgccgataaggtaagcggccaaaactcaccagttcttctacggtgagatcgttagccgtttggtttgtctgtggtaagactgcaatctttttcgcaaaagttttgcttttgatttgttgaatgttttgatgatccagtagaataacgccggttgttggtggcaataggtgggcgatggcacgaatgagggtcgatttaccgctaccattcgggccaatcagcgtagtgatctgaccatgcggaatcgtaattgatagctgatcgacgataaccttgtcgccataaccaatactaatattttgggcttcaatggtattcacaaataggattcctttcttaaagttaagcgttcaaggaggttcgcttaataagttaactaattttgtttagttgtgcacaatcttattttgccagcttgtttgttggaaaacgtgattaaaacaactgctaactaataattagtgttcaattgatagtcttatcttaaatgtttttattgacaattgatagtgttttcactaataattttggtagcgcttgaaaggtggagacagttgtgacaaaacggtggcaaattgtaaaattgggattagtattggggttaatgggaagcctactattaggggcgtgcggtgcgaagcagccgacaagtacgacagttacacgaaccgattatttgaagcataaggtcaaggtgccgaagcatccgaaacggatcgtggcgagttatttggaagatgatttagtggctttaggcattaaaccggtcgtgcagtggtcggtcaaaaatggtagtggtacgcaggcttacttgaaagagcagttgaaaggggtgccgctaattgactattcgttaccatatgaagcggtgaccaaggccaaaccggacttgattctgatggggacgagtagtgcggtcgccaatggcaagtatgcgcaatataataaaatcgccccgacctacgtggtcaaaaatgggactacggtaacgtggcgccaaactttccttgatgtggctaaggtggttaatcgccaggctaaggccaaaaaagtccttgctaagtatgacaagcaggtccaaacgacgcgacaagcgttgaaaaagtctggtcagcataaagtggcggtgttgtgggtcaccaataatacggcctacatggtcaatgataattcggccagcggggccttactgtatcaagatttacaattgggtgaaccaagtttagttaaacaagtgtctaagtcggccacggcggattggtcggcggtctcgttagaaaagctagctaagttagatgcggatgatattttcttagtgaatagtcaaaagagtgcgtcgctatttaaggacccgctgtggaaaaatatcaaggccgtgaaaaacaaccatctgtaccagtatggtgacagtagcagttggcagtattcgggaccaattgcttattcacaaatgattgatatggtgaagacggacttgttgaaataatagttagtcaatcattataacgaaaaataataggattgagataaaaatttaaaacgcgtaaattactcacagtaaaataagtaatttacgcgttttattgtctatagacagcggtaatcatcagcccaacgcgtgttgataggcggggactaataaatcatcgacaagtagatgaagggtggcatcagtaatcggttcattagcaaaagcacggtagcgaagccagtcgaatggcatcagttgtaagtcgcacgataaagttcccgtacgcagttccccacgttgctgtgcacgctgacacacgcgttcaatcgcatgggcatcaatctttttcacagcattgagcaagtccttaacttctggatttgcttgttgatctaggtggtgaaaccaagtgataaccaaagcttgattgaatgtattaatactgacagtgaagcgcttgagtacttggaataaatcttcagaaagtgtctgaccggtcaagttcacttcgtctagttgaccatggttttccgtaatgatttggtcctggatagccgcaattgcaagctctagtggtgaacgccagcgtcggtaaatgacaggcttactggtgccggcctgttccgcgacgttagcgaacgtcaattgttcaagaccatcttgatttaagatgtcacgggcggcttgatagatggcgttttcgagttcagcgccacgacgacgtgttttagtcatgtaatccctctttttaaataagatactttaagtttcttattgactttttctttatatagcgtattataccagttatgcaaataagacacttttagtttcttaattaggaggataatatgcaagcaaaagcaaaaatttcaaaagcaactatgacgattgcctgggtcgtagtgtttggtgcgatggcaccattattagattcaaccatgatcaacattgccattaacaacttagtgactagttttcatagtagcgtgacgacggtccagtgggcagttacaggttatttactggcaacgggggtcgcggtgccattttccagttggttactcaatcgatttgatggtaaagcagtctttgtggctggtgagattttgtttggtcttggctcgatatttgcagccgtagcaccgaatattcaactattgattatcgctcggttagttcaaggttttgcgggtggcttgattatgccactcttgacgaccttgcttgtgcaaactgcgggtgcagcagtgatgggccagatgatggcaacagttgggctacccatgattttaggaccattaatcggaccggtcattggcggaatcattatcaaatttgcatcgtggcattggattttttggatcaatgtcccagtagtcttgatttcaatcgctttgattttgtggaagatgccgaattatccggcacaaaatcgaacagcgaaaatggactttattggtatcttgctactaattgtgtcctcaagtgctatcatttatagtttggttaatgccgcgcatactgaccgttttaataacgcgacaagtattgagatgttaattctaggggcgatagcgttgattagttatgtcgtatgggccgcttggcaaaaagaacgggcggtagtgccactgcacttatttaagtttgcatcatttgatggtgctggcttaggattgtttatcgctgggacggtattgaacggcgcaatgttgttactaccactctattttcaaaacgttcggggaatgagcgtgattaacgccgctctagcgctattacctcagggagcgggaatgctagtttcgcggacgttaacgggaaggctaacagatcaaataggcgctaagtacgtggttctgggaagtgtcgtcatcacgtttgtcggtaccttaccgttttattggtttggtcaacagacgtcttactggattttggcacttattttatttgtgcggggaattggtgctggtggtattttaatgccgttaatggccgatgcttatacaggaatgcaacctggacaagtgccagctgcaacaattgggaccagaattatccaaaatattgggagtgcgtttggatccgctttgattacgacgattgtaacggcgtattccacacaccaagtgaatgtgtttgaacgacacctaaaagcaggaacgtatcacgtcgacgcagctcacttacaagtctttacaacaagccatttgcaagcaattcgcttagcagcgtttcaacaaggctttctagtgattgcaattgccgcaatagttattattttgccaaccttattgctgactaacaaattgaaggcggcgaagtaacaagctaggagaaaaaataattaaatccgcttgacttatagtcggctctaacaactattattagtttcgttggcagatgtttttaactataattcatcaaaaaggggataacaattatgaagacaattcaaattggcgctagtcagctcaaagcgtctgcggttgcgctgggtattatgcggatggttcgtttagataccgatgcggcagcgaacgtcttagagaccgttcatgaccggggcgttaactttattgattcagcggatatttatggtaacggtgattcggaacggattttcgggcaggcattaaaacagtcgagtttaaagcgtgaagacttttttattcaatctaaaggtggtattgtactcgatcctgagaagagttctggtgaactagtctttggtcaacgctatgacttttctaagcagcatttgattgcaacggtcgataagatcttgcaacggatgcagctggactacctagattcgtttctattacaccggcccgatccgctgatggatcccgccgaagtcgccgcggcgtttgatgaattgcaagctactggtaaggtgcgtcacttcggtgtttccaactttaacccgatgcaagtcgagatgttacaagcggcagtcagccagaaattgatgatcaaccaattacaatttggtgtcatgcacaccggtccaattcagtttgggttgcacacgaatatgcaggatacggctagccttaatcatgatggcgaaattatcgaatattcgcggctacaccacatgacgattcaagcttggtcaccctatcaatacggcatgtttgctgggacctttattgataatccgaagtttccagaattgaatgcgaaattacaggaattggctgatcaatatcatgtgactaaaaatgcgattgcgacggcttggattttacgtcacccggccaatatgcaggtcattttaggttcaatgaatccgcaacaccttgatgagagcattgcggggaccgatgtgacgttgacacgccaggaatggtatgacgtttactttgcagcgggcaatgatttaccttaatttgaatagtccttgtgatgattaattaatcataataggtttaggttctttcgaaacggttactagtctcgaaagaacttttttgtgtggtgcaattgtggttgttataacttggtgtattgatcaattgctgaataaagtcagaattgactttattggtagttaagcggtattaatcataaaattgagtaatgatagattataaggaggaacgattatttgaacaaggcaagattagaggcgtttacagatgcgattatcgcgattgttttaacgttattagtattagacttaccgcggcctcaaactccttcagtgcgggcactctttgcggaatggcaaagtatttatgtttatatcattacatttacactattgatttcaatttggcttaatcatcacgatttattcgtgcaggtcaaaaaaatcgatcgggttgttttttgggcgaatagtttctggttgctatgtcagtcttttattccattcatggcctcatggattactaaatttccgcattcaaaatggcccgcagtattttatattcttacgggttttgtttggatgttggcttatcagttactagtagccgccgttagaagattaaatccacacattcatcgtatgagtagtccggcattaagtgttgtttttggtggctttttagtggttctaacagtcgcgttaattaatcccgatgtgggcttgttcctaatccccgttcacgcatttgctagtgttattttggcgactaaacgtaagtggcatttacgcaagtatttttaatataaagatgaaattaaaaagtaggctcatatctggtttaggctagtatcgcaatgataacgaacgacaacgcccgcaaggttgaatactgagtccaatcttgcgggcgttgccggttagtatttagttggtgttagtaggagtatgcttatggtttggtgacgattcctaggtcaatcatagattgggcggttgcaataatcgattccgcagcgggacggggatgccaatccaacaatgtttgggctttatgattgctcgtttccgcgtaggtgccaactagtgaggcgaccattcgcaattctggtcgggccttagcggctagcttaaccgctgcattgggaatggttttggttggtagctgactggcaaaagctggaaaggcctgtcttaagacatttgcaacgtcaagcatggatagcgtctcacccgttgtggctagaaaacgttcgccgttagcttgcggtgcggtcatggcaagcaagtgcagactagccacgtcacgaacatcaacataaccggaatcaacgtttggaacggctttaacttggccttctaagaattgttggatttgaatattggaatgtgaatatttggcggacaacaccggacccatgacggcaacgggattgaccgttgttaattctaactcgcggccctcatggttaataaagtcccaagctgctaattcagcacgtgtcttggattcttgataaggatggatcgctttccagttgagatcagaccagtcagcttcagtgtagggggtcgtacgatttttgtgaccagcaaagatggccccgtacgcagacgttaacacgactcgtttaacgcccgcatcacgactagcagttagaacccgccgaacaccgtcaacggctggtcggatcatttcagctttgtttttgaagttgagctttggggttggggaagcgacgtcgatcgcataagtggctccggccatcgcttccgaccagtgttcatcatgcgccaggtcggccacaacaatttcgagagctgataagtcggtgataccaccattggtcagcatttctttaataacgggtgctttggctaatgagcggaccgttgtgcggacggcgtagccttgttgtaataattgacgaatgatatgaatggcgatgaaaccgctaccaccagtgacgacgactaattgtttttgcatgggactacctccaaatgaatttatgaattgctgttacacttgtaacgtctgtgccagtatcttacaatggggtcacgacgaatacaaggtaatcacgagcatctgtgacagaatggaggaattgttatggcagcgaccaatcacgcgcaagcaatcaaaaaggattcacaaacttatttaactacggccttattacaattattaaggactcatgatttagatacgattacggtgacccaagttgtcaagcgagctggggtcagccggatggccttttaccgtaactttacgacactcgaagatcttttgacagcgtacttcgccccggcgattgcagcgcggtttcaggacgtcttgcagcatgtaccggccaatcggaagttattagcgatgggtcaattttttagtgattttgcgccgacgttacgactggctgagcaacgtggttttgaaaatattattcaacaactttttaacgctaatatgactaattattaccaaacaacgatggcaaatgggacgctcacggcggtgcaacttaagtattggacaagattcatgagtgccggggtatacgcaatttggcgcgaatggctactgggtggacagttggagtccttaacaacgattcatgaattactagcaactttgcagacggcaacgatgcaggcgctgactcaggctcaaaaatgagcagtggaagaatgatcctaaattagcggtgtgaggaggtcgaaacgccgattttagcgtgttgattgggtacttatgagcaattgtaaaagccacctagccatgcaccggcagagctcggtgcggttaggtggcttttttaatcaaatgagctgagattaagcatcttgggccgtggcagcaatgtcaacttcacggatattgacattttgcggcatgtcatacatgaacttgaccgtggcagctacgtgcttggggtccaaagtcaggccacccatggaagctttccatgcttcgtaatcggacagtgccgacttgctagtaacgtgggttaacagctcagtttcggctgcaccgggggctaccagcatgacgcgcacgttcttcggcgcattttcttcacggagtgtctcggatagcccgtggacgccaaacttggatgcaacgtaagcggcgtgattgacgaacgttttcttgccagctaacgatgacatattgagaatcgttccatgttcccggtcacgcatgtcatttaggacaatttgagtgccgtttaaaacacccatcacgttcgtattaagcatggtttgccactcttgtgggtcctgattttgaacatttcctagtaacattaatcccgcattattaactagtaagtcggtcttgccatacttggcttcggccttgcgaacggcagtttcgaattggtgatagttggtcacatcgactgtgtcgatcatggcattttcaaagttcgcagataaggcggctaactttgcttggcgacgccctaatagtaacagtgggtagttgtcagcggcgaataacttggcaatctcggcaccaaagccagaactggctccagtaatgacgactaatggtttcattttgtaattcctccgtaattttggataatggttttcgtttgaattttcaacgatttacagtatacttggctagattaaacgcgacaagtacgcacttttaggtaaccaccaattgagagcagggagttaataatgttaaaagaacgggtaactgcgcaaccacgctaccgaaatgaatttgatgccacgatgcagttgattcgtggtaagtggaaaatcatgattttgtttgaactggccgaggttaaagtcagccgttttgctgacttgcaacaccatattcaagcggtatcgcataaaacactggcgagtcaattgaaggaattggaacaagatgagttgatcgaacggcatgattttaagaccgctcagccgcatgtcgaataccggttgaccgctaaggggcagagcttgattcccatcctagatgcgatttgtacctggggtgatcaacatgttgatccagctttgattgaacgttcactgtgtgacgaataggctagtctaaacgggagcgtgggctttgtacggcgccatgggaaaagtacgttgtcagtcaaaagcaactagcggcgctgttttgatgaccattactaaataatcgcttcaagaatttctaatgacattcttgaagcgattatttgttattcaactaactcgtgctgtttgaaagctgacagccagctatacgggctgttttataagatgaaccaactattgccgccgggatgggggtgggtcgttatcatagacgagtacaacgcggaatcgatgatttgaattaatcgattgccgttacggtgacagcgacgacatcgccaatgcttttgtggagttttgcacgaatatccttacgaatacctaagatataacaaatactaccatcaaggtttttaacacccatattaacgatagaaccgttgtaagggacctcatcgaaagtggcatggactttgacgcgccccttaccgaaaaggtcgcgaatatcgaagggacaggccacgtaagccccacctttgccaattgttgcggcttgaatcggtgcgtcaaattgataagtcttcattattatatgacctccgcctaagcgtaattatggaacggcttcatttttataatcagatttccatattatcatagcaaattagcaattgttggtgaactaagtggtcactcacaactaattataattaaggtgaaccgctatttgcgtgaaatattaaccgggtatatcgttggtatcaaaaatatttatcgaaaagtacaattattatactaaatccccttgcgagcggggcaatcaaccgcttataattaaactgctttaagtaaattaaaaaagggtgtttacatgaattttaaatcacaaaatccaattgatgcaagtcagtcggaaagattcaagctttataagtcggggaaactttggctggttgctggattaactttcttctcatttttaggaggttccgttcttaacaatacaaacgtgcacgctgatgctacaaatgcaacgacaacatcgtcttcagctgcaagcacggcctctagtgcaagtgttgcaacgagctctgctgctagcgatgcgacgactaaagcgacctcagtttcgtcaagtgctgcgactcaagtaacgagtgcggcaacaactaagacgaccagtcaagcagcgacggcatcgtcgagtgcggccactagccaatcgaccagtacagcatctagctcgactagtcaagcaactaagacggcttcgagtgcagccactagtacttctgcaacggctacaagccaagcaaccagtgtcgcttctagtacggcaaccactactcaagtaagtcataccgcaagcagtactgctgccagtgctgcttcaagtactgcaacggtcaaggctgttaaggccgcttcaagtacggtaagtagtgcggcgacgaccgctactaaagccacagctaaagttgctgccgttgcttataccgcagcaacgacgtcttcaacggatgtctggacgattggggatacgactcggccacgcgttgatgttgttgacgtggcgtcatagcaaagtaccatgacgcaatctgatttcaataagttaaaggctgcgggtgttaagacggtcatcgttaagtcgactgaaggcactgattacacgaacccagctgcactgaaccaagcaaagatggctaacaaagctggcttgaacgttgatttctaccactatgcaacgtttagcacggctgatgcggctaaatctgaagcgactaacatggctggtttcttagttaagaacaatgtttcaaccaaagttctcttgttcgctgacatggaagattcatcttcatactcagttaacgcaacggcgaacttgaacgcgttctggtcaacgttagattcctttggttacaagaatcacggcgtttatacgtccaactcatacttatatcgggatgctgttgttaagacagttggccaatcacgtgtatggcgggcccaatacccatacacaccttctgctaataacctttggaacaccaatgatggtgcatggcaattctccgatacggcactcttaccatctggttcagattataccggttacattgatgtcagcatcgattacaatggtttaactgaagatagtgccgggaccaatacattcgtaacgacaactagtagcaatgatacgacgactagtgaagtaacgactgacactagtgctacgaccaatacgtcaactagttcaacgactaagaaggcctctggttggtatacctttaccaagaacacagccatcaagagcgctgccagtgacagtgctaaaaccgttggaacttacagcaagggtaaccgcgtttactataatgctgaagttacaactaatggtgaaacttggttacgttacttaagttacagtggtagcgaacattttgttaagattgccgcagctaaaacgaccacgactaagcctgccgcaagcactagcaagacggttaccaagaatgaaactggcacttacaagtttactaaaacgacagctatcaagggctcagttagtgactcagctaagactttagggacttactacaagggtgacacggtttattacaatgccaaggttactaagaatggtgaaacttggctccgttacctgagttacagtggtgcgcaacactacgttaagatcagtggtgcagctacgtcaacgactaccaccaagccagctactagttctagcaagacggtcactaaggctgaaactgggacttacaagtttactggcaccacggccatcaagggttcagttaatgattcagccaagactttagggacttactacaagggtgatacggtttattacaatgccaaagtcactaagaacggccaaacttggcttcgttacttgagttacagtggtgcgcaacactacgttaagattagtggtgcagccacaacaacgacgacgtcaagcaagtcaacggctacggctagtgctaagacagttgcgcaaagcgggacttacaagtttgctaagacgactgccatcaagtcttcagcaagtgacgccgcgtcaactgttgggacttactacaaaggcaatacggtcaattacaacgccaaagtaacgactaacggtcaaacttggttacgttacacgagttacagtggtgcgcaacactacgttaaggtcagtggcggtgctgcaacgaccacgtcatcttcagcaagtaagacgacggcggctgctggtacgtacacgttcaagaccacaacgaatattcggaccgctgctagtctaaatgcctcagttgttggccaatactacgcgggcgaatccgtttattatatcggaacggtttctgcggacggctatcaatggctgaagtacttatctaactctggtgcttaccattacgttgctaagattggctaacaattagttaccaattactagtgcaataacaaaacaggctttgagatcacgtcaagcgacgcgatttcaaagcctgttttgttgtgtgattgagttagtggcctgttcatcttattttgacaaaagtcggcatagacgcacttgacaaaaagtttatactgattcgaacttctttcagtgggcctaagctggtagcttttgacactaaaagtttgaagcatgcttcgtattcaagcacgtgtaatcggtgctgtagtgaggggctaatgtttataaaacaactaagccaccagcaccgttgtcgtagtcaggtttctgagcagtgacaaccagtttttcgttaacaaaggccattaagcccaggctgcttaactcgcgaccatagccggagcccttgacgccaccaaatggtagttctggtaaggagctgaggaaggtgttaacgaagaccatcccagtttcaatttgttgggcaaccgctttgccatgcgccgcagttccggcgaagacgatgccacctaagcccagttcagagttgttggctaaatcgatagctgcttgttcagaatcaactttgaagacttgggcaactggaccgaacatttctttgtaaaagagggggttgtcttgatcaatgtccgttaagatggttggttggaagaattggccaggtaagtcgattggttcgttgccataagcaacggttgcaccaccggcaatggcccggtcaacttggtcttgtagcttttccttagcgcgtttggaattcatcggtgccagggtagtttgtgggtccataggatcgccagggactaatttggcaaaacgttccttcaactttgctaagaaatcatcgtacacatccgcagcgacaataaagcgttttgatgaggtgcagacttgcccagcgttgtataaccggacccgccatgctaagttgactgcttcgtcaatatcagcatccgctaagacgacgaaagcgtccgaaccacctaattccatagaactcttcttcaagtttgcaccggccgctttggtaaccgcttgtccaccacgcttagaaccagtcagtgcgacgccttggatgcgggggtcggcaataatatcgctaacttgatcatagtttaagaagaggttcgttagactaccagcgggagcaccagcttcttcgacaatcttggcgaaggccgcagccgatcccggtgtattagaggcgtgctttaaaatcattggattgccgaccatgtagttcggtgcgaagacccgcatgatttggtagtatgggaagttccaaggttcgaccaacatcaggacaccggttgcttgtttttcaatttcggcatcgcccgttgcttgagtgctgattggggtcggtgccaataattcagcaccgtgatcagcatagtaatcagcaatcatggcgcatagttcgacttcaccttgagattcactcagtaatttacccatgtcgattgttgcaattttagctaattcatctttatgttcacgtaacagtgcggcaatcttatggaggctggctgcacgggaactaacgggttcatgacgccattggtgataaagggcgtcgccggtagttaaggcctgttcgatttggtcagtggttgcgttgtcgtaagttttaacaacttcattggtatatggattaattgtttgataagccatagtaaactcctcctataaatgttcaggtattgtaaacggttaatctgcgattgtatgggactggtaaccgccttcactattgtacgctaccacaaaagtacggacaaagtcagctaatttgacttgaccagcgctagtgtcagaagcatttagatctgcataaagtccttcaggttcgcgctgataacgactagtttggactaatgaagcggcaattttaacgggaacaccgtggttcgtcaagttagcttgatattgttcatctgagatttgtacccattgtagatcgggcatgtttaaggcgtcgcgcagatcagcaacgaattggtcaccggtgaacgtatcactgaaggcatacttgacggtgataccggctggcgtgtgatcaattaggggataaacgacactggcaatgtcctcgggcgcaacgtatttttgtgctgaagcagcaggcgtgctggaataaattttatgttcagccttgattgttgctaagttaccgaacaagttagcataaaatccggttggacggacaaaagccaggttaaccccgtcaagttgtcgtaattcatgttcaattaagttgtaagcatgcagcgagccagccacttcatcggcatctgcgccgatgctactgaggttgacgacgttggtgacgccggcattttcaattgcctgtttccaaattttagcctgagccacggccccttcgaagggatcatcaccgataccaccagaaagcatgagataaaccacatctttgtcagtaaaagtggtggataagaaatcaacatcagtcattgtaccaatggcggcatgggcgccgacagcttcaattgaagcttggcgcttaggactagttgagataacggtgacgtcatgaccggcttggacgagcttaggaacaacgatccgattaatgtttcctaatgaacctaacattgcaattttcataattatagaacctctttaaaatttgatttttatttttaaaagataaatctatctttcaacgattactagtttaaaagataaatctatctttgtcaagcttgaaaaagatatttttatcttttatactgaagacatgaagaaaaaagatatgaacaaacaagttaagattcaagatgcggttgcggctatcattctcgctgagggtccagccggggtttcaacgactaaggtggctaagcgcgtcggcattgcacaatccaatgtttatctctactttaagaataaacaggctctgatcgatagtgtctatgcgcgtgagacgaaccgaattcttagtactaccgacttagaccgattaagtgattcaacaatcgatgtgacgactcggattcgattatatgtacagcaggtgtatgactattcgttagccaatccagatagcttgacgatcattcaacagatcaaggcattgaatggacaggggatgacgatttcggcggcggatgccgatccgaataatattgtcgctaacttattaacggcggctatcgatgctaaggtgattaagcagttaccggttagtttgcatatgggggtcgtgttttcaactattcatacgcatacgacgaatatcagtaagggacggtatgctcaggaccaatatacatttggtgatattttccaaatgatttgggacgcgatgaaacaagattaggaggtttaatgacaaaagacgcgacttaattgataggcacgagtggatatcaattaggtcgcgtctttttttgcgttcatgtagcgattagtcgtcttgaaatgacggtttagtatcttaaaggctggttgaataattcggttcattgtgtattcttttcaagtgtcggtgagtgttttaaactgtaggtaccagtttgagcaaccaatatgtaagggggactttgatggtacagtgggcaaaacgattcagtgaaacgaaggaaccggttgtattgattagtcataatcaaaataggtgtgccggcaaaatagtggtgttaatgatgagtaggctggagttgtggggtagctgatgaagattatttttgtgcaaacgctgttcctattcttgtttgttaaggtgcttttgcgtgattggcgggtacttagtatttgggatatcagttatgcggtggtcagtagcctagtgagcggctggattttttcagtaatcgggcaatatgcagcattgccattattgggactggtggtgctgtttacttggtggcatacacatagcttcagtgagtcattatttgttagcctacaggtgattatctggtcaattgtcgtcgatcatatcagttcacttttaacgtatatgttgaaattagatgacgggtatcttttgatttttatgggattacagctggttggtttaatcacattgaatctgattttaatgaatacgcatatccagacgacattcaatcgtcccagactgaaccgggttacggccttgctgctactcgccatctatttatacattattgtcagcgagggcctcgacagtgaattgagaatggtcgtcagtaacttagttgtgttgttggtcgttatggggctcgcgattgccatctatgatgagtatcgggttacgattcgggccaagtaccaggttcaacaacaacgcctgcaaatcaaaaatgatacacggtacatgcatgaaatcgaaacgcattataatgaattgcgccggtttcgtcatgattatcagaatataatgttgtcgattaatgagtatttgaaaacggatgatttggcaggcttacagcaatattaccaacaaaatattgccccagtgaccaagcgcgtttcggatgagcagtataatctcgaagatttaagtcgtgttcaggtcaaatcggtcaagagtattctatttagcaaactcagctatgcgcaatcacagggagttaaagttcaatttgacttgaagcaagtgcttaatggggtaacgacgaatgaattagacttggcaattgcgctaggtattattttagataacgcgattgaagccacggccggtcactatcacggtgagctgatgagcgccatttttgttacggcccacagtacggtgttcttagttcaaaataacgtttttgattccttgccacctttatggcagctaaaggaagcggggtattcgactaagggacaagagcggggcttaggcttgagtcagctcagcgccattgttaatcgaaatgaaaatatgatattggaaacgcggttattggcctcagcctttgttcagcgtttaacggtaaagcgggaatgataaaatgatcaaagtatatatttgtgaagatgatactaaacagttacaaaccttgcagcaactggtcagtaaagtgattattgatcgtcaattggatatgggatttggcctaacgagtgtcgatccgcatgaaatattagcgcatgtcaaaagtcagcaaccaactcaagccgtctttcttttagatattgcgttgaattcggatattaatggcattcagcttgccagtcaaattcgtgatttaggcatccgaagtaagattatctttgtgacgacgcatacggagctatcattgacggtgtttcagtatcaagtggaagccctggattttatcttgaaggattttccggatcgcttatacgagcgattaaataccgtcttacgcgtggcacaggagcgtttcaaagctgaagacaatgatcaaaatagttatatccaaatcaaaattggcgagacgattcgatcgttggacgtgcaacacgtgttattttttgaaagttcaatgagtccacataagattatcgttcatttagatgatggtgaacttgaatattacggtttattaaaggatgtgccggatttgaattctgatttttatcgttgtcataagtcatatgtcgttaatctgacccgcattcggtcattggataaacggtatcgtcaactaacgatggctaacggtgaaaccgtcctgtgttccgcagcggccagtcgctacttagtaaggcagattggcaaaaacaatcgctgattgaaatcttagtcgatttatattgacggcagtaaaattcagattggcaagattcggtttgctaactagtaaaataatcgtttcagcaatttgatttccctgaaacggttatttttttacgctttattcaggtgtattgaattatgaacctgagctgggccgttccaatcaattcgcttgcgtttattttgaacttatcttcaacgggccaaataaggtcttaatggttagtctgcctgtcttaaaacggccgttgcgacgggccacactaaattataattagaagcaaccagtttgaatcaagtgggttatgttcgctacaagtgcggctgttaattatggtcaaggcgggcttgccgttattccgcaagtcaaatcgctgtactgggcattgcctatgatttgagcgtgacttgtgattggtcactaacgataatattggtgattagtcgtaataacttaagtgtgggagtgaatagaatgtgtggattggttgggtgcttaacggatcggcgaaaagttgataatgccgcgtatgatcaggttgtgcgggaaatgactaaaatgattgtgcatcggggcccggatgatgagggttactttgcggatgataatatcacgatggggtttcgccgattaagtattattgatttggcgggtggtcatcaaccgctgtcatatgataatgaacgttattggctaacgtttaatggtgagatttataactacgttgagctacgtgaacagttaattcaagagggctacacgtttaagacggattccgattcggaagtgatcttaggaatgtacgccaaataccaggccaagttgacgacctatctgcggggaatgtttgcctttgtaatctgggataagcaggaaaaaacgttattcgcggcgcgtgaccaatttggaatcaaaccgttttattatgcgattgccggggatgatttttactatgcgtctgagagtaaggcgatttataagattttaaaagataagcattttgatcaagaggcattacaagattatttgacgttccaatatgtgccggaaactgagaccctgacaaaggaaatcaagatgctggcgccgggctgttcattaacaaaacagttgggacacgcgccgcaaatcaagcgttattatcatcgggagtttcatccagtcgtccgttctgaacaggactacgcgacacggcttaaggagacgttgattgattcggttaagatccatatgcgttccgatgtcccagttggggcgttcttatcgggcgggattgattcgtcaattgtggtggcgattgccaagcagttcaatccaaatctcaagacgatctcggtgggctttgaacgacctggctatagtgaattagacgtcgcacaggaaacggctgctaagttgaatgtcgataacgtccaaatgaccatcacgccggaagcattcatggcagcctttccacattttgtctggagcatggatgatccgttagctgatccggccgctgtcccgcagtatttcttgactaaggaagccgtcaagcacgttaaagtttgtctcaccggtgaaggggctgatgaactttttggcgggtatacgatttatcatgaacccgaatccttgaaagcctttcggtatacgaagccaatcaacggggcccttcaacggatagccgcgatgatgccagcaggaatgcggggtcgttcgttgcttatgcgggggacgacaccgttagagaagcgatacgttggcaatgcgtttatcttcaatgaaactgagaagcaacagttcatgaagcactacaatcgtgaccattcgttccaacagacaacccgggtattttacgatgaagccaagcactatgatttaatctctaagatgcaatttatcgatatgcacacgtggttaaatggggatttgttgcataatgcggaccggacggcgttagcccacagccttgaattgcggacaccctttgttgaccgggacgtgttcaatctggcagcggaaattccagccaacttgcgaattagccacggtacgacgaagtacattttacgaaaagcggttgaagatattgtacccgcgcacgtgttatatcgcaaaaagcttggtttcccagtaccgattcggttgtggctcaaagatgagatgtacgattgggctaaaaatattattgtgacgtcgcaaaccgatcagtattttgacaagacatatttcttaaaactattggatgaccatcgagcgggtgttcgtgataattcgcgtcaattgtggaccgtgctgaccttcatgatgtggcataagttatacgtggaagctgatatgttaatggatagtgtaacggccaatcatcttgctgagcaagtcgaaatcggttaagctgttcatattaaagctaaataagaactcgttcaacgtgccaatgagaataaaaatcatccagcgacctgattgtcttaatacaaataggttgctggatgatttattttggtggttttgtagttgtttcgttagtcgatgacgactttagtgccatacttgatgttgttatagacccacttggaatctgcaacgctcagatgaatgcaaccgtgtgaagacggtcgcttgccaagatcagcagcgtctgatttgataaagtgaccttgggcatctacgggtgtggagtggaacaaatattcaccatggttgagccatgagacccagtaataggcaccttcatcaacactagcgctataaaaatattttccccgttcggcttgcacatgataggtgccacggggtgttttgcggtcagcagttggcacgccactggatgcatacattgtatagagaacgtggtgatggttcatcaagtatagccgttgtttagccaacgatacgtgaatccataagtccggatagcggttgacattgggatacgcgactgtttcggatgattgacgccagttgattggtgtgcgcatgaccgttgatttagccgtggttttggctttcgtttttgacacgactttttttgtggttaccgttgattggctaggtctgtgggcatcaccaacaactttgacagtgccgaccgccagtaagccgataactaaagtgatgctagttaataaaattaatgttgatttgcgttgcatgttgcgcccccatagttggttggttctgtctggctctgacttgatagttagtggtaatagtcaatactgaccattcaatcaagaccttctcagtaaaagtggaaaccaatcgtatattaccgttatagctttctgaaagtgaaaatgcaacccagtcgaatgctgggtaagtcggttttacgaacaaatcggggtcgcgatagtgtaaagcgggcatattcaggctttaagtcaattaacacagcctaaaatgacaataattggtcttcaaataacactgaaaataaacaataaattccaactaaaagtaggaaggccgccggtgaaaatcgggacgattcattgctagcactctgagtcgcgtattaatgaggttcctgaactagtgacggttaagtggatttaaaagatagtgacataaagaaaaacactcagcctagcgataggacaaccgaattggtggtcattgttaagccgctaagcttagtgttttcgatgaccgtttaagacgactacgggtcatttagttattaattttgaacgcaatgccggtcggtgctttttgcgggccgcgctaaccaaattagacctaacaataggactaagctaacagcaaccatgatggcaccaaagatcggtgtccagcctaagccaaggttggtcgtgacttgaccaccaataccggagccgagtgcgataccgacgttaaaagcggaaatatttaacgctgaggccatcgtaatatcgtgtggtgtattctgttcagctaactgaacaatatagagttggagcccagggacgttcatgaaggcaaagattcccatcagtaggacggtcaatagtcctaaccagtgactgtacccggtgacacttagaatgagtaaggtgatgagtaacccactgaacatcttgaatagtgcaattaagggccgtgcattggcccaacgaccacccagtgtattaccaagggcgaccattaagccgtaaacgactagaatcaaaacgacagcgctcgctgaccaatgcatctgctgttctagtagtggtgataggtaggtgtaaactacgaaggtaccaccgtatcccagcgccgtgacgagtaaggcgaacagtagttgtggattagtgagtacgcggataatcccccggaccgtggctttactgggtaacggcagattacgtggaattaaccagtaatcagctaacaaaccaatgacaccaatcatgctaataaagataaaggaccagcgccaaccgcctaattgaccaatcatcgttcccaacggaacaccagtaaccgttgcgacagtcagtcctgtaaacatgatggcaatcgccgaggcccgtttggcaggtgcgaccacgtcagcggcaattactgaggcgacggtcataaaaataccgtgagccaaagcggccatgacccggcctgcaagtaagacaccaaaggttggggcacttgctgcgagtaagttaccaataataaataaaatcataattaacatcatcaagcggtgacggttaagccgaccggtgagtaatgtcatgacgggcgcgccaatcatgataccaatggcatagatcgagacggtcagcccagcttgcgccaagttgatgtgaaagttgctaacgagtagtggcattaaaccaacactaataaattccgttgacccaatggcgaaggcactgattgcgagtgcaaaaagtgtccaactgggattaaactgttttgtcataagataagcctcctgctattgctaagttaataaataatgattatactagcaagtgaattttagacaagtaccgactttaaagtgggatacccactaaaaagtaagtatggaatggagggacaattattggaaaccaaaacgtatcatattggggtcgaggccacaatggaaattattgggggtaagtggaaatcaattattctgtgccatctgcgtactcagacgatgcggacgagcgaattggaacgcgcgattccacaaatctcgcagaaaatgttagtacaacaacttagagagttggaagccgctaatattgtgacgcgcaaagtgtaccaacaagtgccaccgcgcgtggaatacggactaagtgattatggccggagtttgtccgttgtcttacatgagctgtgcgtgtggggtgaggataatattgatcgccgccgagctgcgggtgaagagattgccttgttacatcgagacgatttatagacaatgagtttaaattaaaaatggtgcgtcaagaatgaaaacattctggcgcaccatttttgattagggggagttaatgttgggtcggttgacgactaaataaacaacaaatcagtggagttaacttattgctactagctattgtgtagggatttggctaggagttcatctgcgaaactcactgggttgttactaaagaactgcgggggtattttactatgcttactaaatatatagaaattcgcacaaattctgtactaaccagatttagttttgaaacttaatattagtagtaatgactccgcttacattttcaaatggttatgataagcttagattattgacgataaatagactggagttggtgagtatgacgaaggcagttatttttgatttagatggattattgattgatagcgaggttatttcattaaagatgtatcaacgaatcgtacaggattatgggcagacgctttccatggcgacttatgcacaggaatacagtggtaagtcggcggtgacgaatatgcaacacttgattgaacgttttgacttgccgtttaatgttgatactggattaaagcgggcgttaacgttggaaaagacgtttatgcaggatggcgttgagctcaaaccgggatcacgggtgttgttacagtttttacaccggaatcattattcagtggccttagcttcatctagtatcaagtcgcgggcattagacattttgacgtcccatgatgtggcgcaatatttcgaccagtttaccttcggaccggatgtcgatcgtggtaagccatatccagatatatttttgatggcatgcgccaaactccaacaacaacctgcagattgtttggttctggaagacagtgaagctggcattcaagcggcgacgtccgcgaagattccggtaatttgtgtgccggatatgaaacggcctaaccagccctatgctgatcaggcgactgcgattgtaccgtcgttaacggatgtgataacgcatttaaaatcagttcgataagattcagttgtaattaaagcataaagattattaaattatcaataaggagcggttgtccgatagaaaaactgctatactacgaggcgtaaataaatcgctgacaagttagccagtggaacgaaggagtcttgatcaatgaagaaattgatgattgctgtaactggtttagccatggtggcaacgctgggagcagcggtacccgttacagggattacagcgaatgcggcgactaagaagacaacggctacgaagaatgtcgcaccaagtttgaaggtcaatgcaatttacaataatacgacgcaaattacaggtacggcaaccaagggcgctaagatcaccgtaaaaagtacggccaacgccaagaaaaatcttggaactgcaacggcctctaaaacgacgggaaagtacacggttaaattagccaagacattgaaggcgcaaagcaatgtttatgtgtacgccacgaatccaacgactaaggcttatttctaccgcgtcatccgtgttcagactgccaaaactactgcctcttcaactaagaagacgactaacaagacaaccacgactaagaaagtggcaactaaatcgacggcggccacttcgtcatccaagaagacgactaaatcgtttaaagtcaacgcgccagcgggtacttggaagtcgaatacgactaacaagtactcccaaatcttaacgtttagcgctaagaatggatttaatcagacgctttataagaatggcaaacaagttaaaaagctggtctcgtatgcgagttatagcatgactgccaagacgccaacgttctggaaagtcagctataagtcaggctcgactactaagaccctatatttacgctatacagcaactaataagtttacggtcgttaatgctaaaaatcagatcgttaaagttaaggttggcaatgccccagcagctgtttggacgtttaccaagaagtgacgggtcgttaaatatcttaagtacgaacaattcctcggtattttggggaattgtttttttgttgcttgctgatcaattagattgaacgtggcctagtgaatattaaaataattgaaaaaacgcagatagcttatcgtcattagcaggttaggtgagcgcatataaattggccaatttgggctgttcatagtgaccatgatggaaaaggcactacagcgttggtaagccatctagttcgctcgaaaaatgacttggtcgtgagtcacttcaaaaatgaccatcgtgcagttgtatccatgaagaatactgaataaacaagtaaatgaaaatgggtgttcgttagctgatacttatcatttaattacggttattaacacaaataatatcacggtgataaaaatttaatattcggatatctgtaaaattgtaagtctttttctgaacgtcacaaactgaaaataatgtaagataattaacgtcaagagatgttaaaatactatctatgtgaagggagcgataggcatgcaacaccggcaattatggtatcggggcggcctgggactggcactagcgctagttgtggttggatatcgtggatcacggacagttattcgggcggttccccgcgcacaattgagtgttgatcagaaaatgccatcgactagcagtgttttttctgcttcgaaattgacgttgcaagatgaggcaaacaactcggcaccacaagtgtcacctgaggcccaggaaagttcgggacctgacaagcagtcggatttaacatcaggcagtagtaccagtagcagtggtatcagtagtggcaatagcagtggcagtacaatactggaaaacgctaaaaataatcaaacatcagaaacggcgacgaccaaagcggcagaaatggtcaatgggacggttaaaatgaccttagatactaatggcacattgcatttgagtggtgggtcatttggtgcatcgctagggtcagccacggggagttggattgtaaaaaccttgacggctaacggctatcaaccgacccaagtttcaaagatcgtcatcgacggtaagataacggcaactactatgactaattattcatatctgtttgctaacttacctaatgttacggcgattgatgggctagccaaccttaatttaactggcgtaacggatatctcgtggctatttttgaactgttcacagttaggcgcgttggacttgaatagttgggatgtcagaagcgtcatcagaatggagggaacgtttcaaaattgtgccaagttagttacgttgaatgttgccaattggaacacggattcattacagtatctaattgacactttcaatggtgacagttcattaacgtcgttaccagttggcaagtggaataccagtaaagtggcgacgatgatgcgaacatttacggattgttcttcgctgacgtcattagacatcgctaattgggacacccgtgtcgtaacgaacatgtccgcgatttttagaggaatgtcgaaggttaagagtttacccattgataagtggcaaacgggccgcgtggttaatatgcagttagtcttttcaggtgatactagcttggaaagtattaacgtcgctaattgggatacgagtcgggccactgcgttggatgggacttttgctaagcttcctaatatcaagtccctgccactcgacaactggaatacaagtaacgttcaaacgatacggagcacgttttatggcgatactaacttgacccagctgccgattgacaactggaatgtcggcaaagtctttgattttaattcaaccttcagtggctgtgccagtttaacaactgcaccggttgcgaattggaacacccagagtgccaccaatcttggttatacttttgagggcatgactagtctcacctcgttaccagtagataattggcagactggtactgtcacgaatatggccggaactttttctggagttagtcagttaaagagtctcccgattagtaagtggaatacgaagaatgtacaaaatatggcggggactttttctaaaatgagtagtgtcacggcattaccagtagataattggcagactggtaatgtgacgacaatgaggggaatctttaccaaagttagccaagttaagaatttgccagttggtaagtggaatacggcgaaggtcgttgacatgggacaagtattttacggcaacccccagttaactagtctgcccattgaaaactggaatacaagttcagccacggatttttcacagctatttgcggaagattcgggtttacaaaccttgagtctaggtgcttggaatacgaccaaagtgactaactttgaatcagttttccaaaataccagtctagacaaattagatttgactggctggaataccaacagtgcgcaaacttataccaacgctttcagttcgaagttgccgcctaaacgtctattgttgggccccaattttaacttttttaagagtgaaagttggcacttgccaaatcctagtagtgaggcaccttatattgggaaatggcgtagtttaaataataaaaaagtttatacgtcagctgatttgatgactaaatacgatggcaaaaccattgttggagaattcgaatgggccactggcaacacgattacagtgaagtatgtggacgctgctggcaagtacttggcacccgacacgaaaatcagtggtgcaactggtgatgcctatcatattaaaccaattgagattcaagggtacgtgccagatcaaccagatggggttcaaggaaactttaccgacaaagatgaaacgattacgttaatgtacaatcctggaggactaatgtttgtctcagcaccgcagaccattaattttggtcagaatccgattactggtaaatcagaaaattacggtgcctcctatgatactgggctagttattcaagatggccggtcaataggttcaacgtggtcgctcaatgcaacgctctcagcatcaggcttcactagtaagcagtcggcacgaccattagcggctgtgctcagttataaggatcaacaaacgggtggcgagtcaattcttacgccaggtgtggcacggttgatcgtcaataaccatcaaactgtttcgaaccaaggcgtcaatatcctcggtcagaaaacggcacttggggcactatcgttacaagtgccaaccgatcgtgccttgacggatacgtatcaggcgacggtcacttggacgcttaatcaaggggttcctaatcgatgatgaaaaaaataatgattaggtaacataaaatttgtaagactgcttgattgttgttagcgagttagttatgtatatttacaatgtaccgtaataactattccagcttaatgattggtttcggccagggttggctttagttataccgcaaataatgatacagaggaggagtggtgttgatgaagcgtttggggttcatcacaattgccatcagtaccctactttgttgggggtggttgtcagcaccgattattggtgtggctagtacggctgagagcccagcaacgattcgcttcgacggccaggctgagtcatcgaactcagacactggcgctaatcagttacaggtgactgaagcgtcaaagtcgagtcattcgattgtgcatcagccgaatgctagtcaagctgttcatcatcagaacccggggtggttaccacaaacgagtgaacaatggtggctgagtgctttcattggtggtattgggttattggtcgttttaattggttggcaattggttaactatctaaaaaaaaaggagttcattatcatgaaaaaaacattattaggacttttattctcagcagcattgattgcaacatcaggtttgaccgcgagtgcggccgatacgccacaaacgtctaatgggacagttggtttcactgggggcgacatcactattgataatggtgatacggacttagctggtgctagtcttgactttggtaccaaccaaatcaccgcagctaccaaagacgataactatgacaacacgaataagtcagcggcggtatccgttgtggacttacggggaacggctgctggttgggatttacgtgtgaagcaaaatgacgtttttaaaaacgacaaagcggttgctaataaagaattgacgggtgcgattctaacattgaatggtgttttggattcaaatgcatcgacgactggtgcggacgcaacggccaataccggtgttgcgctagatacactcaatagtgacaaggttttgatgaccgccgctgtgggtaaggggaatggtaagaacgtggctgatattgctaagtcacaactaatggttcccaagactacggcacgagctacgggaagttatagtacaacgttaacttggagcttgaatactgcaccagcgaatagctaataagtattgatcggaaaaataatggctagtaggggttaatgtcatttttccgaatcatgattagggggagaaatgatgttaacaaagagatggtggcagttaggaattggtttgctagtcggattagttagtctaagctggggacgaacgggttcggctaacacagtcggttttgaggtcgcaccggtggcttccaaatatcaaatcgataaggctgtttcatactatgatctgaaactaaagcctagccaaacaaccactttggcagtgaaagtgacgaacacaagtactcaggaaatcaccgtgcatacggcaattgtaccggcgacaactaatcccaatggggtggttgagtatcaggcaacggctgatggcaagaacattgatttgccagctgatgctagtcaactgattacgacggcggcgaataagattacccttgctaagggaaccagtaagatcgtgacttttaaggtgaaaatgccggctcagaagtatgatggtgttgtcgttggtggactgagtttcttaaaaaaggccgccaaacaacagagtaagagcgcaatggcgattaagaatcaatacgcttactcagtggcggtcgtattgcatggtgaccacgcgctcaccaagaacaagttgacattgggtaagattgatgcgacgcaaaataacgggtataaccaaattagtttacccctacaaaatcgaacggccgctttcttgaatcaagtcaaaactgatgtccaaatctatcgtcgtggtagtaacaaagtgcgctacaagcaggtcaatgaacatggtcagatggcacctaattcagtttatgccttaccgttacgggttggccgggatgcgttgaaacccggccaatataccgctaagttggccgtgaagtccaaaaagcaacattggacgttcaccaaagattttgaaatcacgcgtgatcgtgcgaaccaactcaacaaaaccgccgtgattgaacatcatactaactgggggttgtggatcagcctcggtctgctagtcatcttgttgttactgattgcttggtacattcatcgcaagcagctaaagatcaagcgattagaagaacggcttaaagataaatcataaattcatagccattagtactgttataaacggactcggtcaggttggccgagtcttttttgtgggttcggtggcaatgaatacaaatttacctttgctaacttactcattatctttttgcaggcaatgcgcagcggcttgtttctaagtataatgaaagtgtagttaacttaaaggatgtgaatgaagatgaagtatgaatggcgtaaacaagaaaaaacaacctatgctactaagaagcaaccccaactgttgacgattccagcccaaacttttatgagtatccatggaacggggaatcccaatggcccagagtttcagacgcacctgcaaacgttatatccagctgcttatgggctcaagcatgcgtataagcagtatgcgcaaacacaggcgtgtgaatttgatgattacgttgtttttccgcttgaaggggtctggtcattgacgattaagggacagcaacttgaccatcttgacaaagatgagttcagttatgacattatgattcgggttccagactttgttcccaatgaactgattgcaccggctttggcagcggttaaagctaagaaacaactgccaactgaacaaattaacgtgcagcagttcgacgcaatgcaagtggcacagattctgcacctgggtgcttatgacgatgaacccgcgagttttgccaagatagatgaactggtcgccaatcaggggatgcatcgtactagcaagattcatcgagaaatttatttatccgatgcacggcgggtggcacctgataaactgaaaaccattctccgatatcgagtggcgtcgaattaatgcgaaaacttttgactggcattgggcgtgaagcacgaatataatttaattatattttaactcatataaaattataattaaggggtgctgatagtatgacgcaaatagagatgagtgatcggctgaaagctttattggttgcgaagggctttgataagaagcaattggttttggtgacggatgatggtggtggcaagtactctttgcacggaggtgcttgcagtattggaactaaatttacgataatcgtacttgatcagccggacccggaatacaacgtaacggtggtgaataatcaaagcctcgcgctttggacctccacatacgatctcattttctttaacgatggtattaagatggattacgatcaggggcggatcgctattaaggacaatgcccatatgctggacaatgccgttcaaatcgctaaaggagcggaagttttagctgcttttgaacagggcgtcccagccgacaacctaacttgttaattgcgatatgaagaaggcataataatgaaggcagttatttttgacaattttggtagtcccgatgtattgcgcattgctgacgtgcaacggccggtggcgacaactgcgaccgtcttagtgaaggtcatggcggtggccgttaatcatgttgatacgtttgttcggagtggggcgtttaagacggccctggcagcaccacacgtggcgggacgtgatttagtcggtgaggtcgtagccagttcgcaaccggactttcaaatcggcgaccaagtctggacgaactcaatgggctatgaaggccgaatgggcgcaacggccgagtatgtggcggtgccaactgatcgcttgtatcacgttcctgatggcgtggcgcccatgccactcgtcgcggcggtccattcagctgcaacagccgccatcgtacttaacgacgtcatggaaattcgtcgcggccagacactcctaattgaaggtgccgcgggcaacgttggccgcaagctgattcaacttgcgcatcaaatgggcgtgacggttgtgataaccgcatcaccacgagattttgcacggtgtcagcagctaggtagtaccgcctgttatgattatcacgcggggtttgcggaccagttaacgacggatcagtggacttttgaccatgtgattgatacctcgggacgcgtaccactggcgattaatttagcgttattacgattaggtggtcaggtgacattgattacggcaccgcaggataaccaatttgagttccctgttcgccagttttacatgtctcaacaacgaatcactggttttgtgattagccatgcaacggttgaccagttagcacaagcggccagtcgtttaaaccgagcttttagcgccggactgctattggatgatcaggtcagccagcgatattttaaggatgccgctcagtgtcacgctcaattggaagcaggcacggatcatcaccagcgctttgtgttattaccgagttgattcagcataacgattgaaagcctgattaattaatcagtaatactatgtcaacaatagtattgtaattttggtgatttaaagtgattacttggcaggaggactggacagtcggctcccgcgcgtctaaagttgcgaccaatattatctgtgaaaggaccggcgtgctaacaatccgaaaggtgatcgatacggcgatctttactaatgttaatggcattcctccgtggtaatacgcagacttgaaaagaatatcgatgacgaaagtccaacacttgtcagcaagggttggactttttgtggtgcagcaccagaagcaatggcagaaaaataattaatttactacctatactagattgttgatatgaatttatttattcggatagccatcgattgttggtgaacggctttaaaggaagttcgcctaattatctcaagcaacccaagcttgataacggttacacgaacaatccgggtttgtaaatatagttaacgttatacattattagcgctgttactgaccaaccaatataatgaaaatgtggtcaaaggagtcggcatttaaattaattaatcaatcgtacaaggttattgggggaggtcacaagtgatttagtgccagtaatttatgaattgttatgagagcaatcattgttgataatgaccaccgttcttagttgatgaaagctaaacaagcgctggtaaatgaaaaagggggatttataccatgaagccaatgttaggacacttattaatggcaggaactttattattagcgggtagtacaccgattgttgccaatgctgcagaaaatcgtagtgggaatacggatatcaaagcggaatttacgaagagtacgtccacggtgacgccagttgatccatcaaatcctgatgtgccaagtactgatggcgatggtgacaacggggcggcagcaggtggcgacctgtcgctgatttttgtgtctaaatcgttaggatacgggacgcatgagctggacgttttaaatgatcaacaatataaggttgacccaactagttcatatactttgctatggcaggataagatggttgtagaagtttctgatgttcggggaaccaatgccggctggaaattaacggttaccggctccaatttaacaggaacggatggtacggctgcaaagggcgcaacgctcagtttaccaaaaggtgacgtggtcaacagcggctcggaggccaatggtgcggttgccacggcttccgaagttgctttaaatggtacggtgggatcaagtgccgtcttaaatgccgataagggcggtggttccggggtaactgttagtcgcttagatccaaaggcgttgacactgaatattaaggctaatacggttaaggcgcaggcctatagcgctaacctgaattggacattgagtgatttaccaacaaattaagcgtcatcggggcgaacggcgccccaagtacatatgtgagtaatgggggcgagaagatgcaattattgaagcgaatcatggtcattgtggggacgttaattttaggtctgcaagttagcagcgttagtggattggcagccagtagcgcaagtagcagtagcagtaaaaccacgcaaagcaatgacatcgggtttagcgtggccgcgaagattccgaataatcagattgatcaacataattcctattttgatttaaaaatgacgcgtggccgacagcaacagattcagacgacgatttataacgtcaccaacgctgacatcaaggttcaaacggcgattcatacggcttatacgaacggcaatggcattatcgagtacgtgacaccaactaaaagttatgatccttctttgaagtatcgaatggaccaaatcaccaaaatacagggaccaacgaccatcacgatacccgcaaacgggtcgaaagtggtaacggcgacggttacgatgcctaagcaagcggtgaacggtgtgattttaggcggttggtattttaaacgggtcgccaataaagtcaccggaagtgttaagggttccatgaatattgccaatcagtattcgtatgtgattggactgaaatatactgctggtatagtgccacaaccacaattgaagctcgatacgattacggtgggcatgcagaattatcggcgaggggtgtttccacaattacgcaacgttactgcggtgatcgtccccaaactaacgattacggctaggttaacgagtaagaatagtggcaaggtcatcaagaactttacacagaagaatgtgcaattagcacctaactcagtttataaagtaccaattttgacagggaccaatcgtttgcaggctggttcgtatcatgtccggctagttgctaaaaataccgatcatcgatgggtgtttgataaagattttgtcatcagtacggccgcggcagataagtataatcaggcttccgttgataattcgggaatgagcgttggctggtttattctattcggagcgttaggcatgttaattattggattaatcggtctattaatctttttctggatcaaaaagcggcggcgtgcttagttcggtcagtgaaatgggggaaggaccatgccgaataaatggtggcgattaatattaggggtaatgctcgtgctgagctgggcaataccagtgcgggcggcaacacacggtcgcactgagatcagtgtggggttttatgagactgagtatagtgctgaccggattattcccgcccgtgtgattcctgatggtggtcacccgtacgttattagaccagctgacccgggtacccagggtcagagaaatcagtcagagcgcaagccaatccgccgacaactaattatcgatggctggttgcgtgggcaatcacgcaatggtcaacaattgccccaaacgagtgagcggcttgtcattggcagtatccttggtgggatggggttgttagctagtgttttagcaggcgcgttgtaccgaatattaaaacggcaagatgggggtgaacggaatgcgtaacagacgagtaaaatggttactaattcttgtattcggtatactcggcttgctgaatttgctgcccttagagggtaacgctgcgactttgacgagcaagatgacggacgtgaaagctaatgctgcttttcaggccgtaccgggtggtaattcggttggtagtaatgttgataacggtttgcaagcgtatccagcattaggcaatgtgtccgctaactatgcggataatggtcgaattacgaggcagacgacccaaattacaatgacgatgacgggttcgattaccttaaaatctagtaactcgatgtcaaaagcttattttgatattatggctggtccggcaagtgggagctacaccggggcgacattagttacggctacacctactagtcttggcagtggcaattcgattatgattagttcttcaaaacagacgcagacgttatcggtcaattttcaaaatattaaaagtgagttgccaatctatattggcttccgaatcacagtgaatggtgaggaaggtacctatcagctggggcgtttcaacgcgcagacattatctcctaaaattacggggacactttattcgactgatacgacgatcaaaggaaccgggacacccggcaatacgatcagtagtaatgttaatggtgtgacgacgacggtcggaagcgatggaacgtacacgctgaatcttgggactgcactcggtactttaagtaacgtcaccgtcactgaggtcgatgagattaccggtgataaggggacggcgaccgcagcggtgaccctcaaaaaactaaatattactagttcaaagacggcagtcgatctatatcctggtgacttagattcactgacaagtgatagcgcggtcgtcgcctggttagttaagcaagctggcatcgttgcgacaaatccggatagtgcgactgacacaattacttacgcggccgacgagactagtttagcgagcaagttgagtagtttagccgttggtagcagcaccacgatcaatatttatgggaaaggcagttctgggctgaagtcggatgctaaggcaattactgtgacgatgcgggatggaacgttgagtctgggcacattaccagcaagtttgacgtttggcaccctgacgattccgtttaaagaaacactatatcagccgacaaatgcttggaacatcactgttaatgacacacggaagaccggttcacagtggtacttacgggcgacagcaactgccatgaaatccagtacgcggaccatgagtggcaacctgatttatctgaacgcggggaacaaacaggtgctgacgaatacttcggtaacagtcagttctggcaagaaaatcgcgggtacgacgagcactaatgctgcaagtggttggtcgagcagtcagggtattttattggatgtccagcctagtgtgcaaattgacagttacagtgggacgattaattggaccttacaggatacaccttaaaaattaatataagtggttaaaagatattgcaaaagtatgtcgatttgcaatgtctttttttatgaataattaataataagattgtaagggctttattatagtttaatgcaaatttatgtttacaatatagagtaaagggtttaatgaagccgtatttctgatatagtaaagtgaactaacaaatgtattaatatgatgaggtggttggcgtgtcagcagtacttttagcgctgtcgttgatttctggcggttatgaaatgttgtttttaatgattggttttagagaatatgtcacttggcggattgccatcatttggctaagtctggttatcattacgatgagcctgggggaagtggcttcaaacttatggccccaagtccctctggcttatttttggatcatcccgattgtttgtgtgaccacctttatgagttctcggttgttgtacacccagtggattttaatgttaccggtggcaatctttttgaatgcgcttaagcgattagtaggggcgatcatgggtgtcattgccaaggctgtagcccaatctgcatcgccaatgttattacggcaagcgataggtctacattcgacagcggatattaatctctttttagcgtcgattatgatgctgccggtcattattattttagggatgttagcgcatcgctggttagtacaagtgtcggccgccgatttcttgcaacgggcgcgtgttaatattagcgattacttattagttattttgttttttgctatttacattattgcgtatgtttttgcgatggaatggtcagtcaatgcgcaaacgtatatggcaattgcggctatcgtgacgtttggcattatcgggtcgtatttaattagtaataaaaacagtcacttgaatgatgcgcagctattgctacaagtctcaaattacaacgaattattaagccaccataaccgtgatttacatttgtttaaacatgattatgagaatattcttttgagcatgtcggcatttattcagaacaatgatatggccggcttaaagcgttattttacaacggaagtaatgcctgccagagtaacccttaatcgtcagtcgggactgagtgatttgagtcgcttggatatgccgacggtcagtggtctaatttatgcaaaatatgaggcagccaacggtcagaacgttcatttagtggtgacaatcttagagaaagtcacgttagcggatattccacagataaaagtagtgcggattttgggtaatttgctggataatgcgacggatgctgctgcccgagcgaatcatcaagtggcgctaactgttaaaaatcgggatgctcacacaacggtattttcgattacaaatcaaattccaacgcatgaagcggtagatttatcagttatcaagaaaagtcgatttacaactaaaccaggacatttgggttatggattgagtagtattgaacaattaactacagatcaattagttgttaattattgtattgaagagggcaactttattgcagagctcattatcaaacattaaactatgattatgaatcgaaaggatctgaatttggtggcattactaacaacattacctaatattgggccaacattagccaaacaattgcaagccgttgcgattacgacacccgaacagctaaagtcaacgggtagcaaagtcgcttttactgccataaaaaaagccaacccccacgcttgtattcaattattgtattcgttacaaggcgcaattgagaattgcgcttacccacagttatcaccggcaactcgcgaagatttaaaacaattttttagatcattgctataactcatgaatggcaatgtgagcgctggtcggagaatttaacgataagcttttagataattaagaccatacttttttcactttatgtgaattggttaacataaaaatgattgctttaaagcggttatcccagattacgagggataaccgcttttgtgtattgattgttaaataaaaaatatttgttagaatcattagtgtacagcggtattagttagcattgtaaattgtcagatggcaaatgtaaatagtattactgctagacatctgttaaaatgagcattatttttgggttaacaaattttgaccaataacgtaaaggagttacagattatggggacagaactacaatttgtacaatatttacatcaaatgcgtgattataatgatcagcacccaaccaccaaggggctgatcttattaggttacttagaacgagattttattcgattttaccgggccggaaagattgaagaaggcattcaatttgctaagaaaaatctgacccgttcgcgcgatttattaaataaattatcgagtgaggaaaaacagctgcaactcagtgcgctggttgatgtcttagcttttgagggaatccaaaatcatgctgagatttatgaatttgttaagctacgtaatgattatcaccgttgtttagttaaattacccgtgacgacggaacgttaccagccactagttgtgcagattattcgtgattttgccgcaattgccaaaccgaacgcattagcttataacgcacatttagagtcaacgctcgatgtgatgtactataccaatgctcacctgcatgatcaattatcggtgaaaaaggtattggcccacgtcaatgcgcggtgcaatcctgagtcagtgcggcggtcgtttagtcaagagatgcatatgtcgattcgtgattacatcaatgccaagaaaattcaggaagctgagcatatgttgttggcaacggatttaaccattcgagccattgctgctgaactctgtttctacgatgccgccgatttttcaaaacgattcaagaaggagaccggtcaaacgcccttagaatttcgacaacttaatacacgaactgattagtacttgtatttttaaagataacctttttcgcgtaaatacaaacccccgttttactcgcataaaagcaggtatactatgtctcaaaattcaaaatatgtcgatatttgactaaaattaacagaggcaaattactatgcgatatacacggggcaaatggcgcgtaaccaatcccaaggtttggttgttttctagtgttttaattttaggttggagaattgtgccgacagtggctcaagcaagtgaagctgagacggttaccatgtcgagtcattcggtgcagttagaaacggatagtcaagaccaattaacagaagtagcacggatttcaaaaactgcggtaactcgtgaccgccacagtgtgaccgcccagtccagcaagtcagctgacaggactagttcggagcaatctgctacgactggcactgttgaggcggtcagtccaacgactagtgaagcccaacagcggtcaacacagcaagataaaacagctgttgatcaacaggcaagtgactcaacagcagcttctgcgggtgccagtactaatcaggcgtcagccgcaacaagttctgatcaggcgccagcagccaactcaactggcactcatcatgcgattgatatggccagttcagctagcgcactaggtgctgacagtggggcccattctgaaagtttatctgaggcgcaacactcaggcggtcaaggtaagacgatcgattcagatttatcggggactgttcattcacagtcatcagtgagtaccgtgacgacagctacccctgtgaactcaaattcaagccgagctgtagcggcaactgatcaaatgagcagcagggttgagaaaagggcattgaataaaacaaatgtcactaagtcaataaacataccagttgcaacaaagcagccgagcaagcaacggacagtcaccgcttcgtcgtttttgacaacagcaaagaacttagccgataagaactatcttgatcagtatgccaaacagcatgggcaagcggctttgattgctttgatccaagattggttgtccacgtatcgaattattgcacttacaggaattacgattgtgaatagttcgtttgatggtagtgtggctacgattagtggtggtctgcacgttatcaatacgggggcgacaattcgttctggccaggatgatgaatgggagaccatcataaacggtggtttgtcagtgacaaacaatacaatcacgtttacaactaccaatggattggtggaccgtcccgtagctaatcaggatatggattttacgaagcctcggccaacaggaaatggtgcaatcaaaggtttaccgagcgttacggttgattcttcgttaatcaatgcgcaagaatttagtcaagctcagatcaatattagtgacttttatgatcaactagttactgcaggaaccattttatcggcaactaatggtggcacgttgagtaagatgctgattggtgagtctggaactgctgatttgggctcttatcaaggacaccattattatgccgtgaatattgatttgaatgactggcacagtggtattcggaccactggttttaataatgatgatgtggttatttataacgtcgtcacggcagcaccagcgttaaccattggtggcggtttttctagtagtacaccgaatctagtctggaacttcaatcatgccatgcgtattcagaataccacgatgataactggtaaaatcgtggcaccacatgctgtctttacaactaatcaaaatgttgattcagcggccgttttacaatatggatatggcgatgttgacagtgctattcgagagacgattacgagccaaaacgagcataattatggttttggtcaagtggttactgatgacccgttggattacttaattgcagtgattaagtcggatggtacgagcattgatactttagctggttttcgccatctactagcaaccgggcaactgaagatcacgattacagatgcggctgggacacgtttatcagggttgaatgcagttgatacacatattgcgggccagcattgctatctaatcacttaccaatttggcgatcagactgcaacgacttggttgaacgtccaaccatcgcatgagcccataatacctatcagccggataccggaatattcagcgataacgcagacgatcaattaccaagatgagcgaactggggcggtgcttgctggcccagttatacaaaatgtacgggtcgtgcgatttgccatttttaatgctaaaactcatgaattgctcggctatgatacaaacggcgacggaattgttgatactagtgatgggacaattgcatggctgttagtaccgccaacggatcaagattgggtacaggttgtctcaccagacttatctgcgcagggttatcaagctcctgatattccggtagttgcggggcaaacagtgatcattaatggtggtgatagaacgatgaatacaaatgtaattgtcaagtatcagcaacaaacgcatattgcaacgacgcagcgaacggttacccggacgattaactatatcgatggtggaacactgcaacccatcgcgtcactacatgctgttgttcaaacggttaagtatcaattattagctgtggttgctcatgacggaacgatacttggctacgataccaacggggacggacagattgagacacaattggcagatgaagcatggttgattgttggttcagggccgtggtttggcgcggttaagtcgccagatctgagccatgagggctacgcagcgccggacctaaaagtagtgccggagcagatggttgctggggtcgatgataaagatgttacgatcaatgtttattaccgactagcaactcaggccgttacggtgtatcaaaataaacggcgcgttatcagctatattgatcgacagacccatcaatcgattgccacgaccgtccagcaattggttatttaccaacgaacagcaattattgaaaaaaagactggcaaatgtttaggctatgatttaaacggtgatggattagttgatacgagtcaagctgattatgcgtggattttagttggcagtggtcaatttgccgcggtaacgtcaccaacgctagtcgtccaaggctatactgatccggacataaggactgtagcggctcaaacggtcgcgattactgatccggacctgatgacgacaatcgtgacttatgaccatcgtattattacggtaacaccaggcaatcctgctcgaccaggacagccagttgatcctgacaatccgaatatcttgtttccggatgagggtggcgacaccgatttaacgcacaccgttactagaatcattcactatgtttatgaggatggcacgacagccgcagcctcggtcctacaaaccgtccaatttcaacgcaatgcgatgattgatttagtgacgggcgaagtgacataccaagaatgggtaccagtctcggtaacggaaatggcgggcgttatttcaccaattgtagcgggtgccacgaccacattaacagaagtggcagcccagcaggtgagtgtcacaactgccgatcaggttgtagtggttacttacaagaaatcggcaatcaaaccggaagaaccgggtcaacctgagcaaccaagtcaaccggaagaaccgggtcaacctgagcaaccaagtcaaccagaagagccggggcaccctgagcaaccaagtcaaccagaagagccgggtcaacccgagcaaccgagtcaatcggaagaaccgggtcaatccgaaaaaccaggggaactgcaaaaaccgagtcagccagctgattctgagcaaccagatggattaagtgatcaagccaatttgagtcgtaatcaggctgaacaatcacggacgtcacagccatcacaagcagagtcagatcaaagcgttgtgcagacgaatcagcagaaaacagctgcgtccgtttcaggtattggttgggttagtgcaccggcggtatcaaaacgtaccactaagcatcatcggatgacgacccttccccagacggacgagcagaatacgcaattatcactcttggggatgattggattagcattgagttcaattttaggttggctgaagattaagtcccgcgattaacagttgtgagatgatacccgttgtgagttgcggatctttaggaaccgggattgacggggttaacgttcctttgagggacagctagttttgaatgattaatataggcaatcactgacgtttcttattaaacggtagtgattgccttttgtgatatcgtcgttggtacttttgatgcggtcagttgaccggtcgaaatggcgactaataactgagcaaaggaacgtacgcggcactttttgtagtgacactaaatgtcagacatatgatagtagcaactgggtggggcgtttaaaaaattaagggttatgcctaaaaacaacatttatcgttgacgattgtaaacgaaaagattaatatacacatatagattacaagtgtaaacgataatgagaaagggacgaataaaatgatgattaaagtattagtcttattaattggtgggttagcaattgggtttattctgtggtggttcttcgggaagcatgctacgacaacggtcaccgcgagtgcggttgatgatttacagcaggttgatgtggaggttaagggtggctattcgccagagcaaatcgtgttgaaaaaaggggttccggcggtacttaattttacgcgcaaagatgcatctggttgtctggatcacgtggtgttcagtgatttcggtatcaatcaggaattgccacaaaatcaagttgaagcaattacgattgatacgagtaagtctggcgaatatcaatgggcctgtgggatggacatgtttcatggaaaattaatcattaaatagtgggaggaaaatcaaatgagcgcacgacaacaaatcaatattacagtagacggccattatgacccagcagaagtaacgttacaacaaggtgtaccggcccaattaacgtttacgcgcacgagtacgcaggggtgcttagagcaagtacattcaaccgacttgcactttacgactgagttaccccttgaccaaccgcaaacggtgacggtaccaactgatcgagccggtgaattttactttagttgtgggatggacatggtgagtggcaaggtggtgattgcgtaatgaacacgacgaaacggttttggatttcattaatattttccctgccactactggctaatatgattttgatgccctttggctggatgctcccgggtggtgattggacgcagttgattctgacgaccatcattatggctgtttcggctcggccgttcttgcaaagtgcgtgggcgtcctttactaagcaccatgccaatatggatactttggtggcgattggcactgcgacggcttatttttacagcttatacgcaatggcaacagggcaagcagtcttctttgaaagtgccgcacttgtgaccactttcgttttgctcggccaagtctttgaagaacgaatgcggcacaacgcgtccagcgcggtcgcaaagctagtgggcttacaagccaaggaagcggaagtgttacgcgatcaagaatttgtaaaagtgccgttggatcaagtagtggtcggcgacattattcgggtcaagccaggggaaaaaattcccgttgatggtgtaattacaactggccgctcaacggttgatgagtcaatggtgacgggagaaagtatgccggttcaaaaaacggtggcggacgctgtcattggttcaacgattaatagtaatgggacctttcagttcaaagctagcaaggtcggtgaccagacaatgctggctcaaatcgttgagctcgttaaaaaagcacaaaacagtcacgcaccgattcaaaagctgaccgataaagtttctgatatctttgtgccgattgtgctaattattgctatcgttaccttcttgacctggtatgttttcttgaatgctagcctcgcgaatgccttgatttttgcggtcgctgtggtcgtgattgcctgcccgtgtgcgctaggtttagctacgccgaccgcactaatggtcggtaccggccgtggtgccaagatggggatcctgattaaaaatggtgaggtcttggaagctgtcaatgacgttaaaacggtgatctttgataagacgggaacgattacggttggtcacccacaagtgaccgatgttatcggcgacgaagcccaagtactgcgcgttgccactagcttagaggcggcttcggaacatcctttagctgcggcaatattaaaacgcggcacggcccgtggtattcaagcaccaaccgccacgaacttccaagccatcgagggtaaaggtgtgactgctcaagttgagggccaattagcggtggtcggtaatcataaattattaactgatgagccgattagtgctgaattacaacgccaagccactgagcttcaggacgcggcgaaaacggtcgtgtacgtgggcttaaatcacgaaatcattggattgattgccattcaagacgtcgccaaatcgacgtctgaggtagccattgcgagtttgaaagcacgtggcttgaagacggtcatgttaaccggcgataacgaacgggtcgcacaagctgtggcggatcaagtcggtattgatgaagtgattgctgatgtgctgccaggtgataaggctgagcacgttcacgcgttccagaaggctggcaaggtggcctttgtcggcgatggtattaatgacgcccccgcgttgacgacggcggatgttgggattgccatgggttccggaactgatattgcaatcgatgctggtggcatcgtgcttgttaagaacgatctgcgtgatgttgaccgggcgttggcattgagtaagaagacgtttaaccgtatcaaacttaatctgttctgggctttcgtgtacaacgtgctcgggattccagtcgcggcgggcctcttctttgccattgggctgacgcttagccccgaattggccggattagcaatggcctttagttcattgtccgtagtcacgagttcggtattgctaaataaagctaagatcagttcgaacgcccaacctgcgtagacgatgagcagatagcgtcggatgaaatcgtgcttgttaaacaagcagaaatgtgtgttaatggtacaaaatatgcgggtgtctaacgccagttcacgttgttgagctggaggcgacacccgctttttgagtcgacaatttaaggaagaaaactggctataaattcttcacaatcagtaaaaaagagtattagatttacactaattaagtatcatatcgttagtgtaaaattagaagaatgcccatttaacggagataagtgtggtgttagatgcttttgtaagcgcttgaatcaaattgtgtattgtgtaacaatattaattgtaagcggtttacatactatttgaaacgagggtttgaacatgaaaattaaagcagcagtggttgataaagtaaacgatccatttgtcattaaagatgatattgaattagctgaaatgaaagcaactgatttacaaatcaaaatggttgcgactggaatttgccattctgatgaagcaattcggcggggtgatgcgtcgttaggttatccagtaattttaggacacgaaggttctggaatcgtcgaaaaggtcggttcagaagtaactaattttgaagtgggcgaccatgttattctatcattttacgctgacggaacatgtgataactgtctgaaaggcatgccaactaaatgtcggaattatgccgactataacttgagtgggactcgtcccgatggttccgaccatttccaagaaaacgggcaccatatcagtgatatgttcgaccaatcttccttcacgactcatacggtagttgaccaacgtaatgcggttaaagtaccaaaagaactagatttacgtcgcttgggacctttaggctgcggctatgtcaccggaagtggcactgttttgaacagtttacagccgcgcccaggacaaacaattgcagtctttgggactggtgcggttggtttagcggcaatgatggctggtaagatttccggctgtaccgaagtgattgcggtcgacattgttgattcacggctagaactcgccaaagaattaggtgctactcatgccattaacagtaaggaagaagatccagttgaagcaatcaagaagttgacgcatggttacggggtcgactttgccgttgatacgactggggtagaaccagttatggtttctgcaatccacgcacttgctcaaggtgggactgctgctttgattgccgttacggccaaaaatatcaccattagctcatggaacgatttgtgtgttgatgataagaaagtcattggtgttaacatgggtgatgccatccctggcgttgatattccacggttaatcgatttctatcaacatggcatgttcccatttgaaaagaccgaaaagttctataagtttgaggatattaatcaagctaatgctgattcaggtagcggcaagaccatcaaacctgtcttgatcattgatgaagattatcaaccggggaaatagctgccggctgggtgccatcagttatgatgaataacttctaaaacagcgatgtcaaaagttgattttgacatcgctgttttttgcgttaaacacaagccgcttggacggcttgcataatttgtgattaaaacgtgccggttcttaaattcaaaaacagccagctatggaccgctgggaaaaagttcgactcagcgtaaacttgtttagttagttcgtcctacaccgacctacaggcatttctgccaactgccggaacgtggtgggcacagatttaagccgaagcccacgtctcaaatactggcctttcactaaccaagccaaggacgcttgctaagtgaaatttcaccactgggcattggccgaaacgccttccagtcgggacagtgttcgaatggcggacatgtgcgtacccaacttttggtgaattcgtcattgtttttcataaaccataattttgtcaatcaactgtcagggtgaaaatgatattgagatagctcactaatcttgaattggtgtagtaagatttaagctcttgacagagggcttaatacacctaacgctttgtttaaagttccagtatcaaatagcgaacaacaaattgtaccgagttcggtggtcgttcattagccatttgagcggcttcccgaaacgtgttcggggccactaaagcctgtgcttgctacgccaacggactaatgccaaaaccgcattaatccgttggctaggcaatgctcggcttcaactcgtggcccctcacactcttgagaccggaggggctgggtgacaatgctcagtagccaaattattcttagtcggaagtggggtacttccggcttagaataagactcgtatttgagatgacgcgggttgggcgttagctcaaatcgacgtcggctacgttccagcaattgtcacccagccccggaggtcggaataggacgtgcactggctgacgaataacaatctaaacttggcacgttttaatcacaaatcaggacaaattaatttgcacaatgcgtgttctgatagatattcttatctgtgtttgtcggtttattgttgcggtgtttattttgaatagcgcgtccaaacgtggggtgcatggcattgccgagtaacgattcgagttgtagagaggtcccaatcaaataatcggttcaagaatttactatgaattcttgaaccgattatttgctgtgaatgatttagttaactttgaatgggggattacttggcatcatatgcggcttggaaaatcttgatgatgtcttctttagtacctttgcgtgggttagagaaggcgttaccgtctttaagcgcattagtcgccatgtgttcgaagtcctcgatcttggcgccaatttccttgatggaatgcggaatgccaacgtcttcgctgagttgtttcatcgctttgatagctaattcggcagcatcacgagtcgataagccatcagtgttttcgcccataattttggcgagctcggcgaaacgttcggggcacgcgattagattatattcttcaacgtagggtaagagcagcgcgcagcagacaccgtggggcgcgtcatattggccgccgagctggtgggccatggcgtgcacgtaacctagattggcgttgttaaaggccatgccggctaacatttcagcttcgaccatgtgtgtccgggcttctaggttatgcccattggcgacggcttcgcgtaatgatgtttcgattaatttgatggcctggatgcactgtgaatcggtaatcggattgtgatcgacagaaacaaagggttcgatagcctggacaaaagcatccatgccagttgcggccgtgagtcccttaggaacatctagcatgagagtgggatcgttaaaggacacgagtggcatgttacgccatgaagcaacgacgaacttataatgcgtttcttcattcgtaatgacacagtgacgggtcaattcagaaccagtcccagcggtagtgttgaccgcaatcagtggtggtagggcattcttgagtgtttcgatccccgctaacttagtgatgtcgtcaccgttagtcatgatgatgccggcaccttttccggtatcgtgggcagaaccgccgccaatggtaatcagggagtccgcttgattggcttgatataaggctttaacagcttgaatattatgaattttagggttgggttcaacttgattataaattacgtagtcaatcccggcagcatccagtgaccgccgcacctgagcaacggcgccgtctggcagactttcaagaaatttgtcggtgacgatgactggcttgtgcataccaagagttttggcacgctcgccgattttactaatgacaccaggaccgaaaaagttaacgctaggcattaagaaatcaaaattacgttcagtcatattaataacctctttttatattgtaatcgctatcattactaatttacgaatcaaattatagtcgtaataattacaatttgcaatactttttggctaattaattatttttttcacaatatcgtttagaaaaggtgcggcaatcacggcatacctgttgtaaccaagtgttaaatgacggtgaactatagtcctcatgctattttatattactgcctacaaaaagacgactaattacaaagattcacaatcttagtaattagtcgtctttttagtgtgatccaatagaaaaattgggttagtaccagtgatgatgttgccagaaccgtttggccttgacccaggagccgtagcgcgaggcgacgtaggtattagcacgtttttcctgattgacgggtgacaagttgccgtgtaagtatgagcgcaacaattgatagcgaccgtagcagcggccattacgagccgtataactgtatccagattcacgataggcgatccaatttttggcagcgcggttggctttcgaaagcttggcgttgatcttggcaatttgctgggcttggctaagcttcttggaggcctgggcggtgattgtggtttgtggtccaagactagtagtcacgttaacgacgaccgcgaagacacaactagccaaaactaatagcaacatggttttaaagttaaattttttcatgatatgtataaccccgttttatattttccctaagctgataagtgtagaatacgccaattatgtgtcagctatgttaaagaaaagttactatgttattaaatgaacgtttccgttatgaaatagttgttgtcaataactgttgcagcaattgtttagatgaataattgcgctgactatcacatgaaaaaatcataatattgttaggaaaactaaagcgctttattgccttcgttcggtaatcttaaattggaatagctttacaaaagtattaaaggagtaagtgagggagtgcaataatggcaacaaaagataatgaaaagattacattgatggcgctagtcatgatgatctttacgaccgttttcggatttgccaatagtacggtggcctattatttaatgggttacagctcgattctattttacctagtcgcagccgtactgttcttcatcccgttcgcgctaatgatggcggagttcggggcagcggttaagtctgatagtagcgggatgtacaagtggctggaagtgagtgtgaatgcgaaatttgcgttcgtgggcacgttcatgtggtttgcgtcgtacattatttggttagtctcaacgtcagctaaagtctggattccgtttacgaccatcttctttgggagcgatcaaacgcagcgctttgcgatgtttggtctgaatgcgacgcagatgattgggattttgtcctgtctatggatggtgctagtgacgttcgtttccatcaaagggatgaaaggcattgtgcgggtcacgagtttaggcggcctggcggtgaccagtttgacggcaatcctgttagtggtttcgggggtcgttttagccttgaatcacggacaattcgcacaaccgttacaacatgtgatgacgtcaccaaatccaagttatcagcatccagtcgggttactcgggtttgccgttttcgccatttttgcttacggtgggctagaagttctcggtgggatggttgataagaccaagaaccccgaaaagaccttcccacgcggaattattatttctgccatcgtcattaccttaggctatggcctgggaatcttctgctgggggattagtacgaactggcaagccgttttgtcgaatccaacgactaacctcggtaatattagttatgtcatgatgcaaaacttgggctatgttttagggcaagcgtttggtttgagtacagcggccgctaagacaatgggactgtggtttgcacggtacaccggcttagggatgttcctcgcttacagtggggccttcttcaccttaacttattcaccattgaagacgcttatcttgggaacacctaaggaactgtggccgaagaaatttacgaagctcaacaaagctggtatgccaagttatgccatgatggttcaatgtgccatcgtgattgtgatcatcttggtggcgtcctttgcaacggcagacgcgtcagccttttacaatgtgttgaccttgatggcgaacgtttcgatgacgttaccatacctcttcttgctatacgcgtttccgaagtttaaggaaaaccagaacattgttaagccttttgaagtgtacaagtcattgacttggacgaaaattattagttgggtcgtgttcattgtcgtcttaggtgcgaatgttttcacgttgatccagccaatcttggaaactgggcagattcaaaatacgatttggatgttagttggaccaattgtcttcggtgtggccgggattatttggtatcaagttcgagaacggcatgtcaattaaataaccaatttcaaaataccattcgattgctgactgataaaacagcattgaatggtattttttaagtgccttaatatgggaaatttagtacactcattagcaaaagctatctaggggggaatggtcatgacattgggaactgcgttaaagcaggcacgcaaagcccagcaactcaatcaaaagcaagctgcccggggaatttgtgcacaatcgatgctgtcagcaattgaaaatgatcgctacgtgccgaatgcccggctattactggcgctgtgtcagcgattaggggtcgcggttagtacgttgagcctagccgacgattttgagatcagtgccgagcaagcgtttaatgaccgcgttcggcagatgtgcaatgcccatcagtatcagcaattgaaggattggctattacagccaaccactttggaacatgttcaaacggatgagcagactcaggcttactattattatctgggtgtcgcctgttggcaggttgatcgcacatcggatgctgcacaacaaaatttacggctggcaattggtatggctgctcccagctcgccgccgacaacgttgacacgcttggccttgatttcgttagccgtcgttaaggcgcaccaccatcctcaagccccagtcgcggccttagtcacccgggcactcgctgacattgatgcgagtgcatatgaagaaaatgccaacattgttttttacctcgctgggttggtggcctatgaacaacatgattcccagttggcggtggcccgtttgacgcaggggttggcctttgcgactacacacgattcacactacatgctagccaatatttatcagttgatggcgcaactcgcaatggcggcgggggagactgccacggcgcgggttgccagtcaacggtcacaagttttcaaagacctgtttaaagaacaaattaacgaccgcctgtaaattatcagtattctgattttatgttggcgtccccaccgtgtattttataagcaccaactaaatacatgtgcacttgatctaatggcccgttattgatttggagtggttggccgtaataacgatgaccgggttaggatgaacattgggggttataaaatgacaacagcattatttaccaatcaagtattaacacaggcaactccagcaacggtgcgagcattgctagcagatccgctgaacttaccagcatgggcgactgccattaccacggtcaagccaaccgcgacggggtacgtgttacagcggtccgattcggcttttgatcagccggaacagttgcaggttacagtcggcgctgaccaggtcgtttatcacggtgagggtggccaattgggatatgaaattgtgttcaccatgacgccattggccgagcgaactgcggtccaggaagaagtctcccttacgactacaccgccgagctggctgccgttgccactagtgaagcccgtcatgcaacgagactttcagcggaagttgggtcaattggcaacattagcggaggaacagccgaatgacgattaatgatgggatgacgttaataaaagtgttagtgacgtggtggtctgtcagttggttattacgggccactttgatcggcgttgttggaataattgcctatcgttttttgaagcagcgtcaatttaagtgagttaagacgatgacagcttttatgcctaatatctaatcgtaactattattatttagtgtgcgtttaactatcatccgaaaactaattccggtattctatgggtattcttttgaaggaggaaatctcatgaatcaaccagaattacgtgacccacgctatttatataagacagatggctttgataagcaggatcaggagacacccgcactacaagctaagatgcgtcctgaacctgattgtggtgagaagagttaccaaggacatgataagttgttgaatcgacgcgttttgatcacgggtggtgattcgggaattggccgggctaccgcgattgcttttgcgcgggaaggtgctgatgttgcgattcagtacttgccgggagaggagccggatgctgaggcggttgccgaactagtgcgcgctgcgggccgtcaagcgttattattaccttgtgatttcaaggatgttgacgttgtgaccgacctcgtggaccggacaatcgctgaatttggtggtatcgacacccttgtcctaaatgcgggacaacagatttcacaaccttcactggctaagctgccgatcgaacaggtgcgtgcgaccttcgaagtgaatatcgtcgcgatgtttgcgttagctcaggcggccttgccaaagatgcccgctggcagtagcatcgtcaccacgacttcgattcaagcctatgcgccgagtggtcatctattagattatgctgcgactaaggcggccatcaagaactttacgattaatttagcagccgaagcggccgaaaaggggattcgggtcaatggcgttgctcccgggccaatctggacgcccctacaattagatcaaggccagccaatcgaggcgctgccgaagtttggccaagataccttgcttaaacgagcgggacaacccgcagaactagcaccagtgtacgtctttttagcttctaacgacgcgagctatgtgaccgcgcaaatttatggcgtgactggtggcggcgtgattaattaggtgttcactgcaagttaattcctggttggcttgaataaatcataagtggctaccttggatggatgcattcaaggtagccactttagtgtgtttaatgatctgatgaggcgttcattaagtagtccagcgctgccgttcccaccgctttggctgcaattagtaaacagtcttcattcatcataaaatcagggctgtggtgcgggtgggtctcacccggagctgtttgacagccggcatagataaaggtgctgggtttggcttgtgcaaaataggcgaagtcctccgaggggtcttgggggccgcagtcgaaaattttagtgatttctgggatttgagcgacttgaatactggtgatgacgcgctgtgtcagggttgcatcattcatgagtaccggataattatcatcgtaatcaagtgcaacttggacaccgaaagtcgccccgacgccgttcgcaattttagtaatctggtcacggatggtctggcgcgtggtttcgtccataatccgtacatcgcccttgagggtgacttgcgctttgatcgcattgaaggaaccgacgccgtcgaatgagccgatggtgacactgccggtatcaaatgggtcaatccggcgggaaacaacggtttgtaaggcggtcacaaagtaacttccagcaacgattgcatcgtttgagaggtggggcatcgaggcgtgcccacccttacccgtgaaggtgaccgtaaagttagcccgcccggtctgcgtcgcatttaagtgataggcgatcgagcccgtcggcatggtactcatcacatgcagcccaatgacgttatcgatgccgtctaggacgccagcagccaacatccccttagcaccacccggtgatacttcttcagcgggttggtggataatgcggacgcgaccacgtagctgatttttcagtccgagtaaggtcttcgccagtaccatgagataagcagtatgaccatcgtgaccacaggcgtgcatgacattggcgttttgcgatttaaatgataagtggttgtcttcttgaatcgcgaggccgtcaaaatcagcgcgtaatgctaactgaggtccagggtgaccgctatcgatgtcgacgacgaagccgtacccatcaccataagcagtggttgagacgcccagttcacgatagaacgctttgatgtaagctgcggtttgttcttcatgaaatgaaatctcggggtgggcgtgtaagtggcgacgaatcttgatcatttccggttccgccgccgtgagttgttgcatgagttgtgcttgaagggtcattagaatcttcctttctgatgctagaagcgagtatattataaatatagctgagagatgatagtactgcactaatctttagcttagcatgaaatggcggttaataggtatatggaattttcggacgcttttttaagtagtggataataactaaaaggaatattctgcattgctcatgtcctagtaagatattagatagccgctccaagaatcgtgtctgcaattcttggagcggctattttttagtcgattcaaacatatagtgtttcttaataacaacgttgaaggcgcttttgtgaaagcttagaagttcgtcacctgtttgatattaacctttaaaggtggtaattgaactgcctgactggtttttttattcgtaactctctgcgtgacagttaagccacgggtgctatttttgatttttgcatttggaataaatacttttgtagtcgcacttgcgttcttgatggttttaattacttgaccgttttgtgcaatattgatggttgcatctcgagaaccgataagcgtgtaatagatacctttggttgttcgctcggcactagtgactttaacctttggggttgcgtattgttgggacggaattgtggctagcacctgttgccctttcattaatttgaaatctccgtagcccttaaactgctgtgcaaacttgaattgtcctgatttgacgttgacggttcgaacttttttgccttgataagttagcgtgaggtgttcgattccaatcgcgcgaccctttagtatcaaggagtgtgattgtgaactgtaattagttgtgatatttgtaatcttaggttgtacatgaagatattcggttacagtgatgatttctccgggattatttggaacactatcaaaagtggtagtcgtggcataacgagccttcataccattaatatcgcaggcttgaatagtatagtaccggtttgctggattcattacagatacactatcagtattattgtgcccaattcccagagcatgacctaattcatgctctgcaacattggtacgttctgctttggtataattatatttttcaaataccgctcggttgatgcgaactttgcttgaagtgatttcgccagtagatttattataggaaactgaattgtagccggccagagtcatgtcagaacttccatcatacgaagaaacggtggtttttgctgtagctgctttcgtccacgtaaaaccagcctttttccaagaagcagttgcgttgttccatacatctttatagtagtcggaggatgataaatcttgatagtttgccgcttgtttatcatatcgataacctaacatcggagtggtagcttttgttgatgcgttggcacttagaagtccaaaactagttgtcaaggaaatcgtcgcaagtgttgaaaagattctttttggaaagcgcattgtaagttcccccttttaacgatatttcttatagatgaaatgaattgaacggcgggcaaatatttgcaatattaaacgacaggtagtatcaattttttctcgagatgaaaattgatgtttataaatacagaaggcataatgcgatttgtatttatttagtacaagtattatatcatcttggatgttccgtgaaaaaaatactgtatagtaaataacttatactaatttttaagcgctttatataaatcaatttgtatctttacataatttatcagagcggaggaaagatattgctcccacacatactgaattattatcatcgtaatctgtttttgcaaaagatatgatatattgattgtcctgactgttaatttcaggtaccctaaacagggagaccacaattatgaggaggaacgattgatgaagattttgatgccatattttaagcggtatcgactagacgtctggattgcgatgttgtcggtcatcgtcttagtgtttgcgacgttatggcaaccgcgattattgcaagtcattatggaagctattatcaagaatgatcaggctacggtattccgtgaaggactgatgttgcttggcttggccgtactggggatcattggtgggatcgtgaatacgatatacgcagcccgggtggcccttggtgtggcgaccgacttgcgagctgacctatacgctaaggtccagtcattagcctacgctgacgtggaaaaattttcaccgtccaacttagtggtacgaatgacgaacgatattaatcaagtccaacagattgtgatggctggctttcagcagattacccggattccattactattcatcggggcactgattctcgctgtgatgacgatgcctgagcagtggtgggtcattgttgtcatgatggcggtcatcttaggggtcgcactgattgcggttcggcgaatgactaaatactttgcacaaacgcaacaagatattgaaaacgtcaatacggttgcccgcgaaaacttaatggggattcgggttgttaaatcgtttgttcaagaaccaaacgagatcaaaaagttttcggccgcatccgatgaattaaccgctgtgaccgctaaaattgggtactggttcgctattctaatgccagcgttctttttgacggccaacgtggcggtcggggtcgccgtttacttggtcggtcaaacgattacgacgcacccggcctatttagcagctattacgagttttatttcttatttaatgcagattttatttgccgtgatcaacgggggatttctcatgacttttgcgtcgcgggccgtcatctcacttggtcgaatcggcgaagtgatgactaccgaaccaagtatgacctacgttgatggcgacgcggcgcccgtagctggtgatattcactttgaccacgtaaccttcacttatccgggagatgcgcaaccaacgctaaaagatgtgacctttacggtaaaagcagggtccatgctgggaatcgttggggccactggatctggtaagacgacgttggcccagctgattgcgcgcttgtatgatccggatagtgggacggtctccatcggtggaattgatgtgcgggccttaccagaaaaagcccttcgatccacggtggcctatgtcttacaacggtccacgttattttctggcacgattgcgggtaacttacggcaagttaagccggacgcccagcctagtcacatgcaatgggcggctaatattgcgcagtctgcggaattcattgaacggttgccacagacgtacgatgcccccgtggaagaacggtcacagaacttttcgggtggtcagaagcagcgactagcgattacgcgtggcgtgattgccaatccagaaatcttgattttagatgatgcgacttcggcactcgatgcgcgttcagaaaaacttgttcaggaagctttggatcgcgagttgaagtcaacgacgaccgtggtcattgccgaaaaaattgcttcaattattcgtgcggatcaaatcttagtgttagataatggtcgcatttcgggccaggggactcaccacgaattgcttcaagatagtgcgatttatcgcgctatttaccaaacgcaaaaagcacgggaggagggcttacatgagtgatttacgcaatgctggtaaatattactggcactatttaaaacgctactggttaggcttcttactaagtgtgattctgattgccttttcgacttggtgcattgtggtcgcaccgacttatctgggacgagccgtggaggagctgacgcagtacttgcagcagtggacgaatcaagcgactcgggcacaagcaagcttgcaaccgttcaaccggaccctgatcatctacgtcttgttgtatgtcggtgatgctagcacgatttttattgcgagcttgatcttagcacgcgtgacggccttttcgaccgggacaatgcgggtaggcctatttcggaagatgcaacggatgaaggttcaatactttgatacgcatagtgacggggatattctggctcggttcacctctgacctagataatatttttaatgccatgaatcaagccttgctagaaattttattagccgtggctcagtttgttggcctgctaattgtgatgtttaatcaaaatactacgatggcgtgggtgacgatggcttctacgccggttgcattaattatcgcggcgtttgtcatgcacaaggctggcgtcgcggtgaaccaacaacaggatgatatcggtcaactgaatggttatatcaatgaacaaattaccggtcaaaaagtcttgattaccaacggcttacagcaggactccttgaaaggctttcatcagtataatggtaaggttcgccagtcagcgttgacgggtcaaatctggtcaggtattttgaatccactgatgcaagggatgtcactgcttaacacggcaattgtcatcttctttggctcatggttagcgctgaatgggagtatgtcgactggagcagctttggcgctggtcgtggtgttcgttaactacgcccaacagtactaccagccaattatgtcattgactagtttatatagtatgattcagttagcgattactggtgcacggcgggtcgatgaagtccgtaatcaaccggatgaagtgagccccgctaacggtcaagcgctcgacgggattcatgatgaattactgattgataatgtgcgctttagttacttaccaggtaaagaaatcttgcatggcgtgtcgatccatgtgcaccgcggtgagatggtggcactcgttggcccaactggttcggggaaaacgacggtcatgaatttgttgaatcgcttctatgatgttgatagtggtgcgattacgtttgatggggtgaatattcaagactttgatctccaggtgctacggcaaaatgtcgggattgtcttacaggaaccccagttgtttacgggcacgattgcggataatattcgttacggggacccaacggctagtatggatcgggtcatcgatgcggcgaagcaggctaatattcatgactttgtgatgagcctgccagatggctatcagacgcgcgtttccgacgaacagagtattttttctgctggtcaaaagcagttgatgtcaattgcccggacgattttaacaaatcccaagttgctgattttggatgaagcgacttcgaacgttgatacggtgacggaagccaatattcaagccgcaatggacaacgtcatccaagggcgaaccagctttgtcattgctcaccgcttgaaaacaatcctgaatgccgataaaatcgttgtattgaaggatggtcaaattattgaacaggggaaccaccatgatttattagcggcaaacggcttctatgcggaactgtatcgtaatcagatggtctttgagtaatgaaagtataaggagtcggacatggcagggcaagagcaacaagtgcgggtttcaatcccagtctcagcattaaaacgagccgggattgatcgcgatgatcagttacagttaaaggtgcgcaatgacgcactagtcttagagaagattaagccacgtcaaccacagtggcagcaatacttgataatctggccgctgttggttgcaatcctatcggggttagccagttacgggtactggtggtttcaaaaagtgcgaccagttccactgacaggtgcgcaatcaatcgggagtttgacgattgtggccggtgtggttaccggcgcagtgctatttgtcggctttttcttaaaaacgcgtaatgatccagaaaatcgattttcgcgccatatttattggcggaactttccagttattacgattgcgtttattatgatcttagcctttgcgctggtcggggctttctgggtattagaattattatttccagatgtcatcttcgatcgctttacatctatgttgctactggtcttgtttacgtattttgcggatgcgttcatgattagcgctgcgttgacgataaatgcgcggtcgttatcaacgattttaacggtggtgattgtcagtggctgtgttatctcaatggccgccaatggtcaacggcgatggtggcagcataatttaagctttttagggacgcatgccgctgaaaatgcctggcaattcaacttgacactgattttttcggcgttattgatggtcgttctgattgactatctatttgtttcacttagtcgaatttatccgcgtacttggcgaacgtcaaccttgcggatattgttgacgttgaccgctgtcgatttcggggcggtcgggctatttcctaacaacctgacgtttcactggttacatgacttagttgctggtggcttggtcacgttgttagtcttgttgattgtgggggtgcggtggctattaccagccgtgacgaaagattttctgtggctctcatacggcgttggcgtggtgctattactactcaactttggttttcgctggtttgggtatccatcgctgacggcatttgagattcaagcctttgcgatttcgtttggctggttgctgatgctattttcacgtctacaagcgttagtcaatgaagacccggaattgttgacgattaagttggagcaggaaagtacggcagggcaataagtgccacgttgttttgaaacggtggctgagtatattaataataattgaatcagataaaactggctgctagacacggtttaaagtgtctagcagccagttttattaattatggatgattgttgaagcgggttaggtgtaattgattacttttaaatgttcacatttagcgatgctgagccatcaatttgacttgtggcaacatgttatcagtgcccggttgagcaataccaaggctggtattttcgtatgctgttggctcagcaataatcttcatgattaaatcagcaatactagcgcgtgaaatcatggttcctttgaagcgttcacctttgtaagtcagttcatagtcaattttggtatcgtcggtcatataggccgcacgaataattgtagcaggaatatccgatgattcaattattctggccgcatgtcgcgtatcgtttttagcagcgtgaccgactacctgttcgacccaagcgccaaatggattaggggtttcgtggtagagtccggatcctgtgacccaaataagatggggcacatgattgcgattcattgacgtgataatggtctgtgccaataatgccatattcccggctagatttgcatagacgatatcctgattaggcataacagtgtctagtagctgtgaatcactgacatcaccttgaataaccgtttctcgttctggtgaagtgactagtaggcgccctgcatttcttaagactagtgtcaactggacgtcagtttcggctaagagtcgttgttccacaatccgcgcaattcgaccgttagcccctaaaattaaaaccttggtcattctgatcctcctcgtattagtgaatagtgtaaccaccgtcaacagcgacggcttgaccaaccatgtaactggcagcatcactgcaaagaaagagtacgacttgagcgacttcttctggtttagctaaacgccccatgggaatttcgcggactaggtcgtccatctcctgtcgttcagtatcatccattcgggcaaccattggtgtatcaatgattcctggacacacggcgttgatccgaacattccggtcagcgtattctaaggcgctactctttgtcaggcctaagacgccgtgctttgaagcgtggtaggcagttcgatcagcaataccaacgagaccacccattgaagaacagtttacgattgcggctggtgttccctaagcacgcatctgtcgtaattcgtacttcatactgagaaacatgccttttaagttagtatccatgacatgatcatattcttcaaccgatagatcggcggtatcggtgactggactttgaatcccagcatcgttataagcatagtcgaggtgcccaaactgagcaactgcgaatttcaccattccggcgacgtctttgggatcagcgacgttacacttgaatgaaacggctgagtagccatgatcgactagctgttgggcttcgtctttaggttcatgatggccagctaaaatgacgtgagcacctgctttggcgaatagagtggcagcactcaggccgattcccgtgcgtgcacctgtaacaataacgactttatctgtaaaattgaacatgactttctctccttaattaatcttcttcaaactgcattttaatatttcttgatgaacggaattgtttcaaatcgccagcattaatgtgaccaattttttgaaggttactaatcacttcgccagtttgctcataaaaaatcactaagctgtgtcgcggtgtccagtaggcgatatcaccaactgcatagccagtagtgtgtgcctcgttagcagggagtgcctgctgaaaacgatacgtcaattcacggttataaaggttgagcatcggcagtgttagtggtagttgtgaaagtaacgctgcggtggtggcattttcttccaaatttgctgtgaagtggcggtcgttggctgttatcttcattttcttcattatctagtacctcctaagccaatgcgttatattcgtcattactaacgggtgatagccattctggtgtgcctgcagtgatggcaatgtgactgaaccaactatctttagtagcaccgtgccagtgtttgataccgtcatgggtgatcaccacatcaccaggatgtaatcgctgtgccggttgcccggcttcttggtaccagccttcgccaccagtgactaataagatttgatagccattgtgatggatatgccagttgttacgggctccgggttcaaagctgacgttgctgacagttacgttgacttgctcgtctttcactagagcgttgtggtaacttttaccggtaaagtattgttgaaaagcaacgtttaaatctcccattgcaaaaatgccgtgttggacgctattttcattattgttcattgttaaaaacacctttcatttaaaattaattgtgggctaaaatttgaagctcggcttttgttagtacgtttcccactagttgttcacggaagtcgttgtaatagaagcggttattcaacggcaagttgtgcttgagtgcaaatacggatagtgtatatcgatgaggctgatcaggtggattcggtccggcatagtgatcggcgaaatacgaatcgtttaactgataaaagcgtgacatccatgagttttgaccttgggggccctcaaaattacgactgaaatcggctgggatttctgccatgacaggaatattggtcgcgagccagtgaatgaacggaaaacccgttcgtgggacggcgtcgtaatcaatgagcgaaatagcaaacgcagtcgttattgcaggaattgatttgatttcaattggaaacgatagaatcggttggcctgagtgtttgacgttcgcgttactggtatagattcgtggtaaaaagccatcgtctaaatcaactttaatttgcattaaaccggcctcctagtaaaaaccaggtttgttccaagcagtattgggttcagcgacgccaatgctacttcgctgatataattggggattgtgaataatttcagtaatcaggtcagcaacggcttggcgtgtcacctgcgtatctttgaatggcatcccctgaggaatgaccttgtagtccgtatgctggtcattattatatagccaggccattcttaaaaatgtatagtttagtccactattatcaatcacggcagcagctcgcttgatttcagtataatcacccatcatttgggcattccaaataccaaatttaccagcgacttcatcgtaaatgcctaaaccacctgcgacaattaggcgctcgacaccattttgcttcatcgcatcgacaacattttgattggcggtggtgaaatgccccgttgccaagtaaacgatatcttgacccgcgattgccgccgtaagatcagcggaattattccaattgccgttcgtgagagtaacctgcgattgggcggcgtactgatgaagccgtcgagtagcttgacgagcaaatagtgtgagttcaacatcgtttttggcaagtaggcgtggaattaaatattttgaaatgttactggtagcacctaataaaataacttttttcattgtaagaacctctcttttaaaaaataagacttaataaagttgctacgcccaaactaagtacgaggaagatgaggcaaaattgccaattccaacgtaccgagatagttgctgagctgacatgtaacagggtcgcgacaatcatgacgatacctgcaaacggtgataacatgtatgcaacgacgcttccgatattcagactcaatgcgattaatagtggtgaaagggcaatgtgcatggtcataataatcttgccaattagtgctactgatgctagtgggtgaatgccaattagggaaaccaatacgacaataatgggaattaaaacgatcaataaccagccaaggtgagcaaagcttggtgctaacgcgtgggttagttcgctactgatagtggaatgttgaaaaccgtacgtgaacgtaccgattccaacaaagaacggcgcaagcgctgcaccgcttgcaattccgtgttgccaataatcaaggctagctttttttagtgcaaatttgaaggctgtttggcccgtagtcggcttgagccctaatgccgtgacccaaatcaggacaattagtaaaccggaaagtgtaacagcgttcattgaacttacgactttgctttccattaaaacaaagctgagtattagtagggcaataacggccgccactaaactgacaagtgatgcgtgttcggtaaaacgagtctgctgcttagtattggttgtcacgggctgaatccgcatatacggttggttatattccatcaaatacgctagcaataatcctaacaggcctaaaatcaggcatggtatgaataattgggtccacccgactttagtaacggtactgattagaaagattgttgctgctccaggtgcccataatgtgccgagcgtaaatccacgggttacggctgttgccgaaaaacgggtggcgtctttgacttggcgcttgatactgtcgcctagaattgataggacaatggcaacggtccccatggagagaatacttgatagtaggtgcgtgacaatcatgacaaaggtgaaggtttgtttggggccacgaatgtgcttttgcatgaatgcttcgacagtagcttggtagttgccaatggtgacagggattaagaaaagttgcataacaactagtaacaccacgatatcgaccattgaagtgattgccatggctagaccgttgattgataaacccgtagtacttagcagtcccaacccagcaatgaaaaagatcaatgtcgcgacttgaaaagagcggcttaagctttgaattccgagaattgagaccccgattgcaagcacggcatttaatagcgtcaagttgacggggacaattaagcttagtaactgaatgattattaggcttaaaactagactgtgataaatcgtcgctttattgatagaccgttccattcatgaatcgcttctttctaatattgatcgtggattgtcgtcatcgattagccttgctttgtcgggtaaatggtaaattcattgacgttgacgtcatctggttgtgcaactgcgaagtcaacgacacgggccactgcatctggggtgataccgacggatgcatataatttattcataccttgcttagcattggtatcggtaatggtgtgcaataattcagtgttgatagctgccggatagaggctggtggtccgaatattggtgtgttcttgagcactttccatgcggattacttccattaaattgcgtactgcaaatttagttgcaccatagatgccggaaccagcgaaactcttaagcccagctactgaagatgtcgtaatgatttgaccatacttttgattggtgaaatcaggcattactgcggcgacaccgttcaaaacaccttttaagttcacatcgatcatggcattccattcatcagtttttagtgcactgattggtgaagtcggcatgataccggcattattgaaaatgacatcaataccgccaaattctcgcttggctaaagcgactaacgctgttaagtcttcagtcttagtcacatccgttacgcggtaagtggcttgcccgccttgttgctggattttattggctaatttctgtaggcgttgttcacgccgtgcacctaaaacaactttggcaccatggctggctaacaatttggcactggcttcgccaatacccgatgaggctcctgtaataacgataactttgttttttactgacatatttgtttcctcctgattaatttttttgtttatttaaaatgtgatggtaatttaagacgtccattgtggaaaaatcatgaccggaaagctggattttttcaccatagggtgatagtgaaatttgattgtgcccaataattttccaagtaccggaataaatattagtgacgtgatgttggttctccttccacttgtgatccgcagtgaaagtgatttgttggtgaatatctttgttgtggtgattgatccaaacaccaacgacatccgcttcggtcagatgcgagttgtccgaataggtaacgcttgtctgttgcttggtggcttggttagacttgtcggtggttggtgagtgttgctgaactgcatagacgatgacgacaagtgcagcgacggtaacaataatttgaaaaatagtttgcataaactttttgttcaattaatcatctcgtttctgatgtgctgtgcctcaactacaatgactagtatagccagcaacgtgccacctgagaagaatccgttagttagcttggcattaacttttagtttatactagaaggttaggaggtgaccgttgtggattttaatcaattacagacgtttttacgagttagtgagtatggtagttttacgaaggcgggggaacagagttttatatcgggtactgcggtgatgaaacagatcaaccggctggaagcggagcttaacctaaaactattcgtccgaactgcgaccggggtccaactcacaccacagggtaagaagttccaaccgtatgtgcaacagttgctcgatttactaaacacggccattgaagagacgcgacgggtccgttcagacgataagcaactgattttgttgggaacttccttactacatcctgctgatgccttcatgtcattatggaaagaactggcaccaaagatgcctaaatttcagattagattagttcaattgcaggaagacttgaattcgagaaatcgtgagtatgcgatgcttggtcggagtagtgatttaatcgttgggacgttcgatagcacaactttgaagcagtcctttagtgcgatacagttgggagcgtatcactttggaattgctgtccgtagtgataatccattagcccagttggatgaaatcacgtacagtgaccttgcgcatcgtaaagttctgatggtgtcaacgggaattagtgagaaaaatgatctggttcggagtgaaatgttggcggcagaacctagtattcagccaattgatactagcgggcgttatgacatcaatacgtttaatgagaccgttgaggagaatatcgcaatgatttcgcttacgccgtggaaaagaattcatccgaatttagttacagtaccgctgaaaacgtccgtaacagtaccgtatggtctattaagcaccaagttcccgggtaagaagacggcagattttttacatgaatttacgaagttggtcccgactgaaacgcagagccactcataaaatgacattaaaaaggcaactgttcgtggtcacggtacgtgctggtgaacgggtgtcttttcggggcttaagtctaatttgaagtctgcaattatttgttaacggatactggcattcaaccggattttaatttataattagttaaaagaacatatgttcttttaacgacaaattattgagtcaggtttcatccaaaagtgagtgtcatgggggcgagcgacatgcggctatcgttaaaattcgatcagcagcatgagatttattttggattaccagcaaaatgttaaggtgaacaacgactgcgattgtgtcgattaattggaagggagtcattatattgatggaacagcgaacatacatggcaattgatttaaaatcattctatgcctcagtcgaatgcgttgctcatcaactcgacccattgaatgccaatttggttgtcgctgatatgagtcgcactgataagactatttgtttggcggtttcgccagcactaaagcaatttggtgttccagggcggccccggttatttcaagttgaacaacgggtcgcaactttaaatcgcgcccgtggtcgccagacttcctatcaggcggttcggcggcatcgctcaatttatcgtgatcagctcctcaaacatgctaatttgggtatcgattatcgggtcgttcccccacgaatgagttattacatgcagaagagtgctgcgatttatgatatctatttgcgcttcattaagccggaacacattcacgtgtactcgattgatgaagtcttcatggacgtcacagactacttaagtacttttcaggtttcaccgcacgcactggcaaagacgatgattcacgagattcaggccgagactgggattacggcgacggctgggattggtgctaatctttacttagctaaggtggcgatggatattgttgccaagaagattcccgctgacgctgacggtgttcggattgcacagatggatgagcagcaatatcggcaatacttatgggcgcacgagccgttgactgatttttggcgagtcggtcatggctatgctaagcggttggcagccctggggctcaatacgatgggtgacattgcgcgctgttcactaggaaccttgtcggattctcataatgaagaacaattatatcgtgagtttggtaaaaacgcggaactgttaattgatcatgcgtggggcgatgagtcggcaacaattgctgacatcaaaaattaccatgctagcgaacatggtatatatgccagtcaagtgttgatgcgaccgtatacttatactgaagggcaggccgtgttacgcggcatggtgaataatttgacactcgaactggttgctcgccacgtggtgacagatcagttgggaattcgtattgattacgatgctaatgcttcatcagttggcacgcattatcagggtgcggtcaccgaagactactatggacgacaagtaccaaagcccgctcataccaaggtgacattagcgcaggcgagtgcttcacaacacgagctaggggctgcgtatcaacagctttatcaacaagtcgttaatcgtcaattgatggttcgacgtgtgaccgttatggcgaaccatttggtcgacgaacagcaggttaggtgccaacctcggtatcaacaaactaacttatttgaaaatccagaagtggcccaagcgcaagaacgagacgcacaacgcaaacgtgaacgcgatgggcaattgcaacgcgccattttgaaattacaacgtcgttccgggaataagaatgtcgtcattcgcttggcagatctaaaaccgagttcaactacgattgaacgtaatgagcagattgggggacatcgtgcctaatgacaaaggaagccagtactactgcgttatttaatgatacgagtcgctatgcggatattttagagtgctcgcgacctacttcaaggcatttaccaatgccccaagcagaccgtgctgcccaatttgcgccgttcgcggcgttgactggttatcatgacttgattgaaaaacacgctgcaatctatgcccataaacactatccaaatgctcaggataaaagagctgtggcgacccagttgaaacagattgcagcgttaccaaaactaccattgctcaacgtcgattattttaacgataccgttggctattatcagacggcaaccagccagttggtgaagctcgattggcatcaagcccggatttatctaacagcaccagcaagtattgcgatggccaatatccgtagcgtttctatagcgaattaatcttaattaaggacggttccaatgactaaaattagtcgttagaaccgtccttttaagattaatgattattttatttcgcggtgatttgcattcgtccgtgctttttagaatgatatagattggcgtcgacgcgctgataaaaggccgttggtgattggtcatcagctgctaattctgataggccaatcgagatcgacagttggatttgatgatcattaactggtacagcgatatgattgatggccgcaaatagttgttcagcgaccgcaagtgcttcggttaaatcatagttggggaagataacgttaaattcctcgccaccggttcgatatagtgagatttgcggattattagcatgaaagacaatcgtagctacttgggcgacgtgctgaagaattttgtcgccagccaagtgaccataagtgtcgttgacttgtttgaagtggtcgatgtcaaacatcagcatggtcaattgtgagccgtttttccgactgcttgtaacctgataattaatggctgttttgtaagctgcaaaattttcgattttggtcagagcgtcgtgattagcgaatgcgaccagattctgtttgaggtgtgcattggctgacaacatgctggcgtagatatagagcaaggaagcaaagacgagtaggtaggtccattcttgccaataagttgcccatgataagttgaacttaagcttcatgaaccaccagagaacggccccaaaaccagcacaagtgactaaataaagtgcgacttgtccctgtttcgtttggagtgggacgtgtttacgcaatcggccgagcgccgtaaagaagaggatcagtgtgacggcgtgcccccacgactcccagtaatacaaggagtgattgaagcccataaagataaagacaagcgggtacaagtagtaatagcggacacgtacattgagaaagtagccacaaaaagttagcccgatgagctggaaattcatgaaaatccaggcgtcgttctggcccacaacggcagtttgcatcccaaagacaaataacatcatgtagattaagccgtaccagtcggtaataagcgattggtcaacccgccaatgatgagtattgaagaagttgataatccaattttgtgatacccaaaaaagggtcagcacgcctaggatgaaaaaaacacttgtaataaatggagttatctcccaatgtgaccaagtcatacgcaaacacctttcaaatcgcaaaaactgcgttggttcgaattaaatgacgccggtataagtatatccctttaactgctaaatagcgactgtgattatggactttaattggctttttagccgttattatcagggaaaatcagcgggcctcgcgctagatacgccgaacggcaattaaagcagcgcaacaagcctgggttaaggcttaaaatgcccgagttggtgcggtgagcgtgggggcagcatcgttgacgaaggccggggagtcgtcgtaataatgcccagttggtcgggacgtgccgtaataaaaccggtgtttaccaaccaagcattaatcgttaccggaccgacagatttaaaaccaacttgttgtaagtgctgtgcgatgcgatcgccagtaattgttgtgcgtgggagttcatcataatactggggctggataattaattgttgatggcccaattgttgccagagatagtctttaaaagactgtgtggtccgaatttgttgaatcaggcgagcgttgtgaatcacggcttcgattttacgacggtttcgtatgatggccgaattgctgaggagattggtgatttgttctgagcgatacgctgccaccacctcaatttgccaggcgtcaaatgctgcgctgaatgctgaccgtttattgaacacgacggcccagttgagaccagcggcaaaaccgccaagactcagaaactcaaataattgttcatcgcgctgaaccgggataccccattcgtgttcaaagtaataccggtagccggcatcgtacggatagtaacgattgaatagtggatcatcatcaaaccagttggtaatcattaaacaagcctcatttccaaatcaattagtagacactaactaaatacggtaaatgggtcggaaaacacgtggataaaaaaacttttccaatcctcctgagaatggaaaagttaacttaaagcgtgttcaacgatgatctttgattacaaggttagttggcatgtggcgaacggttttcgtcgcgtggtcacgcttgatctgagctagaatggtcctcatactgactgtggcagtcagatcttttttaaaagtatgcacaccaaagctgtcataagtgacctggtcatttttgagtgtgaaccagttcggctggagttgcttggcatctgccttaatgtgtttatcagaccaaaccagatacttagtttgcccctggccagtgtaaatttcgacctgccaacccaagctgaaatcattaacttcttgccaacgctgaatctttaagtgcttgatcgcgtaataaataatgcagctgtattttaaagcaggctgtttagcaatggtcgtttcggtaatcggttgtggttgttggataacgcgtgatttgtgaaccgtagttgtggtggctcgcggggtgcggtgtagggtgctgagaccaacaatggtaccgataataagaacagtgataatcggaatcagaatttttttcataagaaactcctaacgaataaaattgtaaaacgtaaatattactatttacaagaatggaatttattgctattctttaaaacgtaatgattactatttaaaaagggagtggcaattgtgaaacgtttgtggctattactaggtggacttgttattggtgggggcttgttaacgggctgtcagtctaagtcaacgactgctgaatcgcataaggtcaacattgttgcgacgacgaatttttatggtagtgtggcaaaagctgtcggtggcaagcacgtcagcgtgacgtcaattatcaacaaaccgtccgttgatccccatgattttgagccaacaccaaccgtggctaagacggttggtcaggctgatctcgtcatcgctaatggcatcggctatgatggctggatgaacaaggtcgtgcactcgacgcaacgagccaaattgattcgggtcggcgaggacgtgatgcatcgcaaggaaggggctaacgagcatctctggtatgacagtgcaacgatgcccgccaccgcgaactatctcgctaatcagttagctaaaaagcaaccccagtatcgcacgtattttaaggccaacgcccgcaagtacatcgccacgcttaaaccgattcaacaggaacaggccaagttacgagcgaaggctaacaagttaaagaatcggcaagtgttagtcagtgagcccgtctttgattacgcattgaccagtttagggtttaaggttgctaatcaagactttgaaaatgcgattgagaagggcactgacccagcaccgcaagttatccacaagatgcagcaggcattaaagagtcggcaagtcgccttctttgtgaataacagccaagttagtgataaattagtgactaacatggtgtcattagccaagaagaatcaggtgccagtgttgaatgtgactgaaaccatgccagctaagttgacttatcaacagtggatgttggcacagtatcgccagctcaaccagttattgtccgattaagggacggacctgcaaggcgacgacgcccgattgcgcaacttggacaggggaatacaacgttagcatttcttgaaccatctgtgttaccggcgttcccggggcactgccgacttgaacggcagtgtattcgctcagtaaggattcaaaactagcgaaacgcgtgatgtcgatgagctgagtggtgagctgctggccagtcgtcagatcgatgaaatttacaatgtcaccgacttgtaaggcttggcgttttgcatcgtttaaacggatttcaattgttttgagccccgattttattaacagccattgtggatgaatcaattgcatggtggtcattgaacgtcctcctaatcagtttagtcttaattatagtggataactaacgaaataggggcctaaataatggcaatgatgtgcctgaacaccggatattagtggtaggtagctggcgcctgtctataattaggttaacaatacaagggggatggcacaattggcaaaacgaacagcgattccagttagattacaaatcgttggcacgatgagcgcgttaatcatcatgtatgcgtggggccgctcactaatcggccagccgttgcaattgggcaatcaacagtttacttggttagggttggtttacttgaccggcgcttttctattcttgttagtggccccatggctgaccaatcgcttagcgttgacgccgtttgacttcatagcgatgacggatcatctggcaatggggtggttggggtatcttatcctaattttagtcgttccgatatggtttcagccggccaattccgggcttacactcggcgtgctttccagtgtggttggtggaatttgtatggatgttccacagaatgtgacctggggtatccgggtaccctggacgtacaacttgccagtgatctggaagaaagtcaactggctgaccggactattgttattaatcgccagttacggcatggttggcatcggctgggtatggcccacactgttcccaatctatcaagtgagtgccattgtgggaattatcgtgattgcgttgggctatgcgcaccatttggcccacttgacgtaagttgtgttggtgattattaacacggcaaattgatatacgcggatcataattaggggtggcgagtggcacaagtcacgttaatcgtggttagttgaagcgttgttaacaatcgttgaacggcaaaaaaggctggaaaattccagccttttttagtgtctttttaatttaatagagggcccaggcttgcatgccttgtgcgtggtacaagttaactgcggcgtcgatttgttgttgaacggaaccaccactaatatggatgttttggaataaaccgtatgcaccgcttgcgccgttaacgacgtgtggctgccagttagattcacgattaatgatgtgattccaagttccggcgtcaacaccagtccgtgcttgcatttgaccgagcacgtaactttgtaggttatcacccgaatagctttcagttgccggggtagttgctggtgccgaagcaaccgtctcgttagtttgtgctggtgttgtttgagtcgtagttgcggcctgtgtttcagctggctgggttggtgtggtgaccggtgcctgctgaactggcgctgaaacgaacggtgccgctggtgcttgactagtaaggtcctgggcgttcacccctggaatccgtaattgttggcctggtaaaattaaatggccgtgaatgttgttggctgtttcgattgattcgatcgtcgtcttatattcttgtgaaattgcccagacacagtcacccttcttaacggtgtaagttgcgtcggcgtgtgcagaaacagttccggccaatagtaggccaaccgttgcagcggatgttgttaagattgtggttaataattttttcaagttatactctcccattttttgtaagcaatcagcgtgtcgtacaattgttgatcaacaaaaattagtatagcggcgacttattactcgcatttgtcgctaattttaagaagcgattgcgagattctgagaaaattatggggagtaaatattttactgaatagttgaagactatcgtgacgggacgtatcggtgacaatatatcggctactaatataaaaaatatgacagaaatagcaatataataattactgaaattaccaatagttgagccagttagcaaaaatagcggcaattacaatgtttaacgtgacattcccaatattaaatagttaataccggtattgttcttataagtttaaaaggatgttgattatagaaagtaatttaacgcaacaaaaaaagtcgggaaggattcccgactttgtcttaatagttttagattaaagggcccaagcagccataccttgtgcttcatatagggcaacggcagcgttaacttgttcttcaacagaaccactgctgatgtgcatgttctggaataacccgtaggcaccactagaactgttgcggacgtatggttgccagttggattcacgcgtaatgatcgtgttccaagtcgaagctgagacaccagtccgtgattgcatctgacttaaaacgtaactcttcaaattgctaccggtgtagcttgaagtcgtggagtcagttgaactcgttgaagtggtcgttgcggttgtgttgctagttgaactagaactagtcgttgaagcacttgaactcgttgtgtttgaagtcgttgacgaggtgttgttatcagaactggttgaactcgtcttaatagatagtttttgaccaggtaagatgtagtgacccttgatgttattagtcgtttcaatatgattaatagttgtgttgaatttttgtgcgatggcccaaacggaatcaccgctcttaacggtgtaagttgagtcggcgttagcattgaggacaccggcgaataataaaccagcggctgcagctgaggtagttacgattgtacttacaagttttttcaaattagacactcctataaattttgtgattatcgattaaataagttactgacaaaaatcttaactgcgatgtcattcgcaatcaacagaacccagtctaacgcctccgtgttacttgttagtgtcgcgagttttaagaacgcaatgcaaagattacaagaatacggacttttgtaatcttcgtaaccgaactgtgactttgaaaaaggttggttaaatcgtttgataggggacagtgacaagctaagttaaccaagttgaggtttgcctaaaattaacattatgacgtgaaatcacccaaaattcagccataaaaaaagccgattattttagtataatcggcttttagtgcttgaaaatggcctcaaacacggctatttaacagtttattccgtcactggaaatggatctgctaaaccgagggcttgtttttcagacttcgcttgagcaatttcctcttgcactaattcacgcgcgtgcggatcactatataggtttaatttgtaatccacttccttcagatttttcataatttgggcttgctgagcaagaatagcattgcggtgagtcgtcagcagctctcgtcgttgtgcaatcgattggggacctgccatgacataactgatatattggcgaatagcactgattgccataccggtatttttgaggcaaataatcgtatgtaatagatgaagatcaccgtctgtaaatgctcggtagccggattcattgcgactgacaaagggaagtaagccttgtttatcataaaaacgcaaggtgtacgcacttagtccgaccttatcagcgacttctttaatcgtataggtcaaaaagattcctcctaacacttgccttagagtgttgtctaaggtttatattagctatattaacaagccatgatggaaaaaacaaccaatattccgggggaattaaacatgaataaatcattagtactagtcactggcggtaatggcttcttagccagtcatatcattaaacaattattaacagcgggctatccggttcgggcaacgttacggtcgttagataaagcagctggtgtgaagcagacgctagcgggtacacctaacttagatcgattgacatttgttgctctggatctgacacaggatcagggttgggccgaagcaatgcgtgacgtgacgtatgtgatgagtgttgcggcaccagtatttgttaatcaaggtcaggcttctgatgaggtcactagtgcggccaaggtcggcacgatccgtgttctaaaggcagcgacggcggccggtgttaagcgggtcgtcatgactgccaaccttggtgccgttggcttcagtcgtttggatcatgatcatcccgtcactgaagtggactggacccgcgaagaccaaccggggctttcgttgtatgaaaagtcgaagttggttgctgaagaggctggctgggcgtattgcaaggcgcatgctgatagtccagaattcacgacggttaatgccggtgccatgcttgggccatcgcttaatgggcacgtcacgggtagttataatctagttagtcggatattaactgggcagatgatgccaaaccttaaagtcaatgtcatcgacgttcgcgatgtcgctgacttagaggttcgggcgatgacggcgcctgcagcggccaatcagcgttttctagcagtggccgccacaccaatctcgatgtgggacctcaaaacattgattcaagaacaacggccgcagttggctgcaggcctgacgaaacatttgattccagactggtttgtgcgggggttagccccatttagtgggcaattacgcgagtctagtttgatgatccgcatcaatcacgaggtcagtacccaaaaagcccagcaattgttagggtggcaagcgcgctcagctgatactgcggtattagccgctgtcgatacactggttaagaatggtttgaataaataggacgatcaaaacggtctagcagtagtatttactgccaggccgctttttgtagctactttagtggcaaccggacttagttattttaacaaaagtatatatttttaaagtaaaagtattgattttgaaatagaaataggatagtattatttcacgaggaaagcgttttccaaaataaatgacacagaggaggagtttgatggataaggagcgacagatgcccaaggattttttctggggtaattcagtgtcaagtatgcaaactgagggtgcttgggatgaagacggtaagggccgttcagtttatgatgttcgtcctgcgacagcaaccacttcggattggcatgatgccattgatgaatatcatcgttacgaggaagatcttgatttgatgaaggacttacatttgaatatgtatcgaattcagatttcatggtcacgagtagttccagatggtgatggtgagtttaatgccgctgggattgcgttttatgatcggctggttgatgcgatgctggcacgggggattacaccgatgatttgcctgtatcactttgatatgccgttagccttagctgaaaatgaaaacgggttcatgtcgcgccacaccgttgatgcgttcgtccgttttggtgaaaagatgattgcccattttgctgaccgggttaaatattggatcgtgttcaatgaacataatttatactttaccgacgaagtcttcaacatttcagggtacaccaagggtgatcaaagtgttaacgacttataccggattttccaccatactatgttagcgcacgcgcgcctagatgactttgttcatcagaactacgatgacgtgaagattggtggtatgttagcttacaccccggtttatccagaaacagctaagccaattgatattatggcggctcgtaagagtgacgaatttttgaacaacaacttgaatgacgcttacgtgcacgggcactattcaccagaagtcctgcgttacgttgaacaacagggcatcgattatgatttgcaaccaggtgatgaggcaatcatcagcaaaatgaaagcggattttttagcctttagttattatcgttcaacggttatcaacggggataaaatacccgccgatgccgtcccgaaccgttatctcaattattcatttgaagccaaccgctttttacaagctaatgaatggggctgggcgattgatccactcggtttccgcaacttgattaccaagttgtatgaccagtacgaagtacccgtgttcccgattgaaaatgggattgggttacgcgagcactgggatggccagcatatgatcgaagatgatgagcggattacttatcatgaagaacatatcaaggcgatgaaagatgccatgttgatcgacggcgctaaggtactaggttatctcggctggggcttgattgatattccaagttcacacgcagatatcgaaaaacgttacggggttgtttacgttaaccggagtaatcatgatctaaaagacttaaagcgggttcccaagaagtcatattattggctgcaagggatcctagcaaaaaatggagatgaattgtaatggaaaatagtagtaatggtgctgttagcaatttcattaacaacaaagttttaccgccaataatgaagttcgttaacactaaaccagttaaagccttacaagacgggatggtctacgccttaccatttattatcattgggtccgtattcttgatcttatctaatattccaattccagctgtggctgctgttattaaggcctctggttgggcagcgttctttaaccaggcctatacagtaacgtttggggttctctcactttgggcggccgttgggattgcctatgtgtatgtgcgtaacgaagggtatgaaccactgcccgctgggttaacttccatggccgtattcttacttttgcaaacgcttaacattgccaatccattagtagctgcgatgggtaaagccggtactgggattaccaatgctgctgggaatgtcgtgatgtcaggtagcgccgtttcacagaatatcgataaattaccaaaggtcctacaaaattttgtgcaagcacccgttactggggttgttaatattacttggctaggtggtcaggggatgatcgctgccattattgtcggtatcttagttggttgggcttactccgctatgattcgtaaaggttggaagattaccctaccagaacaagtaccagctagtgttgccaaccaatttactgctatgattcctgccggggtcatcttgattgttgcaatgttaatctttgcggccttcagtgctttcggtaatactgacatgttgcaatttatttacaaggttcttcaaacaccgcttcaaggattatccgattcactcggtggtgcgctggttattgcgttcttagtgccattcttctggttctttggggtccatggtgggttgatcatgggtgccattactagtgggttactgattccgaacacgttcgacaatgcaacgttaatgcatgcaggtaagttgaccgttgcccaaggtgcccacattgtaactaatgaattctacaataacttcattaacttaactggttctgggattacgatcggacttgttatctttacgttgtttgctgctaagtccgttcaatttaagacgattggtaaagttgaatttattccagcattattcaacattaacgaaccattcttgttcgggttaccgatcgtgatgaacccattcttggcaattccattcttcttgacaccggttatcgtggccttatccacttatctggtcatctacttcggcattgtgccaccattgaatggtttcgcggcaccgtggacgaccccagcaatcatttctggtttcctgattggtggctggaagatggctatctggcaaacaattacgttggtcatgtcaactgcaatttacttcccattcgctaagaagtacgatgctatcttaacgaaggaagaaggcgaaaaggccgctgcggaagctgctgctggtaacgctgaaattgaaaagatgtaattatagaaaggaattaaataattatggctgaaaaaattattatgttggcatgttctgcgggaatgtcaacctcactattagtgtctaagatggaagctgcggcaaagcaagatggtgttgattacaagatctttgccacctcagcggctgatattgaccatcaactgagtcaagatccgcatcccgatgtcttgttattaggaccacaagttcgctacatggcgaatgacgtgaagaagaagactgataaggctgggattccaatggatatcatcaatatgtccgactatggcatgatgaatggtgaaaatgtcttacaagcagctgaaaagttactcggcgacagataattaggatttaaccggggaagtcaatgcaatcgtgaatcaccaacgtgtgcggtggttgctttaacatgattgggacttgtccgagtgataatcaaacactaaccaaatcctagattgttttggtggtgggcatctcaggatgttataatatgttacgattcctcactggctaaatgctggtggggaatttttttgtcggtggctggggcccgcgatacggtactgcgagggtgtgcaggcgaataagcgagagaagcatttagtgtggacgttactttggcagtgcttaattttaaaggacggctgctgattcaaaatggctattaatcaaacaaattaaataaaacccttgacctgaaacccgttcgagcagttaggataaaggtaatcaaagaacggtagctggccagcgccattatggaaatctaatcatcaaattcgggagggctttatcatgggactattttcatttggtaaaaaaattaaattatatgcaccagttgatggcacactgatagatttagccacagtcgctgcgggtcagacgggatttgcggtgacaccagaacgccaccatatcttcagtccagtaacaggaaccgttagtgccctgattccagaacaaaatgcgatcgagctggcagctggaaagctgacggtacggttacgaatgggtgttaataccagtgcaactccggcaacttatgttcatgaaggcgaccaagtgacaccagaaacaccactcgcttttgtggatcaagagcaggccgctgaaaatggggaggatatgacggtgttggtggttgtggataaaggtgggcaacccgctgaaaaaatcagtttatccacaagtggacaagtgagccacgaccaagaagttgccacggttgttgctaagtaggacggatgatggggctaatcgtgtgtaattgtttgcgatgagctgagtcagaaggaatttcatcgcgtcaccatagttgattgatgcaaggtcaactagcaattgcaatgcagttgttaaatacgaaaacacacttcaaagctgctacttttgaagtgtgttttcgtgctcagttgatttttgattggcggttgcaagcaattcaatctgccgcagaatgagcctgtccttgtccacaagccatcagttcagcttggtaggcatcattgatgcgattgagtgcttggtgaaattccgtgataactttgttcatttggcgctgatacttttcatccaacgaataaccattttgaacttgagttttaggccccgttgtttgattcaagtacgcctttaagtcatcgtctggctgtaacttttcgtataaatcgacattgtctagtaagcggacgatccggttgtatttacccgtaaaggtccgccgaataatctgtattcggtgacgaaagacatagcaaccggcctgaatgacggcttgaggttctgggtaggttgtcgtttgttggtagtgttggacgatttcaggaacaatctgccgaatcgcattattgatagtcggtgtaattaaggccgccgcgattttagttgggtcggatacgccctgttcagtctgtgaggccgaactgaacaagtcactagaaagaatgttcggattggtcgtagttaggtccacatattcccatagtaggacattgaattctgaatgattgagaccaccattttgaaagacagcggtgacatattcagtcaaactaccgtataaaaggtaattagtggatacgtcaaagtatgcagctactttagcgagtcggtccgcgttagctagcgtacgtcccttttcccagtcattaattgtgctttttccagccaagccaatcgcagatgcaagtttggccatacttaaaccagcggcaattcgaagttggtgaatacgattaccaacttgttgtttatcaatctgcaatttgatttcccccctgattggttcttagtatattctaacatagggagggaagcgctcgcattgttaacactgaatatattagcactttcgatgattggcgtggtaacgacagataagtagtatcaagtgcttagtgatacttatgaataattgtcataaaagcggtgctattatttaccggccagccgtctagttggatttcataaggttgttccgtaccaggataaatatgaccgggaatcgcaaccttttgccggtggtcgtgaatgatcaggaaaaacatcgcaggtcgacaaaggatggtcacgtgtgcggccaggcagtcgctaagcgtggctgctaaatgctggcgaatggtcgttagtcccgcagccccttcattaataacgatcgaccaatcgaatgccaagtctgaataggcggctaatggtgttaattgttgcatgttgaatgcctcctccaaggtattaattagactaaatattactattagcatacatgcaaatagttgtgatgacgaccatctgcgcttgttatggccaattaataagctggcttaacagagatcatgcgacaagtgtaaattgccagcgtatactagaagtattatgtgcaaaaggaagtgtcgagaaatgcaacaccggattgctgtgctggcagatattcatggaaacttgacggcgcttaatgctgtgttggcggatgcgcgtcagcaagccgcgacggattattggttcctcggtgatctattcttacccggcccgggtgccgaaaagctctaccagaccttagcggacactgcgccgtcagtatggttgcaaggtaattgggaacaggggattaatgcggtcatgactggaaacgggcgactggatgatccttcacagatttattttgcacgattgaccgcgtatctggtgacccatctgagcaaatcacattacgctgaattagtgcaacggcccattgcgacaacgatggtcgtgaacgggttaacttttcaactggcccataatcagccggaacgctcgactggtcacgacctgtatccggatgaacgccagtctaattttgatcacctagctggtgatgcggatgtggccgtttacggccatacccaccaacaaattatgcgggtgagtcagcggggccagctcattattaatcccggggcgacaggccaaccttatagtccatacgctaagttcatggctgatcagcgtgctcactatgcaatcttaacggtggatgacgcgggtcgaatcagtgtggattttcgaaaagttgattatgatattagccttgagttgaccgttgcgcgtgaacaacaattaccatatttagacttatatgaacatcttcgccggactggttttacgagtacccatgaccaagccttattgggcaaactgaacgctaagtttaattacgctaatgaggtacgacgattttttggcatgcaagcgtgatagttagtggtaagttagtgagttaactcttataatgattgaacaggatacgaggagggttttcatgaactttgcaccatcagaatggtttggctttaacaagcgagctagacatgatatgacgtttactaagactatcaatggcgagaccagtaccaagcaagtgtacgggcactttaacgtgtgggccctgttgttcacgtggttttatgcgctgttcagtgtgcggtgtcgaaccccgtttttcttactgaaaacggcggtgccattcttaggcatgctgtcgttaaatatggtgacgcagctgttttttagtgaccaagttgtcatgagtatcgggttactaggcgatatttggtatggttttatgtttgagacgtggtttagaaatcagctggttgcaaatggctatcaacaaacggcttagtgcgacaggaatagattagcttatcaggcttcccagcaagacgtggggagcttttttgattggggtcgttgacaagtttctggctagtaaagtatcgcaacataaataatatcgtttctttacaaacatctgactaaacactttacattccttaactattcttaaaagtgcagtttgttttacgataaaaaagatggagtgataattttataatgataaagccgcgtgttttaacgaccttattagtttgttcagcaatcttaacaacgacggtgaccccggccgtcgctgcagtaaccccaatggcgactccgagtgagcaagttgccgaaccagttgccagcccggccgttccaacagcaatcttgagtttggcaattcaaaatcaacaattggttgatttaattgggcagacgcagtggcaaacctatgggcagcctgccgtgacgaaggaccctgaatttaacgaccaagtgttgaacttggatggcaaatcagcgttttacacgaccttcacggatcagcagtttgcaaagttacagaatgggatggcgatcgaggcgtactttaaatatgatccagccgccgatgccaatggtgaacatgagatcttttctagccaacagggtggtggtttaggacttggggtgcaaaacaatcaagtcgttttcttcgcccatgatggttccggctataagactcctaaaggcaccttacataaggggcagtgggtgcatgcggttggtgtgatcgataagaataagacggctagcttgtatctggatggccagttagtccaacaagtggctatgcccggtgatttaaagctggcacaaggaaccaaagactttgtgctgggtggtgatgcggttcctggaagtcacgttcagtcaatgatgaccggtcaaattagacaggcccgcttgtatgatcagacattgacgtcgcaacaagtaagtcaattgaacgttgaagcacaggtcggcaagcagccggtcgcacccgtaccagtcgaccaaacgattgcgacgaagctcgttggcccgaagcgaattgcgagtgggcacacttatggtcttaatgtacacgcccggcaaatcaaagctaccggtgccgccccaatcaccatggatgtcgtgtatgatgcggctaagtttgactatgtcggtgcagaacgtctcttacaagggggaaagacgcaggtccaactgattgcgcctggccgtattcgcctgactacgacggcgaacctttcaaaagctgaatttaaaatgtatgcgcaaacgcggttagcgcaccttaatttgaaagctaaggccgctggtgagacgcagatcaagtttgagcagctaactaaagatacaaccattgaactagggccagctcaaactgttgaaattcaaggtaagtacgcgctagattataacggtgacgggattattggtgttggtgacgtggccctggcaaacgcagccgataaagtggcagccgccaatgcagctgaaatcaagccttataaacacgtggtcgttttaacgactgatggtggtgggaacccctgggatccgaagggaatgtactatgcacaaggtgcggagcaaggaactaagactcccgtatggacaaccaacccagaaatcatgaagaaacgtcggaatacgtatacgatggacttattcaataagcagtttgcaatgagtacgtcagcgcgggccgtttcaccagcgatttcggcacaaaactacatttccatgttacatggtcggccatgggacacgctacctaaggaatatcaagggactaacgcgaccatgggacaagaatactttgcagactttaacaaaccacaagcaatgttcccatcagtatttaagatgttacaagccgataatccaactcggggcgctgcggctttctcagaatggggaccaatcgtcaatagcatcattgaaccagatgccgcggtgactactaaacagtcagcttcgctgaaatcctttgatgatgtggctaactatatcggcacgccagaatttcaaagtactgggttagtctacatgcaaagtgattatatggacggtcagggacacggtcacggctggtacaatgacaattactgggataagtacgcgcaatatgatgcgctgttcaagcgagtaatggataagcttgaagcaaccggtcacattcatgatacgttagtcattgccaacgctgatcatggcggttctggcaagaatcatggtggttgggatgaatataaccgcagtattttcatggcgctcggtggcgaaacggtcgataatggccgccgtttgcatggtggaagcaatgctgatatcagtgcgctcatcctgaatgctttgcaagtcccacagacaccacagatgtttgacagtcaggtctttgactcatcggcttttcttaagcagactgacctatcgaagaagaaacgttcagttgaaacgttaaagctcagtcgcaatgatcaggaagcaaaagttcaattgactcataaccaaaaccggcaactgacggcatttgatctgcaattggacttagcaggtcgggaagtcgctgacgttaaggttccaaccggcgtgcagattttacggcagacggtcgctaatggtcaattaagattaacagtcagtgccagccaacccgtgactgacctggtgacgattaaactcgtaccaagtaagacgcgtgcggctaagaccatcatgttaagtcaagcaatggctgccactgccgacggtacagaagtgcttgtggatttggataatgataatccactgacgagtacggctaaacccgacgaaaacggcagcacgacgactaaaccagatggcaatggtactgcggtcaagccggatgaaaatggcagcacgacaactaaaccagatggcaatggtactgccgttaaaccggatgaaaatggtagcacgacaactaaaccagatggcaatggtactgctgttaaaccggatgaaaatggtagcgcgacaactaaaccagatggtaacggtactgccgttaagccggacaaaaatggtagtagcacaactaaaccgaatggcaacgggactgctgtcaaacccgacaagcatgaaactagcaccacggggagcgggacagttaatacatcaggtgcagacaaaacgagcaccaacgacaatggcacttcaatgacggccggtacagctagttcgcatgcaagtacagtcacggatcgggtgacgagtggcacggtactgcctgaaactagctcgagtgcaactactaatcatggcagtcattcgacaggtcatcatggtagcggctggttaccacagacaggtgaagcggtgcaacgctggctagcagtcgccggcggtgtgttcctcatgctgactggtgcaatcgcggtttggtggcggaagcgacgcgcctaggtaaatataacttgtcacgataattttggaagtaagcacggatgaggcagtttctgggaacggtgtgtttctcgaaactgccttttgtgcacgctgatcgacggtggtgatgtcggttgaagtaccagagcgaaccagattgtaatgtcactccttaataattaatttcaaattatttagcctaatagttagtttttgttgttatagtctaactaaagtgctatgataagattcaataaaaataaggtataagattttttccacagttgtttttttggtaaacttaatgactaatagtcacagttaaagcccttgatataaataaaggggagttggcacacgatattgacgtacagtaaggtagggtgagcgaggatgagctacttagaattaaaagatattcacaaggcctattatttaggcaaggaagctttcccagtcttgaatgggattaatctaacttttgaacgaggtgaattcgtcgcgattttaggggaatctggcggtggtaagtcaacgttgatgaatatcattggtggcttggatcggcaatttcagggacaagtgttattgcaaggaaccgcgttagatcatcaccaagagaaacagatggatcagtatcggcgtgaaacagtcggttatatttatcaatcatataatttgatcaaccatctgtccgtgttagacaatgtcctgatctcgttagatatgaccaagttaaatcggtcagaacgtgagcaacgagctaagcaactgttaactcaggtggggttagcggatcaaattaaaaagtacccgaaccaattatctggtggccagaagcagcgggttgcgattgcccgggctttagcgagtgatccgcagattattatcgcggatgaaccgactggcgcattggattctgaaaataccacggaagttttgaaaattttggatcagattgcggcggaaggtcggcttgtaatttgtgtgacacattcgcaggatgttgcgaatgcgggtactcgaatcgtgcgcttagctgatggtaaaatcacggatgacgagcgggtgaaacccgcttatccggtcgatgaaaatcgccaacagattgcggcacgtaagttaccgtggtatgtgccactgaacacggcgtttaaacatctacgctatacttggacttggaacttgattattatcattgggacagcgattggtttattcgcagtgatgttgtttaacgggttaggtaatggcctcaaggggtatattaatcaggaaatcaatgatatggtcaatccccgtgtcgtgacagtgagtcggtatcaaaaatcgagtcaaagtcagcgaggcggcagccaagaaggcaaccagcaggcagctgccatgggagcgagtgtgacgacgaccaatcagccaacgttcagtacggcccaactgagtaaactgaaaaaagttgcgcatgttcagaccgttcagccaattttgagtgcaagcaacgcgacaattacagttggtaataaagactacaccgcttcatcgttaacaacgtggacggcttctaaccggaagtcgattattaaagctggtcacgtggctggtaagaatgaaatcgtcgtcgataagagtagtgtggcgaagaaatggtcatctaagaattggaagcaattggtcggtaagaaagtgactgtggcttttcagacaacgaataagagtggtaaaagtgtcacggttaaacggcaattaacggttgctgggatcacggacagcacgactggaagtggtgtgaacgccgtgacctacgccactatgaaaaatatgcggtcagcaaagaatttaagtacgcagccaacttcagttgcggtgaaagttgattcgcgggagcataatgatgctgtaaccaagcagattaataagctaaagattgatggcaaacgggtttaccgtgccaccagtattgccagcatgcttgatacggtcaatacgtatgttaacttagcaaccacgattttggcggcaatcgctggaatttccctactagtctcagcgttaatgatcattgtgaccatgttcatgtcggtcagtgcccggaagaaagaaatcggaatcttacgtgcgctgggtgaaagtcgccgtgatattcggcgattgttcacgagtgaatcattgatcattggggtcatcagtgcactactagctactggaattgcttatggtattggagctgccttgaataaggtcctctaccaaatcgccagctacaatatgattgagattcaggtaagtaatattatctcgacctttatcattgccctggtgattgctttattagcagccatcttaccagcttggcgcgccgctcggttgaatccaatcgatgccctcgccgctgattaagtaattgtgagtcattaactaaaatagtctgttagtaaaacggtaatgaagccagaacgggtttcattaccgttttttgtgcgtggggcctttgatgctaatttgctttacatatgtcgaaattgacatataatgaagacaactaaatagaacacacattgcgcgagccaatttgtcatgaatcgtgattaaaacgtgccaagtttagattgttgttcggcagccggtgcgcgtcctaatccgacctccaggactgggtgacaattgctggaacgcagccgacgtcgatttgagctaacgcataacccgcgtcatctcaaatacgagtcttattctaagccggaagcaacccacttccagctaagaataatttggctactgagcattgtcaccagcccctccagtcggaaagccgctcgaatggctgatgaacggccactgaactcggtacaatttgtcgttggctattttgatactgaaccctttcagttaaatatcagagtgccttctccactttttcgaaatattcaattattactacggtaatttagaaatagtgagttatcacaagactttttcaatctgacagttgattgagaaaactgtcagattgaaaaacaacgacaaattcagcaaaagttgagtacatccctatcagccattcgaacgctatcccgactggaaggtgtttctgacaatgcccagtggtgaaatttcacttagcaagcgtcctgtgcttggttagtgaaaggccagtatttgagacgtggtttttcggctcaaatctgtgcccaccacgttccggcaattggcagaaatgcctggaggtcggtgtaggacgaattaactaaacaagtttacgctgagtcgaactttcccagcggtccatagctggctgcttttgaacttaaaaacttggcacgttttaatcacagttgatgctaaatactagcacaacgcgtaaagaaaagtgggtgaaatgatgcattatggggttttagcgttaacgtttttgagtgtcaatttggattttttcttgatgttagtttttttattgaagaagtatcggttgtggcaggtcttgttgggctatttgttgggcaatcttattctactaacggcaagcttctttgtgggtaaagcactgaccttatttttgccagaatggttattaggattcttgggtgtgctgccgatttggcttgcgtttcacgacgacgatgatgatactgccgatcgggctggtgggtcgccggtgattaacgtactagtcacttatttggccgtatgtgctggttgtaatttatcgatctttttacctgtgctcgttggggaaagcatggtacactttgtgatgactttaggatttattggtatattgacgattcttgtcgtgcttatcattaaccaggtggcggaaatcaaggctgttcaaaagcaaatagcggctcatggtgaacggttgatgaaaatttgttacgtggtgattggcttatatgttttctgggatagtgggctaattagccatttaatcgcattcctatgattggtgagaacggaggaactggcatggaggtcagcgggccactattaactgaggcggctaaaatatacaaagtactgagtaatgttaatcggattaaaatcctaatttttttagaacaccatgaagcggacgtcacgcaaatcgttgaacatgttcatttggcgcagccattagtctcgcatcagttagcaattttgtttcagtatcagttggtatctaaaacgaagcgggggaagcatgtctactattgtctagacgatccccatattttggaaatggttgatgccatgattggacatgtggctcatgaaattaaacatgaactgcatcgtgattaatgacgggaggaagttgtgaaggttaagataacgaaacgacagcttatcagtggggcagtactgctagcattactattaattggactgttgatctatcgctatcatggtacttgggagatcattcagcatcgggtatttgatcaatcagcactggtggcccaagttcgacggcaccgcgcgattgatattttattagtagttcccttattgatttgcttttcaattattccaggtgcccccgtggcgacgatcagtgtcgttgctggcatctgtttcggcaaagggcttggggcagtgttaaatattattggcattacgctgggcaacttgattgcacaacgctttttcggacgggtaacggctcgacgtgatcaacagccgtcaaaactcgtgacggccattggtaagatgcggcaccccttattaggaatcgtgattgggtatacgataccgtttattccaacgtcattagttagtttagcggccattgaaacggcggtgacaccccggcagctagccgcagcaacgctactgggcagcatgcccacggcgattatctatgcttggggtggcgatgaactgattaaagcgcacttcaagaatgcgttgatgttggttggactcttggtgctcttattgggattgttgtggttgatccaccatgatcgtcaacgagcagttgatttggatcattaataattgaaattataagccgcgggcacgccttcttaatcattgactaagagggtgtgcccgccgctttgcccgtagccgttatgatgcaactggctgggtatgcttgaattgattgatttgagttgtggttagtgtaactgtcttatatggtaagaaatgttcagacagttctgagcctggatcggcctgaaagatctcgaccgtgtcgtcagctaagtctagctgatagacacgccgcgcatgcgggctgtcaacataaatagcggtagcggtgaagggccgccaggtaaaattagtcgccggtaataagtgccattgttctaatgcgtcgtaggtttcgtttggtgtcataatcgaatcccccttcagtgactattatagtatgtttaggctaatagtcaaataatgtttgacgaacctaaaacccccgtttccacattgaaaacgggggttttgaggttattttaattgatttaacgaataactaaaactgaaatcggtgcgtattttgccatataagcagcttggctaccaaagtgtttggcaatcccctttttggctagggagccaataatgagtaagtccggttgaacgtgggggatgacttccttaacgatggtctcgccaggttcgccttccgcaatcattgcgtggactttggtgacaccagcagcttgggcttgcttttgatatttcaaaatatgctgttcaagttcttggcgttcaccatgaatgtagtctttactgagcgcttgatagacgttcatttcatcattttcaagaatcgagataatgaccagttcggcaccatcttgcttcgcttgatggattgcatagtcaaaagcaagtaaagcatcggcagaatcatcaacaccaacgagaatccggttgaatttagtcgccattatttgttggcctcctttgctgctgcagcaagttgctgttcaacgtaacgtttgttaccgcgttgtaggtcgaagacggtccagacaagtagggctaagatagcggcaatcaaaaggtaggctagaattttagaaaaagtctgttcgccagctgaaggattatcgccaaagaagcctaagattgaatctggtagaccgagtaagtttaagaaagtcaaaccgatgacggataaccaacctaaacctttgatccaaagtgagtttttgaatcgtttgcccatttctgccgcgctgtcagtcatcattaatagtggcaacatggagaatggaagggcgaaagccagaaagacttgtgagttattcatcagattattcaatgcagtatgctcgtcgattgcactcttaccactagttaatagcacgcaaatgaggacgggaataacggagatcaaccgggtcactaaccgccgtaaccagagtggcatccgcatgtggacgaacccttccatgatgacttgcccagttaacgtaccggtaattgtggagttttgcccagaagccagtaacgcgatggcgaagagggctgagagcgccccagatttagcaacactgattaaaataccattgcttaacattgatgtattggataatgcttcataaagaccgaagaatgaaggatctttaacagcgccactcttaaagacggcaacgcccataatcaataatagtgaattaaccacgaaagcgaatgaaagttggatattggaatcccaagcagcgaatttaacggtccgcgcgacatcttcctcatcgttgtggtcaatcttccgcgtttgtgagatggctgaatgtaagtacaaattgtgtggcatgacggtggcaccgataatccctaaagcaccagaaagtggcgtcataccgtttactgaacgacttgtcgagaaagtgtcagcggttgggactaggcccttgatcacaccgccccaatcagggttggacagtgcgacttgataaacgaatacgaataagataactaaaatcaaacaaaccacgatggcttcgattttccgaaaaccgattttggtcaataatagcaaaactaaaacgtcaagcacggtaataaacaccgcaatgactaacggaatgttgaataataaatagagggcaatcgcagcaccgataacttcggcaatgtcggtcgccatgatggctaattcggttaaaatccacaagacgattccgagtgatttactcgtccgcgcccgaatcgcttgggccagatccatctgactcacgataccaagtttagccgccatgtattgtagtagcatcgcaatcaaacttgatatcaagatgacagacattagcatgtattggtagttttgaccaccggtgatggaagttgaccagttaccgggatccatgtaacctaccgcaactaaggcaccaggacctgaatacgcaaagagggttttccagaagttcagattcttgggaacctcgatggtaccgttaatttcctctagtgaggggccgttagcatattcaatcaatttatgcttccggtttggggtgttcgtcttttcgctcaattaaaagaccacctttctatatctctaaatctttgagccgttgtcattgtacaataaataaaagtaaatggaaatacttttttaggtatgcctacaaaataattaaaacagtttgatataaaacattctaattgataataatatttttaacttactaagcagtcaaccaagcagactaaaacgctatgacggaaatcattgtcgtagcgttttggttcgcgattctcaaaaaatacaacacgcgcaaatcgccggcttcatcgacttgcttagaaacttatcttgccgaacaatcacccgtcgcgtacgatgtgcttggaggtgtgaaaatgaatttttcagataatttaaaaattattcggcaacaaaagaagatgactcaaactgacatcgcgacacaattacacgtttcacgacagacgatttcaagctgggagaatggtcgaagctatccagatattggcatgttggtgcaaattagtatggcgtatgatttttcagtcgatcaactattgaagggagatttagggatgttaaaacactacgaggctcagtcggcaaataatcggcggcagcagcgcttggtggcaatcagttatgacttagtcgttggcctactatttttaagctatttgcactattttttgcattggaacgacggcatcgtgacgatggtcattaatggtgggttgattgtgatgaccacgacgttgattatgaattataattattttgatgattgggcaaccactaaacgccaggcgtggcaattagtgggggttattacgatgttggcggttttaaatatcgcgttggtgtggccacaactagctagtcagatcccatcaacccagttcttaaatcaacatgctggtgcatatttagcggggaatgtgagcggaaaattagttggtgacttcttgcatctctttatttggacagcggcggccgtgatggcgattgaaattccgctcaatcgggcgagaaagacttcagattaggcgttcaggttgtggatggtgttattaaatgctgcgaccactatttagcagcaatcgagtcacgctcaacgatcattttggcacctatgataatgatgagttatcggctacggtaagccgtttttaattcatgattgtcgcagattttggttattcgttgatgtgcaacggccccatgatgatgccaactagctgcagaattagctgatgtggacagttaaagctggttggcgttttgtgtatgtgaattattggggtaaaactgaatagttgccatcgccaatagttaactgctgtgctaagattaagttgtgttatttttactcataaaaatgaagatacaacttaaacagaattctttcacaataatcatgtttaagtgaagaaagtcaggtgtagtaaccatgagtaagccagattcgattaaagttgatcaaaatgaggaaacggttactgaaattttagagccagcagcagaattagataaaaaaattatttcacccgttaaagaaacccgtaatcaggcgattcgctatatcttgtggggattgatcagtgttgcggtcaactttgcaactttctatacgatgtaccacctaatcggactcgaataccaggtcgctaatgttatttcctgggtcattgccgttcaagtcgcgttctgggtggaccgcttgaaagtgttcgaccatcattcacaccacgtttatcgtgaaatgggtaagttctatgcgacccggatagtgacgtacgtcgttgaagcgattattttatggttgttgatgtcagtattggggagctcggcggtactagccaagattcttgggcaggccggcgccatcattgggaacttcttgttctcgaaactgtatgtttttcgaaataagtagccacatcaagacgggaatgaaaattcacgtctttttttgttcagtggggtgccgcggttgttagaatgacgagtaggtgtgtgaaagcggattaagattacaagtagattgcggtaatcctaaatattcttaatgattcactaagagctatgtttaagtggggtgtcatgtggtttaataaacttaaattattgcttgtcaccatgttaaaaaattaagaggagcgcacagcatgctaaaaaatctaatgcgcggaatcaaagcgctgtgtctaatcggcctcgtgttatttgggtggcgcaactatgatacgcttgccccgcgcgcggcagctttatatcagacgagtcgtcagaatctagcggctgccttgtcgggtgacttatctagtcatttgttgggtgctgatgatactagcagtgctaccgaagattcggcgactaactcaagtaagcaatcatcaggtcagcagacggataagactgcgagtgccagttcggtcactagctcgagttcgcaagcaactagttcaacaacgcaagcaacaccgattgaatcgatcgtgcagaacgccactttaaagaagacgtattattattccttcgatcataatgttcccaaagcggcccggcaggtctttcttgaagctgtcgcgacttataaccagactgggttagtccatctggtagctggtcaagccagcgggtcacaaaattcagtgactttttcgatgtatcataaaaaaatgacgactggtgcgaccagtgttgaacttggtcatggtggccctgatattactaagcaaattagctggcgaggtatccaatattggaataacgcgacggctagtcttaacggctcatacgcctcagctttcagtaaatcggtcgcagttcatgagttaggtcatgcgttagggttggatcacagttcatcgactgaatccgtgatgtacccggtttcacaaggtaagagcacgttgtcaagtgctgatattgcggccctggaaacaatttatcaaaagaatgcgtaatttattttcgtaataccaaacaaaatttaaccacttttcaaattttgacctataatcaaggtgtatcaaaaattagaaaggaagttgttttagtatggctgcagcagttgaaatgaacagtatgttagacgaaaagatgacggacctgtttgattggagcgactctaagttacccgtacgggatgcgatttggaatcactttatggacgctgatagtcatgatactgacaagacggctgacgaagtagcgccttatatgagtatggacgaagctaagctcaagagcgaagttgaaaaactcttaaaggcttaaccagaataacgaccatgacggcctaatttttgaatgggaactgattgccagtttagtaatcagttctttttttatgcttttaatccggctgaataagctggttggtcaggggggcctctcaaccgaagctaatcaagaccaaaaataatttttttgaattactgtcgacactatgagcccgtagtggtttaccttttaattaatataaaaacaattaaaaattcacttgacttataattaaaagttaattaatctaagaaacatcaacattacaaaaacttttgaaagcgaggcgcgtcaattatgaaaattcaatctaacctaaccaacttgttgacaacccttgctgttcaaaatttagccttattattaacgaagaaggacccggtcacttgaccttgagtataactcaaaattcaagtgaactgagcccttctttcccattgtggtaatgaggctcagttccgggtaaaggcctcattcactacggtggatgaggcctttttgtgacttaaggaggatcggggtcaacaacgtagcaataaaaaaacgaaagtgggaataactaatgaaaaaatgggaaaaacaaacgatgaagattgcagcacttggtgcgatggcgttgacactggcagggtgtgccactgccaaatcaagttcaagtcaaggaaataatcctggcaagactattaaaattggggtcaatatggaattgtctggatctgcggccggttatggagaacagcaaaagcaaggcattcagttagccgtcaagaaaatcaataagagcggtggaatcaaggttggggggaccaagaagaaaattcagttggtgatccgggacaataagacatcgaacacgactgctgcttccgtggctgcccagctcgtgaataacgataaggtcgtggccgtagttggtcccgcgacaactagcgccgggactgcggcgatccctaatatgactaaggcggcagtaccatcagtcagtccatcagcgaccgatccggattatacgttgcaaaagagtggcaaagttcaaaagtacatattccgagcttgctatcagaataattttcaaggagccacggcagcaacctttgtgactaagaacttgaaggcgaaacgtgtcgccattttgactgataactccagtgattacggcacgggcctaacaaaggcgtttaagaagcagtatcggggcacggtcgttagcagccaaacgttccaagagggcgataaggactttaatgccatcctaactgcgttgaaacataaaaagatcgatgccatatatgcgcctggttactattcagaaatcggtctaatcgttaagcaagcgcggcaagcgggaatcaaggctccaatcgttggtagtgacgggatggcggatgctaaattagcccagattgctggcaagtctaatgctaccaatgtttattacacgacgccattttctactaaggcttcggcaacgaacaaagttgcttcgaaatttatgagtgcttacaaggcaaagtatggtagtaccgcaccaactttttcagcactcgcttatgattcggtttatatgatcaaagcagccatcgaaaaggaaggctcggctaattctgttaaaatcgccgatggtttagccaaacttaagaacttcaagggtgtcactgggacgacgactatcgataagcaacataatcctgaaaagacgatttcaattgaacaattgacgaatggcgtggtcagcaaggtttataacgtcaaatagtcagactagtgaaagcgtgggggaacacatatgcagacatttggacaacaattgatcaacggactatcgctaggaagtatctacgcgttattggcgctaggctacacgatggtttatggcattatcaaattaattaattttgcacatggcgatatttatatgttgggggccttttggggctattacagtttgaagtcactacactttaactttgttgcggcgctcctgtccgcaatggtgatctgcgcagttagtggtgtgattattgaatacttcgcgtaccgcccattacgccattcaccgcgaattaccgcgctaatcacggcaatcggtgtttcattcttgcttgagaatggaatgtcatactttgttggtgcgagtgcccgttcatttccccaagcaatcaaagtggtgacttatcactggggcggattgcgggtatcgaatgtgcagctactgatcttaggaacggcgtgcctattaatgattctattggaattaattatcaaacgtaccaaaatgggtaaagcaatgcgggccgtttctgttgatcccgaagctgcacagttggtgggcatcaatcttaaccatacgatttcgttcacgttcgcattagggtctgcaatggccggcgctgccggagtcctgattggcctatactataattcgattgatccgttgatgggcatgacgcccggtatcaaggcctttgttgcagctgtgattggtgggattggttccgtgcctggggcttcattggggggctttattatcggcatcctggagactggtgttcaggcgattggcctatccgcatacaaggacgcggtggtttactttgtcttaattgttattttgctcgtgttgccggctggaatattcggtaaacgaaccaaggaaaaagtctgagggaggcgccaaattaatgaaagcaaatttgaaaactaacatggcgtggctcggtgtgatggttatcggctttgttgtgattgacggtttagagctgatgggcgtcattaactcgtttattgaaaatatgctggtgacgattggtatcaacgttatattggcggtgggactcaatctgattattgggtttgcaggccagttctcgcttggtcacgccggctttatggcaattggcgcctacgcgactggtattatgacccaaacaatggcgacgcccgcgggattttatctgtcgatgatcgtcggcatggtgattgccatggtagcggcggtcattgttggcatcccaacattacgattgcgcggtgattacttagccattgcgacgatgggggcggccgaaatcattcggattctaatcaataatctgaaaattacgaacggtgcagcggggttattcaatatcccggcacttgcttcgtgggcaacggtgtacgtcttaatgtgtctgacaacgattatcacggtcaactttattcacagtcgcggtggtcgggccgtgatggctgtgcgggatgatgaactggcggctggtgccatgggaatcaatacgacgcgctggaagttggccgcttttgtctttggcgcggcgactgcggcgattggtgggtcgttgcacgcggcctacattcagacgattgcgccgggtgattttaatatcatggcttccattgcgattctgattattgtcgtactcggtggggtcggcagtattaccgggactttcgtagccgcaatcgtattaggagcgctcgacacgatcttacaaaacttcggtacgatccgaatgattatttattcattggcactgattttgattatgctttttaagccagccggactgttaggaacgtgggagttctcattcacgcgtctattcagacggcgatcaactaaggaggcggttaaccatgagtagccggttattagacgcacaagggttggtcaaaaactttggcggcctgaccgccgttgctgacgtttcactccattttgatcaagacgagctgattggtttgattggcccgaatggtgctggtaaaaccacgttattcaacttgttgactggtgaaacgccggttagttcgggtagcattagtttctacacagatcagggcgtggtgtcgttaaatggcaagcagcccgctgcgattgctcgggttggtatttcacggacatttcagaatatccggttgttcaaggagatgagtgtactcgataacgtgcgcattgcaatgaccaatcattatcatgaacggtttttgactagcatcctgcgcttacctaagtattaccagactgagcgggcaatgacccaggcggcgcaagccttattagcgatgtttgatttgaccgccgtcgctgatcagcccgcaaagagtttaccatatggtattcagcggcgattagagattgtgcgggccctggcgacgaagcccaagttactcttccttgatgaacccgcagcgggcatgaatcccgaagaaacggcggatttgacgcgcttgattcgccgaattcaacaagaatttcatattaccgttgtgctaattgaacacgacatgtcactagttatgaacgtagtcgagcggctctacgtgttggagcacggggcgttactggcaactgggacgccaaaagccattcaacatgatccggccgttatcaaggcctatctaggaggggtgtaaatgcttaaagtacgtgatttagtcgttaattacggcgcgattcaggcagtcaaaggtgttagttttgacgtgcaacagggtgaaatcgttacgttgattggtgctaacggcgccgggaaatctacgttgttgcacacgatatctggcttgatgcgtccggtcagtggttctattcactatttggatcaacccatccaaaagacggccgctcctaaaattgtgcgggcgggtatctcgcaagttcctgaaggacgccatatttttcccggcctgtctgttcaagaaaatctacaaatgggtgcttttttacggcaggatcggggtcaattggctcagacttatcagcaagtttacgactactttccaattttgaagaaacgtcggcatcaagatgccgcgacgctctcaggtggtgaacaacaaatgttggcgatgggccgcgcactgatggcgcagcccaagctgatgttgcttgacgaaccttcaatgggattagcgcccatctttattaatgagatctttgagatcatcaaggcaatcaatcaggctggaacgacggttttactaattgaacaaaatgccaatcaagccctgaaaatcgctgaccacggctatgtcttagctagtggacaagtcaagcttagtggtcggggttccgaattattagctaattcagaagttcagaaagcttatctagggggttaagtatgagtgttgcagattatatgacaccacgcctggtcgttgttagtcctaaaacgacgatcagtgtggcggtcgaattaatgaagaaaaatgcgattcatcggttacctgtcatggcaggtaatcgaatggtcggcttgatcacgcatggtatcattcagcgtgcgatgccatcacaggccacgagtttgtcggtgtatgaattaaattacttacttactaagacgacggtggatcaaatcatggaaacggcggttcaaactgtcgcagcaaccgctcagttagaaacagcgattgcaacgatgcggaaaaataagatcggcgtactaccagtcatgacgggcgaccaagttgtgggcatcattactaataatgatatcttggatgcgttcttaaatattgctggttacggccagccgggaatcgtaactcgggtggtggtccatcatgaccatgtcggcgtaatttttgccatcggacaggtcttaacagaacacgatttaagtattcagacgttaatggtcgtaaatcaccaggctgaaaaagtgattgagctccacgtgaatagtgaataggccgccgatgttaaccaagtcttgacagcagcaggttttgaagtacaaccggtcagtgattagctctggcggctattgtctattattggagattaggtggctaaagacatcgcgttgtacaaagttatagggcgtggtgaaagtgtgtgggcacaaaaaagattcaggatgattcaatcctgagtctttttttttgacgtattgttacttaagactgcggtcgactgaatgttttatagacaggacattcgctagctgatgggaaattacggcaactaactagtacttgtgaggagtagtgataactgattgagttcgttattaccatgcggttttgagcggtacacacaaatttaagaccggataataaaattgatagcaaaccgagactgatcaagaagaacgatactgacctgaacgtgacaataaaaaaaattattattaattggattaaatccctatctgttgttttattaatgttgtacaagtattagaaaaacagcggatagaacgttttttaatgcaaaaatgatgaaacaaaaaattaatgccacatacaaaatacggccggaacagttgacctggttgattttcacgagttaacaaagaagcaactcaaagattaaggggttgtaattgttgggaagtgtggtaaattattagtgcagttaatgaattaggcaaactaaaggggatgcacgatatgaaaaaagtagtaggcagtttactcatgaccagtaccattttattgggggccttaacgccaatcgttggtcacgcggccgatggtgaaaatcggagtgggacgacgaatgcaacggcaacgtttacggcaaataccactaatccagttgatccggtcgatccgactgacccaacgaaaccacttgaccctaagcctggtgatggcgataacggtgccaattccggtgctggtttgtcactgatctatgcgcccggtaaacttgatttcggttcacatgaaattgacgtgatcaataaccaaagctataaagcattaacaggtagcgatggtagcacggtcaccatggggtcaacgagtaaagttggtttacaagtctctgatcaacgcgggacgaatgcgggttggacattgagtgttgccgctgcggatggcacggatggtaacttaagtacgcttaagggggccacggtctccttacctgcagggacggtcatttcttccggatcggaagctagcaacggcagtaccggtggtaatggtgcggtcggacaagctgttgaacttgacttaggtagtcaagcttcgactagtgccggggcgtcctttacggggacaacttctgggaatgttatgacagcagcggataagagtggggcggggattacgtcggacttgcttgatccggctgcagttaagttgaacgtcgtggctaacacggcggccgctacgacttacaagggcgtcctaaattggacattaacatcatcagcagataattaaattaatgaacttggagatgaccacgtaatagtgggcgtctcttttacataataatcgacggggggacgcaataatgaagaaaatgatgcggtggttaggggccatcttagtgatgatcagcggcttggccgcggtggttccagcacaggcagccaatacggacaccagtaataatattggttttagtgtcgcggcccaaacgccgagaaaccaaattgataaacaggcaacgttttttgacctcaaaatgacggcagggcagacccaaacgttgcagacgcgaatctataatacgactaaccgggatatccgcgttgcgatggggattcatacggcatataccaacagtggtggcgccattgaatacgtgaccccggcgaaaaagtatgatgcctcactgcagtatcgggtcgaccaattgactaaaatcaaggggccaacgacggtgacagttccagccaacggttctaagctggtcagtgcccaaacgaccatgccgactaaggattttaacggtgccctgttaggtggttggtattttaaacgcgtcgatcaaaaggtcactggtgaagtgaagggtgctacgaatattagcagtgaatattcttatgtggtgggcatcaagtacagcttagggactgcggccacgcccgtcttgaaactaagcgatgtcgctgctggaatggttaattatcaccggagtatcgtggtgacgttacgcaatactgcagcagtgatgataccacgggttaccatgaagacgacggtcacagccaaagatagtggcaaaaccgtcgtaaaggcgaccaaacaaggcgtgatgttggcacctaatacgacgtttaattacccattgttactcaacaaacagaagcttcaagcggggacgtatcatttacacttggttgcgcacaatagcgctcataagtggacttttgaccgcgatttcaagattagtgctgccacggctaagacgtataaccaggatacggttgatgataacggcatcagtatctggtggttgattggtctgggcgcactgggcatgttgattgtagtcttactgattttgtggttagtgcttttcttgaagaagcggcggcaatcccaagactaacagcaatcggctcggtgtttagtttggggccgctaagcgtcatgaacaattagtagctgggcaaaaaagggggactgacaaatgatgcgatggctgttgatacggggcttactgggcttactgggcttattaatcggcctaggaccatccatcgggggagctgctcagacggtgggcacttcgtcgacacaaatacagttctatacgtcacgttcagcggacaaacaaacgcctacgacggtgcaacaaattccgcagggcgacgttgtgtacgcaacgaaggctgtcaaagccgcgcccaatcgctttgtcggtcagtggcaacaggtactagcaacgggccgtttgccccaaaccggggtccaagcgaatcactattatcagtggctcgggttcctgaccttaatggcactcttattagggtggcaggtgcttaagttaatgcgtgaaaggggggcgaacacgtgaaacgactgcggcatattaagctaggcatgctgttactgagctgcttagcgtttatcagcatgctagcgattacgagtcaggcagcggcgcccgtgacgtctgcgacaacgacaatcgctaattcgagtaataagtactacacttactttaatagcggtgatgtcgttgggttcaatatctcgggtggaattgggatatatccaagcttaaccaaagtgacggccaactatgcggatcagggacgtatatcgactaagactaccacaataacgttgacctttagtggttcgttgtttgcgaatagttcggagattaaaacgctatattacgatgtcttttataagcaagcaaccgaagaatttggaacttcactagtgaccaagactccgacaaatatggcgactggttctagtacggtatcgatgaatactagcaagactttgacagtcgatatgagtaagttaaaggataatttgccagtatatattgggtttcgattaactacagtaaagggtgagacatccacgtaccgcttggcagtgtttaatcggattagccttaatacgacgctgaatacgccaacaacgacggataccactctgacaggaactgggattgccggtaataccgtcagcacgacaattaatggtaagtcgtacacggcgacaatcggtagtgatggtaaatatgaaattaagttaaatgatggcctcagtggggtcacttcagtcacagtaacgcagacgggagaagccgattatggcgaatctgaatcggtgactaaggacgtgacgataccaccgctgacaatcaaaagtagcagcacagcggtgaatttgtccgtgagtgatctagcggcgttaacgtctgatagcgatgctgttaattggttagttaagcaggctggcgtggttgcgacgaatcctagtaatgctaatgatacgatgacttatcatgcgagtgagagcggtctggtcgcgttattcaaggggctcgctgataatcagagtaccacggtccacatctatgcgacgagcgccagcggcttaacatctgataaaattgcactacaagtaactaagttagcagggacgctgtcgtttggtcaattaacgaccaatatgagcttcggcgatttaaaggtgccgttgacaccacaagtctatcaaccgactaatccactagccatcagtgtgactgatacccgggcgaccggggctaagtggtatttgtacgttagtgccacgccgctgacatcgacaacggtcagtggacggacgttgaagggcgatttggtttaccgtgatggtagtgcacagaccgtcttaacgaatcaagcgacgttggtccaacagggacaaaaagtcgcggggacgaccgatacggtagtcactgatgattggtcgacaacgaagggaatcggattatcagcgcaaccaggtatttacgctgatacttatcaaggtaccttgagttggactctgagtgatacgccagataaataagttagcgtgtatcagttgggtgacggggactttgaccagttacacttgaattttttactggttcgcagttgacaagttaggtgtcgtcatggtttactattagctataaattgaaacggaggatgactaatatgtcattagcaactaaccttcaattaaataatcaatttgcctttagctttttctttagatagcgtttgtattcgtttgatggatacaagcgcacgcaacgcgtttgtatctatcgagagctaaagttattcaacatgacttaaacgccaggtagatgcagggacaatctatctggaaaaatatcgggcccgataaaacaccagttagattcttcccagaatctaactggtgttttttgttttcagtccggttcatcaagacgttgatgaacgttgggcgaaccagacaatttttaaggagcgtttcaagatgaaaaaaacaactttaggggtattaattttaggtgctgggttactattagctggttgtggcaaacaagcaacgagtggtcagcaaagcgtgtcggtgggcatcttacaggtggttcaacatggttcactagaccaagcgcgcaaggggttcaaagccggattacaaaaagaattaaaagcgcataacagtaaagtaacggtcaagtatcactatctaaatgcacagggtgatcagagtaatttgaatacaatgagccaacaactcgtccaacagaaaaatgatttgttagttggcatcgcaacgccagctgctcaggcattagccaagaaaacgacgacggtgccgaccttggttacggccgtaactgatttgaaagcggcgggattggtgaaaagtgatacgaagccccaaactaatgtgagcggcacgagcgatttaatgcccgtcggcaaacaattacagttattgaagaatatgagtacaggtaataaaccgttggggattatgtataactcgtcagaagaaaattcagtgctacaagtcaagttggcgaaggcttacgcgaaaaagcacggtatcaacttaaaggtcgttagcgcaacgagtactaatgacgttgccagtgttttggccggtttgacgggtaagatatctggcctttacttaccaaccgataatttgatggcgagtgcgatgaagacgattggtcagaagaccaaggctgcaaagctaccagtggtaacgggttcgattgaaatggctgaagatggcgggaccgcgacgtatggtcttaactattacgaattaggtgaacagactggaaaaatggcttaccaagtcttaatcaagaagcagaagccgcaaacaatggcggttcaaacagctgacaagttacacctctacgtcaataaagcgaatgctaaggcaatcggcttacaaccaagtacaatcaagcaaccataagaggggagcgaggtaatatgttaatcacgagtattggacaaggtttattatgggcgccactggtcatcggggtgttcctcactttcagaattttaaacatccctgatttgaccaccgagggtagttttccattaggggctgccgtgacgattagtagcatgttggccggacagtcagctatcgtggcgagtttattaggatttgtcgccggatgtttggccggctgggtcacgggggtattagatactaagcttaaaatgccgtcattattggccggaattctgacgatgacgggactatattccatcaacatgcacattatgggcaaagcgaatattcccttgcttgaccagaaaacgttgatgggctggttaccagcgagttggtctttgaatttacaaactatcgtgattggtgcgatggtcacgctggtcgtcctggccgggttgatctggttgtttcagacgcgtttgggactgtctttgatggcaacgggtaataatcctgcgatgagtgctgcgaatggaatctataccgatcggatggtcattattggctatatgttatctaacggtttgattgctttatcgggtggtctgattgcacagagtaacggctacgcggatattgggatgggcattgggacgattgtcatcgggctggcttcagtgctagttggtgaaatcttcttacatggtcgtcaaatctgggtccgtttgactggaatggtcgtgggcgccattatctatcgttacttattgactttggcaatgggtttaggtttccccgtcaatgacttaaagattttatcagcggcgattcttgttatcgtcatctgcttgccactattacaaaataaataccggacaaaacggcagttacaccggtaccttaaagagattggagtcgatcaacatgccacaaccaactattctgaacgtccaacacttacaaaaagtcttctttcccggaaccagcaacgagcggcacgtcttaaaggacgtaaatctaacgattgagcctggcgaatttgtggcggttattgggaacaatggcgccggtaagtcgaccttgctcaatacgattgcgggaacactgaactctgatgctggcgaaatcacacttgctgatcatcgtgtgaccaatcgtcccgttgcgtatcggtcacggtgggtggcccgggtgttccaagatcctaagttgggtaccgctggcgaactaagtgtggcccagaatctcacgttagcccaacgtcatacggggagcttgagtctgcgccgttatcgccaacgtggacaggaagaacgatacttaaggttgctggctagtcttaatatggggttagaagcgcgactgaatacgcaagtgaagtatttatccggggggcaacggcaagccctatccttactgatggccaccttgagccaaccagagctgttgttgctggatgagcatacagcggcgcttgacccgaagacgagtgcggaagtgatggcactgacccaacaaatcgtgacggccaatcatctgacaacgatgatgattacgcataagatgagcgacgcgttggcgtatggcaaccggctggtgatggtgcaggatgggcaaatcaagttggacgtgcgtggtgccgagaagcaagcattgcggacggatgacttggtgacgatgttcgcagctgaggtgtgaggctgtcgttgtaaaaaacgacttgcaacggccgatgatcaattagcaggtcattatcttacttaacgaatttcgcaatcaaataaatgatcagtcctaaactgatgagaccaccgatgatagatataatgaaaattaaatcgccaaaatacattggttttcctttctagcttagcgcatgctgagcaataccaaaatataattattgtaggttcggttagtcaccgcttcgtgcaaatcatgattaaggcgtgctgttagtttagattgcagttcatcaacacgtgttcgtccgacttccgaggctaggtgacaatcgttttagcataccatattagtttcgtggcgataatattcatatgacgtataattctggaaagatcagttaattgaataatccataattgccggtaaacgttgctaaatggcaaatgagttacgttaaggaaaatttaaggaattgtccggcgatttgattatcgaaaacagccccctgcgtatcaaatacgtagggggctgttcatataattggcgcatgtaacaagttatttcgtcgtgaccaacataatctcatcactgactttgacttggttagtcaacatcttgaatttcatcaaattgacagcatccatgttagtgatgataaccatcatggttgtggccttaccagcagccttaatcgctgccaggtcagctttggcaactacttcgccatggtgaacgggttgatcggtttggactagtacttcaaagggagcaccgttcaactcaacggtatcaatacccatatgcagcagaatttctaaccctgaatcggttttaaaaccgattgcatgcttggtaggaaagacggtgctgaccgtcccgtcgaccggcgccgtaatcgtcccgtctgcgggatcaattgcgaagccatcgcccagcatcttcttagcaaatgtgtcgtcgtcgacgttttcaatatctacgtactgaccgttagcgacgctgtaaaagtcggtggtcacaccactagtgatattagtcgcagttggtgctgtcgcaacagcttcattgctagtcgtggtcttagtaatgggtgcgttcgtgagctttaagtggctcaacgcgtcggcgacgaattggacttcggtcccaataatgatttgtagattatggtcgtctaatttgttaataccagcagcaccactgtgtttgatagcggcttcattaatggttgacgtatcggctaattgcaatcggagacgggtcgtgcagttatcgacaaccgttaaattatcggcaccaccgagcgcagcgtaaatttgcttggcttgacgtgtgtatttgtcatcatccgcatcagtggcgatggctaaatcatcggcgtcatcggctgtcactggttcgcggcccggtgtcatcaaatggaacttcttgattgcgaagtcaaagccaaagtagtaaatgacggctagaaccaatccttgtaagattaacattaaaggttgattagcaatcgggtttttaaggcttaaaatgtagtcaactaacccggcggagaaggcaaaaccggctgtccagtgcatgaaggcagcaaaggctagcgataaaccagtgaagattgcgtgtaaaacatagagtggccaagctacgaacataaatgagaactctaatggttcggtcacaccggtaaagaaggacgcaaacgcaccggccatcatcagggatgccgtttcaactttacgttctggtagcgcattgcggtaaatcgcgtaggccccagctggtaaaccaaacatcatgactgggaagaaaccagcttggtacatcccagtcacacccttgatccccttgtgtgctaagaatttaccaatatcattgatgccagcaacgtcaaaccagaaaacggagttgagtgcttggtgcaacccagttggaatcaataggcggttgaagaagccatagagaccggccccaacggcaccgagacccacgatgaatttgccaaaggtaactaacgcatcatagacgggcggccaaacaatgagaagcgcgacgctgactaataacatggtcagcgcggctaagattgggactagacgtttaccactgaaaaatgaaagagccatcggtagtttggtctcgtggaagcgattgtaaagagctgcggcaatcagaccagagatgatcccaatgaagacgttgccaatttgaccaaacgctggattaacagtggctaccttgatattcaagagtgtggcgaccgattctggttttaaaacgttagttggtaattcaaaggcaactaaaccagcaagagcggctgcgccatctttatcttttgacataccgagtgccaaaccaactgcaaagagtagtggtaattggctcagaacagcgttaccaccggcttgtaagaagtgtgcgacgatgtcgttactagcagatgcccaccagttaccaattcccacaagtaaagctgctgcgggtagaacggcaacgggtaattgcagtgaacggcccatacgttgcaaataattcttcatgtacaaaatccccctaaaaagatagttttgaataagtgcaatcattattgtacggtgctgaaagcgctattacaaccgctttttattggtatagtccattggtttaataagattaacagtacaattgggagtggtctaatataaatacaaatacggaactacaagtccgacaagcataagtaatactggtataaacgatgaccccaggtaatgagcataaaaaataaatattggtcggaataataggtgctaatgatagcgatttcaaaataattgtgaaaacaaatacaaaatcagttataataagattgattaatgaatttgttacttttaaaaaaggagttgtttaggatgccaacaaccatgactactaatattaaaaataatgattttaaagacgtggtgtttaaccgccaatcagtacggcagtttgatccgactgtcaaaattgagcgtgaagaattgcaaacgattattgatgagacaatcagcgcaccatcagcatgcaacttgcaatcctggcattttgtggttgccgatagtgcggacggtaaggcaaaggcgaagtcggttttaatgccatttaattatccacaaattgattcttgttcagccatgatttttgtcctgggcgatacgcaatcgcatttggtctatcgggacgtgtggaataaagcttgtgaagaaggacgcattaccccggaaaagcgggatcaaatcttcaagacgttcttaccaatgtatgaaaatgcgagtccagaatttctacaagctgatgcgatgattgatagtagtatggccgcaatgcaattactattgattgcccgcgcacatggctatgatgctaatccaattgcgggttatgcggcagataaagtcgcgacgacctttggcttggatgccaagcgctatgtaccagtgatggctattgcacttggcaaggcagctagcgaaccaatcacgacaacgcgttacgctggcacgcaggttaccgaattcatttaattgagttaaccttttgatatctcaaaccttgatttaatagggcttgagatattttttgaacttttggttagaattttagttagtttttgttgtatttatctaactatcgtgctaacataagcatcattcaaatcaaggaggacaaaaattcatgacagttaataatcgtgatttatttagtagttttgggaagttatttcaaaatcgggccttcgtcatggcggttgcgcaacaatttcattttggcgaccatggttctgagcgtagcgggcgtggtcaaatgggcattttacgggtattggcggatgcacccgctggtttaaccaatgctgagattgctgagatcttagatattcggccgagttcagtcagcgccacattgaaccgtttggaagatggcggcttgatcgaacgtgaacctagtgctcatgacaaacgcgtggtcatcgtgcggttaagtgaccgtggtcgtgagatggcggaccatcgcgcgcaaggaacgagtgatctggcggatcagttatttggtaatctgacggatgatgagcgcgatcagttacaacatttattagataagttgcgggccaatgcggatgacatcgatattcaagatttaatgcaatttggtcaacaacacggttttggcccacgtcccggttggggtcatgggcatcattggtttaattaaattttagaaacacgaggcataagagcagatggaacgaccacaagcagcatactcgcgtccagcgggtggtaaatttgatttaaaacaattcttacaattgattcggcacgctagccctcgttattggcaactctggttgggcttggcattaggcttattggcgactggtgcgcagttgatggtgcccaagtttgcccaaacgttgattaatgggtttagtcacggcgttaatcagaccttactaattggtgtgattggcttattcttgatcagtgcagtcattagcgcgttatcaggttccttattggggatttttggtgaaaatgttgtcgctaatttacgggggactttatggcataaattagtccggctcccggttcgctactttgacaacgttaagacgggtgagatgacgtcgcggttggtgaatgattcgacgcagatcaaagacttgctcgctaacgcatttccacaagtcgtgacgtcactgatgcaactggttggggccatcgcaatcatggtcttaatggactggcgaatgaccttgattatggtcttggcgattccagttgtcttattagtcatgtttccaatcatgcggcagacgggcaagattggtcatgaacgccaagatgctttagctaattttagcgggacggcagaagaaacgctgagtgagattcgcttagtgaaatcgtccaatgctgaaccagtggaaacaacgactggtgcacatcagattaagacgttgtatcgaattggactacgcgaagccatttatgattccatctcaagtccagtgatgacggcaacgatgatggcgttattcgttggggtactattgtatgcgtctgcgcgggttgccagtggaacgatgacgatggggactttggtctcatttctaatgtatctgttccaaatcattggcccagctgggatgcttggtcagttcttcaccacgttagcaaaggccagtggctcgacggcccggattcgggagttgttgaatgaaccagaagaacaattgacggttggtgttgaacacgcagtcgccaatgagactttggcgatgcaccatgttgactttgcctatgatgatgatcaacaaattttacacgatgtcagttttgaagctaaaccaaatacggtggtggcgtttgcgggaccgtctggtggtggtaagtcgactatctttggccttctggaacgttattatcaaccaactgctggtgaaattagtattggcgggcaagatgttaatgaactaagtctcaatagttggcggtcacaaatcgggtatgtcagtcaggactcggcaatcatggccggtacgattcgtcaaaacttaacgtacggtgctgatcggttatactccgacaatgagttgtggcacgtcttagaattagcttccgcggctgactttgtacgcgccatggcagatggccttgagacgcaagttggcgaacgtggggttaaagtcagtggtggtcaacggcaacggttagccattgcccgggcctttctacgggaccccaagattctaatgctcgatgaagccactgctagtctggattctgaatcagaagcgatggtacaacaagccctcggcgaattaatgaagggccggacgaccctagtgatcgcccatcggctgagtacaatcgtggatgcggatcagatttacttcattgaagatgggcatgtgagtggttcaggtacgcatcaagagctaatggcgaacgtcccactctatcgggattacgttaaaattcaatttaaagattaactaaaaacagttggttaccatgacgtgggcacgtggcaatcaactgtttttgttgtctagtatcggtcagaaaagcataatttgatgaaatatgtcgggatggattgttattataaaagaatatacattttctgaattaaacgctatcattgttatgataactagtttaattgataaaggaatgataaaacgatgcagtcattaggagttattgatattggtggaacgaccattaagtttgccgtgtggcaagatcagcaattagttgctaagaccaaagttacgacgcccacaacgctagctgaattttacactttgctaaccacgcaggtcgcgcagatgaaacgcgattatcaaattgctggtgtaggcattagttcgcccggggctgtcaacaaggcaactggaattattgagggtgccagcgcactgccgtatattcataattttaggattcagccggaattacaacgacgttttgaattaccggtcagtatggaaaatgacgccaattgtgcggcgttggctgaattggcggatggggctgggaaacaggttgctagcctgtgcttcttaattgtgggaaccggtgttggtgggtcggtcattgtgaatcatcaaatttggcacggcgcgcacttattcggtggtgagtttggattcacgctcatgaatgaccatcagatcttaagtgagttaggcaccgcggtagctgttgcaaagcggtacaacgcgagccatccagctcaacctgagctagacgggcaagccgtgtttgaactggctgtcaagggtgatactgatgctcaagccgaagttcaagttatggttcgggccttagcgcgggccatctacaacttacaatacagctttgacccggaattgatcgtgatgggcggggcggtctcaaataatccgcacctactcccagcaatcaatgctgaaattgaaaaattgcgggcaacggtcaaaattgcttctataaaaccagatgttgtggcttgtcatttcaccgatgaagctaatttacggggagcggtcgttgacttttgtcagacgtatctggacattcaaaaataaaagtctgaaaagtcgatggcaagcaagttattcgcattccaacgccaacttacttagaatagtcataatgattataaattctaagtaaggaagtatggactgatggtaatgcgtgatctaaatattggcacgaaagtcgggttaggcgtgctcaatgaccggtgggccgcgttagtactgatcaacctgaaggcggcgccaactgagattatgaatttgcgccagcgagttaggggtcttagcacgcttaaactactgaatgttttagctaaattaaccgaattaggattagttgcgactgcagggaactatcaatttcagttgacgactgcgggcattagttttcaaaagcaactgcatcagttggaagtgtggggcgatcaaatgatcgtggccatgcactgaatataataagtattgactgtcgtgactaaaagctggtcgtaatccacaattatgggattatgaccagtttttagtttggtttctagttattatcggccccaagcggacgatcggaaaagagatggtaagctgcggtgtagcggctctgaacgataatgttggcaaccacttcaggtggctccggatgggccttggtcagccagtgctgaataattgccagcacgccactaaagtagattggcatggcgtagtcagccggaatcgactggaaatattgatgatttaagggcgcctgctcagtagtggcgagtaaattatcaatgagaccggcctgaaactgatcaagaaactgtggatcaccatgggggccaagcaaggcctgaaaactagctaattgggtgttgatattcgttgttaattccagataggttggataagcattccgcgggtcaggatgaaccaaggcagcttgaatcccttggttaaggacttgctttgaaacggttgcttgttcgattaaagcatgttcgaaagcgtgaatgaagtcgtaaatatcttgaaagtgactgtaaaaactcccacgactaacgtgggctgctttgacgaccatggtgacagtcaatttaaagatgggtgtcgctgtcagtagtgttgggacagttgcgaacattttctgtacggcaagcggatagttagttgtcatcatgtcacctcctgtaaatggtcaatttgacatcaattgtacatttccaacgcactcgtttggtcttagactatggttattctaaaaaacgaggtgcagctaatgtcaaaaattgattttcatacccactatttaccaacgagttacgttgaggcactaaagcgtcatgttccaggtgatcctgatggctggccgacacctgagtggacaccacagcttacgcttaactttatgcgtgataatgatattagttactcgattttatcgctatcatccccacacgtgaacttcggtgataaggcggaaaccatacgcttagttgaagcggctaacgacgatggtaaaagcttggcccagcaatatccagatcaattaggatacttggcgagtctaccaatcccttatgaactggatgctgtcaaaacggtgcaacaggctttggaccaggatggtgctttaggcgtcacagtgccaaccaactcacgtggactttactttggatcaccagtcttggaacgggtctaccaagaactagatgctcgccaagcgattgtggctttgcatccaaatgaaccagcaatcttgcctaaaaacgttgatattgatttaccagtgccattgttgggattcttcatggataccacgatgacgtttattaatatgttgaaatatcatttctttgaaaaatatcctaatatcaaggtgattataccgcatgctggtgcttttttgggaattgttgatgatcgaatcgcacaatatgctcagaaggtttatcaagtggatgtttacgatgtgatgcgccacgtttattttgatgtagctggagccgtgctaccaaggcagttgccaactttaatgagcttggctcagcctgagcacctactttacgggagtgatattccatatacgccgttagatggctcgcggcaattaggtcacgctttaacaacgactgatctattaacaaatgagcagaaacaagcgatcttttacgataacgcccatcgcttactgactgagtaagtgatgttaggataactgttgaatttttgacgtgaccaatattaaaaaccggaacacctgttaattactggtgttccggcttttttacgttattgttagcataattagttgggctaatctgctgtacgggtaatgcaagtaatcagaaccctcgtctaaaaataaagtggctatggtgttgctgttttagccattgtctgaccgactgttgcggtatattcacgttcaccaagactgttgggatgtaaattatctttgacaaaccagttgtcgttgtcttgcgcaacgtatagccaatcaatgagatgcacattgttatattttttagcggccgcggcaatcaattgattgttagggtcttgccaatctttgcctggaacgcgggtgttgacccagtaaatctggtggttgctgccaatctgatcaatgatcccatcgatttcggcggcactcgttggaccgttcgtccccaagttgatcagcacgtttttctgaattgcattatcagcttttaattggctaatgacggctggtgcttccgacacttggcgaccaaccttggcgttaacgttaaaatggtcaaagatttgttttaagtcactcgtggtgcggaccatgattgaatcaccgatccccgtcactttaagtttgcgcaggacgtgaatttcactagtggataattgatatttttcaccaagggcactatccgaaacggcgtgtgtagcgcccttagttttagtattccccgtaatggcgttgccaatactgacaacctgttgcttaatggttggtgttggaatgattaatgcgccaccaatgaagacgacagcaaagattccgaccaaccaataaattaatttttgatgtttcatttggcacctccataccccgctataagattagcttaccaccattacagtgtcaattatgaaatttatcataaggtgcttaaagtggtgtgatggcaggtttgtcagtcggactgtctaagttgaatttgaaaagaccattggaaagttaattggtgcttgttagactaaggctagtgcttttggaggtggttaaatgcaaaagaaaacggtgggactgttattagccagtgccgggccttttttgtggggaagctcgggaacggtggcacaacatctatttgacaccacaacgatttcgccgttgtggttagtggcggtgcggatgctagtatctggaggtctgttaattttatatggatttagtcgccggttaccggtcatggccgtgtttcatgactggcgggcaacggtgcgtctgattgtgttcagcctgttcgggatggctggcgttcaattgacttattttatggcaatcagtactggtaatgcggcgatggccgcaattttgcaattcttgtcaccggtgatgattattatctttatcaccgccacgacttggcagcttccagggaaagtggatgtcatttctgtggtctccgcaatcgctgggacggttctaatcgtcacggaggggcacactgactcgctggctttgccagtaattgcaattatctggggattgttggccgcggttggtgcaaccatctacacattaatgccaacaaaattattaaaagtgtatggcgccacacccattgttggttggtcaatgctgattggtggtggcttggtgctagtcggaacaggtgcttggcaccattcgccacagctaacctgggtggcgtgggggcaagtcggcttcgtcgtgatttttggcacgatgctggcctacttgttctttttacagagcttggaatacatcctaccaacgactgctagtgttctgggagctattgaacccctagcagcaaccattttaagcgtcttatttttgcacgttcactttaactgggtcggactgattggggcgataatgattgtcggggtaactattttgcaatttgcagcgacacgcgccaatcagtttgtctctaagtgagcattgattggtatagatggggaccaaacaatatatgaacatattaatcgttttattcacaaattctattgaaaatccatcttgctagcgtatacttttcgatgaaggatattatgttacgagggggatttttttatgaagttaagtaagcggggactattctggctacttgggttagtaagttttgcaattttactactatttagtcagccactaggggcccaagccgcaactaattatcatgcgaaggattacacaactgccgcatcggtcatcaatggtcctgattttaagcacgctgataccattcaaattcagtatcaaatgagttttggggatacggctttcaaagctggggacacagtcactattgatatgccagctaatttggaaccacggaccgttggggctacttttgatgtgactgatgctgtgactggtactgtgattggtacgggtgtcgtcggcggggatggtcaggtcgtactgaccatgaattcggcgattgaaggtaaaactaatgtaaagattgatgttaacctgggaatgaagtaccgttatgatgacttaggggaacaagacgttgtgtttgatacccaagacggtcaagatacatcagtgatcaatatggttgctaatgaagctaatatgtctaaaaaaggcaccattgataaagaaaatggcacgattaagtggaccttacttgttgatcggcgtgaaattaccatgaaaaacttatcgattgccgataccattggtgatcatcagcaaatgatcaaaggtattgaagtctacaatggtgaatggtcgagtgccaacacttacaagcggcgtgataagcttagtgacgatgcttatcaagttaactacagcgataatggttttgacttgaaattcaacgatacagtcagcaacctagttgtcatcgattactatactaaaattacggatacagaattaattgatcaaaattatcattttaaaaataaagctgtaatggaatggggcggcggtacgtccggtggcaagaacagcgaagaagctaacggtaaggtctacgaaaaagtcgttaacggtgggagcggtactggcgacttaagttccagctcgagttcgaacagttctagctcaaataattcgagcgacgtcgattccagttccgaccattctagctcagaaagttcaagcgctgtggactccagttccgacgattctagctcaaataattcgagcgacgtcgattccagttccgaccattctagttcggaaagctcgagcgctgtggactccagttccgaccactctagttcggaaagttcaagcgctgtggactccagttccgaccattctagctcagaaagttcgagcgctgtggattccagttccgaccattctagttcggaaagttcgagcgctgtggactccagttccgaccactctagttcggaaagttcgagcgctgtggactccagttccgaccactccggttctgaaagctcgagtgatgtaaatactagttctgagagttctgacaatacgactacggaaccagacaatggccatcagactggtgacattgaagatcccgaagataatacggcggtttatccagatatcgatgaagatactgggaccatcgatgttgatggtgggttcgatagtaactacgatgggagtacgacttccaacagtactaattcgtcaaaaccattgaaagattcaacttcgagtgtctttacgagtacgcccgctaacacaacgacgggccaagatggtgctgatcaaacgccagcagcggatactaaaaagtctagtgctaagacaacggtatctgaaagtgacgcgttgaccccatcaacgcctaaccaagttgctaaattgccacaaactaacgaagctaagatggacagtcaagcgcttcgttcagtcggcattttgttaggtgtattaacgctaggtgccggtgcacttatccgtcattggttttaaggctaactgatagccctaaaatgatgcacatataatgttattttttaaaacggccttctgttaattcagaaagccgtttttagttagcggtcatttaatagctaacttgaaatagttagattagttagcaatggcgaccatggtcgttagaagggctcactggttaacgcacggcaacattagtttacgacgggttcacaagcggctgctgactacgttaatcgttattagtcgcaattggcataactggttgcgcaattcgatttgattttaactggataatgggggtaaagtaacgaatagatagaaatggaggtcacaagatgagtaaccgattgatttttgatgctgactggctggtgccggaacaggtccaagttgccgggcaggctattcaatattatgctgcccgtaatattcagtacgttcagcatccagtcgcagcgattcaggtcctaaacgtttttgtaccagccgcatacttgcatggcagttcagtcaatggttatcagcgggcaacggcgccaattctgatgccgaatacggtcggcggttatttgccaggaccggcggatgatccgcaacgtgtcacttggccgacgaatgcagggacgattcaacaggcacttaaacgcggttacgttgtggtggccgctggaattcgcggtcgtacgacggttgataagtctgggcaacgggtcgggcaagcgccggcttttatcgtagatatgaaggcggcaatccgttacgttaagtataatcagggccggctgccaggtgacgcgaaccggatcatcacgaatggaacgagtgctgggggtgccacttcggctttagcgggtgcgagtggcaattcggcttattttgaaccagccttaactgcgctcggggcagcaccggcgactgacgatatctttgcggtgtcagcttactgcccgattcataatctggaacacgcagacatggcctacgagtggcagtttaatggtattaatgactggcaccgttatcagcctgttgcggggacgaccaagaatgggcgaccaaaatttgaaccggttagtggtcagctcacagttgaagaacaggccctttcgttggcgttaaaagcccagttcagtacttacttgaaccagttgaaactcacggccagtgacgggacgcacttgacgcttaatgaggcgggaatgggttcatttcgtgatgttgttcgccaattattgatatcatctgctcagacggcattcgatcaagggacggatattcataagtacgcaggctttgccgttactggaaatcaggtgacggacttggatttatcagcttatttgaagtcgttaactcgcatgaaagccgtcccggcgtttgaccaattagatttgacgagtccagagaataatttatttggcgatgcaacggcgaaagccaagcactttacggccttggcacagacgcgaagtacggtgactgcacaactagcggacgctgagctgattcaggcgattaatccgctcagttacttaacgacaacttcgtcacaagttgctaagcactggcggattcgccacggtgcggccgaccgagatacgagttttgcaatcccgattattctagcaataatgttagaaaatcatggttatggcattgattttgcgctaccgtgggatattccccacagtggtgactatgatttaggcgatttattttcctggattgatggcttgtgccaatgatttgaatacgatgagtgaaagcgaccagcgagggcatcgtgcctggctggtcttttcgtttagttggcaacgataatgtgatgaaaatacgttgacaattttcaaaacacgtggttaaatgtagctattctcatttttatctaatcatattcttattaatttaaatggaggcctacatatggaagcaactacgaccgcggctaccgcgacacataagatgagtaccatggattacgtttataaagtttcggcaggtgtttctaatgctattttagtttgtttagggattggattgttattgcagtcactcgcgaattttgttcactggacggcattataccaagtcggtgcgattgcgcaagtgttattgggaccggcatttggagtcgcgattgccacgatgctcaacagcaacacgttagttacgtttagcgccatgatttcgtcgacgatcggggcgaacgctgtctttttctctcagtccgcaactaacggcgtcacagcgacggggcatacgttggcccaagcagctcagagctcgatttttaccaccggtcaaccgatttcggccgttgcggctgggttagtcgcggttctgatcggtaattatttaactggtaagacgccgcttgatatgatgttggtcccgttagcggccacttttgtcggtgcggtggttggtctcgggttagcagccgtaacgacgcccgcgttggtctggctgagcaagttcatcgcgacttcaatgaaggtcaacccgttgatcggttcgatggccgtttcacttgcctgggcgttatttttaatgacacctgcgtcttcggccgcattggcggtggcggtcatgttagatcccgtctcatcgggtgcggccttaattggaacaaccgcccagttcgtgggctttacgattatgtcttttcgccaaaataacttgggggccaatatcgcgcaggggattatcacgcctaaagtccaatttccaaacttgctggtgaatccacggttagcgattccaccaatggttgctgcggttattgccgccccggtggcgacgattgcctttcatttttcaaccagttacaagctggccggcttaggattgaattcgttaattgcaccgatttcgttagcatcgacgaactttaacagttttatggtctatctcttgactggggtgctgatgccagcagttatttcaatcgtgctgtaccgaattctagttgcggcaaagtgggtcgaatcgcagcagctacagttggaaatcgtttgatgtccagccgatattaagagcctgtttctatgactgatgtgaaggtcatggaaacaggttttttgtatagtgttagctgtttgttcaggatagggtgagtgctcaggactatgaaatgggacgtaaatccactatattaaaggtatgaataatgaataagtgagatgacatcgatggaatttaagattaaacgggatgggctggcgttacaggcaaggttggagactccggcggcaccgagctcaacgctagtcatcttaatgcatgggtttacggccgatatgggatatgatacgacccaatttgtgccgcaattggcgcaagcattagttgctcacggcttggcagttctgcgttttgacttcaatggtcatggctgtagtgaaggtcggtttcaagatatgacagtgattaatgagattgcggacgctaaagcagttttagatgaagcgttgaccttacattatgaccacattgtcttggcagggcattcgcaaggcggggtggtagccagcatgttagcaggatattatccagacgtggtcgacaaactgatcttgatggcgccggccgcaacgttaaagtccgatgcgcaacaaggtgttctacaaggtgcgacctatgatccacaacatattccggcctatttgaatattcgtgatggccttaaagttggtggcttttatttgcggaccgcgcaacagttgccgatttatgaggtagctcagcagtatgccggttcggtgacattgattcacgttacggccgacacggtggtctcgccacaggcttctgaaaagtatcatgaggtctatcagcacagtcagttgcattgggttcaggacggtggccatcgctttagcggcgatgcgcgcgctaccgcgatccaattagcactggccgcgtttaaatgatgacttacgccaattaatataatgttaggttagttaacgttggtgagtttaaaggcggtgcggataaattagtttaatgttcaatgaaaataaccttaatcttttaccggaagacgcctatactaagagtagttagttttctgaaagtaaggtgtgcaacgtgaaaagtgaagtacagggaatcattcaagatttatatcaagaattagcaccaactgcggcgaatcaagaaattcgggcagcactattgaaggcacaccaacaattgaaacaggcgccccagcttgatcatgcgctaattaagcggttaacgaatgacgtgacttataatatttttactaaacagttgcgcttgacgccaactgaaaacttattggttagtgagttactatcggtcagtcatcggttgagtgcgtaatggctgaaccagcgactcattttggaggtgggacgatgcgccgaatcatcgcaatcgggaaagcactagtgacggccggatggttaataacgattattctggtgggttacggtgttagccgtcagctcaagcggacactattcgagtagcaccctgttatcggttacaaattaatttgctcaatctaatgaatataaaaaacctcgtaaattaacgtattatcataagcgttaatttacgaggctttatttgtgataccttcgaacaactagtattgactaccgaacaagttaccaatttgattggcaaagtcagttgcgtgactgagaagtgcagtctgtaaatcctgcagaataattttatccataaagtagaacagcaggctaacgactagaaccgcaataagggctaggtagacgcggctaattaatggttgggtcaccgacttgttaatgacgaagatcaaacctaattgccagacaaggacactgacactcaacaggataatcgaccatctgaagctagccgcaatggtaaagaagttatcaacactgaagttaactagggacgaagcaaaccataataataggttcacaataattgcgtaattggttaactgaccgaagcgtttcatataggtcgtaaagccgactttggtcccacgactgccaagtaagcaagtgacatagccgacagccaggtagaagcacatgccgattaggagacataagaaaatctttaagtcggtggaaaaagctaatttactaatatggaaatagctttgactgtcattggcagtggtcagaaacttattgctaatggttacagcggccaacgtcatgaatagtgcttcaatgacaaaggaaatgtaactaaaataactttcagttcggacttcacagctaggatttttccagctagccaagagccaactaaaataattcttagcagatgattgcagctgttggacttgttggttagtagccgtccgtgtcgtatcagcagctgctgaacgtgatgctgcttgtttttcagcgctggccgattgttgttgattggctgaagctgtgctggtatggacagctgcttgcgtcgttgcagtcgttgtttgggtagctgtggctgaagtggcgttggccgttgccgaggccggtgtcgctttggttagatcgtaaccacagtgggtacagaactttgcattggcagcaatctcagtgccgcagttgggacattttttcataagttaaattctccttcattaatcatcagaatcatcggatttagtgtacgaccgaattttttgggccggcgtgattttaacaatcttgtagtgccccccggttttctcgaccgtcgcggtgtaacgaaagacctgaatgcgttcatcttcagagttggtaaagtcatatttgacgtcataagtgatctggctttgttgcttagctgctggaaccgttgataagacagtcggttcataggtgacatcgaggacgtcatcattgtcgtagtagcccttcgccatttggaccagttctttgtagtcagtgttatcggtaccgttgacgaagtagtcgtccaaagtgcggtcatcgtaatccgaagcatccgataggtcaccggtggacgtataactgctgacagcggtgaagataccgttcaggtagtccgaggcagtatctttactcatcacaccagcaaatttgaggtccacgtcttgaccctcagcgtcactaacgttagtctgtttggcagtcaatgtttgtgaaccggctttgtatttaccagtcaacatcatgcgattagaccagggaatatcattcagcgccagtgtgccactgctgttaatcgttccttcattttcgccattgatataaacggtggtattcggtgtaccattaacggtgaaggaaattgtacgtaaatctaagtcgtaagtttggccgtttgcccggaggtaataggtgcccttattggtaatctgatggccgctaaccgttcccttggcagtcaaggtgtatgaaccaggaacatacggcccgattttatgctcgtaagttgctttattagatgttgcgacgtgcttaccattaacgctgagtgcaacgttacggtggttcgtcgccagtgtggcataaacggaagtgacttgtagttgatacttatcgaaaaacaaccagtctttaccggttttaacgaactggataccgtaatcattagtcgcagaacgacttttaagcgaactagccagtgatgctaatgattttcgattgtttttaaagtaagtgaccatcggcttgacgctatcatttgtaatcttgagtgatgggtcagtgctagttacttgcttcgctaaaccttttccagtcttgagtgcggttaagtcacggtcgagctgattgagcggttgataataattctgtccatacagatagccgccaatcagaatgacaacgataacggcaatcagaccccaaccccaagttggcatatggcgttggggttgttgtcgaaccttgcgcgtcgaacttgttgttgactgcgcggtgtttactgatggcgatggctgatcagtggttgcgtgcaacttaaaaccgcaattaggacaaaattcatccgttgcggccaccgcttgcccacagttaggacaaaacgatgcttggccgcgacgatcgtcagcggctttaaaaaattggtgctgtttatacattccccgatgctcctccaaaaatagattgattagtcgacaataaaaaactatttactggagtcttcacagtaaatagccgctactatcaatcgagttaaaattctgaataagacgtgtcacttgaatatgaataataagtgctaatcgatgaataaggctattgatgactaatcatcgttaataacttaagaaagtctaaaaattattaacatattttaaagtataaacatgattaaactgtttatcaatgtttacacggcgtatttatttagtaatgccccagtttgcacaataaacgacatgtcacgcattaaaaatacgactcggctaaatgctgtgccggttcgttagtcatgaattatgattgaaacgtgctgatttccaaagtcaaaagcagccagcttaggcccgctggaaaaagttcgagttagcgtaaaattgcttagttggcgcgtcttacgccgacttccaggcatttctgccaattgctggaacgcggtggacacagatttaagccgcaacccacgtcttaaatactggtcttccactaaccaagccaaggacgcttgctaagtggaatttcaccgctgagcattggctgaaacgccttccagtcggaacagtgttcgaatggcggacatgtgcgtacccaacttttggtgaattcgtcattgtttttcataaacaataactttgtcaatcaactgtcagggtgaaaatgatattgagatagctcactaatcctgaattggtgtagtgagatttaagctcttgacagagggcttaatacacctaatgctttgtttaatcaaaatagccaacgacaaattgtaccgagttcggtggtcgttcattagccattcgagcgacttcccgaccggaggggctgggtggacaatgctcagtagccaaattattcttagtcggaagtggggtacttccggcttagaataagactcgtatttgagatgacgcgggttgggcgttagctcaaatcgacgtcggctacgttccagcaattgtcacccagccccggaggtcggaataggacgcgcaccggctgacgaataacaatctaaacttggcacgtttcaatcataattaatacataacaatcatcgacctaatgcgtttagttgtattattccattcacgaataacatatctgcgcaatccgaattgaacccgcttacgagtggccgtatgatggtcttgtaaactttaagggagatgaatgaaatggcagaacaaccatgggatttgcgtcgcgtgcttgatgagatcaaggatgatccaaagaactatcatgaaactgacgtcgaagttgatccaaatgcggaactttctggtgtttatcggtatatcggtgctggtgggaccgttcaacggccaacgcaagagggtccagcaatgatgtttaacaacgttaaggggtttcctgatacgcgggtcttgactggattgatggcgagtcgccggcgcgttggtaagatgttccaccacgattatcagacgttagggcaatacttgaacgaagcagtctctaatccagtggcgccagaaacggttgctgaagcggatgcgccagctcacgatgtcgtttataaagcgacggatgaaggctttgatattcgtaagttagtggcagcaccaacgaatacgccccaagatgctggaccatatattacggtcggtgtggtgtttggctcaagcatggacaagtctaagagtgatgtgacgattcaccgaatggtccttgaagataaggataagttagggatttatatcatgcctggcggtcggcacattggtgcgtttgcggaagagtatgagaaagctaacaagccaatgccaattacaattaatattggtttggatccagccattacgattggtgcaactttcgaaccaccgaccacgccattcggttataacgaattaggtgttgctggtgcgattcggaaccaagctgttcaattagttgacggggtgaccgtcgatgaaaaggcgattgcgcgttctgaatatacgcttgaggggtacattatgcctaacgaacgtattcaggaagatatcaatacgcatacgggcaaggcgatgcctgaattcccgggttatgatggtgacgccaacccagctttacaagtgattaaggtgacggcggtgactcatcggaagaatgccatcatgcaaagcgtgattggaccatccgaagaacatgtcagcatggcgggaattccaactgaagctagtatcttacaattggttaaccgtgccattcctggtaaagtgacgaatgtttataatccgccggctggtggcggtaagttgatgaccatcatgcagattcacaaggataatgaagcggatgaaggaattcaacggcaagctgccttgcttgcgttctcagcctttaaggaattgaagactgttatcctggttgatgaagatgttgatatttttgatatgaatgatgtgatttggacgatgaatacccgtttccaagccgatcaggacttgatggtcttatcaggcatgcggaatcatccgttggacccatcggaacgcccacaatatgatccaaagtcgattcgtttccgtgggatgagttctaaactagtgattgatggcaccgtaccattcgatatgaaggaccaatttgaacgggcccaattcatgaaagtggctgactgggagaagtatttgaagtaacgtcatccattgcacttgatgagcgtatttttatcgcattgaaccaaaatttaatcttacaaagagccgccagaccaacggaagtgtgctggtcggggggctttttgctgtcaaaattgaagggagcatgtagctcgtgaacaagaaaacgattggctttttcagcggaatcgccgtatttgccattatttacttcttgccgattgccggcttgtcagctaagggtcagatggacttggcacttagtttgatgacggtcgtctggtgggccacccaaatcgcgcaacccgcgttcgttggtgggatttacttaatgttgctcattattatgaacgtggcgacaccgtcacaggtcttctcgtcggcgtggactggttcaattatgtggctcgtgattggggcgtacttgattgcgggagcggttaatgaatctggtttgggtcaacgcatcgcgtacgcattcattatcaagtttgtgcggagttggaaagggattgtgatttcgatttttgccctgacctttatcctcgcactcctgattccccatccatggcctcgggcgttcatgattatgtccgtcattacggtggtcgcggaaacggcgaagatgcccaaacgcgatttggctaagctaggcctcgctgtctttgctgcgtcctgtccactatccggggtcttttatactggtgacacgtcactaaatccgttggcagtacaggcctctggtcaaagcgtcaactttgtctcttactttatctacatgggcgtgcccatgatcattgcggccatcttaaccatgtttctgttcttattcctcttcaagcctagtcaggaagtccacatcgatgtggaagcgttaaagcaacaacaagcccagttgggtggtatgacggggaaggaagttcgaacaattatttggctgatcattgcgattgcactctggttaacgagtgggatcaccggtttggacgttggttggttgacgttgatcgttgcgctgatgatgagtctcccggtagttggcgggatcttgacggccaaatcatgggaaggtgttcccgtgaacgtgctcgtgttcttgacttcggcaatcgcaatcgggaatgtcggtggtgtgactggcatgaataattggattgcgaagaccttgattccaagcaacttgccaactaatatttatttattagcgattgtgattactgtttttgccatgattatccacatgttcatgggttctgtcattgcggtgatggggattacgattccggccttcgtagcggccacggctcatatgggaatttcacccttggccgtatcgttactagtcttctcggtgacaaacttgcattatattttaccgttccacaacctcgctgtcttagttggaagcgaccccgatactggtgggggttacacacaaaaagacgtgatgcggttaggaatcccactgacggcggttgtctttgtcgttgcgttagttgagatgttctggttccacctcgttgggttggcataagcggataagtttaaaaaatacccttttcaaacggccggttggtcggatggaaagggtgttttttaaacttgttgattttcctgggcagtcaccgtcaagtagtcaattaagtcggtgagtaactggttccccgttcgctggggatatacaaagttcagttgactgatgaacgggatggcgagtgagcgcatgaccacgtgttcagtcatgaacggaagtaccgattgtttaaataagaaagtcacgttattttgattgagaatgcccaggagcgtttcaatatgcgtactttcaaagaagaattggggcgtcatgccttgctgagcaaagagtgcgttgatcggttcgtaaacaccggagcccggtggtaacgttgcaattttctgccgcgctaagtcttgaatccgaatgactggctgggtagctagggggtgatcacgcggtaaaataattttgagttcgtcagcgagtagtggttgtttttgaaattcggtgggttgcaattgggtcgtctgagtatcgcgaatgatggccgcttgcagctcaccactcagtaaccgtttgacgatttggtcgccctcatcctcgatgattttgatttcagtatcaggatgctgagtatcaaaagtggcgatctttttggcaatgttatattgacctgagattggaatggcgccaatgatgagcttggcaaatgtcgttggccgattcggtgccaaatcgtgcatcatggtctcatagtctgtaatcattttatgcgcatgatgatagaacgtttcaccagctggcgtgatttgtagacggcgcttgttgtgtgtatctagtagtttaatgttcagttcgttctcaagggctcgcattcgtttggacaattccgattgtgataagtggagttctacggcagcgttagaaatgtggcgtaaatcgtacaccatcacgaatgcttggaggtcattaatggtcatagcagtcacacttttctttaggttaaattctattctaacaccgatggcgaggcccgcctaattaagtaacggtataaattagtatcaatattgtgaggccgctacggtaatcgaaatattagttattttttttattgagaatgggtcactaataaaatcatggtgcgggttaacatttgttagcggtgatgattattcgttaccgtttaattgtggatggggactcgtgttgagggaggcagtaatgacatctagatataattattttggtgatgtggatgaaagttgttgagtggttggtgattacaaatacgctgaatcactagctttccttgcttttgaaattgaatccggcaaaatgaaatagttccagcagtttcatattgatcatcatgctggtcatggctgggcaatactttttaaaaggggattagtttagtatgtcaaaagcgcttaagatagtgatgggaatcaccatgttaacagggggcatcatggcccagaaaatgacggtacatgcagccgaatctaacactcgaaccggtcaggcagtaaggatgaatggcacggtcagtttagcaagtcaggtcgaaaataacccagctgttaaggcggcccactaccaggtaacgcaagcggtgcaagcattaaccatggctactacggcagtcaaaacggctatgagtgatctgcaagcggcgcaaaccacgttagacgctgccaacaaaacgttagccaagaatcaaaagattcagacgcatatgggcgtacttaagcaagcagccactgaccggcacgtcaaggcaacgaaagcacttgatgaacaattggcaactaaaaagacaagccaaactgcggtaacgacggcgcaagcggcagtgactaagtcacaagctgctgttcaagtagcccagagcaacttcgataaggataacagtgcggccaacaaagtcacgttacaaactactcaggcaaagctgaaaacggtgcaagagacgttaacagcggcacaagctaaccttgataagactaatgagcacgtgatgatggcagaagaagaattagccaacgccaaaattgaagtcagtggcacgagccgcgacttccaaatggcacaaagagattatgatattgttcagccccaagcagcagttaatcaggcgaaagcagcggtgacaggtaagttgcagcgcgttgcgggtactcaagatcaggtcgttactgcacagcgggaattgtcccaagctcaagctggattaacgaccgtgcgcgcccggaccttggcaaccttaacagcagcggccgaaaagccaatgactgaaaaacctgtgggcgaacgaccagtcgttagtcattcaactggcacgtcaaccagcactaatcagtcggcggcaccacaagcgaccccggccaagcccactcttaatcagtcaagttcagcttccgtcccaacagcgcagcgggttgttacgacgcagccacgacaagccacaacggtattgcggacgacgacgagtccggcaatggctaagccagtgacccagcagacggtgccaacgaccgcaactaaaacggccacgttaccacagactggtgaacaaaccaatcgagttttgaccgtattgggcttcgtattattggccgcaactagcttatttggttttagcaagcaacaacggcgccataaaacaactgattaattaacaagtgtgtgggcacaattcgatttctcaatgattatttcgaagtgcaagactagtccaatcggttactttagtctgagcgactaagttgacggcggaattaatggcgatttaaaaaagttctttcggagttttagttgttcctgaaagaacttttttgctgggaatgattggtatcgtttagttaataataatatgctaagaacgccagtttttcggccggaaatacttgcttgaaagtagctgctggactactataaacatggtttcaaagagcccaagaattttactaaataaggagttgagtttgtgatgatgatgacgggaatgatggttctatttgtattgttagttggtttagttttaagtgggattttcttccgatatatggatacaactgccggtatctcattcagctcactgaagttcgctgatttgcggatggaattgttaaacttggtactcgttattggactattgctgtgggcactggttttaattcgttaaagcgacaattaaacttatcaacttagctattattgcgagtccggttaacgccggacttttattttggcttgtgattgacgaattatatcagtgcggccgccaaaatacttgcgcttcaacgtggaacaccgctattatggataagtgattattatctagaagggaatgaataactatgacgcagtcgccatattggcaacggatcgcggccaaagctcaggccgcccagcgaccgttttttagtttagcaccgatggaagccgtgaccggctccgtttttcgccgggtcgtgatgcgcgctgcggcccccgatgtcttttatactgaatttacgaatgcgttaagcattacccacccgaaggctaagtttacaacgcggggacgactatatgttgatgaggccgagtcgccccgaccaatcgttcaactttggggcaatagtggtgaggactttacgaaagcggcccatgaagtgaagaatcaaggttatcaagccattgatcttaatatgggctgcccagatatggcggtcattaaaaatcatagtggtagtgatttaatccgacattttgatcgtgccaaagaagtgattgagggcgcacgtcaagcagagcttcccgttagtgttaagacgcggttgggctttgacgatgtgcatgagtacgagacttggattccatttttgttgcaacagcaggttcccgtgttaacggttcacgtgcgcacgaagatggagatgagcaaggtaccagcgcattatgagttaattgataatttagttcaaatgcgtgatactttggcaccagcgacgctattacaaattaacggggatatcctggattatcaggctggtctgaagcttgccaaagcccatccaggagtcgatggtatcatgattggccgcggtatttttcagaacccatacgcttttgaaccgattccccagcctcattcaacgcgtgacatgctagaattgttacggtatcaagtagatctgtatgatcaatttattggcttaggtctacaagggcatttcgcaccgcttcaacgcttctttaagatttatgttcgcggtatgcgtcatgcggccgaattgcgcaatgaattaatgcagacgaagacaacggatgatgtccgtgcgattattgatcgcttagaggctaagctaccagcggattaggtcgcgttattttaactaaaacggctatatttttgccatttagctgtgcttgattaaaatggttttaatgtcgaacgtaccgcatctaaagtcaactgcaaattaaatgctagcctgtaagtggaccataaaataagctaggtccttcaagaagttaatttcttggaggacctagcttattttgtggtctaaattattgtaaaccggtcatcgagtaaggtaacttgttcaggtgataagccaacgatttgaagctcacgctgtttagtcacaaaaatggcgccgtaaatatcgggtcgctgagttgcccaatcgggaatcggttggcccgcaaagaagagccgcgtcgtttcgatttcaccatcaatggaagctttcgagaaaacggtgacactttcaaggtcgttttgtcggggataacccgtttgcgaatctaagatgtggtggtaggactggccgttaaattcaaggtgccgctcgtaaataccgctggtcacggccgagcaggggccaatcgtaacgctggcaatcgcgttaccgcggtcagtggtgggatcttggataccaacgcgccattgcccatccggatgaagtggggacgtccccaccattaacagattaccacctaggttgatcattccggcccgctgtccaaatgcttcccagtaatcttgaatgcggtcggcaatgtagcccttggcaattgcgcctagatccagctccattcccgtgaccttgagaagcacactgaaatcagcgtcattacaaatgacggcttcggggtcgatcaaggccaatcgttcgttaattgcagactgttcagggacgtgcgcgttagtaaaaccaatgtgccagagtttcacgagcggaccaatcaacgcattgaaaccaaaatgttgtcgactgagttcgacagcttgccgaacgagtgtataggtggcggcactcacttgaacggggtgttggcccgccgcctggttgattgccatgacctcagaaacagtccggttgacagtcaagcggtcttcatattggtcgataagatcgcaagcagcttgtaggtactggtcactatcactaccaaaaagggtcaaatcaatgtcggtaccgagcgcgtgatgagcttggtgtcgacgctgctgagcgagtgcaggaattgctgtctcgccattataagctaaagttgtcataaaaccagtcctatctttcataaatatcaacgagttcagcaaactgaacatttattcccgctcagttagaagtaggcacaattaaatcagtttccctgcacagtgatctaattcgtgttgaataatttgtgctgtgaagtcgttgaatcgttgttgttgcggtttaaagtgttgatctttatatttcaccgtgatttggtgatagcggctagtcggacgttcaccaggtaaggacaggcagccttccttagtctcgtaagtgccgtgatgatcaatgatcttcggattgatcattgcaattgcaaagggaccgagttgcacgacaataatttgtttgttgaccccaatcatattcgcggccattccaacgcaattatcggtgtgtgcggcgagggtatccagtaaatcagtcaagacttgagtgtctgcaggggttgctaagtcagcagggacactaagcgcggcgggatcatgcacaattggtcgaatcatttgatgttcctccattgattagtcatattaatttaattatagagagcacggttgacagaagcaagccgttcgctagttgtcaggccctaaaaaacacaccacactcacacaagtcaacgtgcaaatgtggtgtggccttcaattagtacgacaatttaaatgttggcgttaaggtgcccgcctttaaggcgtcattagttgtggtgggaacctggttgtgttcaggctgccaatttggatctttaatcagtgcgatattagtcccttgataattcatggtcatttgattagcgtcgttgagggtcagttttgcaacattgtgatcgattgtgaacgtggcacgtgtatcacttaacgttaacgttgcgcgactacgaatgggcgtatgtccgcgtcggaaccaagcaacttgatgattggtactgaggtacagactcattgctggtctagcgctgacccagcgacctaagaaatcccgagtcgtgactgagcgaacggcgctgacttttgatgttgctggttgaacggtgggcgtttgtgtgtcagtggcagaatggcatcctgtcagtagccctgtcaacaacaagccaacgattattcccctgcttttttgcataattattctctcctccaatgtccacatccctcaatgaggacttaatttcattatagcgaatccgccgcatgagttaaacaaaatagtcataagttaatcagtttacaacaacttggttgtgttcagcttaatttttaacgaattaaaattcggtttatggcgtgtgaaaaatattgaaagcaagccgtatcaaggttggttcggtagttaacgagattgattaaatattctgatattagataaaaaacagtataaaaaatattttttaaatattccaaagacgcactaaccggacgattaaagcgatttggtgtacacaactgaaggtgacagttaattttggcaatgggcaagttaatggaaatgagctactatatatagtattgattcaaacagaacgcactatcaattgtattcaatcaatgactttgaaaagtggggaattaagatgctaacaacgacaactaacgatatattagaccaattacggccactgaccgtcacaaagcggggtggcgcacaaacgaaatttcatccgtataaaattgactttgtcttacgacggttgttagcgactgatgacgaggtacgggtcgtcaagcaggcccttgttgcccagtatcaagatgctgacaacattgatactcgggagctacgtagtaccatgatgcagattttgaatgcgcaaggcctgaccgcggcagctaaggcatatcaggattactttgaagctgaacagcagcggtttgcggcagcaactaatgttcaaggacggattgaaaagttgtttgagcgcgatgccagcgttgtgcatgaaaatgcaaataaggatagtacgatttttaacacgcaacgcgacttagaagccggtgctgcaagtcgcgccatgggcttgaagatgctaccagatgtcgtggctaaggcgcatctgcgtggcgatatccattggcatgatctcgattattcaccagtcacgcctgaaacgaactgttgcttgattgattttgacggcatgttcaaaaatgggtataagattgggaacgccgaagttgcctcaccccggtcgattcaaacggccacagcgcaaatggcgcagatcattgccaacgtggcttcattacagtatggtggctgttccgctaaccgggtcgaccaattattggctccctatgcggcaatcaactatcaaaaacatatgactgatgcgaaaaagtgggtccctgctgatcagcgggaagcttatgcgaaagccaaaactaaaaaagatatctatgacgcgatgcaagcccttgagtatgaaatcaatacgttatattcgtcacagggccagacgccgtttaccacggtcaattttggtctaggaactagttggattgaacgagaaattcaaaaggcgattctccagattcgaatcaagggactcggtaaggagcaccgaactgcgatttttcctaaattgatcttcacgatgaagcgggggttaaatttaagtccgaatgatcccaattatgatattaaaatgctcgcgattgagtgttcgaccaagcggatgtatcccgaccttttaatgtatgacaagatcaaggcattaacggggagttttaagacgccgatggggtgccggtccttcttacaaggttggcgtgatgaaaatggtgtcgaggtaaactcgggccggatgaatttgggcgtggtgacagtcaacctgccacgaatcgcgttagccgcacatggggaccaacagttgttctgggaaatcttcgaggaacggatggcgacttgtcatgaagcactcgcgtaccgtatcgaacgaacgaaggaagctaagccggaaaatgccccactcttatacatgtatggggcgtttggtaagcggctaccagcaggtggtaatgtcgatgagctcttcaaaaatcagcgggcgactatttcactgggatacattggaatttatgaagtctgcacgaccttctttggtccgaactgggaacaagacgagcacgcgttagcttttgcggagaccgtggtgaaagcgttacgggataagtgtgcgcagtgggcggctgaaagtggctatcattatagtctgtattcaacgccggctgaatcgttgacggatacgttctgtcgtgacgatattgcgaagtttggccggatcgcagatattacggataaggaatattacacgaatagttttcattatgatgtccgtaagcacccgacgcccttcgataaattaactttggaggaacgttttccacaatatgcgtcaggcggctttattcattattgtgaatatcctaatttgactcagaatcctaaagccttggaggccgtctgggactggggctatgatcatgtcggctatttgggaacgaatacgtcgatcgaccagtgttttaagtgtgggtttaagggtgagttcaaggccactgcccgtgggttcgtctgtccagaatgtggcaatcacgaccctaaatactgtgatgttgttaagcggacgtgtgggtatctaggtaacccacaacaacgaccaatggtacatggtcgccacgttgaaatcgcgtcccgtgctaaaaatatgtctccggagatgattaagaatgccgcgcgctacgaaaggaccaaacaatccgatgcccaaagaatggctggcagaggacttaagtgaacaatatgttgctgattataaggcatttaactttgttgatggggaaggggtccgctgtagcttgtacttgagcggctgcccattccactgtccaggctgttataatgtggcggcacaaaattttcattatggacaaccgtattcacaagaattggaagatcagattattgaagaccttgggcaagattatgtgcaagggttgacgttgctaggtggtgaaccgtttctaaatactcaagtcggcattcggatttgtgaacgcattcgctccgaatttggaaacacgaaggatatttggtcgtggtcaggttatacttgggaagaattgcaacaagactctgaggataaactgaagatgctatcattaattgatatcttggtagatgggcgctttttacaagataagatggatctctcgctacaatttcgggggagttccaatcaacgtattatcgacgttcctaagtcgctaacagctggtaaagtcgtcatctgggataagttggttaagtgaaattaagactggtaaaaagagcgttatgacgaggtcgtcacgacgttcttttttgttacggtcaatataacggttacatataacccttaataatttttttaattaaagtctgtaactatgtctcgatattttagttaaaagcggttatactttacaggagttgtcaatttatattgacataaagaaatcattaaaagcgaggcttcatgaatgtatcgtttttttgttcaaccccaagttgatcacagccatcgagctgtttttggttatgaattactgttacgtaaagagatgaatggtcactgggccgttccgaagtcgttcactgaattatcattagataaacaagctgaattattagaacaacttgctagtcaattgcagacgaaagcgactaatcaggtgttagcccttaatttaaaccggcaacaagctgaggacgacctgatgttagggacgatcatttacctaaaaaaaaggttgaatccggccgcgctgacgattgagttgacagaatgtccttcattaaacgagattcaaaaatatagtctctttttccaccaacatgatattaaattaagcattgatgacgtggggacgggctcgaacacgtttgagaatattcgccacgcactaccgtttgttgatcaaatcaagtttgcgatgcaaaacttacggatgagtgggcaagcggagcgcattcctcatgaattagcattttggcgtgatattgctcagtcttaccatctggaatttattctggaaggtgtcgaagaccagggtgatcaaaagatggctgaacaacaaggtattgaatggcaccagggttactattatgggaaaccgcggttagtcgatgatggtcggcaattggtcaacggcggatgctgagaaaggatccttacgatgacatggtctaattggcgaatttcgccgttcgtaacgagtattttctttatattaggtgttctaacactttactgggtcctctttaattggattacgacgtggtttcatgcccgtcacattaacattgacgatgataccgtcaatgcttggcacggtgtgatttacatgttggtctttgtgtttgtcatgcaactgtcggtcgtcggtaaagcagatagttgggagtttgttaactttcacttgattgccgtcgtgttctgctcgttttttttgaatattcgaatgccgtattattcattgttacctgtggtcatagtgtacatggttttcgaccagtcgattttttactgggaatcgtggagttacgccgtcgtgttcgtgctatttttctggagcatgaattatctacggctgtgggtacctaagcatcggtatccttggctatattactatggcgcggtcgctttttacggcggaatcttgtggggcctgatcaagcttaaatattcgctggattgggacaatactttacaagaatatggctacttaatgatttttgcaggattattgtacgcctacgttaatatgctgacccaagatagtgagattaaattacgattggcccagtttgcgagtcacgacgctttgactgagactgagaactttgccgcttacacggaacatatcaaatatttattcgatgatagtgccaagaacaatctcaacttatcgatgatgatgttcgatattgatcactttaagcacgttaatgacacgtacgggcaccttgcaggggaccgcgttttgcaagaagttgccgccacggtcacaacggtcttggccgccaatgacgagaaggtcaagctgtatcgcaccggtggtgaagaattcaatgtcctgtttcccggttatgatctggctagtaccaaagtgattgtccgtcaggtctttgaagcagtcaatcatctcgttgttaagtatgaagacgaggaaatcaatgtgtcgatttcggttggtgtctcgacactgcatcaagccgatggtagtccgattgatttgtacaaccgtgttgatcagaacctctatttttcaaagcggcacgggcggatgcgtgttacggttgaatagtggctgagattaaaaataaataacgttgacttgttgagctcccggaataaaagccggaagctcttttttgctcgcaatcggtctgactgaaattgtaggcctaaccgtcattgcctgattgacgtattggggaaacatgatgtcaaatctacaagattgcttgagtgcgacattggggttatggtggccaatttcagctatttagtagcatcgttcgttaattgagtttacgaattaacgctaacagatgtaaaccttaatcgaaaccgttaattatgctggcattctagtttaattatggtatggtttatgttgtaaagataacagtcaatgacttaaactaattgacttacatattaaagaaaacaagttttttacgttacgtttgttaaggttatttaaatacgaatggttgccaatttataaagtaaggaagtgagaagtgtgccagtggtcattagctcattaattcccgtagttgcgccggttaaacgccaagtgatcaatgtgacgacctttgcaaatacggttcacttatatgggttactaggatttaagcagcaaattataccggcaacggatcaaattgttgcgccctttgctggggttatcacagccgtggcagccaatcaacggttaattggctttcgagcggccaacggtctggtgggctggctacggattggtcaattaaccagtgctttggaatcgcctacatttaagttcaacgttaaaccgggtgactgggtggttgctgggcagatgttggttgaagtgatttcactactgacacaacggctccaaccagttaaaacgacggtggtattgacgattagacatgcggttgttcgtgctcgagaacggttgctggcagcaagtaatcaagtcgatccgatgggaactgttatctcaggtattacgaccagtatggctggtaatcatcgggtcgcaacgatcgggccaccccaaggtaattaattgtttgacaataagcaatcgacgtcctagatacggggtgtgtctagacgtcacgcttcgacgcagcccattgaatgggcagtagtggctgaggtgtgcgttttaataacgcagttaggggcagtgctggacgcatgaacagtactggttcacaaggtcgccgtactaggaggtacgacgtcgctgatgttataaggtattaagattaagtagttgtgggtagcagtaattggtcagcgattaagttttggcagacttataagcacaactgctatcacgggtacgattaattgggtgctaacgtaagtatggttacctagttaattaagtttcgtcggtcaaaggttaggccggtattaccgagatggttgtgggggtataactacttcggcgatcgtttgatgtcgtgttatgttcaagataggtcaattatttggtttaagaacggatcacttgcttttacttggcagtccagtttatcatgacggtaaattgtgaaggagtgattcggcatgaattcagcgacatttaatcaaactgaattagcaaaatataatggtcaggatggtcaacccgcatacgtggcggttgatggtgtcgtttatgatgtaacgggggttgcagcatgggctggcggtaagcatcatggtaatcttgcggggcaagaattaactgcagtcatcgacaccaaatcaccacatggacgtaaagtgttaacgggactgaccgtcgttggtcaatacgtgactaattaaattattgaagactggttgattgtgaccagtctttttttgtgtggataggcggctgttgtgattgcttaaacgagctttcacaccaaaatttttcgtactgcgaggcaagtattgaccaattttaggcggctgtttgtgggtttgagacattgtgtaaaataagtgcgtgatgataatcgatattccaagtaaacgaatagataacaaaaatactaacttatgattagttaagacctgtaatggttgctggcacgtctattgacagtcatccactgtttatataacaatacaaaataaattatataaagagttgaatgttgtatgaaaaagcgtgaaaatagaattgaattaaaggaaagttaataaactatattttaggtgggtaaatgatggagcgaaaacggacgaattttaaaatgtacaaaattggccgtcgctgggcgtttgcatgtgccgttatcttgacgatgggcacaacaacgctggtggctcgggctgatgatggaacgactgcaacggggactgatacggcatcaaccagttcaagcacaaccaaatcagtcacggctaagacacaaactttgaagactgcggccacaactgaagcggatgtgactaaccaaaatcagccggttttagataccgatggttcgaattcaaagactgctgctggcacagtggctggaactaaggcggcaacggatactgatacaaacgctaccaccaatttggatgagacaactagtgccaatactgaaactggttcagatacgacagctggttcaaagacggcaaaagagacgaatgcgacaaccggttcagagtcgacaaaagagacgtcgaccacaactgattctgccactgcaacggctgcgcggacaacaaccagttctaataaaggtgcgactactgactcagctaccagcaatgataccgcggcaacggctgctaaaactaccgatgctagtgctaagattgccggtacgacgactagtgatagtgtagcccagcaaacgacgacaactaaagaccagtcgacgacaactgcaacgccccagaccgtcgcggtggcgcttagtcaagctgtgacccatgcaaacgatgccgttgccgatggtggtaatgtgacggacgattatccggatctacataacatgctcggggtttcgtcccaattccatatttttgcacgggaagcggaactacatgcccatacgaatgggaacgttgcggtgcaaaacttagtgggcaacgttaactttggtacgaacattattgaagaattattagataaagatatttcgtatattcaaaatatcagtaatattgctgggagttcgtttgtttcggctggtgagacgcggagcaataaagttatctttggcgaaaatattgagattgatgtttcgaatcctaatcggccgatggtcaacggggtctatatcgaccatttacttgcctctgaagtttatcaagacaaagatggtaacgtctatattgattttgacaaagagtttgctaagttggaaaaattgagcgctagtcttagcgaagcgtccgcgaacgccacctatacgagtgacagttttgaagatatgaatcagcgggtcatcgatgtgacggatatgcaacctgatgcggatggacacattgtgatcaatctgtcagcggatgttttaaacacgagtacgccgctgacaatcaagggactatcggcagatgcggatggtaatacggtcattattaatgttgatacggcaggtgcgaccaactatcaagttaactcgcagatcaaaatcatttatgatgacggtacggagcggaataataaagaaactgaagactttggtgataaccatttgctttggaacttctatgattcaaccgcgagtgacaagttagcaactggtgtcattagtgtcgaccggccatttcaaggcagtattttagccccagcggcggaaattgatgcaaatcaaaatattgatggcaacatcattgctaataaagtcaacgtgaaggcggagacccatcgttgggatttacaggataatgttgataatgaaaatgatccagaaccagttccggactatgagaaaccggtacatccaagtattgatgccgaattaccagatggtggcgagggcgaagagccagaatacgacaaaccggtacatccaagtatcgacattgaaatgccagatgacggcgagggggaagaaccagaatacgacaaaccggtacatccaagtatcgatatcgagatgccagacgatggcgaagaagaagaaccagaatacgacaaaccggtacatccaagtattgatatcgaaatgccagataatggcgaagaagaagaagagtacgacaaaccagttcatccaagcatcgatgttgaaatgcctgactttgacgagattgaggacgaagaagaagctgaagacgcagaagaagaatttgaagacgatattgaggatgaaatcgaagctggtgtgacgccagacgaagttgtcgaccaaatcgaagaagaagtcgacaatgaaattacagctgactgggtcacggacgaaactgcgactgaattggaaacggcgtttgaggaagttcaaaaagaagcagtggttggcgatcagattaaggatgaggaaacactgatcaacttgattgaccgggcaatcgcacaagctaaagcgcatcataatacggcgttagtagcgcaattacaagctctacgaactaaggtggctagcgcattggcagtggctaaggggcaagcattaccacggactgatgaagcgccaagtcagatgattagtttagcgggaatcgcattagcaagtacattagtattaggtgctgcagcggttagccggcggaagcgtcggtattaagcttaaaattgtattttgaagcaactgttgattcggcaagtttaatcttgcgaatcaacagtttttttgcataaaaaagtcactaaaccaaattggtctagtgacgctcaattctctctactccatgaccgacctaatctcttgaccccaaatgcgccactagtgaaacgtggtataaatgctaacccccattagcatttatgatatttattataaataattcagcacattagtcaacttttattcgaatatatttttaatttatgttgaaacttattcatagataaatttaattcaccgactgaattggtctaaagtaagtaaccataataaaaagctggatggtccggatgaccattcagctaagtaatgttggtaaggtttaattacgaattaattcattgaagttaaattcgttcggaataaagtgggattcagtgtattcaacctggcgtccttcatcgttaaatgcgatgctaatcatattaccgacgcaattattatcaccgagcgctagctgagctttgtcgagttcggtggcggattcgactcgtagcattcttttaacgacagcaattttcagaccattttttttgaagtgttgataaattgagtgttgggcgatggtcttagtcagagtgggagtgcgctgggcgttaaaatagttaatgtccagcactgcccgaataccgtctacgatccgaacccgttgaatagcatacactggaatacccacttcaaaagcggtatgtgtgctaagcggctggtcaacgattcgttgctgaaaggccacgacctcggtctgataatcgaggtggcgctccgcgttgaggctctgcagaccgttgagattatttaaagccagattgaattgctgggtttgtggcgtgtgctccaataagaccaccccgcgccccttaacgctgtaaactaggccgtctttggctagttgtgcgattgccttacgaacagcatagcgactgctatcaaattctgtaattaattcgtcttcaatgggtaatcgcatcttaacgctgtagtgtcccgcgagaatgcggtcctttaaaacgtgatagatgtcgctgaatgtttgtttccccattttaatacccccgctcatcatataattaatttaattatagcaaataatagtcattagcgagtaaataagcgaataaatatcgatatttattcgaataaaaattgacaagcaatcatgtgaccttctataatgaaagcgaaatcaagtcggtaatacgggagtaggagggggaacatatgcaagttgaacagcgcacattaaatactgcggcacacccatttcagatcacggcgtattggttagaccaaattagtgattttgaaacagctgttgattatccaatcatgattatctgcccgggaggtggctttacttatcattctgggcgggaagaagcgccaattgcaacccggatgatggccgccggaatgcatacggtggtcttgaattaccaattaattgtgggagatcagtccgtctatccttgggcgttgcagcaattaggtgcaacaattgattggattacgacccaggcgtccgcgcaccatgttgattgtcagcggattattcttgccgggttttcggctggcggccacgtggttgcgacttataatggtgttgcgacccaaccagaattgcgcacacggtatcatttggatcattatcaaggccagcatgctgccattattttaggctatccagtcattgatttgacagcggggtttcccacgacttcggcggcgcgtaatcagattaccacggatgcccggttgtgggcagcccagcgcctagtcacaccagctagtaaacccgcttttgtctggcaaacggcgacggatgagttggtcccgccaatcaattcgttaaaatatgtgcaggccatgctacaacatcaggtcgcaactgcgtatcatttatttggtagtgggattcatgggttagcgttagccaatcatgtgacgcaaaaacctggcaaggacaagtatttgaatgaccaggctgcaatatggccacaattagcattgcggtggttacaagaacagggattgttagctggtaattattgaaaataaatctgggcgatcagtcgtgcttcactgatcgcccgttttttgtcaacgatcctgacaccaattaattttctgcggtataataatacgaataagcttattaagtaagaaggagcgattgagatggcaacaaatcaacacttggtcattatttccttagatgcgttagaacgtgtttagaatcttttcaagagtattcgcaggaaggctaagctaatcatcatcttactggtgttcagctttcgctcacaattgcgccagaggcgccgatattttcctagccagctctgcgttcgacaacccagcgttgcggggtcacttgaccgtgcctaagttcactctgttttagcaataataacttcagcgttaatcattgcctgaactgattgagcaaagttgttaccagtataaccaccatcggccatatacgcgtttgaaccaggtcaaacttgtgatttgtttaacgaccagtgcggcattggcgccatcacgcgaatcaaccgaaacattggcggtgtcaccttggactgccatcggacagcccttgatctctacagcagatggcgcttgaatgcccactcacctttttaccccatcgtagccactacttcagcaggatcggtattcttgacacttggagatcctagaaatgatgaacgatgtaaaactgaacgcttctgagccaaccgatgttggctgacaatttttttaaaccttatccagaggagtgataccagaggagatggcgttttagtccaagtaaccagtaataatagacggtttcccattggagaaatcactgggtaaatcgcgccaaacgcacccatttttcaaggtataagcagggcacaaaagatatcaataatcaacctttcttggctttagtccgcttacgtatgccttctagatctgtcggattagttcaaattgtttcacgagagatgtcgctactataatggtgtgcaaagcttttcatggattaaaaactcctgtttttgatctaatttaactaaaatcaaatcgaatgtcaaagtatccaaacacgttcttaggatttcgtgatttacgcgaacatcaagcagaattacccgttctgagtggattgatgaccggtggtacttgggtcaagtcggtgacgggcatttatccaacactgacatatccgtcacataccacgattattacgggacagtatcccagcgtgcatggaatcgttaataatactaagttacaaccgatacgccgttcaccagattggtattggtatcaaaaggacgttcaagtaccaacactatatgatttggcacggcaaaagaagctaacaacagcggcttttttatggccagtgacggctggcagcaagattacatataaccttgccgagatctttcctaaccgtatttggacgaaccaagttctcgtctcgttgaaggcgagttcaccgctcttcttactcgcgatgaatcataagtatgggcatcttcgtaatgggattaagcagccccaactagatgaattcatcacggcttgtgcagtcgatacgttaacgaataagaagccgaacctaacgatgattcacttagtcgacatggatagtatgcgccatcgctatggtgtgcgatccagtgaggccatggcagctttacaccggctagaccggcacgtgggccagttgattgacgcgactaaagctgcgggcacgtttgcggataccaactttgttattttaggtgatcactatcaaatcaatgtggatcacatgattcatttaaatacgttattcgctcagcagggctggttgaccgcacgtcaagatcagacgtttgaagatgactggtccgtgatggcgaagacggcggacggctcaacgtacatttatacgcgaccggaatttgaccagttggatgaattgaaggcattggttagtcaggttgaaggtgttgagaccatcattactggagaggcggctgcacgtcgtggtgcggaccccgcttgtgcgttgatggttgaagcccaggaaggttattattttactgatgaaagtcgacggccaactgtggttgaacccgtccatccagcgacactcggtcaaccagaccgttaccacggggttcatggatatgacccgacgaagcctgactatcaaacgaccctgttattcaatggaccagcagttaaagctggtgggacgattgaagcagctaacttagtcgatgaagcgccgacatttgcgcggttactcggattgagtttcgatggccccatgccgggacattgcctcgatggtattttcaaagactagacaaaaaagagagagaggaaaagcgggcggacatcagcaccactaatattgtggttaatgctcgttccgcctccgattgcgatcagaggttcccgcgaagtaacttaatgaaatttaataaacagcagtggggttggatcttttacgattgggccaactcgggctatggcattattgtcacaacggcggtgctacccgtttactttaaggcagttgcccaaagtagcggtgtgacaccggctaatgcaacggcttactggggttatgccaatagtattgggaccttactagtttcgattttggcgcccgtcctaggtgcactagcagactatccccatgccaagaaacgaatgctcaacatcttttcgatactcggaatggtgatgacgctagggctgagtgttgccccgactagtgcctggaagtggctattaggtatttatattttatcaattatcggttattccggtggtaatctgttttatgacagttttctgactgacgtggcaccaaacgatcagatggatcgattgtcgtcatatggttatgggtttggctatctcggtggtgtcttggcgtttatcttattcttggtcttacaattaaccagtggttttggtcaattatcaagctatggggtcgcgcggtggagttttgtcttagccgctgcgtggtggattatcttttacattcctttgttgaaaaacgttcaccaaaagtacgcgttagcacccagtgcgcatccggtgcgttcaagtttccaacgggtatggtcgactttgaaacacatccggaattatcgcgctgcggcgtggttcttggtggcgtacttcttctacattgatggagtcgacacgatctttacaatggcaacttcgattgggatggatatgggaattacgacgaccacgttgatgattgtcttgctggttgttcagctagtcgcgtttccgttttcactgctttacgggtggttagcgaataaaacgtcgacccggacgggcatcttgcttggcattattatttatttaggtatctgcttgtacgcgttgcggttgaatagtacgacggatttttggattttagccatactagttggaaccagtcagggtgggattcaagcgcttagtcggtcgtacttcggtcgtttgattcctaagactagtgggagtgagtttttcggcttttacaatattctcggtaagttctcagccgtgatgggccccgtcctagttggaatcgtgacccaaatgacggggaagtcaacgattggtgctgcttctttaagtattttatttgttgttggattagtgattttcttggctctaccgcatttgaaccagacaaagtcggtttaagccagggtttgtttaatatcatgcaaaaagaacttcttctaatttggagaagttctttttacgttgatcaagctcagaccatcatgagttataaattcatttccgtattccgctgtaatacataataaatgataaaccaacacaatacgcgctaattataacaatctgaaaggcgtagctatcagtaagccttaggccagttaatcagtatgtgtgattaagaaaaagcctgttcctgtccggcgtaatttattgccaggctagaacaggctttcggtgttaaagatgcttgtgagactgatgcgattggcgataagtctgggcttgcttagtgcgaacgttacgaattgcaaataacgtattatcaatccgggggtgatgatgtgtttctaagacgctgacttcatcaagcaattggttgccaatttgccagtcgccaaagtagagattccagatgccaagccagaattgttggctcaaccgcccatcccagtttaactggtgactgtcgatggcagtgaacttggttttcagattttgagcggattgaaaatcatgaaagttcaatttagtttgaaatagtgatccataaaaatcgagtaagtcgttgctgacgtgaaagggatcgccccaacccgtttgataactggcacaattggcggccatacgggttgtcagtggtgttagtgcggccaagccgtcgatggatgcaataattggaattagaacgggcactaattttagttcctgcagggtccaagtcttggcttggagcaggtgatcaaaagcgggctgggtcgtggttgtcacgccgactgaacgatggtcataggatagcatcaagatgctggcataactggcgatgagttgttcgtaggcgtgggggctgtgtcgatgttcgcgaatccaagtggctagggcgggaaaatttagcgtttcataagcgtgacgaattgtccaaagggcctggtcatatgctgatggctggtagttttggtgtatgaatcgtaactcgtcggctgaaattgctaagttatccagaattgcaaagagtttactggcgccaatatcgttggcaccactctcaaagcgtgaggcgaatgagcgcgagataataccgctatacacttcttgttgagttaagcccttacttaatcgaatctgatgaatagtttctccgatgtttgtcatctagcactccttaatgtggcatatatgcaacctacttgctgattgtaccacggtaatgacgagtaagctaagtccattatcttaatgggagatgggttaatgctgactttattaaaaaatcggaccctccaaacgattgctagtgcaaatttttttacgacgctgggggtgagtttgttcaatatcattttactcacgtacgcaaagaattttccaaatccacattggtttgttgccatcgtttcggtggtgacagttgtgccgtacgttttcgggggattaacggggcgactcgctgatcagacgcgccgaaaaactaactggctgattggtactaaggtcgttcaagcggggttatatctcgtcttggcccaagtgattactcagcaaacggtggttgttttctacgtggtcgttgcgattaattttatttcggatctactaggtcgatatggtggcagtattttgacaattgttattcaagaccggattgatcctgacgatcgccaacaagtgatggggcttaatgcgagcataagtacgcttgttgagccactgggtcaaacactaggggtcttgattatcgcccagtggcatgattatgcgttagctggaatagtgaatgcgttgacttttattggggccgctagctgcttgttggccggacgttcagcgattcagtcgactcccaaagttgctggacgaccacgacatattgaggcctggcccgtgattcagcgagtgatgctgacgacgactagaatgggtgcagtcagttatctgggtattctgatgattttaaacgtcgcaacgatgagcattgatgcgattttgaacttaatgtttattgacttggcgtcccgcatgcccgtgagctattcggtcgcaattttaatgttcaacgtggtctttgttaccggaagcgtattgggtggcattactaaaaatacttggtttgatcggctctcattgtttcaattgttactggcagcgatgctagcgccgatgctgacctatgtgattttactagtcgttccacaactaatcttgattcttgggggcatgtttgcagtgggcttcatgagtggcaaactggacccgaagatgttcgccatcatgatgccacaaattgacccgcacttaacagggacggtctttggtaccatcagttcgattgtgacgttggcggcacccgttggtagcgtcggcatcgttttattatataacttagttggtgcgacggcggcgtgttcggtgatgattggtgtgagtgcgctggcgttgatctgggcagtgatggcgcaccggcagtgattaattgttaatcttttgttattgatatttcaatttggcgttaggatgtggctatcagctttgtgatgacttacgaatggatttagtgaaatgcagtgctcaaaaagacatcttgggacggctgactaactgaaatggtacattaaggaaaaggacgtaagtttcgtccgcttcattggcaccatcgcagcacaacaaaagcgtgtctaacccctagcaagttaactagctgggggttagacacgcttttggattaaatattcgataagagcgttgtgatgaatgaggtcggtcagcagttcattggttaaacgtggaatagggccaaatgcgtcttcaaatattgccctgttacactagttggattttgactaacggctaatggggtaccggtggcgacaatgttaccaccgttgataccgcccgcgggtcccatatcgataacgtaatcagcgttggcgattacgtcgagatcgtgttcgatggcaatgacggttgccccttgctgaatcagttggtcaaagactttgacgagttgctgaatgtcgagcgggtgcaaaccgactgaaggctcatcgaagacaaagagcgttcccgtttggcgtttgccaatgcgggaggtgagcttcaggcgctgagcttcgccacccgagagtgccggcgtactttcacctaatagtaagtagcctagtcccatatcatgcagaatctggagtgtattagcgatggcggattgcgctttgaaaattggtagtgcctcgtcaaccgcgagatctaaaatatccgcaatcgaatagccatgccatttgacggtcagcgtctgtttattgtagcgcttgccgtggcattgggggcagacttcggtgatgtctggcaggtattgcacatctaaagagatttggcccgtaccaccacaagttgggcaagcacccgcagcgacgttatatgaaaattggctagcggtccaaccgtttgcttgtgctgctggggtggcggcgaataattggcgtagatggtcgagaatgttggtataagtggcgaccgttgaccgtacattcttaccaacgggcactgagtcgacggtaacaacgtgccgaatgtgaccattgtcaaaggccttaacgtgggttgggagtggtcgctttttagctgtggcaatcagtgctggaatcaaactatctagtaccagagtcgttttaccagcgccgctcatacccgtgacggtcgtgaaacggtttttgggaatgcgcgccgtaatgtcttggatgttaaagtgatgagccacttcaatagcaagggccccctttttccagagcgcatcgtcggttaatacggggcgttcacgcagcgtggcagtaccggtgagaaatggcgcaattaaggactctttgtcctgcttgatggctgcgacagtgccttgtccgacaacggtaccgccgtgcttaccagcccccggaccaatctcaataacatcatcagctgcactgataatactagtgtcgtggtcaaccaccacgacggaatttccttgggcgactagcccgcggaaagctttgattaggcccgccacgttagctggatgaagtccaacggaaggttcatcaaggacatataacacgccagtcgtggcgctacgcaaagtgcgtccaagctgaatgcgttgtaattcaccagttgacagggtcgcgccggggcgactgagtgtgaggtagtcgagtccaagttcttccatgggttgcaggctgagtagcaattcatcaacaagggattgtccaagatgatgcatcttagtaggtagccacgggacaatcgtggccgcaaaatcatgcaaggcggcgacagtcatatcactaaccgtcgcaatgttttgaccatttaattcgtagttaaacaactgaggattgaagcgtgatccgtgacaatctggacaagtatcaaacttgtaaaagcgattcagccgagtaattgcccgttcatttttggtcgtcgccatactatcttcaacggcggcaaaggcgttctcgtagacagcgttgtccatgtgaaagattttacctttagcgcttggaatgttgatggcaacggtttgcttaggaccatgtaatacgcgtgctttatcggcttcactaaggtctttatatggaatgtcgatgggaatcccaatttcgcgcgcaacgatcggcataaagttacgtccaggtaggtgccaagaagcaacggccccttcttcgatagtttgattttcatccgcaataatgagtgccgggtcaatttggcgaacttggcctaggccaccgcaagtcggacaggccccacctgaattgaaggcgaaatcttcggcgccgggcgctctgaatttggcgccacaagtcggacaggtgacgtaaccatcattttcagccacatcgagcgttggtggcatgcggtgaccattggggcaaactgctgagctgagtcgtgagaaggctagccttaagatatttaagctttcagacatggtgccgacggttgaacggacgccgggaacctgggggcgttggcgtagcgctaatgcagatggtaagtattgtactgaatcaacactggctttgccgacctgattgattcggcggcgggtaaaggttgacagggcgtttaagtagcggcgggccccctcagcgtacaggacgcccattgcgagtgatgacttaccggacccactgcgaccagtaatcgcaacaaattcgttgagtggaatgtcgatatcgatattttttaaattattgacgtgtgcgcctcgcacttgaatgtgagtcggtaacgtggtttgtggcatgactaaaacccctttcgtgtcactttatatgctacaacaaaaggacggctttgcctaagaaagcggtggcagtatctcgcgccccacgaccgggggagtatgataaactagggctaacgattattggagggggcgatggtgagatgtcgaagaagcgacgattaagttggctgagcgtgctcggactattggcaggattttgttggtggtttagcttagcaatgcgcgcggctgcggattatgatattgaccaatatcaagtcaatgtagccattcaacgtgatggtagtgcgaatgtaacgcaagcgatgacttatcaatttgatgatgattatcacggggtatttaatgttcaagatttgaaaggtattcagggggcccagttggaaggggtcacgacgcaactgaatggtgggaccacggtgacggcggcgccaagtgaaacgggggccaacaacacgtatcagttgacccaaaatgctgaccggatgcgtgtcaagctctaccggcaagttcaagaagatgataagttacgggttgtctatcggtatcggcttaaaggggtcgtaacgaactatgcagacacggccgaactgaattggaaagtgattggtagtggctgggatgtaccactgaataatgtcaaaatcgtgattcagttacctgccaagaatgtgagcgcgttacaagcctggacgcacggaccgttgagtggtcagacaaaagttgagcgcgcggcaggccgggtgacgatgacgttgggacataatcccgcgaaccaattcgttgaaagtcacctactatttccaaccacggtcacggcgacgaatacgcggacgaatactgccaagcgaaaagcgacggtccaaaaacaagaagctaagttggcacaggaagctaatgaaaaacggcgacgtaatcagttactgcgtcgcgttatctttggtgccgcggtggctggttggttattggtcatgattggctatctttggtggctggctcgtcatccggctaagccacatcagcagccgattcccatcaatcattcatttgacgtgccaccagtaacaccagcagttgctgagtcattgtgggcacagcggtcgccgaatacggatgctttaacggctgagattttgcgagcagcagctaatcaagaaataacgattgaaacggttgcgggtcaccgaaaaccggatgtgcggttaacgcaattgaaaccagtgactaactcatttttggctcactgttttgataaaatcgcggttgacgggcagttcatgttaacggatctcaaaaaatacgggaagcgtgataaagctggtcggttgggcaaatggtttagccgctggcagaccgaagtagaccaagacgtggcggtctatcaagacgaaactaattatcggcttcgtaatcaatggctgatggcagcagttgtcgtgagtgttatggggatgattgccacgggtgctgggttattagttagtccgaaggtcgtgaccctgatggtgattccagcggtagtggccgcggtggctttctggattggctggataattcaacggcggcggattgccatcaatactgacgcaggcttggaattacgtaatcaaatcaatggactacgccgcatgcttaaggatattgggcactttaatacggcccaagtcggtgatttgattttgtgggaacaaatcttgccatacgccgcggcttttggactagccaatcaagtgactaagcaattggcgattgattttggtacggaagcattggctacggggatgctcgtgtattacccactcttctatgcgaatggtgggctggacttcgatttgtccggtgcaatcaacgatagttttagtggcgccttagatgcctctggaagcgctagttcggcgtcgggtggttcaggaggcttctccggcggtagttctggtggctttggcggtggctccggtggtggtgccttctaacaaagtatcagaaaagacttgtactttgcgggcataatcggtaggctaaggggtagaaaaggcttacatgaaatggatgattagtaatgacgattaaattaatagcaacggatatggatgggacgtttttaaatgatcatggtgattatgaccaggagcggtttgccaacgactatgcggcgctacagcagcgcggtattcagtttgtgattgccagtggtcaccaagcgtcggaactagccacgacctttagtgcttaccctgaaatgtggttgattggaggtaacggcgcggaactgtggcaacgagaagcgggactcaaagctgcgacgttcagtccccaagcaactcagcaagtgttagcggccctggcaccgtatcctgaattacaagtggcattgtgtggcacccaaacggtccatgtgttggcgcacgcgaacccgcagtttgtagctaatatgcgtgactactattaccaattagagacatgtgcggatttaaccacagttactgatccggttgtgaagttcgacgttatttgtcccgcggcaatgacggagcagttagtatatgaacttacccctaagctcgctggcattgccgtacccgcttcaggtggtcagggcagtatggacttgattcagccgggaatgcacaaaggccgcgccctcaaacagcttggtgaacagttgggtattctgccggatgagatgttagtttttggcgacggcaccaatgatcttgagatgtttcactatgcgacccatgcggttgccatgcaaaacgcgcctgaaaatgtccaagccaatgcgacagcggtgacaggtaccaatgtggacaatggtgtattggattatattgaacaacatattttgagttaactttgtgagaccagtattttgctaacttgggttacttggtgtgcgtgatgatcgtcagacggggctttggtcgcgcaagcctgttcactagacatggttaaaactggtgtttacgggtggggttaatttggattgtttatgaaaatgatgagatgctttcagaaaatcacgtatggttttgattgccaaacgagctgaaagcatgctaaaattaaagttatataattaacgacacagaggtctggaaggtttgtttaattccgacctcttttctatcggacaatttcactttaaaaaagaagaggtaatggaatgctcaccgtaaataatgttagtatgcagttttcaacacgtaagctttatgaagatgtcaatttaaaattcacgccgggaaactgctacggcgttattggtgccaatggtgctggtaagtcgacgttcttaaaaatcttggaaggtaaattacaaccgactactgggacggtctcgatggggcctaacgagcggatgtctagcttgaatcaaaatcactttgcttttgaagatgaagaagtgttagcaactgttattcgtggtcacgaaaagttatacgaaatcatgactgaaaaagatgcgttgtatgccaagcctgattttagcgatgaagatgggattcgggctgctgaattagaaggcgaatttgccgaaatggatggctggaacgcagagtcggaagcggaccagttgttacaaaaccttggtatcgatgaatcgatgcaacacttgaagatgagcgagttaactgaaccgcaaaaggtgaaagtcttattaggtcaagcgctgtttggaagccccgacgtgctattactggatgaaccgacgaacgggttggacgtccaatcaattagctggttggaagactttttggctggttacgaaaagacggtcattgtcgtttctcatgaccggcattttctaaatcaagtttgtacccacatgtgtgacgtcgactttggcaagatcacactatttgttgggaattatgatttttgggtggaatctagccagttagcggccaagttgcaagcgaatgccaatgccaagaaagctgaccaaattaaagagttgcaagaattcgtggcgcgattcagtgccaatgcttcgaaatctaagcaagccacctcacggaagaaacaattggagaaaattacgttggatgatatcaaaccatcatcacgtaaatatccgttcattaagttcacgccagaccgtgaaatcggtaatgaccttgtgaaggtcgagaatgtctccaagtcgattgaaggcgttaagattcttgataacattagcttcacgctccgtcccaatgaaaaaacggcgttgatcagccgcaacgatttggcaacgacaacactgatgcaaattattgctgggtcgatggcaccagatagtggcacggtgacctggggacaaacgacttcgcggacttatttgcctaaagatattaatgaagaatacgcgggtagtgaattgccaattattgattggttacgccagtttgcatcgaaagaagaaagtgacaatactttcttgcgaggtttcctgggtaaaatgttgttctctggtagcgatgttgaacgaccagtgaacgtgctatctggtggtgaaaaagtacggggaatgttatcaaagatgatgcttagtcgggctaacgtcttattattagatgatccgaccaaccatttggacctggaatccattaccgcactgaatgatagtctgattgattttaaaggcgccatcgtctttacttctcatgaccatgaatttattcaaacgattgccgaccacattgtcgaagtgagtgcgaaaggcgttgttgatcgtggtgatacgacttatgatgaatacttggcccatgaagcaacacagggccgggtgcaagatctttattagttagtcgtggaatccgataaatctaaacaaaatcacgtgtgagcgtcccccaatctggtatgattaatgcatatcagattgggggatttttttatgacgccggaaaccgaacaattattacgacgctggtacatggggcagctcatcgtgttatttggcgcggcctttattcaactatttacgtttgatggtggtgtgtttttcccagttggtggtatgcagttgctgatatggggactgttagcctggtggccagctgccgaggaggaccaagcacagtggcggcgtttgcgacatgttaattattatgtccaaacagtactgcagttcacactcttgccgattttactggcgaacctcgtggcttggttaagtcagctgtcatggttagacgagcagggattgattgctgtggggatggcttatttaatggtcgcattcgtaccggtggcagtggtggtcactaaaccgatcgaatctgtgattggccggattgcggtcctaattacggctatttttagtggtgtcgtcagtgcgcagcagacttttttgattttaccgaatctgcaagcaccatcagtattcgagatggtcagtgatactggtattttaggcgccctgggctttgtgattgctgttggggtcttactgcggggatggggattgacgggcccatcgtggcggtttaatcgtcaggctcaaactagtttagtggttgggctgatcgtggtgggaacggcttttagtctatggaatgcctttagtgctggtggttcatgggcgacgacattcacacattgggacttccagctacggtcagcgacttggaaaatgtttttgagtgggttagaaccgggaatcgcggaggaatggttgtatcgttttgccgttttaaccttgttattacaagcttttcggcatcggcgttaccagatcgactgggcagtgtggctaagcggtggcctatttggaatgtggcatattacaaacgtttttgcgggccaacccttgtcagccacggttgagcaaatcatttttgcagcgacactaggctggtttttagcctcgacgtacctatactcaggtagtatcttgctgccgatggtgatccatgctgctattgatattttgagcatgatggcatcaggtagccagacaatggttaagccggatgtgttcgaatggcaaacaatcggtgctaccgtcattatttttgttggcataacgatttatttcttgaccggttctcggcgacaagttattcaagtacatgtcaatcaacggctttcagctcaataaaggccgactgttaagaccatagtgggcgactttgttcgttaaagataaactgggtgtccgtagccagagacgattaagcaataccaggctaacttttagttggtttagaccagttgtaacatttttgtaatcttcgtgttatctaaacgcaatgctggctcgctatactaaagacaaagttatgaagcaatacatacgctttgtcagcggatttaggttgggagccggatcgatttactttgtcaggacattgttaataagcaattattgatagtgataagtagctcagttagctgaatcataacgtttgacaagcatttatacctctcgggatgggctgggtccatgacgaggcacatacacaatggcaagcttggggtttgcaagtcgatcagagaaagggacggttggttaccggcccttttattgtggttaaaatttgcgagaattggatttagaactgcgcccgatttgaagcggtaggaactgcgatgctggcacaggtgactttgccaaatcattgagagtggaacgaaataatttacatttgccagtagattattataattaacgaatcaataataatttggagatggcaatttgactcagtttgaaacggaacggttgatattacgaccaatgacagcggcggatcatgatgcgttagcggacatgatttttgatccgcaggttgtcgcttatttacgttaccgacgggttcagagtccggccgcgttcgagcaactgtttacgacgcactttttggcagacacgaccactgtttttggcattgaacgtcgccgtgatcatcaactgattgggttttatgagtttcatggtagtggtgcgactggtgaattgacgtacgctttaagcccagctgcgtgggggcacggttatgttgcggaagccggcaattgtttgatgcattatgggtttgaaacgctgaactatgagaccatcgaggctcactatgcgagtgccaaccctaattctggccgagtgatggctaagatgggcatgcaagcggctggagaactgcacacgtttaccagtgataaaggtgaagtgatccacgtcatgcggtacttactgaccaaagcaacctggcgccaacttagtgcttgacctgaaacgcgtttcagcagctatactaaaattgttgcgacagcttgcaacacacgcttaagacttatgaccaccattctttcagccagaatggtggtttttttagctgtcgttgtccctaagtgagctaaagtcaaggacggccagcttcggttcgctggaaaaggggccgtttaatgtaagtttatatgtccacgaatgtgattgttgttagggtggtttttcgatatagtagacctatgaattgagagggcgtgatcaaatgacggcaacaattacaattcgaccgcttcagcgcgcagaattaacgacgctatggcaactaggttttagtgatccaaatgcggagtggacgcgctggaatggaccgtattttcatgaccaactaccgactcaaacagactttgagacaattattggcccccgtgattggttgattcgaccgcgtaactgggtcatcacacgggatggtgtgattgtcggcagtgttaattggcactttgtggatggttccctcaaacgctggttagaggtaggcatcattatctataatcaggagcattggggtgagcatattgggcgcaccgcgttgactaaatggttgacccacttattccaagaggagacgactttgccgcacattggattgacaacgtggtcggggaatatgcggatgatgcagttagcggaagccgtgggattaaagcaggaggcctggattccacaagttcgttattggcaagggcagtattatgactcggtcaagtatgggattctaaggaacgactggcaagtacaaaaagattaaaagaaaacgtttgttccccttgtaaaagtacggtatgatagaaccgtacttaaaaaagatggggtggaagagaatcatggtgaaattaatgcgacgcgttggcatagcgggtctcttgagtttgagcttgctgttgggtggttgtagcttgttaacgtctggtacggatacgacgagttcgacgactagggtccgtcttaaaactacttaagtaagatgcaaattgaggcaatgtagaccgtagccagataaacatgagcgagcttatcataacgcgttgcaatcctacgaaagttcttcaatgatgaagaagtctcaatcaaatggcgctcacaataaacgtggtaatcacaggtcacacttgtctttggtattttcctttggcgaatggtatagacgcctgcttatcttcaatatatggcgaagtttcgcggtgccataggctttatcgcgataaggttgtgagaaatatcgaagctcttccgcaacctggcactgtggcttcatgtacttgccaacctgttaggcgaaaaccaagggaatcccaatccgtcacgagttcgtgaaatctttggtcgttcgccaccctcgacacttaagtccaatagcttgttttcgaccaacattcggcagttttttttgccccagtggccttgactgcgctcgaaaaacgatcgttgaatctaagcgcacgtttcccatgtcgggtatcgtaatcaattcgagaaaacctcgttcgaacaagcctgcacttacccaggctcgatgcgactataccccgttttccaagaaagccatagcgttgcaggtagatcacgccaaggagccccagctgcgcatggagccagaggatagcgttgagggcggtacggttgtctaggcttgatggacggccacgtccgtatggcgggaagatagtatcctttgattcggtcccactgagcatcttccagttcgtatcgtttaggtgttgtcatcggaatgcctcgattcgtttttcctcagattatacctgaatttttagttttcagacagtccctagtcagcagtctgaatccagtcgtaatcaaacgaccagtgcgactggtaatacgcaacaaacttacaaacaactggcaaaaatgacttatcaatcgggcagtgctgcggccatcaaagttaatagcggtaagagtacgctggcagcgagtcagtggaaaaattctaagattgattacggtaatttagattcattgaatcggacaaccacggacacggcttacttgagcaaggccaatttaggacggtctgaaggacggacggcgcaaacgtggagcccaactggctggcataatcaaccgcttaccgttaatggtaagcgggtctatccgcaaaatcgtgggcacttgattgcttacacgttatcctttaacttgacgtctaatgggcagtatcgcgctggtgaagatggtagcttagataacccgaaaaacttggcaactcagacggcctactcgaatcaaaaaacgatgcagatttatgaagatcaggtgcgtacggcgttagaacaaggtaaaaaagtcatttatcgtgtgacaacggttttccgtggcaacgaattgatgcctcgtggttactggtcgcaagcagtctcaaccgatggcagtgtcaatttcaacgtctatatttggaacgttgaacctggcgttagtttcgactatgctactggtcgtgggaaagcggattcgacgatgcaggttgctggggctgacaaagtcagcagtagtcagaatacgagtgcgagtcgctcgtctcaatcgacgaccactagtaagcaagtcgagcgcgagttggttaagtatggttacaaatatgtgaagaaggcgttgaattaagcggcaagacagtcatctaggtcagcataatgggcacggtcggctgttaaatgtcgttgtttcatacaacaatttaatctaaatgtcctgttttacgacaaaaggttcaaagtaggactagcaaagtttcactgagcgattatactgtagttattcgagttacttaaccgccgttaatttgctgatgtttctgtcattattaacaagtaacgcgatgtcttagatcatggggccttcccaaacacctatgattttccatacaacggctccggctcccaaccggacgttgctatcaatcgttttgattgctagtactaattacccttggagacgtctgactgcgtggtcaggcgtctttttttgcgtcaaatgcgacaaaaataataatttgtcgcgtttgccgacaaagtggatttaggtgttgcaaacggattcaaaaagctttatcattgatacattcgaacattagaatataagaatataggaggctaatcgcatggtcagtagtgaagaagcactgcaagaatttcgagaaacaattccgatctttgaagtcttagccgatgaacggcgtcaacaaatcatgattgaactttcgcaacacgcgcagggcatgactgttggtgaattaactgaacggatgcatatttcgcaaccggccgtttcgcatcaattgaagacgttaaaggaacgacactttgtcgcagttgaacatcaggggacccgtaactattatcgggtgacgtttgacgcgccactaacgcaagttgagcatttgattcacacgcttaaggcggacttggaattgaaaccgtacttgcactaaactgcatgaacaccagcaatcgttgcacggggatgcagcggtgtttttatggcaaatatattcttctattcgaatataagaatttaaaaacggggtgatggtaatttcaattcgtacggagctggatttacagcgggcgatgtaccaattgttggagcaacgttcaatctcacaaattacggttgagcagatctgtaagcaagcatttatacatcgcagtagtttttatcgttattatacggataaatttgatttgctcaggcagatggtgatgcacacgttagatgaactattggctgctgagcgaactgatacggttggttcggcaattatgtcgacgtttatcggggcgcacacgcaagttttacgacatttattagtgacgaacaatgagggtgacaatacccgttctcaacaagtgatcaatgactgttttgtcacggtcgccgagacgggggcggatgatcgggttttcgcgatgattcgccagtcgcagcatcccgatttgacggcgtacttagtcagtggggtcgtcacaagtattgtccagtggctcaataacggtcatcgtgatggtcaggcggccagcacgcaggtgatgattcaggggacgcttgcgacggtgttttcacttgagcaacacacagtttaattatttgaaggaaggtttcaggttgtgaaaatgatacgcgacgaatggcggtcaattcgtcatagcaaaatactatggatttcagtttcagtcatgattttgatcccgtttttatacagcatcttcttcttgaagtcggtgtgggatccatacggggatacgcaaaacttaccagtggctgtcgttaatgaagataagtcagtgaactatcaaggcgaaaagtttgcagttggtaagcaagtcgtgacgaatttaaagaaaaataacgatttggattggcactttgtgtcggctaaaaaagccaagcagggattgaaagaccggaaatattacacggtcgtcacgattcctagcaatttctcaaaaaatgccacaacgatgacggataccaatccgaaaaagatgaacttgcattatgagaccaacgaatcgttgaattatattgctaaggtcattaccgatactggtgtttcacgagttaataagagtattcgggcgcaagtcactaaggcctacgcattagcaatcttcaagcagattcggactgccggtaagggctatcaaaaagccgccgatggggctaccaagcttaaagatggtggcgtcgaactgcaggatggcttgacgacgtatacgacgggtgttcatacgttgaagaacgggacggtcgagcttaaaaccagtgtgacaccgttatcaaatggtgtttccaagttagcggatggttccaataaagtaacgaatggtcttggacaattgaatagcaaaacggggacactttccagtggtgtttcacaactggaaaatgggtcaggacaggttacaaatggcttagtgacattagataatcaaattccggcgctcagcggtgctgttactcagctgttcagtggttcaggtcaagtgacttctggctcaagtcaagtaactactggcttagggacgctcgcgggcaatagtactaaattagcaagtggtgtcaatcaattagcgaatggctctgaaacattgagagtgggggtagcccagtatactggtggcgtttatactgtgaccaattatttgaaacagttgaatcaaggtgctaagcagttcagtggtgttggtgaattagccaccggagcagatacgcttcaaaaaggtatcagtggctatactaatggtgtcgctaccgttaatggctatgcctctcaagcaaatactgttgcgacagaattaaaaaagagtacaaaagacttgccaacacaggctgctgagttagctgatggagcaaggaaaattgatggtgctgttggtcagttttctacagcaagtggcagtatgacgtcagaaattagtgaaaaaggacaagcattgaaagatcctgccaatcaacaaaagattgctaatttacagcaaggcatggcagatatgaaattagctttacagagctttcaaaagcaactttcgactcagcaaagtcaatctaataatagtgatattgcaactgttgttagcgatatgcaaacgaatatctctaagatttctagctcaacgacaactaataataccgacttaacagctaaaattaatagccgaatcaaggaagttcaaagttcgaatggattaacagatgaacaagtcgccgctttggaagcgaaactaagtgatgttggcgcaactacaagtacagcctcaaatgaaagtactaagacagcattagctagtgatgcttcgaaattacaatcgatgctgaaaagtaatgcggctgcaacctcacaacaaacggatttagttactaaatttagtgatttgcaagatggtgttgacagcctgataagtgacctcagtagtatgagtgattcggtttccgagctagaaacatcttcgacaaactttacgtctgagttaaaccaattgaagacaaaaacatccaaattgagtgcgggactcacaagtctcaatgaaaatgttcccacactagtagctggaattaatggtgagtcacagcttgctgctggaatttcaggagggacgaacaaattaatacaaaataatgatagtttaaatggcggttctgcgcttatcaatgaaaaacttggcgtaattagttcggccgtgccaacacttgtatcttcaattgatcaaataactaatggtagcgaacaaattgctgccaagtctggacaattgaatgctggtgcaagtcaagtggcagacggaaatgcacaactgaatagccagataccagtgcttgtttctggtgtggatgcgctatttaaaggttcaagtcaagttacaagtggttcatctaaagtaactaatggactaggtcaattgaacagtaagactggcgaattagcaactggagttacgaaactcaagaatggttctgcacaggttacaaatggcttatcaacacttaatgggcagattcccgttctggttagtgctgtacaacaactatttagtggctcgaggcaagttactagtgggctgaacacactaaatggacaagtgccggccttaatggctggtgtcagtcaattaaatgacggggccacccagcttgacaacaactctgccaaactcctatccgggacaaagcagatcaagaatggtaacaagacactcgcgacttccttacaagaaggtgcggatcaagttaacgcgacaccattaaagaacgcgaatgcgaaaatgatggcggcgccaactaagacgtcctataaagactacacgcacgtgccaaactatggtcatgcgttagcaccttacgtcttgtcactggctttgtatgttggggcaatcgtcttcaacttcgcttatccaattcgacggattgcggatgacgacggcacgccaacacaatggttctggagtaaagttgctgttggtggtcccgtagcacttgcgatggcggtcatcgaagcgacagtgttattagttgctggtttgaaaccaatcagtgtacctgaatactacttgacggcaatcatgattgccttagcgtcaatgttcctagtcatgttcttatcgatgctattcgataacccaggacggttcgtcgcaatggttatcttgatgctacaacttggtggttctggtgggaccttcccaatggaaattaccaacaagttcttcaacgctattcacccgtatttgccattaacgtactcgattcaagcgttccggcaagccttaactggtggttggggtagtggtattttctggtcatcaatcgttgtcttagcaggaattacgattgtgtcgctgggattactgtgggcttccatggtcttcctcaagcaacacgatatgcaagttccagccgaggctgaaattcagatgaaagctggtaagtaattactggtaatcatattatcgcgcttccaagacgaaaaaccgcgtcttgggggcgcggtttttttctcgaaaagggttaaattttaattttactgataccataattcgaagacattacttttttctacgagtgagcgcaactaatgaataactaggcacatctaatcgcgtaccaggccaattgtgcggcgataaacccgactccgatgccatctccaaggtatctgattagtaatttagccgctgccttccacgtctttctttggattaatccttgaatgcctccgcgtaataatgcttggaaagtttgatagccaatcatgtccaataattgatttttcatacaggaccaaaaacttctagtttgaatactatttagcttgtattcatatttcattatctcgttgatatgctgcaattggttctggttattggaaccgtattttgatactaaagtgttcacatctaagtttgttgctaatccagtctggggatcatactgaatgctatttgatacatctgctaattcttgagagatacaatctatggcttgttgtgacgatgatgttgtattggcagaaatttccaaagttatggtagtagatattaggatactgctcaataaaataatgaccaaagtaaatttgtgaatgttagcttgactggtataattcattgaacttcctccttattccggtagtgtacatttttgaattgcgtatgtataataagacaaaacgaaaccggtttcaatagatgggagtaggatatgatggctgtttttaaatcaagtttcaaacaaagcatgattgtttttggaatatcagttatttatttttttgttttacatggtggatatgattttctcacacaatacaaatattggtttacagaatactgtgctaatgttttgggtatttccattatttattttgtaatgtcactagctttcaattatgtcatcataatatggaaactctatttgagaaagcattgagatagtaatttgcttaatagtgtgtttattgacgctagagtacgcgaaaaggcccaggtcaaagaaaacctgagccttttcgatgtagatttaaagcatttaaataattaatctccaaaaatgcagcaatcaatccactttcaagactaacgatgctatcagtcaatcctagttttgccccgcttcaagtcgtttaacatgcagaacattaatcaaaatggcgatcgccaacacgaataatagcaagaaatccaacttgcttcccataattgttccagttacggtcgggtgatgaatttcatagccggcaattacagcggacataatactggtcccgattgaaccggcgtactgttgcatcatactgaacatcgagttttgatcggatttttgaggcagagggacgcgggtgctaccatccgaaatcgcagtcccaaaaccagtattaaagccgacgcgtagtagcgcgtaaatgacagccatgatgatgactgtgaagtaatcggttgtcagccagaataatagtaaggcggcgctcgccatgatggcactaaatgttaataaggtcgttgggccttgtttatcgtaaattcgaccggcgattggcccagtgatggcgccgacgattgcgccgggaagcatcatgagccccgccgtcatggccgaagccccaaggacggtttgggcgaaaagtggcagaacgaacgacaacccgatattaatgaattgtaaaccaaagtaattaaatagccgaagtcgcaagattggcaatttgagaattgaataatcaatcagttggcgacgccccttgatggcgtacgtcaccattgcaccaatcatcacgatgctccatagacaccagaggccgaagttcggcgacagccagccgtgagttcccgcgttgttaaacgtgaacaacagactagtgaaggtgatggctaaaaggattgcgcccagatagtcgaattttttatcgccaacacctaaggccttccccgaaatgttgaacgcccctaagattgccagtaatgccaataacggtacgataccaacgaaaattgcccgccatgaccagacgctagttaaaatcccgccataagttggtccgagagccggggctagagacacgatgacactagctaaaccggtataagttcctagttgattgcgagggacgtaagtgaaaatcaactggaacatcagtggaatcgaaatcccagtggctacggcctgtaaaaggcggccagttaataatacggagaaattcggcgctaaccaacaaagaatgcccccaagcagacacacgagggcggcaaataagaataagggcttggggttaaaccgctttagaacataggccgtggtactcattacaatggttgtcagtaataggtaaccggtcgtcagccactggacggtatctagtgaaaccctcattgttttaatcagcgtggggaacgtcacattcatcgatgtttccacgagaatcccgacaaatgagagtaaaccaacggataagattgccagtttggtttttaaagtgacggtacttggttgggacacaatcaacactccttataaaaataattggcgtattttggacagctcaccaagcccaatagtcggtggtaaaaatcagtaatctgaatttttacgattgaaagggacgatcgtaatgaccgtcccactaacgtccccagtttaagcttattttcaatctggtgcaatcactttgcattggggatggaacttatcattaaggggtttgcgcgaggtatggtattataaaaagttgtctaattaaattttaatcaaattattggaggtgcgctgtgagtatatttttgaaattaggctggtattttcggcgtgaatggaagttgtacctcgcgggggtgcttggactagttttgactgccattatcggcattgtgccaccccggattattggggacgtcgttgatgggattaatcagcacagcttgacggcgcacacgctgacggtctatttagttattattggtgtggccgccgttggtcagtacctggcgcgttatttatggcggaatgccatctggggtggtgcagccggccttgaacgaacgctgcgggaacgactcttttggcattttatgaagatggatgcgacgttttatcagcaataccgtaccggggacttgatggcccatgcgaccaatgatctcacggcggttgaacgggtcgctggtggtggcattctccaatttgcggattccattattactggtgggacaacgctgattgcgatgatgacactaatcgactggcgactgacgctgattgcggtggtgcctttcccattattagcgatcgtgtcacggtatttgggtaaaaaaattcacgtcgcgtttcgtgcctcccaagccgccttttcgcgactgaataataaggcgcaggagagtatcagtggaatcaaagtgatcaaagcgctaggtcaggaaaaggccgatgttgctgattttaatcaacagattgatcagacgattaagatcaatcggcatgtcaacgtactcgactcgctatttgatcccgcgattaccatgattattgcgttatcttacggcgccacaattattttgggcgggttgtacgtgacccacggtgtcattacaatcggtaacttggtctcgttcgtcacttatttgggaatgatggtctggccgatgtttgcggtcgggatgttattcaacacgatggaacggggaaacgcctcgtatgatcgggtcatggaattattgaatcagcaaagtgccattattgatgccaaacggggcattgaacagcgcccgcatggtgatattcagtatcaaatcaagcagttcaattatcccaacgatgcaggaaccagtctgagtaacgtggactttactttgaaggcgggacagacgctcggaattgtcgggcgggttggtgctggtaaatcaacgattatgaaactgattttgcgtgaatttgatcagtacgagggccacattacttatggtggtcacgatattaagcagtatgcgcttgatagttacttaccagcccttggttatgtgccccaagatagttttctgttctcgaatacgattcgtgaaaatattcgttttgccgatccgactgtgagtcaagccgttgtggaagcggtcgccaccaagagtgatttgagtggtcagattgccagcatgcccgctggttacgatacccaagttggtgaggaaggtatctcgctatctggagggcaacgccaacgactagccattgcgcgggccttactcatcaatcctgaattgctgatcttagatgatgcgttatccgcggttgatgccgaaactgaggcagaaattttagctaatctaaaggcagaacgagcagacaaaacgacgattatcgcggcccaccggttaagttcggtgatgaacgctgatgaaatcattgtgttggatgccggtcacgttgttgaacgagggacccacgcgcaattaatgacgcaacacgggtggtatcagaagatgtttacgcgccaacaattggagaccaaagtggaaggagcggtgcaataatggcagcacgtcaatcggtatgggcacgttccatgcctgttaaggaacaactcacggttattcggcgactattgccgtatgcgaaaccgttcaaatgtttttttattgcggccatcgttttttccggtctgattagtgtggttaatatctatctaccgcgtgtattacagacctttattgatcattatctcaaaacaggacacgccacggtaccggtcatgtggtactttgcgggcctctatttcttcggcatggttgtgcgcgcgttgatgcagttcgtacagaacttcagtagtacgatgggggcagaatatatgcttgaaaatgtccgccgacaaatgttcgccaagttgcatcggatgggcatgcgctactttgatcaagtccctggtggctcaattttgtcacgcctgactaacgatacgatgtcgttttccaatttttgggcgttgtttaatacattatttaccgccttttttgcggtgatttcgtcgtttgtcgcgatgtatctcaccgatgcgcagattgccttgtggttattggttttcatgccttttttggctgtaacgatttggtattatcaacggtatagctcgcgggtttaccggcgaatgcgggaacggctcagtgagttgaataccaagttaagtgaagcaatcactggaattagtgtaattcagcaatttcgacaagaacaccgtatcaatggtgaatttgatcataccaatgatgcctattttaagacccgccaagcgatgatccggacgaactcattattattaagtccactgatcgacttgttttatgcgttagggacggtcatggttctgggaatcttcggggttcgtggactcaatggttatgtggctgccggggtcgtttatgcgttcatcacgtacctgaataacttctataatccgatgacgtcgatgatggataatttgtcagactttcaagatggcgtcgtcgccggatcacgggttttacgggtcatggatgatccaacgattgccccggcccaacacgtcgatcctacggctaagattacgcgcggtaagattgaatttcggcacgtcacctttgcctatgacggccagcatccggtcttaaaagacgtttcattcgtggctgaaccaggccaaacggtggcactagttggtcagacggggagtggaaaaacgtcgacgattaatgttttgatgcggttttatgagtttcagtcaggagaagttttaattgatgatcgcgacattcgtgagtatccggctgaggaattgcgacagaagatggggttggtcttgcaagaaccgtttatgttttatggtgatattaattccaacatccgaatgtttaacgatcagatttcagatgaacaagttcaagcagcggcacggtttgtaaaggccgatgacttcatcaacgatttacctgagaattatcagtcacgcgtcattgagcgcggggccagttattcttcaggacagcggcaattgatttcatttgcgcggacgattgtgactgaccctaagattttaatcttggacgaagccacggcgaacgtcgatactgagaccgaagagatgattcagactggtttggatcggattcaggagaaccgcacgacgattgcgattgcccaccgcttgtccacgattcaaaatgctgatttgatcctggtcttaaatcaggggcaaatcgttgaacgcgggtccaacgacgagctattgcaacagcatggttactactatgatatgattcagttgcaaaattccgctcacgtcgattaaagtgtggtatgctcgatttaaattaattgaggtgatgccgaatgcgtcgaaaattatcgttaatggtcgtgatgactgttattagtacgctggttaaagtgggctggcaattaatcttagcgcgccatcaagcgcctaaaaagttaaaaattaaggtaaaactgaaataaacattgtcgtcgtgtcggtagcgatgcttacggcgattcaatcagttgtcatgaccgaccgttctggaaaaggtgtaacttccagaatggtcggttttgtgttggaaaattgagttggcggaggtggtcacggtgagttgtggtggtgcccacaaaaccggtttatcagtggttcgaccttaaaatcggtcggtgacactcactgcaggatgtggcctggtatggttgcaaacgtgctgttcatttttggcccaacacctggagtacggtgccacgcttggatgtcgccaggcacattgaaaataatgattggtgactaataacggtcattaattcctaaaacgactggatgacggataactatacggaatggttataattgattatttgaactaggtattttactctgccaacggatcgcgttttaataaagagggtaatgagttaacgaagggagttgtgatgcaatgcaatatcgacagttaggaacatccgatttaaaagtctcgtcgatcgcacttgggtgtatgggctttggtgcggggactggaacggcacttaatcagcgctcgtgggcagttggtcaaatgcaggcgaaccaggtacttgatcgcgcgatatcactggggattaacttttttgatacggcgccggtctatcaagcgggtgcgagtgaacgtgtcttgggacaaggactaaagaaatttcagcgagatcaattggtactggcaaccaagtttacgaatcggacaacccaagaaatcgaaaatcatgtcagtgggcgtgaacacgtcttgcggtccctcgaccagagtctacagaatttacagacagactatgttgatttatatatttatcatatctgggactggttaacaccaatggctgaaatcatggctggacttaatgaagctgttcaggccggtaaggttcgttacattgggatttctaacgcctattcctggcagattgcgcagatcaatgcgctagcggttcgttatggttacccacaatttgtctcgatccagagtcattataatttggtctatcgcgaggatgaacgggaactgttcagttatgctcatgagaacggtttggcaacgacgccgtatagtccattagctagtggccggttggcacatccttttggcacccagactactcggcgacaacaagatacgtttgctgataccaaataccaagctaccagcgagatggataaaccaattattgatcgcgttgaggaactggcccaccaacatcatgtttcaatggcggccattaatttggcctggctacaacaacgagtaacggcgccgattattggggcaactaagccgcatcatttagatgcagtggctgaggcagcggggttggcgttaaccgcttcggaaatacagtacttggaaaccccttaccaaccccatgacttggagggcgtgatggcacttaaccggtcacgaactaataattggaatcagtattccggacagtaagcgaacaagttagttgacttaacgtgcagttgaagtaatacactgatcctatcgtgcgactaaaggtccacgtttcagtataaaggagttattgagattaaattgaaaacaatcacacaacagtatttaacgggcgagcgggcactctttaaagctcacgaccttgaaatcgacactacaacgtttgctgatggtgaatcaccactgaaggaaagtcgcaatgtcacgttgaagcagccaatctttaagtggaaatatcccttgtggtacagtcaacatgtgactgtggatcaaggcttgtttgagacaatgtctcgctctggcatctggtacaccaaggatattacaattacgaatagtacgctacaggcacctaagctatttcggcgggccagccaagttaagttagcgcacgttcacttttcagatgcggaagaaacgttatggaactgccaagatattacgttgaatgatgttcaagcagctggtgattattttggaatgaatagccagaatattcgcattgatggcttcagcctcgtcggtaattacgcctttgacggtgctaagaacgttgaaattcatcatgcaacgctgatgaccaaggatgcgctatggaattgtgaaaatgttaccgtttatgattcacaaatcattggtgagtacctgggctggaattcgaagaatattcggttcgtcaactgtacgattgagagcgatcagggcctgtgttacatggataatgttaagttggaaaactgtacattactcaatacggacttagcttttgaatattgtcgtaacattgacgctgacgtggtttcaacgattgatagcgttaaaaatccgcttagtggtcggattcatgcgcaagccattggtgaaatcatcatggatgatcctgaagtagatcctcatcagaccctgattagtgttgaccatgaaagccgtgcaccccatgccgtttgattttgagaccgtgcttaatcggcggcacacaaatgccgttaagtgggacgtcgcggatgatgagttgccgatgtgggtcgctgacatggactttgaaacggcaccagttatcaagcaagcgttgataaaacgcgcccagtttggcgtcttcggttacgaagaagtccccatggcttactatgaagccgtggcagactggtgggcaacggaacacaacttccgtccgcaaattgagtggttgatgttctgcaccggcgtcgttccggcgatttcatcaattgttcgtaaaatgacagcggctggcgataacgtgttagttcaggctccggtttataatatcttctatcattcaattgaaaacaatggccggcataccttgagtagtgacttagtggcacgtgacgcgtcgtacgcgattgattgggacgatttgacgacgaaactagctgatccgttgaccacgatgatgattttatgcaatccgcagaatccgatcggcatcgtctggtcgcgtgcgacgttgcaacgccttggcgagctgtgcttgaaataccatgtgctagtcgttgccgatgagattcattgtgacttgacccttaacggtcacacgtacaccccattttcatcattgactgcgccagtagcacataacagtatcagctgtatctcgccaagcaagactttcaacgtggcagccttacacgcggcaacgttgattattcccgatgcacacgtccgcgcattagtgagccggggcatcaacaatgatgaattggctgagcccaattcgtttgcgattccagccagcattgcggcctatactgaaggccatgactgggtagctgcattgcgaaccaaactagctgccaatcaacgtcaagttcagacttacttgactgctgagttgccgcaagtcaagttggtggaagcccaagcgacttatctattatggttggatgtgcgtcaagtgacaaccgacagtgcggctttggctgcttttattcgccaacgaaccgggttgtttttatcagcgggagatgcttaccgtggtgatggcaaccgcttcttgcgactgaatgtggcttgtccaacgactaccctgacggatggattggcacgattaaaagctggtattacggcttaccaacaagttcaagcatagttgacgcgtatgaggtgcaattccataatgatttcgctatcattaagataagctggtttggtctagatgaccgctgacagtccgtgataacggaccagataagtcggttaattcaaaccattattaaaagatgaggtggaggatagttatgaaaattggaattattggtgccggtacggtcggcacagtattagccaagacctttgcgcgcggtgatcatcaaatcaaattaagtcggcacagtggtgcggctagtttagcaacacggcgcgccgagtttgctgccaatgtggcttttgtagaagttgctgaagccttacaacagccgttagtcattcttgcagtgccgtttgaacaggcgccggcagtattagcgcaggtcgccgattataagcaacggatcgtggtggacgtgacgaaccagtttacggctgactttaagaaaattaagacggccccgttgactggaagtgaagtcattgctcgtgcagctaacaatgcccgggtcattaaagccttcaatacgattccaccggagtttatggatgggcacgttgatgggcctggaaagcgggtcttgttctatgcgggcgatgacgttgctgccaagaaagaattcgctgcgctcgtccggccgttgaatttccgccccgttaacttgggcaagcttcggcatggcggcagtgtcatgcaagttggcggtggactaggtaatacacactttgttcagattgaagaatagtggattgtaaaaaggggttcacttttggaccaaaatagctagtgctgaccttgtaagaaaaggtgtggctagtgtcactttgattgggccgtgcggtgggcatcaattgacaggtgttcctgccaatcgtcgccgcgtggttaaatttgaatcgtgttatgggtcatgaagcctaattcttactgtgtcgtaactgtaagaatggggctgcatggctttttttaattgaggttaattattgtttatacggtttgatgaggacaatggtattgatacgagtctagtcaatcaactccgcccacttagctacggaaatatccgataggcacaataagaggaacgtgaaaattcttatgtctttacgctattttggttaaataaaagtgtgaacattacctgctttatatcgtatgagatgcagtgtgcccattcaataggctttgcagattatgttaatgaatttcgactatacgcacaatacatattattatatttagccacgggtgttcttagttcccagctatctatatactagatcatgcaatgatactttcaactattatcgaaatttattggaataatgcaggttttccacttacagcgcctgaatttaatctccgctgtcaaagtaggtgcatgggcaatgacccttgtctgacctgatgaatcataatagtgttattcttcatgcgtataatcatttattttttaataccaaaagcgttgtgcttcatttcaatgagaaatctagacacaacgttttttattaaatactgctatctaagctaaaatacttaggtaattttagaaaggactatctaaattaatgtcttcatattcgaatgagcttctcatgctgattttccaatcgacgctatgcaaacaagtgctcatattttttgcctacagtggtttgtactatttggtaacgtactttatggataagaaaatccagcatcaaaaacaattcttattgaaattaggtctagttaagctcaaaaaaagaaataagacaaggtgggaaaaaatacgattgataatgcaactgttcctaatagtatcaatactggtcttagttgttagtacatttgttctaaatcctgatgatcagtacatacttttggttatttatgttatgaagcttgctactttcacttcttttgcaatcgcgtttgtggatagtttaggtccaataaaggagatacagcagttgattgtcggcgcacaaagcagtgatactttagacagtgataaaaaggtattaacggtgacaatctttaaaaaaattagatggatgctgatattatatcaagtattaaaagtacccgcgcttataattcttttaaatttaagcgtcgactattagcgcaacggtgttttcattttatgagaatttgcatctaacttgttttttagtccgttcctttagctattcttctcgcacgttaattgatagcaagcgtcaagtggattaaatctgcaaatcttatcacctgagaagaaagggcacgttttgacagcttacccagatgaactgttattagcattgtttcacggccgaatcttgaattaagcaacgacgactgttttatataaattgcttttcttgctgattcgtcaattggtctttttgttgattggaaatcaaggtaagcaggttattgagttaaaagccgtcgatacaactactccgcataatacctaatatgttaaatagttcagtttttaagatacgttaggcctgcgcgcagagtttgctgattatttttgcgtttaaactgttaataacagtttttgcagttgcttaaagttatccacagtgtaagttggggcaattgttgtgtcgttatgcacatgctgtggattgtaccagatactaggtaaatgggcggtggtcgctcccacgatgtctgaacgcaggctatcaccaatcatgacggtattcgtggcattcatgtctgggtattggtcatgaatagcgctgaaaaagtgtgggttcggcttggcataaccgatactttcagagatgaagatatgatcaaaatagggcgtcatatgggcacctgccaagcgactgagctgggtgtgtttgataccgttagtgccgacgagtaaggtcagcccagcgttggtcagcgtgcgcaaaagttcgtgggcgccgggaattacctgataactgtgcgctaataattggtcgtattcttgttgaaccgcaggaccgtcaacggtgatgcccagtgtgcctagaaagacttgaaatcgttggtctaacaagctatcacgatcggcaccttgttcgatttgttgccaaacagtttcgttataggcctgatactcattttctgcacggcgaatatcagtgacgccatgatgctgaaagacggctgcgaggttagccgcttcagcgcggtcaaagtcaaggatggtattatcgagatcaaaaattgcgtattgcatggaaccactactttcaataggtttatttaaaccatcatacagcaattttgaatggtgtggtatgcttaaagtatcatacttaaaaggaagttaaacatggaaatcgataatgacccagcgtatcaacaaatgattaatggtgaattgtacttagaatcaccaatcctacagcaacgtcggcgagacgtgcggacgaagttaatgcaatataatcagattgctgataatgatgaacggaatactaagatgaaaagtctcttacgttcagccggtgaccggttcttcgttgaaccgacctttgaatttagttatggcgtcaatattcgtatcggcaatcatttttatgctaaccatggggtcacgttatgtgatgaaggacttattacgattggtaatgattgcaaatttggtcctaaagttggcttgtacacgcctgctcatccattagacccaactgtgcggcggactgaagcggaacggactgcaccgattacgattggtaatgatgtttggattggtggtagtgccgtgatcttacccggggtgacgttgggcaacaacgtgattgttggtgccggtgctgtcgtaacacattcatttccagataacgtcatcgtagtcggtaatccggcgcgtgtcttgaaacaaaatgcaccgcagtcataattgacaattacgcctaaattgatgaaaataagggtgtagtcagattatcagagaatggggagtggagccatatgtcagagatgagtcctaaggaatttaagcacatcttagtcggggttgatgattcggatgacgcgcagttagcgtttcggtacgccattaaccgggccaagagtgacggtgctaagttaaccatcgtctcgattttggaacaggataatatgaatgtgtatgaagcgatgagcaaggactttgttcatggtcaacgcaaggatttggaagaacacgttcagcagtatcagaagttggcccgtgacttcggggtgacggatgttaacgcggtcgttgatgaaggtgaccctggtgaaaccatcgtgaagacggtgattccagcgttaaagcccgacttactagtcattggctcagttgccaagcatggtgttcgtaagtacttcggttcgcaagccgcgtatatggcaaaacatgcaccgatttcagtactggtgattcgatagtgataagatgaattttgattaatcaggccttccggttatggagggctttttttgttgtgtcttgaggaataccaaataccagtggtaggggctttatagttagacaaatatatttaagttatggctgaaagttgtcttttcattcagctttaagaggtgtttcagggtgacggtataagtatgccataggtaatcgagtgaaatactatacgaaaaacgtatggtagcatgtttattcggtatttttcagtgaataagaatcggtttatgatagtgtcattcaatcagttggacaagtaggttacataagctcattagactgattagagaaatatttaataatcacggaggatttatttatgaaagtcttgattttaggcgcagcaggtcaaattggtcaaatggtaactggtgatttgttggcataaacagatgacaacttagtgctattcggtcataacgtctcacaacggttggcggaacttgattcagcacgagtgacgtttgttgatggtgattttttggaatttgacaaggtacgacaagctgccgaaggtgttgatgcggtatatttaagttttgttgctaagccagctattattacgggagtcattgacgcattagataaggccggggtaaagaggtttatcgtagctaatgttcctgatttgtatcaagaagttagtgggccattccaaacatggtatcggcaaaatactgggctgacatggcaaactgatctcaaaaagtcggccgacttagtggaaaatagtgatttggattacgttattttacgtattacttggctgtacaaccaagtaaataatactaagattcatgtttccgagaaaggtgaacctttaacggaagcccaagtcacacgtcaagcggtcgctcaatttgttgttgatcttttgaccggcaaagctgattatcatcaagccaacttaggattgggtgaacctgatactcaattcactaagccgagctttatgtaagagacaaacctgtgaatgctcagaaagcatttgcaggtttgtcttttaccaaattagtactttaaagttaggagtttgtaatgagtaagagcaaagaaaaatttggcattgtattgccaattattttattaagttatttcatgattttattagataattccattatctttactagtacggtaaagattgcgcaagagctacatttaaattctcagacgttagcgtgggtaagcagtgcttatacgttaacatttggcggctttcagttatttggtggccgtatcggtgatgtttttggtcgtaagcgagtgttcttgattggtttggttttattctcatttggttcattaatggtggggctatcgaccaacgccgccatgattatctcaatgagggcatttcaaggcatcggctcagccattttagcaccaactactttggcactgttattggatagctatcaaggcacaatgcgcacgcgagcaattgcggcatacggtgcaactgctggcttgggtgctagctttggtctgattttgggtggcatcatcaccagcgtgttctcatggcggtacggttttttcttgaatgtgccagtgggaattctgatgtttgtcttgacgatattctttgtacatgacagtaagactgaaggttcacgacatctagactttgtggggacgctgttatcagttatcggtttatccgctttggtatacagcattgatggtaccagtcatcaaattttggccttgatcgttgcgattgttgctttgattctgtttgtttatgcggagaagcgcatcaagaatccaattatgccattgaaattatttatggatagagaacgtagcagtgcttacatcgcacgtttcttcttcatcggtgcggcatttgcctacttctttgtgacaccacaagctttgcagcgagtgtatggatttacaccattgatggctggactagcctttttaccagcgacattaccacaattcttcagtgcaacccaggtttctagagtttcaatgaagattggcaatgatcgtttgattctagtttctatcatatcaggaattattggtgtcctactttcagccgtgcttggtcttagtcatggatactggctagcagttggtattccaatgattttctttggtgttggacaagggcttggattaagcccgctgactatcgcgggagttgccaatacggatgctgatattgcgggcgccgcttcgggtgtcgtcaatacagttcatcaatttggacaatcggttggaatgtcaattgttgtcgccatgactagcggcttcaataatccagcgacaagctatcactatcaattgttgattattgctgtgatttttattttgagcttcattgcatcgcttggaattcagaggaaaaagcaataaaaagcattaccatacgtctgacgtatgctggcatgcttagatagtaattttcagcgagttaaatcgaccttataatgaattcatcaattaaataaagaggagatcacataatggaaacagttaaattaaataatggtgttgagatgcccaaattagggtttggtgtgtttcaagttacagatttagaccaatgtgaacaagcggttgttgatgcaattgattctggttaccgcttgattgacactgcggctgcctatcaaaacgaagcagcggtcggacgggcgattaaacggagcggggttgatcgtaaggaactcttcattacctctaaactttgggtttcagatgctaattatgaacgtgcacagaagggcattgagcaatcattaaataatctgggcttggattatttggatttgtacctactacaccagccatatggagatgttgtaggtgcttggcgcgcgttggaagaggcttacaaagctggtaaaatccgtgccatcggagtctctaacttctatggtgaccaattaaaaaacttggaattatcaaatgaagtcaaaccagcaatcaatcaaatcgaagttaatccatggtaccaacaaaaatcagaagttgacttcgcacaaagcgatgatattcaagtagaggcttgggcaccgtttgcagaaggtaagcacgaaattttcactaataaagttattgctgaaattgctaacaaatatggcaagtctaatggtcaagtgattcttagatggctacttcaacgaggaattgttgttattcctaaatcagtgcataagaatcgaatggcggaaaatattaatgtttttgattttgagttaaaaagtgacgaaatgaatgcgctgaataacttggacaaaggcgaaagtcagttttttgatcatcgtgatccaagagttattgaacaaatttttggagcaagtttggcacaattaaaataataaaggggtagataaatatgtcagaagcaacttttaaactaaataatggtgtgaagattccagaaatgggtattggtacttttcaaatgtcagttgatgatgctgagcaagctgtagttgacgctttgaaagctggttatcgcttggtggacactgctaatgcttatatgaacgaaactggtgtggggcgtggtattaaacgttccggcgttagtcgttcagatgtattcttgagtacgaagctttggccatctgtctatacagacaataatgcggttgatgatacgctgcaacgcttaggaactgactatgttgatttgatgtttttacaccaaccagctggtgactttctcactggataccatcaacttgaaaaagcttataaagatggcaaggtcaaggcaattggtatctcaaattttcaaggcgaaaaattacaacagttattggataatgttgaaattaaaccgcatgtgattcaagccgaagcacatccatactttactgaagatgaagttagaacaattttgaaaccgtttgggacaagattgatggcttggttcccattaggtcatggcgacaagagtctgattcaagaacccatttttgctgagctgggtcggaagtatcataaaacgagtgcgcaagttattttacgttggcacacacagatgggattcattgtgattcctggatcaactaatccggatcatattcgtgataatcatgacatctttgactttacactgactgatgaagaaatggctcaaattgctgctgtaaagaagaatattcggtattacacaccgtcagctgaaaatgaagaaaaatatgccacgatggcgttagactttagtactgaaaagtagactaggagtgttttattaatgagtgaatcgaaagtaatcgttattaccggtgcgtcaagtggtattggggaagcgacagctaaattagtggctaaagatggtgcaaaggttatcttgggagctcggcgcgagaataagttaaagaaaattgctgatgggattgagaagttaggtggcgaagctgcttatcaagcaaccgatgttactgatgataatcaggttgaagcactcgctaaattagcgatagataaatttggtcggattgacgtttggctgaataatgctggtattatgcctcaatcgatcctttctgaaaagaaaatcaatgattggaacaatatgattgatatcaatatcaagggaacgctttacggtattggtgcagcgattccgtatatggataaacaaaaggcaggacacattatcaacgtttcttctgttgctggacacactgctcattcaggtagtgccgtctattcagcaaccaaatatgcagtctgcgctatcagtgaatcgctccgtcaagaaatggtagaagccaagaataatgttcgggtaacggttatctcaccgggtgctatcaacactgacttgctttcttatgtaactgatcctgaggttaaagctggtatggagaagttttatgaatcgtttggtatttcagttgatcgagtagcgttaacaattaaagaagctattgatatgcccgccgatgctgcttggaatgaagttattattcgaccaacaaaccaaatgggctagtccaaaaagactggaaaatttgagcgtactgcttaggtagctaactcctagttacctagtttgttaagtgataaatagcccctgaaccaatcgtttttggactggtttcaggggctgtttatattgattgtcggatttgtgacaacttacttttcggttgccaactgttattttgctgcaagaaaataaaactttaggccgctttaacattttgggggccattcgaacacgattcagattgagcgtggctatgtggaaatcgctggtggtgtcaagttgagaatttaagagttagccatttggcagttagttcgaatgagacttttctcttgccttggagttcacaccagggtttaacatgatgtttgttaaaaatcaagaaaggtatgattaagttgaaaagatggggaattggtattgtcgttgcaatcgtgattattgtgagcgtgatttgaattggatctactatgtccggtcattacgccaggccggaatgttgattgaatcattgattgagtatatgaaactacttcatcaaccggatacttcaccagaagtacgacgagacttactgatcgatcaacgtgatgaattagtgcaacagttgagagagacacgacaaacaattgcatatttgtcctataaaatcgatcatttccaagaacatattttaagcagtgaggcagcacaactatttccacaacaaagcaacaaaattattgatgatagtcacaacgctgaggactgatctattgcagtaccataatgatttaagataatccaatatatcctgaatggtaggaaatttttggatgagaggagtgattgaatgaaaaattcaagtaacgcattagtgttgtatttttcactcacggataatactaaacgggctgctaatacggttgctgagataacgggcgctgatattgagatacttcgtttagaagaaccttattcagacgattatactgaagctgctaaacgtgcggagcaggaaaaagaccagcaaataataccagaattaagaccacttaaccatcaattgaatgattatgagacgatttatttaggctttccgacttggtggtatcagccaccaatggtgattcatactttttttgctgaatatcaattttctggacaaacgattgtaccgttcactaccagtgctagtagttcaattacggcaagtgccaaagtattagcttcattgaccgaacaaaaaaacgttgatttaaaagcagggtttactgctaatcaaactaacgtgattaaacagtattttaaagacctgttataagttgagtattaatggataagctttgatttaaggggatgatgaaaataaaaaaggtcgggctaggattaattggtattggtagtttgatgttaattggcatctggttagtactcaaagctgagccgaagaacggggcatgggcaaatcaacaaaccgttgtcgccgttactcatgacaacattagggatagtggcaatagtgttgctgaatgtgtaacttctaattgatgtttatgaggttagtgtgtgtcgtagcaaacattagcggattgctaggttgcgtcgctggtatgacatgcgtatcggtaggattgaataattaatttacagaaacctagcgtgatggttgaatgtttaccatcacgctaggtttctgtaatagttacttactttgtagtgccttgggccactgttgttggatttcgctaagcatgggagctaggtgtttcttttgggcaatcaagtagttagcatatacgaccattttggcgctgtcatcactgattggaacagttacccggtccttatcgtttttaacctgctcattaaagaacgggtcgctttgcgataggttagtcgtgaagaatggaaaacgtgagtatttagtgatttcagcaaaagcgtcacggtcatcttgatacataaacttcgcctctggaatattatcttgaataattgcactccatgggccaatggcacgcatcacaatgaaactcataccttgcagttcctcaaaggttacggttggttgattggctaagtaagtaaattgatccaagttaacttgtagtcgttcttcaccaatgtattgagattcaatctcatccgtaaaaatctcctgatcagaaaaaatcacggtgtattggttattattgagtgcgtcagtaatttgctgattggaaatggcattagtgtcaatttggatatgcctgctaagcgtgggctgtagctcaccaaggaggattaatggacctggaacagtcgctgcaatcgcagttaagtgttgaccttgatcatagttctgcaccttcgtaatcatggccgtgttgagcttcagtagttttgtcgcttcttcagctgcaagaacgcctgtgggggtaagctgaatgtgattggcctggcgctcaaataactgaaccccaaactcgtcttccaatttttgcataccacgagtgacggaaggctgagtcacattcaactgtgttgcagtttttgttagtgtcccggtttgcgcgaagacgctaagttcttctaataaatagctttcaatcatataattcactcctaagcatacattaaacgtatggtagcatgtttatctagtaattttcaaacaatccatctcgccttatgatagtgtcattcaatcagaaaggtgtgaaacaaaatggtcatgacgcaaacggtccgactaagtagtgggattgaaatgccgcaagttggtttcggcgttttccaaattgtagatgaacaacaatgtgaacgtgcggtaacgcaggcgttacatgcgggttatctttcaattgacaccgcgacggcttatcagaatgaagttgcagtcgggcgtgcgataaaaaatagtgggattcgacgtgaatcactctttgttacttctaaactgtgggtggcggatgcgtcatacgaacgtgctaaagcaggcattcaggcttcgcttcagcacttgggactagattacttggacttatatttattacaccaaccttatggtgacgttgtgggtgcttggcgagcgttggaagaagctaatcaagcaggattaattcgggctatcggggtatcgaacttttctgctgatcaacttaaaaatctggaattaacgacgacaatcaaaccggtggtcaaccagattgaagtcaatccatggtatcaacaacaagaagccattgattttgcacagtctgaaggtattcaagttgaaacgtgggcaccatttgcggaaggtaaacaagcgatttttgaaaattcagtattagtcgccattggtcaacgatatggcaagactgctagtcaggttattttacgttggttattacaacgtgatattgtggtaatttccaagacgattcatgtggaacggatggttgcgaatctaaatgtttgtgattttgaacttactgacgaagatatgcaacggattacccaacttgatcaacatcgtagtcagttctttgatcatcatgatccgttaacaattgatcagatttttggcaccagtattcagaagagtcgcatgccatcagggcttgattagtatcgtttagcaggatagttgttaagaaacaaattgataaagtttattttgaattgaacggaggaattattaatgaaagtgatgattttaggtgcagcgggccaaattggtcaaatggtcacacagcagctgttggcgcaaaccgatgatcagttggtattgtatggacataatgtatcacaacgattgacagcgtttgattcgatacgagtgacatttgtggacggagattttcttgaatttgataaggttcaaaccgcattaaacggagtagacgcggtctatctgagctttgttgctggcccggatattattgccggtttgattaaggttttggatgcgacgggggttaaacgactcattgttgccagtattccagatctttatcaagaagtcagtggcccgtttcagcaatggtatcgtgaacataccggtatcgtttggcagtcagaccgtaaacaggcagctgatttgattgaagcaagtgacctcgactatgtgttgttacggattacgtggctgtataaccaaactggtaatacggcagttgcggtaactaagaagggtgaaccatttacttcggcccaagtgacgcggcaagctgtggcacaattcgtcgttaatttgttggctggtaaaggtgactatcatcgtgaaagcctaggcttaggagaaccgcagactgaattttcaaaaccaagtttttattaattaattggtgaacattgcttgcaatcagtgcgcaccacaaaattttaaaggaatgaaggaaagcataatgaatattgtttggatgttattacctgcgattgcgtggggcgtgttaccactaattgtgagccaattaggcgggcgaccagttaatcaaatttttggtacggccgttggaacattaattgctagtttagtcgttcagctaatcgttcacccagccattaacgtgatttcatttattatggccatgattgctggtgccttttggattattggtcagttgggacaatatacgggatacgccaatgtaggtgtttctaagacgatgccgatttcaactggattacagttagttgggacatcgttagttggtgttttcttgtttggtgaatggtcaacgacaattgcaaaacttgtgggcggcttaggggtcttgttacttgtgattggtgtcatcatgacttcaattcaagatcgccaagaagtgactggcagtaatcagcgacgaacgattgtgatgttgattgtgacgaccattggatttattgtctttaatgcgattccaaaggcgttatctgcgtctggtattgcgatctttttaccagaatcagtgggaatgatggtagccgttattgtttatatgttagtaagtggtcaaggtcgaattgtggcagaacgggctagttggttgaacattattggtgggttagttttttcagtagcttcgttgacatacattgtttcagttagccagaatggggtcaatacggcctttgtggtttcgcagttatccgttgtgttgtcaacattaggtggcatggtatttttacacgagcgtaaatccaaacgtgaattagttttaactttgagtggcttagtcttgattgtgatcggtgcagtcgtcactactttaatttaaactgaaacgtcatatgatcaacttgcgacggaataattgagctggtttctttacaaaagacgaactaatgaaaaattagccataaaatgagcggcgctaatgcaattttagtcccgttagtattatgatgtctgatcagtaatcagcggtgttcaagaatacctttattcttaagtaccgctgattttggttagtcgtgctagtggcattgattgacttcaagttagtatgttgaatgagcaagttatacttttaggaatgattgtggagttgtacctgtgtttagaaacgactaatcatcagtgatatatcactggtgtagcaatgttggcgtgtgtcactgaccgagctaaaggtcacacagttatgccatacgttaaacgaatgctagcatgtttatcaagtaattttcaaagtgtctttttagcattaatatatagacattcaatcggagcgataaatagcggcgcttcgtaaacaaatagttattgttaaaggagtgaagtaaaaatgtatgaagatttaaatggtaaggtagcagtcattacaggtggctctaaaggaattggttcggcaatcgccaaaagatttggtgaagaaaaaatgaaagtggtcattaattataatagtgatcccgccggtgcgcaaaaagcagctgatactgtaaaagtagctggtggtgacgctgttattgtccaagctaatattgcgagcgaagctggtgtggatgcattattagctgcggccattgaccatttcggtgacctagatgtttgggttaacaatgctggtatggaaattaagtcaccaactcatgaagtctcattggatgattggaataaggtgacggctattgatcagaccggtgtgttccttggttcacggacagcccttgcgtactttaaagcgcatcaaaagccaggcaatattatcaacatgtcatccgtacacgaacggattccttggccaacttttgcgagctatgcagctgctaaggggagtgtcaaactctttactcagacgattgctatggaatatgcgcaggacaatattcgtgtgaatgcaatcggccctggtgcaatcaacacaccaattaatgctgaaaagtttgccgatccacagcagtatgaccagaccgttaacatggtgccaatgaaccgaatcgggacgccagaagaggttgcagccggagctgcttggctggcctccagcgaatcaagttatgtcacgggaattactttatttattgatggcggtatgacactttatcctgcatttaaggatggtcaaggataattatcactagtgaataagtagtaatggtgacgttacatcggcagtactttgatttaattggaggtaagtagttaatggcgcttaaagaacgtatggacgttaagttagcatcagcagtaatggacaatcaaatcagtgatcagccagtagtggcttatcagttagggaaaacggccagtgtctggcaacatggtgcgggaactaaatctgatggaatggatacgaatgctagcaatcagcctactagacgattaacaaagcaggctcgaagcatcattatttatttttcacggtccggaagcactgaattgcttgctagccaaattgctaaagagactcaggctgatattttggagattgtggtcaaatcaccttatgaccgtaattatcagcaaacgttagcgcgtgctaattcggagcgcgaaactgctaattatccggaattgaatatgcaggttcctgatttgagccagtatcaaactatctatctgggttatcctgtatgggcgatgactttatcgcatccgatgactgcttttttaatccagtatggtagtcaacttcagcataagcagattgcaccgtttatgacagagggtggttatggtcagggggatagcgtggaacgtctcaaaggcatgttaaaagtcgacggttcgagtactaaccgatatgagacagctctagtcattgacggtaataaagttgatcgtgaagttaaacagatcaatcaatggatacaccgtgttacgcaacgtgactgacagtcattggcgtgacttggtaagtcacttttagttagcttaatgtaatgctgaattataattaagttaattaataaattggaggatcttttaatgaataatgaacgactgaccgcatttgaagatgcgattctagctattattatgacaattttggttcttgacttgagtaaaccaaatcccgttagttggaccggattatgggcattgcatgcgagctttttcgcctatgcgctgtcgtttttctggattggattaatgtggatgtcacatcataatagttggcaagcagttcggacaattaatatgacaaccgtgctcttaacgctagtgttgttgtttttcgcatcgttattcccatacacaacgagcctggttgcgaacagttttgataatgcgactgcccaagcgctttatgggattattattattgcgatttcgttattgaacgttggtctatcgctgaatctaggtcgtctcaatccacgcgccaaatttggattgttatataagacgccaacgtgggtcgtattgctcgatctaggaattaaattgattgggctaattttagcaatcactatttatccacaagcgatgatctattacatttttattgcgggtttggtgctgagcattagcatgacgactaatcgccaagttaaattaaactaaggggcgctattaatgaaaacaattaagttaaacaatggtgttgaagtaccgatattaggatttgggacattccaaattactgatcctgaagaagctgaagatgcggtgcgtgatgcgattcaagccggttatcggcatattgatacggcacaaagttatgaaaatgaaggggccgtgggtcgtggtattgcaacctcgggtgttgaccgcaaggaattgtttgtgacgactaagatttgggttgaaaatactagttataaaggtgtcatgagctcgtttcaacgttcacttgatcggttaggcttaaagtacgtggatttattactgttgcatcaaccatacaacgatacctttggggcttggcgtgcattggaagaattacaaaaacagggtaaagttcgtgcaatcggtatttctaactttagtgttgaacaggcggtgaacttggctgaatttaatgacgttacaccacaaattaatcaaatcgaaatcaatccgttccaacaacagacgaataatattcaagctttacgtgatgaaggcatttccttggaagcttgggccccattcgcagaaggtaagaatgatattttcaacaatccggtattaactaagattggggacaaatatggtaaatccgttgcgcaagttattctacgctggctgattgaacaagatattgttgtcttagctaagtcggttaaaccagaacggatgcgtcaaaatttggacgtctttgattttgaattaaccgatgacgacaaagcacaaattgcgactcttaatgatggcgaaagccagttcttctcacatgctgatcctaaaatgatcaagtggatggcaggtcgccgtttggaagtgtaatgattaatacattgaccgataattgactacagtttagaaaacattaaaccaaaacacccgtcccttgtttttgagtgacgggtgttttcattgataagtaaaacttatcaatgtgggctgaatttgaaattggtctaaaagacgtttgcttgtaagatatgacttgtaagttaaggtgaatcaaaacaagtaaagaggtcaatgaatatgaataacgaagtaattgtgcttttcggtgccggctcaattggtaaagcaattgttcgacgtgttgctgccggtagaaatttattgttggcagactataatgaagcaaaattagttgaaatgaaacaacacttgacggaagctggatttaacgttgagaccatccaagcggatctttcatcacgggaatctattaagacagtggtttctaaggcacaatcgcttggtaagattatgggattggtcaacgcggctggcgtttcaccatcccaagcgagcccagaacaagtgctcaaagtggacctttacgggactgccgtattgttagaagaatttggtcaagtcatggctcccggtagtgcgggaatcgtaatttcgtcgcaatcgggacaccgattacccgccttatcacaagcagataatcaagccctagccatgacaccgactgaagaattattggatttaccaattttacaaccggatgtgatcaaggattcattagcggcttatcaatatgcgaaaagaaccaatgttttacgggtcgctgctgaatcggttaagtggcaagctcgcagtgcacggatcaacacgatcagtcccggtattatcatgacaccattagccgttgacgaattgaacgggcctcgtggtgcgggatacaaaaagatgttcgagtcaatggttacgaaacgtccaggaacacctgatgaaattgccaatttggcggaactcttaatggatcgccgtggtgcctttatcacagggagtgatttcttggttgatggcggaattaccgcacaatattggtatggtaatgtttcagaagttcgtaacaatggcgtccagaaatagaattttaaggagagtttattatgaaagcagcaacttttattgaaccaggaaaagtcgaagttaaagaatacgacaaaccaactattcaaaagccaaccgatgcaattattcgggtgctccgggcctgtgtatgtgggtcggatttgtggtggttccgcgggatttcacaacgccaagcaggttcaaccgttggtcatgaagcaattggaattgttgaatctgttggttcagccgttaaagatgtacaagcaggcgatttcgtgattgcaccgttcacccatggttgtgggcactgtgccgcttgtttagccggttttgatggggattgcttaaaccaagaagccggcggtaacggtggctatcaaggtgaatacttacgctttaccaatgcaaactgggcgttagttaagattcctggacaacccgaagattattctgacgacatgctgaacaactttttagccttagctgacgtgatggcaacgggtttccacgccgcaactagcgcagaagtcaaaaaagatgataccgttgttgtgatgggtgatggtgccgttggtttgagcggggtgctttccgcaaaattgcttggcgctaagcggatcatcgcaatgagtcgccatgaagatcggcaaaagttagcaaaagcatttggcgccacggacattatcgctgaacgtggtgatgaagcagttgccaaagtgatggctttgaccgaaactggggctgacgcggtacttgaatgtgtaggtactgaacaatccgttgacacagcagttaaagtcggccgtcctggtgcggttgttggtcgcgttggggtcccacaaaaggctgaaatgaatactaataatcttttttggaagaacattggcttacgtggtgggattgctgctgtaacgacggatgacaagcaagttttgttagatgctgttttgacggggaaaattcagcccggccaagtctttacgaaacggtttatgttagatgatattcaagctgcgtacgaagcaatggaccaacggaatgcgattaagtcattggtcattgtcagtgataaataggagggaaacatgaagaaagttttaattgttggtgcaacggggactattggcggtgcagttcgacaaacgcttttgaatgaaaccgataatcagttaacgttgtttgctagaagtgccaatcgattaaagactagtgagcgtgaaagtgttatcgctggcgatgttactaaagatagtgacttagacaaggcgattgcaggacaagacgttgtttttgttgccttgagtggttctttaggtcgctttgcccaaaaaattgttgcggcaatggaccggaataaggtttcacgattgctgtttattacttcaatgggtatttatgatgaaattcccgcttcggttggtgctagtggaaatttaagtagtaatccagtgctacgcacttatcgggaagccgccgatgttgttgaagcttctgatttgaactacaccctgattcgtccgggctggtttactggtggtcctgttgattatgaaatcacgaaaaaaggcgaaccatttggtgggcatgatgtctcaatcaattcaattgcggattttgtcaagaatgcgattgtcgataatgattattatgcacatgatagtgttggactaaatgcaaaataatattcaaaaggtcattagctagatagctagtgacttttttcgtttataagcatggcagggaatcggttcaggttctgctgcaaaacatttctcaaattgttgattaaggttatactaattaaaataatatgacaaatttgaacattcaaagataattttgtaaaggttgaggtgccggtaatgtttcaacagatgcagtattttatcgcaatcgttaataatcatagttttactcaagcggccgtggactgccacatttcgcagtcagcgatttctcagcaaatgaaggagttggaaagtcaacttggtgtgaagttattgaatcggaaaggacgcagctttgaagttactgaagcgggtcagtacttttatattcatagtcaggatattttggcggatgtggaccaacttataaagaaaaccatcaaaattgaaaagaatgatgaggtcgagttgcgggttggctatttaagaagttttgggactgctgagtttttacaaactgtttcgaagtttactcaggagtttcctaaagtgaaaatcaaaattagtagtggcacgcacgaagaactctatgaattattacagacaggaaaaattgatttgaatttttctgatcaacggcgggccttatccaatgaatatcaaaatgaatttttgactgctagtgagtttatggttgccgttaacaattcgttgccagttgagacacaaaaaatcgatgttgccgacttagtggatattccttgtattttgattattgatggcaatcagcaagtctcagaagaggagtattatcgcaatgttttaggtgtcaaaagtgagtttgtgattgctaaaagctatgacgaggcacaaatgttgatcgcgtctaatcaggggtatttgatcatcaatcagcggatgagaacacaattagataaagatattgttaaaatgatttccttggttaaaggaaaccgaaaattggttcagaactattacgcttattggcaagctaataattcaggttattatatcgaaacttttgctgaattattgaaacaaacctttgcataatttttacttatgaatgacccttgatttctgaatggttttggcatagaaaagttggtatcatgcttgatgtaagtaaagaaagcgtggtaagaatgacggataaagaaatgattattaaattgtatcgtgatgaaaatattgctatggttcagaaaaacctcagtcggttaaatgaaattttggcaccaactatgaagttaacccacatgacggggtatgtgcagtctaaattggagtggattgaccaaattcaaaatgaagaaatgcaatattttgcttcaaaagaagataccatcaaagctattcagattgaaggtaaccgggcaagcttaattggtcagaaccaagttcaagcaagaatttggggtggtggtacgcatacttggcggttgcagatgcagatgttttatgagaagaagaatggtgattgggtcattagtgcgcagaaagccagtacctactaaagcgactagtgattagtggtcagtaaaacggtcgcattaggaaaatagtatttgttggcttggctagactgtcaactaaaggcaacacgcccgtgctttgtgacaatttctgaatagaatatattaagcgaactataatacctttaatttctgatgactgtggcatataacaatgttcgatattatacatttaatgctactaatgaagagaaatacacaatgatggtgttaagcttaccatcaaaagacgtgtcgtgacttgatgagtatttggcatggcgatttttcgctaattctcggttagccaaaatgaacgagctgttgccgcacaataattaaagtcaggataaggatgcacatctgattcttatcctgattttttgtttgccagctgtatgttttaaaatgagagttgtttcatgcttgatgacaattctactcaaattcatattaaacaagtcctagagtccgtttgtccggccaagtttttatgctaaaatagttgaataatctaaaaaaactaacggagaattaaccatgaaatcaatcaccttacacttagtcgttgctggagcaacgtactttaatcaacttgaccggttccagggttggagcggcacgccgttgacggcgactggcgaacaggcgacggccaaggttgcgcagcagttggcgtcgacaacgtttgataccgccttcgctagtgatacgagtcgggcgattcagactgcgcgcattatcttagactcacgagcacaacccgttaagttgcgaacggtagtcgcgttacgtgcgccattctatggcggctttgaaggcactgaacgcgcggcggtttggtcaggatttgcgactaagctaggttatcagagtgtggccgcttttgccgcagatcagacccccagtgagctacagacattgttgcacgatcacgatgcggatggattggcggaaagtgggcaggagttctgggatcgctatcaaaaggggttacaacaggttatggcggcaacgcctgatcatggtcaggtcttgttgattgtggacggcgcaacgttgcgaatgatgcattacgtcgcaactggtcgtgcggcaacgagacaagaattggcaccaagtgtggtgacaacgatggtttacactggggataagttgactgtaccggtcacggaataagttatccactgtggacaactagtggcttgcggtttatacaaaagtgcgctactgtgaaaattgagtttaaaaattttaacgaggagcttttaaaatgcaagttaatgttattacgagtacggtggccggccaagagacggtcgcaactgcggatgtgcaagctttcatggccgccatggaaaaacaattgggtgcagatttcaacttcacgttagatacagattatggtcagagtttgacggaccacagcgcggacgtttacctagtttattttggctcccaagcgaacttatccccagaacaacggtcccaaatgatcatcttctattctgatgaagatgtggctaacttaacaatcggacgttttgtggatatgctacaacagttaaacaagcagtaggcactgcgttaatcacaagttaggaagtggcattatgcaattactaattttaggtgttattgcaattgttatctttatcttagaagagtacctgtttacggccagtcgctacttttgggtcggcggtatcgttccggttttatggacggcttttttggcgtaccttgtcgtggtcaatgccatgaacttaacggtgcgcgagtatgctttagcaattattgcggtcatcattccttatgtttgttggggtaacggctatcaacggcatcagaggcgacagtcatgaaaatccaaccgatagcggcagctcaaattccacgggatttactgttattagctgatccatcttgggcacaggtcacagcgtacttatcgacaggccaatgttatggttatcaacaagatggacaagtggtgggtgttgtcgtgttgacaacgttcaaaacaggggtgtgggaagttaaaaatattgcggtggcgcccgcctatcaacatcgcggcattgctaaggccttactagcaacggcaattgcagtctgccaagcagcgccaacctgtgatgaactgcaaattggcactggtaattcatcgttgcggcaactagcgatttatcaacacgctggttttgagatgattgaagtgtgggtcaacttttttgtggataactatccagacccgatctatgaagctggcttgcagtgtaaaagtatggtgcgattgagtatgtcaacaaccggggaggtggcacaacgtgtggaaaacgagtcatttaataattagttggttttacggtgcaatcgccgtcttcattatcatgttttttacggcccgtcaggaagtcaatcggatcgtgttagaatttaatccgttcgtcatttacagtattatttgtgcgctcgtgctgtttccaattgtgaagtatcgttggccgcgggtgtttcaagtctggcgtaaacaacccaaggaaacactgtcaacgcgaccagacgatgagcaaatcattcaggactctggccgaccatggtcagtagcagccaagcggacaaagcccaaacctgttccaaccgcattaacgccgcaagtcgaggctaagagtgacttcatggatggctttatcaacttctttaagaatattttgatggcagtgattttggttcctttaagcccaattatttgtgggtattttggggtccaggattggcgtcagcgccaaaaatagtcggagctgataatctgttcagaaaactgatcaaatcaattgaagacttatgcaggtactgtggataacggcattaagttattaactgtggataaaagtctggttaacaaataaacgaatcaacaagttgttcataactttgttgattcgtttatttgttagttttgaaaatgattgatgtattgttgccggttctgtctaatgacgccaatgactttgcatcggccataaatgaggacaatgcaaatacagacgagtcatctgtataacaaaaaagcaagtcgcagttaacgacttgctgataaggtgttcaaatcttaaggttggtagttattaatatattgtttgcggttctgccatggccatgctttgacgaccccaatcatcttgctcttaggaacgagcccccagtaacggccatcgttagagacgctccggtgatcaccaaggacaaagtagtaacccttcggcaccgtattgttggtcacggacttggcccagccttgatcatggctcaaactattgagtgtccaaccagtgaacttactgtgactattagccatgaaggacccagtcgtttgttgatacttatttttgaggtaggtttgcttgactaatttgttgttcacgtaaagtttaccggaacttgtgtagcggaccgtatccccaggcatcccaatgacccgcttaacataaacggcgtttttgtcggtctggttcggatcgagtccgtaggcgttgaagacgacgacggaacctgctttgattttgctagtcttaaaagctacgacgcgttcgttattttgtaaattcggttgcatcgaagtcccatcgactttgaccatagtaaaccagaactgacgaatcagtagggcgatgatcaagccaatcgcaatcggaaccacccagctcataatgcttttaaatgttttcaatggttaaaactcccttaattgtgtgtatacctctcattataaacgataatgattttttcgcagtataaaaaagcttaaaagttcaacgatactcaaaatgggggcggttgctttcgagaatgcgtgttcatggtgataattgcgtgctatgctggtgaaagtgaaatgcgattgatgggaggaactgggagtatgaaaacacagaaagaacgaatgctggcgggtgagttgtacgttgctgatgatccagaattaggacgtgaaaatcatcgtgccaaacggttagtacgggaatttaatcaaacaaccgaagcccaaccagaagaacggcaacgattgttaacggcaatgttcaacaaaattggtgacgggggctatatcgaaccgccatttcataccgactatggaagtaacacgacaattggcaagcacttttacgccaattacgatgcgatttttattgatgtgggtcggattacgattggggacaacgtctttatggggccgcgggtcggcttatatacggcgggtcaccccattgacgccgccattcgtgctgaacaactcgaatatggttggccaattacgattggacacgatgtttggtttgggggcaacgtggtcgttaatccgggtgtcacgattgggagtaacgtcgtgattgggtctggttccgtggttactcatgatatcccggataacgtggttgcggtcggcaatccttgccatgtcttacgagaaatcaccaccgccgaccatgaatattgggctcggcaacgggccgcctattttgctgatcgtgatgatgattgatagaaattaatggtactgtgttcatgtcattagagtttggattagaaataaggccgcgatatttttaataatagacattacaccccctcagccttaaaattaacttagaaacaggataagaaagaggcggtaagcgcaatgctaaaagatgatcagatcgtgtgggcaattcaccaaatggaagcagacatcggaccagtggggccttccctggactcgcggacgccgtttcagtatttgatttcagtaattctgagcgctcaggcgaccgacgtctcggttaacaaggtgacgccggtgctgtttgagaagtatccagaaccaaaggacttgatggctgccgatgttgcggatgtggaagcaattatcaagagcgtcggattatttcataataaggcccgcaacatcattaaaacggcgcgcattgtccatgaagaattagccgatgtcgtgcctaccgatcgtaaaggcatcatggcgttaccaggtgcgggccgcaaaactgccaacgtggtattgagtgacgtttttgaacaaccgacgtttgctgtcgatacacacgtctcggcaatctcgaaacgcttgcactttgtcgctcagaccgcgacgccgttacaagttgaacaaaaaatcgtgagtgtgttggcaccggcagaattacatcaagcccatcacacgatgattgaatatgggcggaagtattcgatgaagttgacgccagacaaagaagtttgtcaattgatcattgactgtgacaagttgaatgaggaaaatgaagcgttgatctagtagtgtggggcgacagcgagcatattttagccattggtagaactgcctgtaagtcttgctagacgtgtaatcaaagccaggttacgctaaacaacctcttttccgacaggccgaagttggctgcccttgatcttaactggcagtcctatttttaacataatacgtactgacgtgagcattaagacgagtggtggtcttgatgttcgcgttttttagtttgttcacggtcgtgtttttcgatgcgtctgaaaaataggctattcagaaagtaagtaaaaccgaacataaaaacaattagcattaaaacagtcgcaatggcttgggcaatcatagttggacctcctcggataacgggtgataacactggaattatcagtgtcagtgactgttgtcattgtacgggcaatgcgaggcaaaatgcaagcggtggcttaaatgctaaccgtgaatcttgaaaatacggtatgataatagtaaccgattacatataggaggctaaattatggcatacatcgaagtgcagcaggcaacgcgccagtttaaaaatggtgagcaggtcaccgttgctaatcgtgatatttcatttgaagttgaccagggtgcggtcgttgtgattttaggcccgagtggtgcgggaaagtccacgttactcaatattttaggtggcatggacagtcctacgagcggccgtgtactggtggatggtgtggacattgcgcaattcaactcacggcaattaacaacctatcgccggcaagcggtcgggttcgtttttcaattctacaacctggttccgaacttgacggcgcgtgaaaacgtcgagttggcgtcgcaaattaccaaggacgcacgcgacgttgatgagacgttgaccttggtaggactgacgcaccggtcagataactttccagcccagttgtccggtggtgaacaacagcgggtcgcaattgcgcgggcagttgcgaagaatcccaaattattactctgtgatgaacccactggcgcgctcgactatcagacggggaagcaagtcttacaggtgattcaagatgcagctaagcagacgcagacaacggtcatcattgtgacgcataatagtgcgattgcgcagctgggtgaccaagtcattcgtatcaatgatgctcaagtgcagtcggttgagcataatgctcatccaacgcctttggctgagattgaatggtaggtgcagcgatgacagcagcttattttaaaacaattatgcgtgagatttggtcgtcgaaagcccgttttgcttcaatattactgatcattttcttaggggttgctttttatacgggaattcgggcgactggtccggatatgtcacaggcagctaatgattattatgcgaagcaaaagctggcgaccaatagtgtccagtcgacaatggggctgactaaggccgatacacgagtactgaatcaacaccgctcacagctcacttaccaagcgacacgctatgctgatgttaatcagttgaacaatagtcaagtcgtgcgggtgatggcgttaccgacaacccaacgactgaatcggttacggatcgttaagggacggttaccgcggcatgccaatgagatcgtgttagacgcgcaagcacagcgattgcagccgaagctaaaagtcggttcaacgtatcgaattagcagtacggctaagcgcaatgcacagttcacgcggcgaacattcaaggtcgtggggtttgtcaattcaccaacgtatgttgaaaatacgaatcgtggcgtcaccaacgttggtaaagggactttggactacttggtctatgtccgtccgcaggtgattaagtccagtgtgataacgcgcattgacgtgcaattcaaaaatttgcggggcgtcaccccctacacggcgaagtatcggcgcttgaatcgcgagaacaccgcgcaactcaaacgctggttaaaaccacaagcgcgtaagcggcagcaggcattacaagcccaggcccaggctaagctgaaaccattgcaacaggcgacccagcaacttgctagtcaagtaccagcgggaacggcacaactagtcaagttacaaagccaattaaaacgcgcgcaggcccaggtcgcggccatcacaatgccgacttatttgtacactgaccgtacggataatccgggttacacagaatatcacgaaaatacgcaacgagtcgtggcactgtcgactgtctttccgctgttctttattgcgattgccgcgttaatttgtctaacgacgatgacgcggatggttgaagaattgcggctacagatggggacgttaaaggccctcgggtatacgaataccgcggtcggtagcgagtttatgatttatggtggtttagccgcgctgattgggaccgcgctaggtgtcctgttcggcgtcaattttttcccgcggtttatcgcgcaggcctatggtagtatgtataatttgcccgcaatcaacgttcaatacatttggatggacattggtatcgccttagccattgcgttgttgtgcacgttggggacggcactggtcgtgctccgcgtggatttaaacagtttacccgcgcaactcttacagccacgatcacctaaggccggtaagactttgctattagaacgctggcaatggctatggcatcggctgagttttaatcataaaatcacacttcgtaatctatttcggtataagcaacggttgctgatgaccgtgctcggtattgcgggctgcatggcaatgatgattacggggtttggcttaaaggattccattggtgatattagcgtcaagcaatttaacgaattgtggcactacgatgctgtggtgacgcgtagtgggaacgaaacggaccaacaacggcaagcactcagtcgtggtcaactttaccaggctagtttgaaattacaggccaagcaggtgacggtcaaacagtccggggtagcagaacagacggctacgctcggtataccggcaccccaccaatcgctaagcaagttcgtggtattacggcaccgacaaagtcatcaggccattcatattggtgatcgcggtgcggtcatcgatgaaaaattagctaagttatatggcgttcaggcgggcgatgatttaacgatcaagttggccgggcaaaccaccaagcggattcacatcagtgcggtggctgaaaattacgtcaatcactttatctatatgagtccgacttattatcgacgtgtcttcaagcaggcaccagtatataacacgaactatgtccggtttaagcaggcaacgaaaaagcaagaaaatgcttatgcggaccggctattgaaacaggcgggggttcagaacgtgacactgatgagtacagagaaagccactaattttaaaatgctagatagcatgaacttagtcgtattgatctttgtcatctcggcgggggcactagcgctagtagtgctctataacttaacgaatattaatgtttctgaacggatccgggaattgtcgacaatcaaagtgttgggcttttacgatggtgaagtgacgatgtatattttccgtgaaaatctgatattgacggttttaggcattattgccggttgtttcttgggcaactggttgcacgcatatatcttgcaaacggctgaaacgaacgcgttaatgttttcaccaacgattcatccgttgagttacgtttacgcggcattattgaccctggcctttagtttattagtcatgggaatgatgcatcgtaagttaaagcgagtcaatatgctggatgcactgaaatctgtcgattaaacgtgtctgacaacggccaacggtagccgaagtggtataattaaattgattggaacagtttaattaaggatgactaggggatgaatggcatggcagaaacggcacagttagaagctgctgtacaggcattaagcgatattgtaaaaatgaatacggtaaataaccatgagcaattggtggcggattatttggtcacacttttaaagcaacatggtattgaagcacaatcaatcgagtacgctcccgggcgggtgaacttggtggccgaaattggtgatggtcacggcccagtcgtcgcgttggatggtcatgaagatacggtggcgttgggtgatgcagataaatggcacacggacccgttggcagcaactatcaaagataatcggttgtatggtcgcggtgtgacggacatgaaggctggactaatggctgaagtcttcgcgatgattgcattgcacgatcaggacgccccactccatggcacggtgaggttactcgcaactgtgggagaagaagtcgaccatttaggcgctgaacaattgacggaactcggttacgccgatgatattcaaacgttgatctgtgcggaaccaagcggtgcggacaaacaacttttactgaccaagtcgattcaagccatgttaggtgttgacggcgatacggcgcaacggatggcggatgcgaatccgacgaccgaacaacacttcatcgaattagcgcataagggttcactgacttatacgattaaagcgcaaggggtggcggcccacagttcgatgccagcgattggtcaaaacgccatcgatatgttgatgacttactatcagaaacaaactgcctattttgacagtttcaagactattgttaatcccgtattgggcccaaccgtgcctgtcgtgacgttaattagtggtggcgaacaggtcaacaccgtcccagccagtgccgaaatgtcagtaaaaattcggacgattccagaattacggaatgaccgcttgattaaggatttggaagccatcattgctgaatgcaatgcagatggtgccaatctaacgatggacatcgcaagttcgttctacccagtgcatacgccggaagatagccagttggtccagttggcgaagaaggttggggaacaagttttacagcaacggctcccgtactttggtgctcctggtgggacggacgcatcgtcttatattgtaaagagtcctgatatgcaagtgattgtcttcggacccggcaatattacagcgcaccaagttaatgaatatgttgatttggatatgtatgggcgcttcatcgagatttatcaaaaaatgattacggaattgctggcttaacggaaacgtcaataagtgtgaatttaattgtgccggaaaaggtttcaaaaaaagtaatagtcgtttcaagaattgattcttgaaatgactattactttttttgagcaaggcgactgaatctcggtgtatctaacttaataatgattgtggtgacggttgtgcgttattcaggttattcgtgatgcccaaaccgttgcaagtaactcgaaaaatcttcgtgatcctgggtaataccagcttccttttcttcataccaattaattttgtcgttgagaatctgtagatgatgctgaacttcgttgaactggacgagaaagtcttctttaacgtgtttgagtagtgctaatcgctggggaatcgtgttgtcgccggctgcgcgccaggtaacgtattgttgcaattcgctaatactcatacccgttcctttaagatgcaataagaatttgacccagttaatatcggcagtctcataatagcgccggccattgtctaagcgatgtggttcaatcaagcccgctttttcgtagtagcgtagtgtgggggcgctgagaccaacggctttagcgaagtcaccgattgaataacgttctgtagtagtccttaccaattttaaaattctccttattctaacttttatttgaagtaactttagcaataacaataccacgaaatcctattttagcaagtttaaactttattgttgacttaaagtgcactttaagttgtaagctgtattcatcaatcagttagcaagcaaataattaaggagtgtttttaatatgacaacaactaataatagcggcctatttggattaggtgtaaagaatgaggcctaccaacaatactttatcggtcaaagttacctgaatgccttagccggtgatgagcaggtcgacgtgaatgtttccaacgtgacgtttgaacctggctgtcggaataattggcatatccatcataacggataccaaatcttattggtaacgagtggtgaaggttggtatcaagaggctggtaaaccagtccagttattgcatcccggcgacgtggtcacaattcatcctggtgtgaagcattggcatggtgcaacaaaggatagttggtttgcccacatcgcgattactaagggaactagcgaatggctcgaaccagttgatgatgaagcctacgcaaaattataaaagttaaagtagttatcgaaggaggaaactaatatgacagttaaacaaaccgcaggacgcgacaacttaggcaaattagcaccacagtttgccgcattaaatgatgatgtgttatttggtgaagtctgggcacgcgaaagcgcactaagtttacatgatcggagcatgattaccattgcgtgcttaatgaccagtggtgattttccacaattaaaggcgcattttaagatgggcaaagatcatggtatctcaaaggatgaagccgttgaaattgttacccacttggctttctatgcgggatggcctaaggcgtggtcagcaatgacactgatcaaagaagtttacggtgagtaggaggaacagttagatgacagttaaaaacaaagtcgttgtgattacgggggcctcgtccggaattggggcgacgaccgctaagcaattagccagtaatggtgctaaagtcgtattgggcgcacggcgtgaagaacgcctggctgctttagttgatgaaatcaaggcagctggtggacaagcggcctatcaggtgacggatgtaacgaagtcggccgatgtacaagcactggttaagctagcgcaaacgcaattcggtgggcttgacgtgattctcaataatgctgggattatgccgacatcgccaatcagtgccttgcacacggatgaatgggaccagatggttgatattaacatcaaaggcgtcttgaacggggtggcagcggtcatgccaatctttaccgctcaaaaatctggtcagattattacgacatcttcagtggctgggattaagtcctttgctggctccggcgtgtacggtgctacgaagtttgcggttcgtaatttgatggaagtcattcggatggaaagtgcccaagaaggtaccaatattcgaacggtcagcttatatccagcggccatcaatacggaattactgcacacgattacggataagacggccaaacagaatatgactgatttttatcaacaagtgggaatcagtccagcagccgttgcgaacgtggtcaactttgccattgaccaaccagaagatgttaacgttaatgaatttacgatttatccgacgaagcaggcttaacttgatttagctgttgttaacggttgtttgagctagttgccgataagtcgaaaatttgaattcaaaaaatacaagcacccggtctagcgcataatggcgttgctagaccgggtgcttgctgttgttataaatattcaactagtgggcctacttcaaccgtaagccgcgctttaagttgccccagaaaccgagttcatccgtttgtaacattagcccgccatagattcggccgatgtagatcatacttccaatgattgttgcaatgagaatcaggagtgacacgattgcagcgggcatcgttgccatgccgttaatgaggcgtaatggcatgaagtatgatgagaagaacggaatatatgagaaaatcttaacgaagagattggtgggtgtgttctgaaaggctagggccatgaaaaacgctagcatactcagatagatgaccggttgtgctgccttgctagcatccgcgacccgggtcaccaaagcaccacagaaggccgacgctacggtgtagagtagtacggccagtaatgcaaacaacaagttgattgagaccaagttgtgaatcacttgattgatcaaatcggtattctgttgccaaaaatcaattgtgagtgagctacgtttaacgaattgcatgacggcaaagccacccactaagtagacgagcagctgagtcacaatgactagtaagacaccgtaaattttaccattgaagtatttccgcggtgtcgtactcgagaagatgacttccataatcttggtgcctttgtctgcggcaatttcttgggctgtgattgctgaataagtggtcaaaatcaagtagacaaagaagacgacaatatagaaggagaccgttttagctgttttatctgaagcagcgtgtttctgtaattgttcagtaaattttggctgtacagccaacgcctgggtctgcttggcacttagttgtgcgcgctgtacgttacgttggctttgggcagtggctaagaactgctgaatcttagccttgtcaccgctgctgacagcattaggaccagtgaactgcgcttgcaactgttgatttttggttgttaaaacgaggtagccggcgatgtcattgcgcttcgtcgccgccttagcgctggcgagtgtttggtatttattagcggtagccacatgactctgcttaatgaaacttgtgcgtaattgtgggctagtgctaacgaccgcgatgtcattcttactagcgctgggtgcagcaaaataagaaaaggcggccacgaacccgaagaacaagaagggcataaagacgagtgacaaaaagctccaggacttgatctgccgcaagtaggtttcaaaagtcacaatccaagtcttattcatggttaacacctcccgcttcagttcggaaaatctcatccagcgttggtggctgctgactgaactcttcaatgtaatgaccagcagtgacttgatcaaaaatcgctgggccaactgaagtatctgcaagttcgagtcggaatcgacgggcaccttgttgagtaacggtggtgactcctggtagatcggccagttgcgcttgtgaccagtcagtcgtcaagaagagacgggtccggccaaactgggcgcgaacatcttcaacggtacccttaaggactgcttcaccattacgtagcataacgagtgagtcacagatcgcttcgacattactcatatcatgactggaaaaaataatcgcggcgccccgttgcttagcatctaaaatagcttgcttgagcaggtcggcgttgaccgggtccaaaccactgaacggttcgtctaagataatcagtttgggatcatgaattaaagtacaaatcagctggaccttttgttggttccctttagataacttatcaatcttatcggtcggctgccccttgaccgcaaagcgcttcatccatgcggcaattttgcccttggtcacccgtgccggctgatttttcaaacgggccaagtacacgatttgttgtgtgatggttaatttggacattaggctacgttcttcgggtaaatagccgatttgatcgtagtcatcagcggtcaacggttgcccattccaagtaatttgaccgtcgaatgatagaaaatttaagatgctgtgaaacgtggttgatttccccgcgccattttgaccaatcaatcccatgatttctccgtcatggacatcaaatgacacgtcatttaatgcttgaacagtcccgaaacgcttctgaatatgtgcgatggatagcattagtttgtcccccaaattcttgaaataaagtcattacgtgttgtgcgagctaatagtcatgaaataggatcaaaacgtgccaagtttagattgttattcgtcagccggtgtgcgttctatgccgacctccggggctgggtgacaattgctggaacgtagccgacgtcgatttgagctaacgcccaacccgcgtcatctcaaatacgagtcttattctaagccggaagcaacccacttccagctaagaataatttggctactgagcattgtcacccagcccctccagtcgggaacccgctcgaatggctgatgaacggctacttaacttgatgaaatttgtcgttggctattttgatacgggaactttaaataaaacatcagggtgcataacctactttgtcgcaacattcaattttgactacagcggcttaagatgttgagctattccaatatcattttcagtctgatagttgctgagagaaattactatttatgaaaaacaatgacgaattcaccaaaagttgggtccgcacatgtccgccattcgaacactgtcccgactggaaggcgtttcggccaatgctcagcggtgaaattccacttagcaagcgcccttggcttggttagtggaagaccagtatttaagacgtggtctgcggcttaaatctgtgtccaccgcgttccagcaattggccgaaatgcctggaagtcggcataggacgcgccaactaagtaattttacgctaactcgaactttttccagcgggcctaagctggctgcttttgaacttacacaacttggcacgttttaatcctaattaggcctaataactattggcacaattagcaatcattgtttgattttatgatgacatagttgattcggtgtgacaagggcgtgcgcttggttctaagtgaagcttatttgggcaagcgggcgttttcaagagctaatagggcgcgtttcattggcaaaccaccacgatagccgccaagttgaccgtctttgcggcggatacgatggcaggggatcacaataaggagtggatttttaccaacggcgctggcgacagctcggactgcggtagggtgattgatcattgtggcgagttgtgaataagttgcagtttgaccgtatggaatacgggttaaagcttgccaaacttggtgttgtaaaggggtgcccgtcgtttggtcgaggggtatgtcaaaatgctggcgttgaccagttaggtaatcatgtaattcttgacaggcctgttgattagcttgttgatcataatgaatattagcggatttgaagaaggcttgccattcgtcgcgtggaccgttggcacggccgacaaaggctaagccggtgggcgttgtgcccagccagtaagtttgctggttaatggttgtttgggtcaatgttaagtgcatgtgtgagccctccgtctcaattaggatagcgttagtataacagaattggtggtgtgacgacctgattaaatcagaacatcactgctatatcttaatgaaaaaagccagtgcgaacgatgagtcgtccgcgctggctttgatgtcaatgataaagcttgaatttgataattgcagatgctgattagtaccagccgtttgcttgccagaacgctttagcagcagtccatgagccgtaacggccagcgacgtatgcgtcggcagtcgcttcttggttggcggcagaataatcgccatttaagagggattgaccaagttgatatttaccatagtaaataccgttggttacggtgtaggagccaccagattcgcgagcagcaatccaggccttggcagcagcctcagatgtactagtcgagctggttgtcgtgcttgttgttgaactggccgtgcttgagctagcttgactggcagttgtgctgctagtacttgcactactagttgcggctgaactagcggtggtcgtcgtgctttgactggttaccgttgtactttgactagccgcactttttactgaactagcactggcttgactagtactgctttggctagcggccgacgttgcactctggctcgtcgtgctagtgactgaactagcactggcttgactagtactactttggctagtggccgacgttgcactctggctcgtcgtactagtgactgaactagcactagcttgactagtactgctttggctaacggccgacgtcgcgctttggctcgttgcactggtaactgagctggcgctgttttgactcgtgctgctctggctaacggctgatgtgctgctttgactggctgcactggtaactgagctggcactggcttgactcgctgtgctttgactaaccgttgacgtggcggtaacggtgctagtaggattttgaacggcggcactagttattgtagtcgtcgtgcttggcgtggctactgaggtggtggcccgtgtcattttaactgtctggtgtttgttaacttgtagtttgtccccgacgtagattaagttgacgttcttcaaatggttcaacttttgaacggcggcaacggttgttttgtgagtgtctgcgatttcactgacagtgtcaccagccttgaccgtcaccgtatcggccttagcagcagttgcaccaagggcaatggcaccagttgttgctaatgaggataataataggtgtttaattttcatataattgattcactcccaaactagattagacttcccttaaagtttaccatcatgtaagcggttcgttaagcgcaatttgcttactgacggactttttagaaaataaaacatgcccgattaagacatagtgtaacagattaacgcttacattaccgctaatttgcaatgcaatcttagtgacgagtgtgtcaatgtagtgacctgcgtaacgtgattacgttgacggtggggggcatggtagaattggacttttgaaaagccctcccaaattgactgcggcttgcacgtgttcgactttaccagcagaccatttgcatagtggttgatgaaggactgcaataagggccgatcatggggggattgccagtttgcagtcaggcaagtccgatgcacctatatggcaacagaaaaacgcggcccccatataggaccgcgctgattgtatgttcagttgtgcatgaatgtgtttagtaataaccgttggcttcccagaaggccttggccgctacccatgaaccgtagcgtgaagccacgtattcgtcagcgacggtttcctgattagaagctgagtagtcaccgtttagaagtgacttgctgagttgatacttaccataatagttcccgttagatgcggtataggagccaccggattccttgttggcaatccaggcttttgcggcagcttcagcactacttgatgtgctagttgttgatgaactgctgctagtactcgttgtggtgctgcttgaagtggtagcactactgctggctgccgtacttgtgctggcggcactggaagcagtggtgttgctcaacttcgtcatagatgcggaagtggcggttgaacttgacgccgtgctagcttggctcgttgcagagcttgaagtggcactgctagttgacgaactggcggcactacttgaggccgcgctggcggttgacgtgctggtcacgctacttgaagcagcacttgtgcttgatgagctggcagcactacttgaggcgacacttgtcgttgacgaactggtagccgtgctagctgctgacgtacttgtactgctgctaacggatgcgctgctggcactttgggtgctagtactgttggccgttgaactggcagtactggtcgaactagccgtacttgaagcagcactagttggtacttgggtagtaaccgtggttgcgtggtgtttgccgttgacttccagtttgtcaccgatatagatcaagttaacgttctttaaatggttggctttttgaatcgctttgatggtcgtcttatgcgttaaagcaatttcactgacagtatcgccagctttaacgacaacggtatcggcattagcaacggtagtacctaaagctaacagaccggtagctgccaatgaagttaatagggcatttttaattttcataagttaatcagtcactcctataaaagttgtgttgttatttcgattgaatggtgattagtataccgaccgcagattgcaaagcaataaataacagattacggtttgagccaattttgtaataaagtaacatggtgtaacaagttaacactttcatcatgttttcgccacattatcatcacactcgcggtaaaattcagaaggtaacttaaaaaatggtttaaagctgtgagcgatattcttattaattcagtaaaatttgttataatcgagaccgttaagcagaacgtcgtgtaagggagcgagtaataatgtattattttgtgaataccagcattaacccgaaaaaatcgggaattgaacatgctgagatgaaacggctggcactttttaaccagcatcacgttcctgctaagatggtcacgcgatttttttcattatcgttacaccagacactgacagcagcagggattgcggctgaaaatcaaattaatctgtttgatttcattcagcattccagtgaacggccaacgactaagatgacgattgaagatctgcatctagcaccggactttcgggtgcaatccgttgggcgtcattatgaagtttatcaaaatgaccaattattaatgaaggtcaatacatttctgaacactcaaaaacaactgaacaatgtccaatattatgatcaaaatggtaagttagtgaagaccgattggtacgatacccggggatttaaagggcttgaacagttctatgccgctgatggacaagtagcaagtgaacaagtctttaatccggacggggaggttgtctatcagacatttcatatggcagatcgacaaaatcaggtccaaaattcactttatcgattcattaattatgaggggcaagactggtcatttgctggtgaaacggcaatgacaacctttttcctcgatgaacttaatcggaggacgccgcatgcggtctttgtcattgatcggacgtatgagttggcttacgccgcacttcacatgcgaactaaagcgtttaaagtcatgcatttacacagtaatcacgttaatgatccagcccatccgaagacggctagtctcaactttaattatgcttacgcgctcaataacctagaccaatggaacggcgtcattgcgtcgactaagcaacaaactgctgactttcaagcccgctttggcaatcaacccgccgtttatacgattccagttgggattgtcgatgacgcgactttgaatgcgcccaagccatcttttgatcagcgcaccgcaggcaagattatttttgtggcgcgtttagccgaagaaaagcaacaagatcaggtgatccgggcattcaaaaaggtattggcccaagtgccgaatgcgacccttgatttctggggctatgcaaatggtgataccggcaaacaactgcatcaacttgtggaacagctgggactgaaagcggcagttacgtttaatgattatacgaccgatttaacagctgtctataatgatgcgcagttggcgatgttaacgtcgcgggcagaaggttttgcacttgccttgcttgaaggtcaggcccatggggtgccccagattgcctatgatgtcaaatatgggccacgtgatattattcgggacggtcacgatggtcaattggtgccggtcaatgatgaaaatgcgttggctacggcgatgatcgacttgttaacgcagccgaaaaagttagccatgtatagtcaacaggcttatcaagatgcccaacgctttagcacaacggctgtttggcaacagtggcaaccactcatgaaagccgcagccgatttttatcaagttgagggggcaacacagcgatgaatttttttgtgaaccaatatttaatggcgttaaattctggtgtggaacatgccgaattcaaacggctccagttgtttaaagatcatcaggcaccggctaaactagtaacgcgtcaatttgatggtttgttacatcagaatatgcggcgcttcaatattgccgatgatcagatggccaacttgtttgacttttttcgtgaaacgaccagcttttccagtcgggtcatcaagatggctgatttgaactggccaactgcctatgacattaagccggaccccaatgtcagtgaggtgcgagctggtgatcggctggttgctaaggtccactttgtccccagcacggtggggcatgtgtacttcattgaaatttttgatcacttcaataatcttgttcagcgtactgattatgatgaacggggctttaaggcccgtgatgaattcttctcgtcagccggggaaccaatcacggatattttctatcgaccagatggtagtcggatggccgaacagtattatacgcatgataataatgggactaattatgtttcgttgtgccatcttatcaattatcatggccgtgactactactttaatggtgaacaagaatggtaccggttcttcttagatgaactgaacaagcaatatgatgaaaacaacgtctttattgcggatcggccgttagctgctcagtggccggtggtgaacatgcagacggcggctaaaaaatatttgtggttacccacgccacatgcagtcgatccgcgtgatcaagtctattctaatttgaataacgcgtatgtttatggcctgcacgagtttctgagtgcttgggacggtgtgattacgagtaccgaacaacagaagcaagatttgacgcagtggctcggtggtcaaccgagtgtcccaatcctgacgatttcagcagccattgtttccaaacagcaagctcaacacgcaccaatttcgatcagtgaacgtcatgcgcatgaaattatttataccggccgtttggatgcggaacggcgcgtcgatcagctagtgacagcttttgaccaagtgcaccataagattacggatgcgaccttagtgatttacgggtatggtggtgagcttgaccgtctaaaacagcaagtgtcccagttgcacctagagaccgccgtgacttttgctgggtatcaaccgaacttaacaatggcttatgatcaggccggtgcttacgtttatactggtgaaagtgatgcgcagccattatcgttaattgaagcccttagtcatggtgtgccagcaattgcttatgatattaactatggccctaaggatgttttgaaggatggcaagaatggttatctggtcacggatggtgccgtcaaccaactagtcagagcgctgacccgaacacttgaaagtccgcaacgtcagcaacgacttagcaagggggcctatcggagtagtgaacaatatagtgatgaacaagtttggcaacagtggcagccggttgttcagtgaatatcaaaaatggtctggctttagtggtcagaccattttttaaacgctaatgtcaaaaagacctaataacaacggcggggatcgctaatctgaccacgttgttaggtactgggtaattgcagtctgtacggggcgcagtgccgctgccggttgcgtgttagtcagtaaaaagaattggcgttggtaatgggcacttagctgttcgatgggaatctcgttgcttaaaacgtgacgtgaaataattgtttggccgataccatgagcgaggaggtccgcgatgatttggttactgtggatgaccatgacttgtgctggctgaatgttgcgggcttttaaaaaggcgttggtataatgacgcacaccggaattaggttcacgtagcagccagaggggactggcaaagtcgcccgcatggacgagctcatcgtgaccaaatggcaagcgattgagctggtcagtaacgagtggcttttcaactaaaccaaagtccagtttgtgttgggacatagcggtcaaaatttcggccgaattggcaagcgtcacttgaaagtcaaagcgatcactgacggcactcaaattggctaataaggtgggtagaatcagacgcccggttgtgtgtgaggcaccaatccggcaaggaactttcactaagtggcgtggtgattgtaccgctgttttggtagcggcccaagttgttaacagcttttgagcctgttgatagaggagctgaccactggcagtaggaacgatttcttggcgcccgttacgtgttaagagcgtggtttgtaaatcggcttcaagttgtttgatttgtgttgagacggtcggctgggaaataaaaagttgctcggcggcatgggagaagttgcgagtttcgtataccgcacagaacgtttccaattgtttaaacattgtgttcacccctaactattatttttattaatagtaactatcataataatttatttctcaaatgtaaataactttcgtatacttaaaagcatcgagatagagatgggagaaagcgaatgaaggtcaaagggattttaccggggttagtgaccagtctggtcattgcaattattagtcaaggattggcgcaatttgtgccagcgttaggtgcggctactatcgcgattctattaggaatcattggtggcaatacgtttctgaaacaaccgcaacttggtcgggggactaagttcgcagaaagtaagctgttggaatattccgtgatgttgctcggtgcgacgatgacggtacagacaatcggcaaaattggtgggttcggcgtgctctttattctttgccaaatgacgattacgatcgttggggctttgtggttggggcgtaagctgggtttcagccagtcggtacgtatgctgatggccggcggtaacgccgtgtgtgggtcgtcggcgattgcatcaatcgcccccgttattgacgcggatgaagatgataaggggactgtcattaccttagttaacttgatggggacagtgctgatgttaacgttaccggtcttaggaatggccgtgtttggtggcagtgtcattcttaaaggggcgttgattgggggaactttacaatcagttgggcaggtagtggccgcagctagtatgattaatcaaacaacggttcaatttgcaacgattttcaaaattatgcggattatgatgctagtcgtcgttgttttgatttttggccggttacaccaacgcacgattgaaaatgaattggctgaggatgctgtcgtcagtggtaatgggaacggtcattggttaccatggtacgtggccgggttcttaatcttatgtgcattgaatagcttgatttcgttaccagcaattattggcgcaacggctcatacaatcagtagttggtttgaaatcattgcgttagcagctatcgggttacgtttgaatcttgttaactttatgaaagctggcaagcgcttagcactgtatggtttaggcgtggggacgattcaggtcgtcagcgccttgattttaattacgttattactgcaacattaattgggttttgagacacttaaatcgcaatcatggttaatcattcaattaatcatgattgcgatttttcatctaagagagtaggaatgttcatgctaacttatcgagtcacaccagcgattgaattgcgagaaccgctaccccaaagcgatgcgccggcattactagcattattaaccgctgatcgtgcgcagtatcagtattatttgccatgggtggctaaaattcaaacggtggcggatgaacaacgctttttaacttttgcacaagctcagttacaacaagcgcaagcgctcaacctagtcattgtcgttgaacaacgggttgcgggaatggttagctgtgaccacttcgatgataacgaccacagtgccaacatcggctattggttgggacgaccatttcagggacgcggcgtcatgacggcagccgtccgtggcgtttgtgatttgggttttaatcagtatcatcggcaatgtttgcggattcgtgcggcggtggacaatcaggcaagcaatgcggtggcgcaacgggcgggctttgactttttgattcagcatccaggtggtcagcacttattggatggcgatcatgatgagaatgtgtatcaggtttcagcggttgattggctggcgaagcgccacaagtgatgacgattaaacaaaaataaaactgactagccaagatggttagtcagttttattaacgtctaatttttaactgtcaccacttgccacgtcttaggaattgtaaacaaatattggcgttgaacaatttttgtcttggtatttcctaggctgaataacacgtgtgtcaggtgatttttaaactgccaagtcgtggtctttagttgaacctgcgcgggtgaaccgctagtcagtttagttgttgtggtggttgcggtcaccgtgtgactgactttagtggcggctgcaactcggtaactgatgacgcgttcagaccccgttccgagttgctggacccgcaacgccgcttgtttggattttagcggggctaaatcttgaatttgcgtgcgggtgacttcgtgcatgccccaatggtaattgtcgtttaggacgagggcgatgaggctagcggcaataatcaggccactaataataatggcaatgagacggttgcggcctgctggtgaaaaaatcatcgtgccagcaaagacaagggttgcaagaattagtaagacaatgatcatgcggcaccatcctcctgactaatggtttttgaatgattggtttttaagaagaaggtaatcccaaagccaatcgcacaaaaaatgagtgagacaacgaacgccatgtgataaccagttaaggttgcggtgattccgtcctgacggtatttcaaaggtgcctgtgtcagtaattgatgtcccggcatttgccacttagcgacgctggagtagacactgattaaaacggccgtccccattgaagctgcgacttgacgtagggtgttgttggcggcggtcccatgggaaatcagccggaaaggtaacgcattgatcccggtcgttgtgacgggcatggtaaccatggtcaggccaaacatccgaatggcgtaaacaacgatgatccataagattggggtcgtggcgctaattgataggaagaaagcagttccaagcgttaggagtaacatccccgtcattgctagtctgcgggcaccgatatggtcaaagatgcgaccagtaatggggctcataattcccatcatgattgcgccaggtaataaaatcaatccagagtccattgctgaacgaccgaggaccgtttgaatatacattggcaaaatcatttcgacgcccatcatagccatgtaagcgagggcggtcaggattgcggatagggtgaaagccggaatcttaaagacacgtaattccaataatggctgatccatgtgaagttgccgccagacgaatagaccaatgaaaatcagaccaatgactaaagttgtgaggacgactgggtcgccccaaccagcattaccaacggatgaaaaaccgtataacatactgccaaaaccaattgttgagatcaagactgaccaccaatcaattggttgtttggaagttggtaagactttccgtaaagtgaagaatgaaacgatgatgactagaatattgattggcaggatgaataagaagagtgcccgccaggaatagttatcaataatccagccagagagtgtcggtccgatggcgggtgctaagccaataacaattccggctgtccccattgcggaaccccgtttttcgggtggataaactgaagacatgattgtttgaaacactggggcggaaattccgacgcccattgcttgaatcattcgggcaatcagcaacatctgaaagttgacggcaaagtacgccagcgtagttcccagaccaaaaataagcatggctgttaagtacaaatacttggaattgattcgggtcagcaaccaggcactgacgggaatcatgattcccatgattaacatgaaaccagtggtcaaccactgaacggcggttgctgaaatatgaaaatcggccattaacgttggaaaagctgtcgttaatagtgtttgggtaatgaaggtagtgaacgtcccgacaagtaaagtcaatacaagccaagtccggtgatagggctggccgttggcatcaagcggcaacgttgaattttgagttggcataataccgtcctttcttttataaattctgtaataatgcacaatcaataagtatatcacgatgcaagtcctaggcctattaattggtactggggcggtctgctgagtgttcggtgtcgtggtaaaataaaatagataatattagttaatttgtggtgagtcgtgctaatgatagccagcacaattcatcgacattcagtaaggaagctaaaaaatatgaccaaaaaatatttaacatttgattgttacgggacgttaattaatactgagccgctgtatcaatgggtggctaatttaggattggcggttggtttagacccactaacggttcgcaaagcctacgcgacttatgaggacgatcctgccagtgtcaatccttatctagattattcaacattagtccgggctgatcttaagcatttagatcgattgtttgaacagagacacttctttgaaagtcattacgttgaatgcttggaagtgcaacgacacctattaccatacgccgatgttataccgaccttaacagcgtggcagcaattgggctatcaattgattattatgtcgaattcttcctgggatatcatgccggccaacattgctgctttaaaggtgtcgttcacagcggttgttacggctgaagacattcaagcttacaaaccagcgttagctttctttgaaacggttcaagagcgttttaagttaacggcagataatcattggcatattgcacgtggctatgaatccgatgttgttccagccagtgctatgcagtggccgatgatttggattaatcgtgatcagcgacaaccgactagttctgaacggccgacccatatggttactgatttggccgctgttaagcagtgggttaactaggcgtgcgcggtagtgtccccgttgatcaacagttaaaacactggttgatcatcagggttgaacaagctttctaattttgactaagctgttaaatctcaaaattggaaaggaaattaacgtgaattcaaaatctttaaataaaagtacggtcctattaatggcgatctccgcggccattgtagtggctaatattaattatattcaaccgattgaggcggacattgcgcaacagtttaatctcccaaacgccgttattggcgcggtggcaatgctgacgcagttaggctatgcctttgggttgctcttaattgtacccatgggtgatatcatgaatcgccgaatgttgattatgcgcttactggtactcgcaatcatttcagcgttactagccttcgtggctcccaatatttgggtgtacgccttggcaagtttactgattgggataacctctgtggcaccacaagttattattccgtacgctggctttctcgcacctcgtaatcagcgtggtcaagtcttgggcaacgtcctgagtggcttgctcgtgggggttctcttgtcacgaactgtcagtggggtacttgcgagctatttgtcttggcagatggtctatctgattgccgctatcttgattgcaggattgtggctcgtcttgtggcgaaaattaccgcatgatcccgtgacgacacataccacgaattataaagccatgattcagacagtacctcagttagtaaaacgctatccggttttgcgagcgtcggctgttaacggatttgtcttgtttggtgtttctaatattttctgggcaacactcgtcttttacttgcagcatcaatacgggtggggaagtcgtgaagctggtctgcttgcgttgctaggtgttaccggtgtgttagcagcccctttaattggccgcctagccgatcgttttcggccccgaacgattatcggcttgggtctagtgttatcaacattagcctacgtagtgttttggctgagtggtacgcatttggtggggttaattattggtatcgtcattcttgatttaggtactcaattcgggcaggtcgcgaatcagacacggattcaaagtatcgatgtccatgccagtagccgtttcaattcggtattcatgtttggctacttcatgggtggcgccctaggttcattttgtggcaacgtcttatggtatttagctggttggaacggcgtctgcgggttagcggtcgtcgtgttaatgattggcttttatgcccactttgttcattatccacgggtggtgacacgacaagtgcaacattagcagtgtattagttaatcggtcatgaatcatgattaaaacgtgtcaagtttagattgttgttcgtcagccggtgtgcgtcctattccgacctccggggctgggtgacaattgctggaacgcagccgacgtcgatttgagctaacgcataacccgcgtcatctcaaatacgagtcttattctaagccggaagaaaatcacttccgactaagaataatttggctactgagcattgtcacccagcccccagccatctcagcctatggggccccggtttaagccgagcattgcctagctacggatggatgctgtttttggcatgagtccgttggcgtagcaagcacaggatcagtggcccgcacgtttcgggacccgctcgaatggctcatgaacggcacttaacttaggacaactgtgttggctattttgatacgggactttaacgaaaacgttaggtgtattaacccttggtccgagacgcggccattatacgatttgattgatgcaatatgagacatcctaatatcattttcacctctgcacagttgattgataaaattattgttatgaaatcacgacgcattcaacaaaagttgggttccgcacatgtccgccattcgaacactgtccccgactggaggcgttttcggcatactcatacactgcaagagtggtgcggttcagacgaggtggagacgggatgctactagctagggcgttaagcgtgaattttcccttggcgtcatgcgtagctaaccgcagtctccagtcctgacccgaacaactttcaaatttcatccaaaaacaaaaatcaaccaaaaatcagactcaaaatcaataagatcatcaagaggacgtcctaaaatcatcgcgaatcaaaaaatgcatcacaccaagttggcattaaagcgtgaagacattatttaagacttgggcttcggcttaaactgatgtccacccgttctaaagcaattggccgaatgcctgggaagtcgcgtaggacgacttgaaagcatgtttacgcccactcgcaccgtttccagcgtttttagctggcgttttttgaaactaaaaaacgacacgttttaatcatgattaatcctaaatgactaggcatatacctgttgtttaagtaggctggtgaatgtttttgtaataacttgatgattgataggcctggcagtagggacgttaattaatatgaagtatggctgatttgattcttaattaatcttcgaccctaatcggcgttgacttaatattagtcgtttaaatcaattaaagatttatttcagagaaaatgtctacactctaaattttcatgttataagatgtaacatgatctaaatagaaggggttttgctatgcgaattgaagctgattgtagtggaagttagctttccgtagaggctttgtaatggatcctacgttacgtgccgtgcataattttccgattacaacgaattgtgcatccactgatcatgcaaagccttgttcaaactcaaaaggaaagcggccggccgttgaatgcggctgccggaagctttgtctaatgaacggccacgccattattgcgtgcatgttaatcaggtactcttggggcgtttacgcgatacttcagtgtgccagcgttcaggggggtggctggaccagttcgggctaacataacgtcaatgattgtgctaatttggctcacctattgatgccggcagttttgccgttcatccaacataatgttatcatcacatcaaccaatgatcttttgccagacggccttaaaatggcgctttgcatgcaactccagggctatttaacgggcactcagccggtgtacaacgttactctggttaaatcgcagcgttatcacaagatgcccatcaaagttgccgactcagacttaagatgcgctccgacgacgtaacggcggacctttctgcttattaaccaaaaaa

SEQ ID NO: 723 - DNA, 72047 bp, Unknown
  Metagenome-assembled genome
aaacgtgataaagtagatgtacccaaagtaatcactccctatattggttggaattagctactaccattgtaagtgattgctttgggctttttaatttctgttcggattaattatagaatttgccataataattttgctcaaccgataagtgctggtccacctcacctatccgttagacacactaaccacggcaaacgggccgtagctcccattgttaggggaactatggccttttactaacggttaaataattgttggtcacagtagaaccttcaccaacgcttcagaaactgaggcgattaatttctgaaaatccacaaaaagtcctatgcaacccacgattttagtgtatactagatatgttgacgaaaagttaacgtgatggcggtagtggcgaagtggttaacgcaccggattgtggctccggcacgcgtgggttcgattcccacctaccgcccttctaaaaaagcacgtgcaattgcacgtgctttttatttaatcaaattttctaatcacgccttcagccaagccttcaaagcggctccagtgcgtgaagtgggcacgtcaactgctgctcgtggggttccgctatactgaattcggccgccatactgaccagcatccggccccacatcgatcaaccaatcggcctggctaattaccgctagattatgttcgataataatcaacgagttaccagcggccactaaggcatcgaataattttaataagcgttgtgtgtcttgcaaatgcagaccggcagtcggttcatctaacaagtacaccgttccctgcttgcctagctcaaccgccagcttcaaccgttgcagttcaccacccgacaaagtggtgagcggttgcgccaatgttaggtaacccaaaccgacccggtctaaattcttcaatggctgagccactttgtccatcgtggcaaaaaaagctaacgccgctgtgactgacatctggagcacgtcggcaatcgtcttaccctggtaagcatagctgagcgccgtttcattataccgcagcccatgacacaattcacatgtctgcacaacgggatccataaaggccatattcgtgatggtcacgcctttacccttacaccgcggacaagcacccttaccattatagctgaaccaactagttgccacgccattggctttcgcgaatagttgtcggatttggtcgagcactcctaagtaagtcgccggtgttgagcgaatattcaggcccactggtgtctgggctaaatcaatataagccgtctttaattgccgttttagcgcggtaaccagcgaactcttccctgaaccggccacccccgagacgaccgtcatcacaccgaggggcatgtcgacactgacatcgtgcaggttattttcattaatatggtgtaatgccaagtgggcctggactggtcgttcttgaccccatttatgcgattgtcgcaaccaccggcccgtcaacgtatcagaagccagtaactcgtcataagtcccggtaaaggtcacgtttccaccagtgcgaccagctgcaggccccatctcgacaacatagtcggctaacgtaaacatggctggattgtgttcaacaatcagaattgtgttacccttatccttcagcttcgttaacgcttgcttgattaactgaatatcatgtgggtgcagcccaacgcttggctcgtccaaaatgtagaccatatctactaaggcgctggtcaagtatttggcaatcttaatccgttgcgcttcaccaccagataaagaactggtcccacgatccaatgtcagatagcccaggccaatatcgaccaacgattggatcttggtcgtcagctcccgcacaatatcttgggctaacggcgcatcaatcgcttgtaaaaatgccagaacatgctttaaatccatagccgtcacctgagcaatgttgaccccgttaatatgattggtcaacacgaccggtttgagtcgtgtgccatcacacgttgggcacggtttgcgcgtgacgatcgccgcaatcgcatcgcgatggtgttcggcttccttcttaccaataatcgagcgcttgatccgcggaacaacaccttcatacagggccgttctaggaaaaccttctccaggatgggctaatttctgttgcggtgcgtgcatcagtaaatcgtattccgcagcactataatccttgatgggtttatcattgtcaaacaaaccactcgtcgcataacggcgccaacgccacgtatccggtgcaaaactcacaaacgtgatggccccctcatttaatgatttctcaggatcaatcaattgctgctcatcaatatcgtcaacataacctaaaccttggcaggttgggcacatgccttggggtaagttaaacgaaaaactgtccgaatacccgataaacggttccccaacccgtgaaaacaagagccgcagtaacgaataaatcccagtataggttgccaaggttgaacgcgcattcttgccgaggcgttgttgagcaatcacaatcgcaacgggcaagtgctcgatatgcccgacgtgtggttgaccatacttcggtaaatattgttgcgtaaaactgggaaacgtttcattcagttcgcgccgtgacgccgctgcaatcgtatcaaaaacgagtgacgacttaccggaacctgacaagcccacgaacaccgtggttgcatatttaggaacgcgaagactaacgtgctttaaattgttttgggtagcgtcgtatacgtcaatggcgccatgtggaaatgaataactggtcatcaaaccttcctttctatcacttgtttgctatcaaaaaaggacctgaaaattcagatcctaagtatcagactgattcatcaacgagcttgacgaccgtcccatagccggttacgatcaaaaaccgtggtgcaacactcatctgagcgacttcagtattgaagttcacataaattaacccgtcgccaccttgatcctctgccttttgtagcagtagtggcttgacttgctcgattaaatcgtcaaaccgttcaaactgatcaacaccatcagattcaaacatcaggtgttttgtgacggagacgacgcccttaatcatatgggagcgctgtaaatcaccagttgtcataaacatttttccaaccccctatcactttaattttacttgaaaacgacgtcactcgcaaacgtaaccaattatttgaccacaagtttttaaaggactaaattaatcgtagggagtgatagtttgaaaacagcaacacaacttttacaacaatatacctttgagcccgttaaggataaaatgcgggtcgaacaacacgccttagccgtccaacatcaggatcgcgccattccattcggacacttcaagatccggttgaaaaatattgataatcaacaaacttatttattggaattaaagcaagcgttacagttgaccaccacgtctgggttccagttacgttcccgactacacggggtgcatgtcaaacatgcacaacacatgatgccgaccggttatcacgtattggcatcactgacgattaaggccgccccacgtgacgctcatgaatttgtacatgacaaaacaaaaatcgcctgcctgattccagttggtgatcacgcggccaaaacattgccagcacaagttccactttatgcgttcacggacaaccatcaacttgccatcaatcagcaggccatggcccagttattcctgacatgcattaagtcccaacaacgccaacaggtcaattaattaacccgcttttataaataaatcgttcgaaaacaatgtatttgcgcaatattaattgcatttggcgaattaattgcgtacaatgtactaaaatagatagtaaaggaggcggtttgatggcaaccccaacaaaaaacattttgctcgacgaacagctctgttttgcgctctacaccgccagcaaacgatataatcatttttattccgaagctttagcacctttcaagctgacttatccgcagtacatcactttattggcactctgggaaaagagtccgatgacggtccgggaacttggttcacacgttaaccttgatagcgggactctgaccccgttattgaaacggatgcaaacccaaggctgggtcgaacgcaagcgcgatacggacgatgaacgccaagtcaacatctcgttgtcgcaaaaagccatcgatgctaaaccagagatttttgcccacgttaattcttgcatggatttacttggtttagatgaagcaacctataaccagattcgcgaaacggttaactttgcttccgaacacatcaaaaatgccgatcctaaaaaggtcgactattctggtgaagcattctaactgactgcttaactaggtcgaggtttttctaacctcggccttttttgttgcgattaaaccaattgatttttgacactagcgtcactttgttttgagactagcccgttcaaggctaatatgaacaatcgttagctagcaccaatcaaataattatgggtgtttgcagccacattaattccgcaaaaaataaatcaaatgataaaacccagttgaatttgatagtttagaccgctaaaaataatttaagtatgtattaagggacgattttttgcaggtactgtattcggtgactttggggacgtgcaacaaaaaaatgactctaccgcttagtagcagtagggccaaagagttaggtttaagtacaatatgggggattgtacttgctcgtccatccactttgggggagtaaaatgaacaagtgtataactattaggtacaagtatatactattacataattgtgaagaaagtgtgaagatttgtccgaattatgcttttttattctttatttttatagagcatcaaccattatttctacaattattatatttttagcattcaaccagattaatatcatccgcttgtgcctggcatcgatgcctttctcagatttgcaaatccgtgtcgaaacctgaacactgcggtaaaatcaaccatgggaggtgaagtccgatggaaattattgaccgcggcttggggtggctcggacgcgtgttgctcactgctggcctaattgttggggtcgtgatcccaccaatgttacttaaattaattaaccaattatatcgccagcatcagctcacagcctggcagatcaccctggcaggtgtctatctgttaatttttgtgatcctagcactggcggcaaccgccctaatgcggcactataccggcaactatcaatcagaaaacttacaacaccatgactggcaaattattggaatggcctatctcaccatcttaatttttgagggcggctttcaatttataaaccagcttctgtatcaccagaatcaaacacaaaataacgccgccattaaaaatttaatggccggcagtcctctgtcgctttggcttatggcgttgagcgccgtttttttgactccaattgttgaagagttagtttttcgtggcgttctgactaaccttttctttcaacaagaatggctcaaggtcgggctcagcgggattgttttcggtagtctccatagtagttcaaccttaccgagcttcctcatatacgtcaccatgggactcgtgctagctattgtttatcggctgacccgtaaaattcgcgcggccagtgcgctccactttgtgatcaatagcctagcaattaccatcatgttactgcattgacgaccttcacgcacaacttcgtcacggcactggccaccctaacttttataactcccctgccagactaataacacgtcaaaaatcaaaaatagcacattaaaatgtaatagccaccaattcatcaggcctttctcacgcaccattcccagaattgccaagccaatgccaataacgggaatcaaacctccttgtaacaaccgataaatcggcaagtaggcccattctgatagcaggattggtcccgttaactgacccaataaaataaacaacaaaaataccccgatattcaacaatgagcaggcaaacgccgtctcggtaatggtgcccatcgcgaggcgaaagtgaaattgaaatcgtaaaaccagtgtcccgatgattccaatcaccaaaataatgccaaccactaacatacagccacgactccttttcttgtcattgttactgtacgctaaaatcaacaatgcgcctagcgcaaaactagaagcttaatgattttttagcaaccccgtaacgcgactaacaactaaataaattcgagtagttcaccgtagcttttatatggcacgctgtcctagtcattaaccatcaaaaaagagccggcaacttgcccgctcacccatctaactctttgtcccggttggtactgttagtactttggcttttagccccacgactttaattgtaattcgcttatgaactggcattttaacatagaattgaccactctgcttattcgaaataacctgacggacatgtttcccactctttaaggtgacaatgacaccgtgcttggtacggccactgattgttgcagaggtagcattttgatggtaaaccacctttgacacagtgagccgatgaattcgtcgatgataatcaccttgcaagctgtattccgaaccaaatattaacaaacaaccggccaaaatcattaagattagtgaccagaactgcttcatgacgccacctccagaccagctcccacagctggcatttaatagtctaagcatacatgcaaattaatctaaaaagccaaaaaaggtgcaaagctcataatagcctgcaccaacgtcattaaaattcacttttgattaacgattttgttacattagagtcttaagcgaagctagctaaacgtgactgccagttcggaacgcttgattaatgcgattaaatcatgcattttacgaatcgcaatatcgaccgactcgccattttcaaagtagccaagctgatgttgcttatcaattcgtactagcatttgcgggttcaccaagaaactcttatgaacccggaataactctgggtgggccacggtttcatcactaatcttaccattgtattgaacaattcgatctgttaaatggagaaccagcttgttacgaactgctccagtctcgataaataacacctgatctaatggaacattgaagagctgaccacccttagagtaagaaaacatggccttgctggtgactgcttgcttggtataacgttcataagcaacccgaatatctgtctccactttggctttgaccgtttcttgacccaaatctttcacaataaagtccagtggttcgattcgtcgttcaaaggtcaaaaaggccatttcagaatgggtcgacacgaagacaatccgcgcattaacatccgcctcgcgaattcgagtcgccagtgctaggccatttaagtcttgcccaggatattcaatatctaaaaagtagagtccctcaagatcggaattggtctcgacatagtccaacaacgtttgtgcttgtccggttgctaaggtcagttccatatcaaaatcattaatcataatatgattcttaatgatttgctttaaggttgctaattgttcaggatcgtcttccacaacaaaggtctttaacacgctgctcactcactttcaatactaataataaattcgaatcgttgatgggagctcacttcataagtcacgttagctaatggatctaacaactcacgaacggttgctaacccttgcccatgaccagcacctttcgaagtatgcccagcaaccatcagctcatccaggcgctcaatcggatgattcaatgaattggcaaaaatcaactccaccatgcggggatacttaacaagtgcgaccgcaatctgaccaccactctgacccttcaccgcttcgatggcattgtctaacaagatgccactcacccgtgataacgtcactgaatcaattgcaattgccgcaatcggggcgttggcttccaagcgtacttgaattccagcttggcgcgcaacggaaaacttactctgaataatggctttcaatggtttgtccttgatttgttctaaattgtcaaagtgtccaaaatcacgatttagactttgcttagacttggtcacaacttgacgaaaatattgttgtaattcaggatcatcagctgtctgaatatactcacccaaggacagtaagatgttttgataatcatggcgaaacttacgtaaattttgataactattttccaaatttttgacataaatatcatattgttgccgttccaaagcttgccggttattttgaacccgcaatgtataactatagaacaggtaaagaaacgttccggcgttgatcagcaagatagccactagaatcaacattagaatccccaaaaatcctgagccaatattataattatccgccgcagtcgtgatggtaaaaaacgcgaccgcaactacagccaaagcactgacaatcacgttcaacgttagcccgtctacaaattgccgcggataacgcttctttaagaccttgaaactagcggcgactgccaacatacaagctgtgacaattgtttcaccgatggcttcaaatagccagccactccagtcattcaaacccaagttgaataagtgaaaaatcgactccgtcgcataattgccaaagaaactaaaaagaatgtaggcgagtgtggccgttagactcgtcacaataaagtactttttgcgccgtacaaacgccagtaaccccatgttcacaatgaacgtgatgatatccgaatagtcgtcatacaacatgtagatcacagttagaagtacggtcataaccgcaacagtcgcatagactcgcttctgtcgaagctcacgattgattaatatctgcagtaaaaaaaccagcatgaccgagtaccaatggtcaaaagctgcaatataccaatagacgtaaacgataactgctcccctccccgcatgatgctcaatactaccattgtagcgaaatacggccagtttgtatatttgtgcgataaaaacttaacaatctttaccaaatcgctgactgaccaattaatacccgtaaccgtcttcaaaacttgctatactcgcctttattatcttaaaagacacacatgatcgacggtataaaaaaagcgacccccgttcattaacggtgccgctcacagatcattattagtgaaaatcacccggcataaaactctcgataaccgcggttgtattaaaggtttcaaaactatggaaactggcctcatcaatttcagcgtagcgaatggcaatttgtgggcgcttggcaagatcgaacatatcaacataattaaattcaatatatttcttatgttcactatgaataaagccagcatagctgtcaccatgttttttgattcgaccagatagttgaatcacttgatcgtggtgaaaagcttgcttcaacaatgtttttaagagcgaatgtttagtcttattctgcttcttcagcagcttattcatcaatcgttcagtgttccaaacatcataatagccccgttgcttagccagcgcaatgatcgtcgccatgctcttcaaataatcagtgtcactaattacgcgggctaacgatgccttacgaaagaccactaacccatctagttcaccatcgacattaacggcttggaccagcacaaacttctcatcctgctgaatcacatagccaacactaaattgctcattggttcccttggaatagatttcaacgaggttggtattcttaatcgctttagctaaatcgtcgcgaatcgcactcatgcgtgttcccccattcagtaatttgtaacaaataatttatttcatactaccacattttcaattatcatgataccacttgtaaaagttgaacgccaaatggcaactttcattttctaaataaaatttgtactataaaataaacttgttaataacctctgctaacgcgtcatggttgttatcagcgaccgtcacgtacttagctgcggccttgactgcatcgataccattggcgacactcacaggcaatccgaccgccttcagcatggggagatcattgctgttatcgccagctgcaataatttcatccgccgtaattcccagtagctttcctaattgaaccgctgcggtccccttgtcaacgccagccggattaaactcaacgtaacggtcggacgaataagtgacggctaatttgcttggatcaacaatagcttcaacgtctgcgcgcatttgcttgcggtcagtcatcgttggcaaggccataataatcttcatgacgttcatcgttttgaattgttcaaagtccggcgtcgtcatagttgtgaacgtcacgccccggttttgtagataatctgaatcacttggaaccggattgtaaatatataacgtatcctgcgtgtacacatgcgtcgccgcctgctgattcgcaattcccgcttcaaacacccctttagcaacctcatatggcatggcattcaccgccaatggccgattatccttattctctaaaatcaaaccaccattataagaaatcgaatattgatgtggttggtcccgcaatcccatcgtctccaaatcgttctgaaacgaggtataactacgaccagaattcggcacaaaataaacacccttagccgccgcagcttgaattgccgccgcattcttttctgacaacgtaccattgtcattcatcagggtctcatccaagtcacaaacaatcattttatacatattaaagttccctctcatccgcttgaccatctgaaacttggtcattttaggtttactattccactctagcgaaagacgtgcggaaatgcaaccgctttatttttgcgttgaaatctcaatgtttatccatacatacgcgcagtttttagcacagcgtgcaattataggtgctacagccatttgtgaaatttaacttagtcgtttgttaagacatttcaaaaatgcgacctgctaagaatcaatttctaaaactgaaacaatcaattactgtgctcaatgacccaactttcaaaaaacaatagctttatatgattacgaaaaggtaatcgcagtaccgatgttttaattggcagtatttcttcaatatgttgttaaagccagtacttttgatattattgattgcttatcattccctactgattaggcatcgtacattgacagggtttgctgggaacaggtgccgtgatatggtgaggtaaattcagtatcataattgcacccacaaccaatataataccaaccaaggcctgaggaactaagatttggtgcaagaataacatgccaaaaagtacggaacttattggttcaaatagtccagtcatagttgccagaaatccgtctattagctttaaactttctaaataaagatcatacgcaacaacggtggctagaataacaatgataagaaccgctaaaagctgcgtttttgaaaatctaactaaatttggtaacggtgtgtgaatcaacgctatcacaccgccaataactagtgcccatcccaaaatatccactgcggcaatttggtttaacaatggaacaggtagtttggtgtataagataaccccgatagccgcaatcaggccaaaaataattgcttccggttttattaatccggtcttaaatccggattcaacaataagccagattcccatcaatgcgcttattaagctcattcctgctaataaactgggaagtcttttcgctttcagcgcggtaaatacaagcagaataaacggactagtggactgaaagacagttgcaactgctgcattactgtaattaatcgcagaaaaaaaggcaatttgtgccgtgcacaagccggcgatgccgtatatcataattcgtgttaaaattcgccaatgtgtccaaatctttttcgtgctttttctagcctgcttgaaaaacaagttacgatatagcaacaacattgccccaccgattaacagccgtaacaatacaatctgttgcggagtcagaacttgctcacttaacaaaggctgtgctagtattccacctagcccaaataaagcggcactaataataccgcacagagttccaactaaacgcttcatacaaaagtttctcctctataatagttcaccattagaaatagcaacactttgattgtggtagtcatcattaaataaggcattggctgctgccctagcaaacgtatctcgattaattgcaaattcagactccggtatcgctctaaattcaggaccgtgcgtaataatttttgtttcgggtccattctgaattagtcctggtctaaagattgtaaagggaataccactatttgcaaataacaacggtttgtctaactgatcatgggtatactgaggatgttgcgtgcgaacagccgataaatagggtaaattaccagacaaatattcaccgtaaataccgcctgccgaaatatcgactattcgtttaattgttgcctgtgtttccttaattgcacgtaacaataacttaacgtacggaccagtgctcagcccaccaacggaatcataaatataatcgacatcctcgagtgccgctacataatcagtatatttcgctgcatctcccagaaaaataacatgttctcgtttctgataggcagggacctttttgcgattacgaacaaataattttaaagtcatttctggataatcacgttccattaatttaatgaaggcctgggcagttggcgaagttgcaccaataactaaaactgtattcatcgttcatcggactccttttccatttgctgatatgttttaataaacccgttcatgaatgcgacctgtttcttaagttcagcctgttttttctctaattctttcagatgatgttcaacaatcgcttgacgcttttccgctgttgcttgcttgccttgaacaactaaatcagttagttgacgaatatccttcaacggcatttcggaatcaataaaaatcttcaaatttttcatccaaatcagattcttttccgtaaaaacacgatacccattctcagatcgtcttagattaggaattaggcccaggcgatcatagtaatggacctgagagacactcatcccaactaatactgaaatctcttgggttgtatatttggcgacttcatcatccaattttagttcctccttttttcgcatgcgattcattataaactatcaaccatacttcatagcaagcttttccaatcaaattggacttgggtgaataatacccacaataatagccgccatttttgacgtcggccaaacggtgcttataactaagatgcaactaacgatcacatcaatatcatctggttgcatttcttgttagagtagcttacgacagggtgatagaaaacaaatcataacattatgtgctaccaaagcaccgtgctaaaatcaaatcagccaaaatgcaagtacgtgctaatactcggcaaataagccagttaaggagacaccatgaaaacaaaacctgaagccttaatgcgcgacttatacaatttaatcatcaacccggcgacgcgtgactgggaacgccatttactagtccaggccaagaataatcggcaacagctatcgccgactgggcaactaaaacagctcgaagctgatttgcgaccattagctatgcggaataacttgaccccggatgttatggacttttatcttgccatcactggcaacgcacccatgccgactaaaaacaatgtatcggcttacccaccccttagttcgccttatgaagaacgggcagtctttgctggtgggtgcttttggtgcatggttgagccctttgatcagcgtcccggtattaataatgtgatttctggttataccggtggttcgtgggcccaaccgacctatgaacaagttagtggtcaatatacggggcacgttgaagccgtggaaatcagatacgattcccgtaaaatctcgtatcaaaatcttgtcgatatttattggcaactaattgatccgaccgaccgctttggacaaatcaatgatcgcggtagccaataccggccagtcattttttatgctaatcaacatcaattgaccattgcgcaagcatccaaacaagcgcttgtggactcgcaacgttatcaaaaaccaattgtcgtggccattgagcccttacagcaattttggccagcagaaaattatcatcaggatttttaccgcaaacaaccccggcgctaccgacaactgaaaaaagcccatgatcactatctaaattggttgaaattcaaaaacaaattctagcttggcggttcagtcacaacttatgactttgcctgcttctggaatcaattggtcaagcactaatcgctgtgccatacttaattgttatggaggcgcataaacatgcggcaaaaatcgcaatgggccctaatcagcttgtggctgattatattaggaagtttcatccacatggcttaacagtgatgccggtaattgcttataatctcctgcaaagaccgtttggttgatcatttctgatattgctattattatcaattgaccaagtgttttatgaccacttgatcaatctcgttagtcattcaatcatcaaacattaattttaaaaaacaggatattgacccgccatacgaatgacggccgtccattgtcctgtttttattgcggtattttgcagcatgtcagctttcagtttgacataacggtctcaatcaggacaaaccacaactgcctacttcgatatggtatattattactgtctacatcagatttgccaatctgtctgagtgctatggcctttttctagccacctcacgcaaacactaaaaacaacgaggttctcaccatgcaaacaattcagttaagcaacatctttaaacaacaagcacaccaaacgattttaaaagatttcacactcaccattccagcgcaaagtaacatcggcattcagatgagccacgttgaggcaacgaccctctttaacctattacgccaaacgacaccccaaactagtggcgtgatgactggcctcactcccgcacgtatccaagccatctttcatgatgacggcttttatccgcaattaacagtctcgacttatttgaagacctttcaacacatcagcacctttgagacggacctggatgacattttgcagtatttcgcactcaaagacgtcgcccatactaagatcaagcacttatcctttgatcaacaacaacgtctggccttactgcgggcattcatcctacaaccggacttgttgctaattgaaagtcccctgaccaacttgaccaacgctggcattgagctgtacttagcagccttagcctatactcgcgaacacggcgtcaccgtactgctgacctcctactcattagaagaacttgtcctaaccagtacgactatctttcgttatcgaccaaaccagggcctcgagttgactgatttggcgaccgaaagcagttccgattccgcacacacttcagaagatacacctagaccaatttttaaaattgcaagcaaggttgaagataaaacagtctttttcagccctaacgagatcgattttattgaaagtgtcaacggggtcagtcaactgaacgtcagtggcgaacaattcacatcatcgcaaacaatgagcgaattagaacaacaattgacgacgctcggcttctttcgctgtcatcgttcttacttggttaatttacaacaaatcgcggaactaatcagttactcccgaaatagttacacgttaatcttgaaaaacaaaagtaaactgcccctctctcgcggtaaactcactgatttaaaagctttgatcaatttttaggacaccattcagcctaaataatgcaccattcggccccaatatgccccattacaccttgatttaatcacattcgacgattgctccagtaaactagattttgtagaagccactacgcttccaaatcaaatttaaaggagtcagcgatcaacgatgacaataaaaaatgcaatcgaagtgattaacattgccaaatcatttcaaaatacgaccgcgctggaccaagttagttttaccgtccagccaggtgaaatttttggctttttaggtccctcgggatcgggaaaaacaaccaccattaaaattctaaccggacaattattaccaacgaacggtgaagcctacgtcctgggtcagtctgtccaagcatacgacgaacaccgctatgaaaaaatcggcatcgtcacgcatcaaagtgggctttacgacaaattatcggtataccaaaacctactattcttcgcgaaaatgtttggtgtcccggttgcacgtgttgataagttacttgaacgagttggtctcagtcaacataagaaaaaactcgctggtaagttatctcaaggtatgcgtcaacggctagttctggcccgagcaattcttcaccaaccgcaagtcttgttcctcgatgagccaaccagtggtttagatccccgcacgacccaagcaattcacgcactgattagggaattacgcgaccagggtacagcgattctgctaacgactcatgatatgctggaagccactcgtctctgcaatcgtgtcgccttactcaacgctggccgcatcgcagaatgtgcagccccacaagcattgcaattaaaatataatcgcgaccagcagtatcgcgtccacattgcatcggcagcgcaagatttgttactccccgcatctcctgagacgacctatcagattaatcagtggatgctttctgggcaacttgagacgattcactcgtgcgagccgacccttgaagatgtctttttaaccgtaactggaaggagcctaaaatgagtttatcagtaaccaaaataaaggccttattcggtcttaaattaagactgatcatttcaaatatgagtctaatgactgccccaatcatggccattttgtacgtcgttttcatgaagagtattatgcaaagtaaagcaccatcacacgtcgctctgatttccctattactgggaatgggactatgctttaatatcgttatgggtggcatcatgatgacgagttatcccttagccgaagaaaaagaacaccatacgttacgtgtcctaatgacctcttccattaccgggcccgaattttttatcggtagtttattgccaccactagctattatgactgtaaccaatttgatactggtccccctaagcggcgccagttggtcgcaaattcacttaggaaactttttattgattactattatcactagtttaacgagtctcgtgctcggatacattattggtctgattgctaatagtcaaactcaagcaggcgtctacagtattccaatgatgctgattttaagcctgataccgaatttcgaacagttcaataccacccttaaatcctttagcagttatctgtatagcagcacgcttaatcactatattaccgcctcgtataccactggtggcttttcatggacgcttcgtgaggtactgacgcaactcggatggctcgtgattacctgtggcatcttcttctatgcctaccgtcgtcacggccttgataatgactaaaatttaggaggttttcaatcatgtcaactttaaaaatcggaacgaccgtcaagttaccaaaaccatatttgggaattgtgggaacgatcattgcctactacgcagctaaagatcaatacttagttcggtttggtgttagccaacaactctacttcaaaccagatgaactaattgtctggaaatcttaactgcttatctcataccaagccccttactttgaaatatcatggtaaggggcttcttttccacgttcggacaatcccgcagccgaatcgacgttggctatgttatagcaattgccgctcagcctagaaggtgtatgtaggacgcacatttactgatgaccagtaacctaactaacacatttttatcataattgatgacagctcaattcatgctatgtatacccataatatttttaaaatcataacttacccttaattttaaaccccacttgcactcaaaatggggtttaaaccccacatgctgtcttgatgatgtggtgctatttctgaaacctgttatcctctttaatgcacacacggggtttcatacaaaatagacaattaagggagcgcaagtaaagatgattaaagcagaatgggcgtatatgcgcaaacacaaactaatgattatcgtcatggcaatcattatgttcattccatcaatttatgccgtgacatttttacgatcaatgtgggatccatacggtcggttaaataatttacctgtagccgtcgtcaatcatgatcagccagtcacgtaccaagggaagcatctcagtgttgggcgcaatttaacaacgaatttaaaaaaatctagcgctttgaagtttcaacaagtcaacgcaagtcaggcacaagctggcttgaaaaatggtcgctattatatggtgctcacgattccaaccaatttttcgcgccacgcgaccaccttactcaatcaccaaccacaagccatggtgctacattatgatacaagtgctggacataacttcgtcgctagcaagatggccgattcggcggtcacttcgattcggtcatccgtcgcccaaacgattacaacgagctatgccaaaacgatgtttgccgctatcaaacaacttgacagtggcctcaaaacagctgctactaataatcaaaagctagccaccggtggtcagcagctccaaactgccaaccaaaaaatcgccaccaacctggacaccctcgcaactagttcgctgaaactaaaacaagggagtcaaacactgacggtcggtttaaaccaatatcttaatggcatttcacaactacaggtgggtaaccaaaaagtagttgccggtctaacacaactgctcgtcaaaagtaatcagttagttgctggcatggctcaactcaacaccggggttcaaactttaaatcaaggtgttgatcaatacgttgctggcgcccagcgagtgaatactgggactgtcaaagtcaatactggtgcccatcaggtggccagtggcacgcaacaattcagtagtggtaccgctcaactggcgactggtacgcaacaacttagttccggtttaaacgcttatgcggccggtgtcggcaaggtcaacactggtgccaacaagcttagtcaaggtgctaatcaactacaagcacagaccgctcagttaacggctaaaacgacggccctaacgagcggctcaagtcagctaactactggcatccagacactaggtcagaacagtcagtccctcaccatcgacttgcaaaaattgcagacgcaacttaagcaaccaaccaacaatcaagccacgattagcgcaaccgtggcagcgctgaaaaagcaggctgctggtaccgacttatcgtccgttaaaaccgcgctaagtgcgctgacatcggctattaaaactagtgcggcgcttcacgacaatgtcgccgcaaccgctaacagtcaaaatttgactgcggcacaaaaatcagccattttgacaacggttgatcaatccgctaaccgtgacgccatcaacgccgcccttgcgagtttaaccacggccatcgcccagtcgacgcaaccggctctagatacgactgctttgactagggccctcagcgccacgactcaacagcaggctgaccttgtctccacggtcacccaactcactaccggtgcgcaatcactgacgaccggtattcaatctgctggtaacgcggctaacaaactgaggactagtctaacccagctgaacacggtcctacctaatctcactaatggcattggggccgtcactactggtgcgacaaacttggctagcggaacaacaacgctcacaactaatagccagcagctcacccaaggctttaaaacactggatgctaacaccaacttgctcaatcagagaagtcaccaactggctacgggtgcggggcaagttgccgcgggttctcaacagctgaccgcgggcacgcgtcaactcagcacccagggcaaccagctaacacaaggtgccagccgcgtggctacgggtcttcaatctgcacagaccaacctacccagcttaacaactggcatctcacagttagttacgggcagtcaacaagtcaccactggcttacatcgactcggcacaacgggtattgcactcgctaatggcagtcagcaactcactagtggcaatgggcaattagccaccggagctcagcaactagccgtgggtgctaaccaagttacaaccgctggtaataagattcaaactggtaaccaagcattagcgaccaaattaggaacggccgcaagcaaggggaatctcaatccatcaaaactgacgtatcaacaagttgccaaacccgtcactacaactcaccaggaccgtgatgatgtaccaaacaacggtactggtatggcgccgtatatgttaagtgtctcgttatttgtcggcgcgctcgccctcaatatgatgtttgatatgtataccccacgcaaacacccgcaatcggcactggattggtggagtagcaaggccagcatcatgctcgtcttttcaatcatggaaagtacgattatgctcggcttgatgatgttaatcaacggactcagcccgattcatccgtttgccacttggttgttactcacgctaacggcgctactcttcatgacgatcgtcgcttggcttaaccttgtcttcggcaaagctggcgccttcttcagtatggtactactagtcttacagctcggtggttcagccggaacgtatccaattcagctgtcaggtcactttttccaaacaatccacccgtggttaccaatgagttacagcgtcaacggcttgcggcagaccttaatgactggtaattctgctcttcctgagatgggcgtcttagcactgattctaatgctgtttattgctctgacctggttgttctttatccgtcgttaccctcggctggctcaaattgactttgaagaccccgtcgccgtcaaagccactcagagtaagttagccacgttggttcggcgaaaggctcaagctaaagcatctgacaataagacgaattagttatttggatttatgatctcgaaacactgccaaaacgactttctctatatcagagagagtcgtttttagcagctaactaagttgacgactttacccaaatggtgctgttaattctgattcgctggtcaacaccttaacctactaccatattattagtattcgtgaaaatccctactaatattgaaacgacttccccatcacttgagactgcttttcacagactcattttgaccggatgtcacacacgctaagtcacctaacttgtcagtcaacagcccaactagctaaaaccattaactagtctcaaatgcaccacaacaatcattcagaacaacattaagtcactatccaaacaaaactaatcatgataccacctcaaattagtatgggtatgctttagttagggacaagcttacggttaaattagattggtatattgattgagtcagcgtttgattttggctatactgttaacagtcaattaataaaggagtgcgagtcgcatgatcaaagaattcaaggaatttattgcccgcggtaacgtgattgatttggccgttggggttattattgggtccgcttttacggccattgttaaatcgttgacagacaacttaattaatccactgattgggattttcttaggcaaagttgatttatccaatctaaagttcagtatcggtgatgctacttttaagtacgggtcctttctaaatgccatcattaatttcttcatcgtcgccatcgtcgttttcattctggtgaaaattattaataaagtggttaaaaatgaaccagaagaacccgaggaagaagaagtcgatgtttccgcgcaatatctagaagaaattcgtgatttattaaaggaacaggctaaaaaataaatgaaaatagctcccaagcaaatttttcattaaaagtctatatggtattaaaactttttttgagatacaatatattgtgcaattttttataaagaggggctatcatggtgataataacagcaggaatgattggggtcggcaaaaccacgttaacggggttaattgctgaccaccttggaactaaggcattttacgaaccggttggcgacaaccccgtattgccactttattattcggatcctaagaattacgggttcctattacaaatctatttcctcaacaaacgttttgcaatgatcaagaaggcattggccgacgataacaacgtcctcgaccgctccatctatgaagatgccctcttcaccaaagaaaacaacgctgaaggaaacatctctgatactgaattgaatgtttacttgcaactactagacaatatgatgaccgaattgactgaactgcctaagaaggcaccagacttgatggtctactctgaaactgacttcgatacgattctttaccggatcaagaagcgtggtcgcgactacgaacagttcgaccacaaccctgaactggaatcttattactataagatgtggaccgcttatcggaaatggtacgatgaatacgatgctagccctaaaatgaagattgatttacaacagtacgacttggaaaaacctgctaaccaacaagcagtgctagctcaaatcgattctgaattaggtaagattcgcaatccaaccacagtttaattaatcatgctaaaagcgccagtccccattatcgggactagcgcttttattgcgcacaatctagcgagcaaacaatacagaaacttcttaatgactcgcgaccagctaactaggtagcgcgggtagtgtcgcattaccaaacgacaatctttgaatgccgcactagcacaattgcgctcgattacatggctgcccggacttgttgggctaactcaaagttattggtaatcaccgcattgaccgaggctgcgaacaattgttgcattacgcttggctcatccactgtccaaacccgttcagcaacatggtgtacaggttgatagtgttcaagatgcaccccttctaagtgttcgtgagtcgcaaactcatccggattacccagacgcgctgaagtcaaaaaagcatatttctggctggcatcaatggcgtaggcccgctgtaagctcttcagattaaacgacgaaaaaacgaccggataaattaagtcagtctgccggaccatccgtagcacaatccgctcgatatcaagataatagtgtcgatcagtcttcaactcaaggttcaagtgaacgggctccccactcactaagtttaaaaattcttgtaaggatgggacgggctctccatttgctaattcaaatctacgcaactgttcgaaggtcagatccgcaatagccccttgcccattagtagttcgatcgattcgttcgtcatgcataatcactggtatttgatcctgggtaagatggacgtcaaactctaagccatcgatatgatgactgatggcatacgcaaacccagctagcgaattctcaggaaacttaacgggaacgccccgatgaccataaatcaacgacatatttggcacaattcttcaactctttccaattaatgacgaccgtttgcacggttatttgattctaacactttattgtacgtattttcagccgtttgcaacgattgtcgaatatcttggcctgcaaaaatctgctgcatcgccgtttgaatcgccgtccgtgcgggaacccaaccatcgacaaagacacctgagttcgtattattaggcttcgttcgtagcatctgattaccagaaacttctaggaccggcgacttcttgaatagttttttcagcgttggctcgtccttagcccccttattaacggctaaataaccagtcttggcttgccaatcggcttgcgtctgtgcgctagcgagaaacttagtgaattcccacgcgccatcttggaccgcgcttggtttatcgttcgcaatccaaagtgccgccccaccaactgcgattccgttggctctctgaccattcggccgtgggaaatatgtgacacctagatcatttttgagcacttgatacaactgacccgtgttcgcggacgattgcatgaagatacccaaatggcctgccaagaaagaagctgcttcatttgcagcagcattaccacccgaaccaaagttcataaagtcaccatagtcaatattttctttaacccacttcatcgcattgatcgccgcgggactcgtaaagtcgaccttagtcgcattgccagtatgaccattatcatgattggcaacgggaacacctgcgttagcgactagctgctcgaatagccacgaataggcctccattgtcattcccttgactttgccgtgggatttgtcgtggatggccttagcgactcgcgtgatatcatcgtaagtcggatccactggtggcggcgtaatcccgtactgacgcaagaccctcttattataataaagcgccgtttgcgatgcattaaacggcattgctagcaattgattgtcgcgcatcacgatcgccttggcgcccggaatgatttgatcagcatcgtaatggtcacggtcaataaatttctgcatcggtgtcgtgaaaccactgtgatacatctgactggtggaaatatccatcgattgaaatagcgctggtgacgcggccgtcccatgcgtattcaagattttttgaatgacgccattatagccaccctcaaactcggctacaacttcatacttggactgttggtgattaaacgctttaacgtaggcgtcaatcgcttgttgaccaggacctttcatctcatgccaaaacaccactttaatgcgactactatccgcatggacacgggtccgactataagcgaccccacccactaccaagaggacaaccatcataccggctagccactgccactttcgcgttatcttcatcatttcaccgaaccttcattcaatccagatttaaagtagtgttgcccccagaaaaggacaatcaatgttggaatcaccacgatggcggcactcgcctgaacgagtccccaattcgtagcggtttccaccgaatgcaattgccgcaatccatcttggaccggacgtagccgatttgaaaacgtggtcagcattggccataaatattggttccagcttcctaaaaagctgtaagcagctagcgtcaataaactaatccgtgagtatggtaaggcaacgcgacagtaaaattgccagtgtgagagaccatcaacatcagcggcttcctttaagtctcgtggaatttgcagaaaggcttgacgtaacatgaagataccaaagcccgaagttaagaacgggataaccatcaccgcatagtgattcaacaagtgcatcgcacggaccgtgtgaaagttcggaatcacttcagcttcaaatggtagcatcatagttgccaagaccaagtagaacaacgcatcccgatacttaaattctaaaaacacaaaggcgtaggcggcaattgatgcaaaaaacagatgagcaatcatctgaatgatcgaaatcactaaactgttaaataagtagcgaagaatgggtgttttggtaaacgcatcctgatagttctgccaagaaagggttccgctcagtgatcctttcgcaatagtcgtcgttggtaaaaagctggtccacaaccctaaaacaaacggtaaaataatgactaacgttaatgtaattaataacaagtaccggaatccgataccgattcgatgtcgaatcagggcttgagtagccattgtattttccattagtaatgcacccgctttgctaaaagtttgaattggattaccgtaatcgctgcaataatgattgctagtatgatcgattccgtgctagcaagcgcatagttaccatcaacgaaggcatcccgataaatacggtaaactaataagttggtggcgttcgtaggcccacccgcagtcatcaagtcaatcaatccgaaactcttgaacgctgagatcaacgtaatcaccgccgcaaagaagagtgtgggggaaatcattggcaacgtgatatggatgaactgataacgccgactggtccccgccacatcggccgcatcatataaggttttaggcacaacttgcaatgccccaaaaaagatcagaaaagtaaatccgaggtgcatccaaacgctcgtcataataatcgccaccatggcccagtgtggctccgttaaccaattaattgccggtaagtgcatccagatggccaccttattcaacaagcccacggatggattaaacatgaataaccagaaaattgcggagaccgagacagacactcccatagtcgaggtaaacatagttcgaaatagctcgataccccgaaccctttgattggcagcggccgctaacagtaaccctccaattaacgtgaacaccgtcacacccacgacatagattccagtggcttgcagactagcaagataactcttagtcgtcagcaaattaaggtaattttgcaaaccaacaaagacggttggttcaccaagactattagtcaagaaaaagcttagatacaaggtgcgtaacattggatagaaaacaaaaacactgagggcgagtattgagggcccaagaaatagccaagcataatatttatcattacgctttaattcaaaactgtcggtctgcacagttgcttggtcatgcgcatctggcgattgtttcggcttaaggcgtcgcttaatcgacggaaacgagttgatcactagtaacaccctcctcttcagcaatcaattgttcgtgctcatcaaaaatgaagatcttaccattaacggttacattcacccgctgctcaagtggtaattggacctgaccagattgtgcaattcgcaatgccgtcccgttatcagcctgcacttcgataatcgtcatctcgcccagtgtctcgacattcgtaaccttgccattaccgcgctcatcagtaactggtactgcgtttagctgattaggtcggataccaatcgtatagctccccgcgtttaatggttggttaagcgcaatctgaaagccctccgcgacgtgtaaattacgagcggttttcgtcaccactggcagtaaattaatctgtggcgtaccgaaaaattcagcgacgaaatgattagcaggatgattataaatatctaacggtgtatcaatctgctgcacgtgacgctcatttaacaccattacgtgatcggccatggtcatcgcttcagtttggtcatgggtgacataaatcaatgtcaatccgagcttacgttgcagttcgcgaatttcggtccgcatttgcacgcgtagttgcgcatcaaggtttgataacggttcgtccatcaggcaaaccttagcatcactggcaatcgcccgagccaaagccactcgttgccgttgaccaccagatagttcgcgcggcttgcggtcacgataagccgtcaaattgaccatcttcaacgcggcattgacccgacgctcgacttccgcggccggcatttttcgtgcttgtaaaccaaacgcaacgttggcagccacgtccaaaaaagggtacaaggcataactttgaaaaaccattgacagctttcgatcttttggtgggactgcattcatgatctgaccattgatggccagctttccactagtaattggaataataccggcaatcatccgcagcagcgtacttttaccacaaccggatggcccaacaatcacgaataactctccgtcttgaatctcggcatttacatcgtttaaaactggctgtttcgccttatcatacgtctttgtgatgttctgcaaggtaattcccatattcatatcccctcgaccttttatttgtaatttattagattactctttaatcatgccagatcaacgtatcgggaatgttggcataatgtaaaaataacgtatgggttatgtatttttttcataaacagcgcccaaccaacaaattcggagtgaataaaaaatagttgtttcgagaatttgtacattctcgaaacaactatttagtctgtgtcctaccagttaatctgtcatggatgataacggtccaccttgagtcggttttctctgtgtccgatatcgagcttgaaaaagccgctcaaatgtttatctggacacactatcggatgtcctaaaaatttcaattaaagccgacgagtggtatgctttggcagtttgactggctgttgatcagcatctgtgcgcaccaccaacgtgtcacaggtagcattgcgaatcacataagcagcattagagccaattaacacccgtgccacgttgttaagacctgtggccccaacaacgatcaagtcagtgccatagcggtctggtaaagtcgtcgctaacaataacttcgaattacctgaatgtaagtgaacccgcacatcgctgacacccgcggccatcgcttgttggcgagccttagcgagattcgctttaagaccggccgtcaattcgttcaatgcctgcggtgtcgttgcgccaaaacccatcggcccttgagtcacaccaataaatttctcagtattaatgaccgtcacaatatccaaagcggcattttgctcgaccgcgatcttaattgctttcgttaaagctaattgggactgaggactcgtatcgatgccgactaaaatgcgtttaaccatcgtcataaccatcaccctccattaaaggatcactatttgtcggttgctaacacggcaattgattcagcgtaaatcgccattgcagccattaattcgtcaattggttggaattcattggcttggtgcatcgtatcttcggtatctgggaagagtgccccaaaggcaaccccacgagccatcatccggccataagtcccaccaccaacaatttgtggttgtgaggccgtgtcaccagtttgacgccggtaaacgtccatcaaatccttgacgatcgggtcttcagggtcaacgtaatgtggcaccatgaagtcaccctgcgtgaccgtggcaccagctggtaactgtgcttggactttcgccgttaaatcagcaggttcgattcccttcggataacggaagttcaacgttaacgcaccacccttttgatggtcgaagctgagtaacccgacattcatcgtcaaatcacccataacgtcatccttgtaagctaagcctaactggttcgcccgtgaatcatcgtgtagcttattagccacgaagtctaagaaagcagcggcatcatcagcaaaggcatagttagtcaagaacgttgcaaggtaggttccggcattgatcccgttacgtggttccatcccatgggcggcctttccaacaacttccagcttaacgccttcaggaacgaccgttaattcaccagttactggttgctggtccagaaacgctgtgaagtcggccgccaactgctcgttgtcatccgtcgcgaccacggcttcggcatcacgcggcaccatattttcacgcaagccagaatcaaaagaaacaaggttaaagtcgccattatcttcatgaccgaagtgtaattgcagactcacatttcccttttcaccattgatcaacgggaacatggcatctggagagaagcccaaggttggtgctggttcaacttcaaagtagcgtttcattccagtccaattactttcctcatctgtcccaacgataaagcgaatcttcttattgagcttcaagccaagttctttgacaatctttaagccatagtaggccgccattcccgggcctttatcgtcggaaacgccgcgggcatacatcttgccatccttgatggttggttcgaaggggtccgtatcccagccgttaccagcaggcatttcatccacatgggctaaaattgccaaggtttcatccccctcaccaatttcagcataaccgaccaagttatcaatgttcttggtcttaaagccatcgcgttccgcaatcgctaaaaacgtggttaacgcttgcttaggaccagggcctaagggtgcatcatccgtcgcctggctatcgtcacgaaagctcggtacgcggagcatggtggttaaatctgctaaataatcatcttgatgcttagttgcttcatttttccaatcaactgacatgttaaattcctcccacatattgttacctcaattttatcatagctgtcgtcaacttaataatcgtaagtaaccgcttttggaaaatggtatactcaaagtaaattaacttagaaagctggtcattttatgcaacctattacaactgaaattgttagccgaacgattatcaaacgaccggctgattctcacaaaggcaattacggccgaatcatgctgattgggggtaatcaaaattttggtggtgctatcatcatggccgcaacggccgcaacatatagtggtgccggtctggtgacggtcgctaccgacccgtctaatttcacgagtctacatgctcggctacccgaagccatggtcattgactatcatcaaacggacaccttattaaacctgctagcaggaatggacgttatcgtcatcggtccaggccttggaacagataccatcgctgatcagttactgaccgccgttctcgccgcgacgcacgtcccacaacgattggtcatcgatggttcggcgctaaccttgcttgcacagcaggcccgccccttacccgccacggacattgtggtcacgccacaccaaatggaatggcaacgacttagcggcatcgcgatcaaagatcaaaccccaactgccaatcatgacgcgcaacaacggttaggtgttatggccgtggtcaaagctcatcgcacgaccgtctacactgacgaacgagtctggttcaaccccggtggcacttcggccatggcgaccggcggcatgggtgacacgttggctggtatgattggtggcttcgtaagtcaatttcataatttcaccgatgccgttctcagcgcggtctacttgcacagtgccattgccgatgacctcgctgcaacgcggtatgtcgtcttgccgcatcaaatcagtacccgcattccgacttacatgcaccgctttagtcagattgaacgcccttagctagctggaccataatgaacacgaacaagccaacgacattatgctaaaaaagcctcaactaaccatgcttgaattcatagttagttggggcttaatgatttagtttaaaccagagtggccgaattcgtaacacgcactattcgcctacgggttggttcgcatccgccttcaacgctgttagttcgtcatcagtcagcgcacgatagttccccgctaataagccaacgggtagcgttaacgaaccaaacttgattcgccgtaacccgacgacccgttcacctaacgttccgaccatccgcttaacttggtgatacttgccttcatggatcatgattcgaatcgtggtaaagttctcgatttcatggaattgaacaatctcagcctgagccggttgcaattcagtcccgtcctttaacgtgatcccatcattaaaattagccaattgagctgcagtgatttcccccgttacttcagcctcatagaccttcgtaacatggtggttcggcgacaataggtcgtgcgatagggccccatcgttcgtaatgaccaagattccctcagtatctttatcgagacgacccacgggaaatagatcgtcacgaaaatccgtcgtattgaacaggtccatcaccgttttcgcagcggaatccgtcgttgccgtgatgaccccgactggcttattcatcacataatagaagtattgttggtaacggacctgcacgtcatctaaaaagacggtatcactgccagggttaatctgttgtttgccagagattactggctcaccattggcagtgatatgaccatctttaatcagacgacgtacttgagtccgcgtgccaattcgcatcgcatgtaaaaatttatctactcgcataattcacctatttaatccgtaatttccgtcgtaacccagcagctttcgttccaatcatcaaatcagccatccgtgaacggagtgctaagtaaacgtaaaccgcaccaccagcgataactgctagggccacgatcaagaacgattgcgtcttactgtgctcattcaacacaaagttcagcccataaacaactaatcgtgccgtgacgtacgttaaaatcgaataaactaaaattcgattgatttttggtaataacttcacgtaccgaattccaaagttgacttccaaatcatacatcgccatcagactcgcaaccatcatcccaatcgcggtcgcaaccaggggccccgccgttgataggaaatagatacatggtaactgaatcacgattttgaccagtaagccgatcaagtaatagcgaataatatcgcggttgcgtgataggccttgcatcagcgccgaaatcaccgtaaaaaagcctaaagcaatcgcggtaaatgctgagatctgcagaatcaaggtcccaatttgatcataactataaaagagcgtgttaagtggttgtgccactgcggccatccccagcgctccgggaatcatgataaataggaataaaataatcgaatcttccaattgtttacgaatattacgcatattatgactggccaatgattcagataaaatcggcacgaccgtcacggcaatcgcagacgccaatgacacaatgatcatcaccaatttgttcgcattaaatgcaaagtaagcatacaacgtatcgatctgcttagtacccaaatggtaaaccagccgcatcatcggttggaacgttgcttgatccaacaggttgaagactgtcgtcgcggtatcgatcacaataaatggaatcgcctgaataataatatcgcggaacaattgccagactggaataactagtttgttctcactctgagcagctaaggcatttagctcgggccgtttgcggaaataataccaaccgagtaataagaagctggcagccgccccgacgaatgctgcgaatgtcgattgggtcacggcattcacccaatcgccgtgagcgacgcgcatgatgaaatacgtcgcacccaacatatagatgacccgaaaaacttgttccacgaactgtgagattgcggacggcgccatctgttgatacccttggaagaatccccgggtcaaagacatcgatggcagaatcaccaaggcaatagccaacgcatgcaagacgggaatcagattggcatcatagcccccaaaagctgttgaaatcaagccagcaccaaaccataaaataatggcaccaataatcccaaaggctgacgtcaacaacaagccccgcttgaataagcgctgtccaacggcatattcattcatcgcattatattcggaaagttgtttagaaattgcggacggaattcccccgatcgcaattagcaggaaaaaactataaatattatatcccttggcataaagcgcgttaccttgcgtataatcagcgcccatccagataacccacgggataatataaatcgccccgagcacccgtgaaaagagactcccagccgtcatccaagccgacccgcgcaccatcttctggtgcgcttcggcttcagaattcacgtgtgcattctggggctgattagcttttgattcctcagacatgttcgtaacccactttcttaattcaatcctaatcattttagatgaaaaacaaacaagttgcaattcaattccggccttatgcgtgagtttaaccgaactttaatgataaggtcttgacaactgcaccagctattggcgaaccgtaccgccgtccgataccctatggctgatacagaaaaaaggccaatccgtacgctttaccagcggccacgatgcggtctcaaattcgattacagcagagtgccgccatgatatccatttccgctgattaaaccacgttactgctagttttaagttaagcataggtggttgcacacactctgcccaccaaaaacacgtgtgatttgtctcccaaaccgaaccagaacgtcctcagaatctttattcacttaaccaaatcaatcgtaaccgcactaattagttctgtgagtagttaaaaaatcgtgatagcaaccaacaattgtcagtcaccatcacgattaatttaagcgatattcatttaagttgatactggtcgtggtacttagttggcaaccacgttaaccagtttaccaggaatggcaatcactttacgaactgtcttgccggccgtaaattcctggattttttcatccgccagggctagtttttcaagttcatccttgcccatatccttagcgacttcggcgtgcgagcgaaccttaccattaacttgaagcacgatttggaccgtgtcttctactaacttagattcgtcatacgttggccaagtggcgtaggtgatcgtgtcatcatggcctaataatgaccatagttcttccgacaaatgtggtgcaatcggtgacagtaacttcacaaagccttcgatataaatgattggtaaatcgtcgaccttgtatgcttcgtttacgaagaccatcatttgtgaaatcgcaatgttaaagcgcatagcttcatagtcttccgtgactttcttaacggtttcgttgtagattttcgtcaacttaccatcattgatagtcgtgattcgatcgcgaacacgattgttttcatcgatcattaagcgccaaacccgttcgatccacttattggcaccatgtaacccatcggtactccacggaatcgaagcttccaatggtcccatgaacatttcgtataaccgcaacgtatcggcaccatattggtcaacaatatcatcggggttaaccacgttcccccgcgacttagacatcttttcgtgattatcacccaaaatcatcccttggttaactaacttctggaatggctccttggttggcacaacgcctaagtcatataagaacttgtgccagaaacgtgcgtaaagcagatgtaagaccgcgtgttctgcaccgcccacgtataagtcaacgggtgaccagtacttcaacttgtcataatcggccaaagcttcacggttgtgcggatcaacgtaacgcaagaagtaccatgaactcccggcccattgtggcatcgtgttggtttcacgcttccccttacgaccgttttcatcgacgacatttacccagtcgtcgatattcgctaacgggctttcaccagttcctgatggttccaggttcttagttgctggtaaccgcaatggtagttcatcttcaggaaccaacgtcgtttcgccgtcttcccagtgaataactggaatcggttcgccccagtaccgttgccgtgagaagatccaatcacgtaaccgatagttgaccttcttttcaccggcatggtgttcacctaaccagtcaatcatcttatcaatagctggttgcttagctaaaccgtcaacaaaacctgagttgatgtgttccccgtcgccagtgtaagcttgttggtcataatcattatcacccgcaatgacaggtttgattggcaaatcaaatttttgtgcaaattcaaagtcccgatcatcatgagcaggcactgccatgatggccccagttccatatgaagccagaacataatcggcaatccagattggcagtttttcaccattaaccgggttgatgccgtagctaccagtgaagaccccggtcttgtccttattcaaatcagtccgttcaaggtctgacttgctggcgattttagctttgtatgctttgatagcgtccgcttgttcgggtgtcgtcaattgttcaactaagtcgtgttcaggtgccaagaccatgtaacttgcgccaaacagcgtgtctggccgcgttgagaacacttcaatctcggtatcgtcaggttgaccagcaaccttgaaacgaatggatgcgccaactgagcggccaatccagttacgttgttgctctttgatgttttctggccaatcaatatcgtccaggtcatcaatcaaccggtccgcataggccgtgattttgaggctccattgcttcattggcacccggtaaacatcatagccaccgcgttccgtcttaccatcaaccacttcttcattagaaacaaccgttccacccatcatatcaggagcccagttgaccaacgtttcagattcgtaagccaagcccttcttatagagctgttcaaagatccactgcgtccacttgtagtaacttggatcagtcgtattcacttcacggtcccagtcatatgaaaaacctaatgaccgaatctgacgtttgaagtttttgatgttcttggccgtaaagtccttcgggttatgccccgtcttgagcgcatattgttcagcgggtaaaccgaatgcgtcccaacccattggatgtaagacattgtacccttgcatccgcttgaaccgtgacataatatccgtggccgtatacccttcaggatgtccaacgtgtaatccttgaccagatgggtatgggaacatgtctaaggcgtaatacttcttcttatccgtcgtatctaatgttttgaaggttttgttttccttccaataatgttgccatttgcgttcaatgactttatggttgtatgccatagtagtgcccctttcttgctgccttgtatgtaaaagctagcattgcgactttccaactgactattcaagatggcattttcatgcttcaactcagtaaaagcggttaaaaaacaaaaaaatcctataagccaattaagcttataggacgaaaacgggttccgcggtaccacctatgattccacgttaccgtggcctcttgggaatcttaacgcgaaaccacgtccgtacctacaatcttgttcagccggaagactcgaaggtgagttcatgattggtgaatccccgtttgcaactaccacggagtttctgcaaaacaccagccactactattccttctcagagtcgtaaagttattgttttcatagtagcaaaccagcacgtttttttcaagggcccaagccccgctggcgataaattttatcatcggcattaatcggacccctgataaaaatgctataataatggcaataatttatttatcggaggaatcagtattgaagcaacgatcctggcaacgttcggacagtttgattctacttatatttataggatggttaggctggacggccgcggtatggcaacgggcgccttggttaacacactttgacaccacggttgctaatttttggcatcatagtccccagtggtttcaacacgcgatggtcacgtatacgcagcttggcaatccccacaccatcaccataatcacgttaattatcggcctggcactctggctgggccataacccacgcggcgcagtcttcttttgggtcaccacctggctgattgccggctacggtaattatctcatcaaacaggtcatcatgcggccacggccaaccgcttggcgacttgtccaaattggggggtatagttaccccagcgggcactcaacaacaacgaccgtccttatcggtagtctgctcgtgttggcatttgactactggcaccgcaatgccttgactggctggctcactgccctcggcataacggccatcttgttaatgatgatcagccgggtcatcgtgggcgtccactatcccagcgatacaatcggtggccttttacttggaagtgttttactatatataagtgcgcgttttagtatgcgttatcggcacggaccgcttcgattgcggccctaattcatgaattcaacaagggggtaacactcattcaactcagttcggcattagcttatagccacgcgctaatgaaccaagtcgtcaatcccggtgaccacgtgattgacgcgacggttggcaacggccatgataccgtctacctcgccaatctggtcgggactactggtcacgtcgacgggttcgacattcaatcagcggccattgaagcgacgacaactgccttagataaagcagcgctcacccatcaagtcactctgtggcaaacgggccatgaacacatcgcagataagattgccgctgatcaacctatcaagtgtgccgtctttaacctgggctatttaccaggtggcgataaacaaattattacgaaaccaacgacaacgttaacggccataaaagccattcaggaacgcctcgtcaccaacggactcattatcctgctagtctatgctggtcatcccggtggtgcgacagaagcacaagccgttttggattacgtaacgaatttagaccagcatcaattccaagtcctacaatatcagtttattaatcaagtccatgtgccgccatatttgttggccattcagaaacgttaatttaacgataaattagccgaaaagacctgtcagacgattagcttcgtctgacaggtcttttcaattagatacttaacttaaaaaccaatggtaccttacttctcccacggatacttaccgttctcatccttaggggtattacgcatgatccgcttagttccctcgtccatctcgttacgccgcttcttacgattatggtgacgaacaattaggacaagaccaccgatgccacagtacacgatcattcgggtaaacatcttaacggtcccataaatggtcataatcattaacattttgcgccctcccttgccgtcaaatctacttaagccgtgaccttagcaggcttaaagtaatctaacaatgcttgccactgcttgaaaacggcttcttctgaataacgcttggcattttcataggcctgagcactgtattgtgccagctgcccttgattcttcaacaattctaaaatcgttttggtcaattgttgcacatcgccgtctgtcgttaggattccactcttatgatcctgaataatatcactcgggccgtacttcacgtcattggcaaccattggtaacccatgggcttgagcttctaacaacatcaatgagaatccttcagctcgacttggcaaaagtcctaattgggcccggttgtaaacggcattgacatccgtggtataccccttgaacaataccacatcttccaagtgcgctgcagcaacttgtgcatgtagttgcttttcaatatccccgttcgcataaccccataattccaacttggcatcaggaaactgcttgtgaacttcaacaaaggcttcgattgaatgattctgttgcttttcaggtgccagccgcgcaacttgcacgacgaggtctttttgtcgttggtcaaacttcaccggcgcggcttttaacgtagcattatcaacatagccaaccggaatagtgaacgctggaatatccttaccaaagcgggcttccacgtccttagtttgttccggtgtcgcagaaatgaccgcgtcccaagccgcccaattattcagcgcattagcataattattgttcaaggtagaatgcataatatccttagcatcactcacatggttattatgtagatgcaagactttcttagctggtgtggtcatattgaataagccccaggcacattcgacggtccgatcacaaatgaagacattttgttcatcattcaactggttaagttcatcatagaagtaacgggtcagttcattcatcccattaaaagtatggctctgctcgttgtagttcaagacgcgccacgtgattcgctcctgaccagcgtgatttaacaagtgtaacttttccacgtgaatcaatccatccgggccaaagtacgcttcttgggcaatcttaccgtcccagtcaaataattgttcaagacacttaaagccccgcgtatcccaccaactcatcttgagcgtacgaccattaacgtcaaagtattgcacattgctaacggcttccgtaccggcccgaaggtaaataatcatgattaacttaccacgttccatgacttgaatctgattatcctttcgggtcttgatagcatcggctggcacttcaaagtcggccaaatcaaacctttgacgcttgaccgactgactaccacaaaagaagtcaaaaagattaacaaaatcagcatcggcaatgttggccccttcaagcacatcgtgcaaattcattgcgaatacgcgggtcacgattttagcggccacatggtgcttcttgaataaagtcagtcggttgatttccgcctgttcgattcctgattttgaaaattgcatgttatcgtttaagaaataatacatatgcgccctcctacttaatacccagtaattgttgccaacggtgccaaacttttaagtcagtttgtgacgtatgaagcttcttaaaggcggcttcgctgaatgccgtcaacttcttcgtatccgtcattaattcgatgacccggtcacgcagcgccaattgattgccaggatcaacgatgaaaccgtcatgaccgtcatcaatccaatctttaggcccataattaaagcgataactaatcactggaattccgtgactcatggcttccggcatactcattggaccaccatcaacaatatcggtattgagcaacagctgataatcatcataacgtgtttctaaatcaggatgataatctaataaatgcacattattcgtcaattttaattcttcaaccagcttattcagcgtcttaagatactctggatcgccgtagccgtaaaagtcacactgaatttctttgacctgttgcttaactaacgcaatggtccgaattaactgattcagttgccgatccggcgccagccgcccaacgtatagcaattacttggggcgggccgtgattggctgtagtttactctgcgccaacggactcgtagttacagttggtaacactgtcaccttagctttagggaaccgcgtccgcagatgctgagcctgactttcagtagctgtaatgaaaccatcaaagtgttgcagattatcgaaggccggtgttaagaacccgtccaacggggaatgaattgggtcattaatatccttcgcctgataaattggaaccgtcacatacttgtgagaatcatcctgaagttccaacaacggcttcacactggtacctgggcgatcactaataaaggtcgtcgtttgcttgtccaaatgactgagttcggccaagaagaaacgaaataaatggttcgcgtcctggaagaagcgctctgcttgatcacgataattctttaaaatcaaacgtgacgctagcggattaccgttagtgtcaggtacatagtactgctcaataacggtctcgccttgtagattataaaaccgttccaaaaccagtttaccgttctgaccaaaatattgtgtactggacttgaagcctcgccaatcccacaggtcagttgaagataagttaccttgattgtcgaagaattcttggtaaaagacgcgcccaatcgttccaggaataaagccgacgttgctaacgtgttcatcaccattaaaaattttgctaaagttggcacccacttctaccgcatattcaactggcagatgcatgtcatcagtatgcagaactttagttggcacatccgtggtttgttgaaagtaatcaaacatattcagcacttgctggtttgctaactgaaaagttcccatggtctgatgtagcaaacggtcatacatcttagtcacaatctgggctggcgctttatagtggttaaataatttcacccggttgattgccgcgtgctcaacactcgaattcttgcctaaaatatattcattaatgaagtaaaacatacagtcaccctttctgttacctagtattatgcttgtcgatatgtgtagttataatagttgatcaacccagataagaagtgttcacaatcgtcaatccgtgtccggaaattgtcatgacgtgcatagaacccaccaatgaacttctgtggattatagagatacattgcaatctcaggtagaaaacacccagtagtaatctcatacaacgcacgataccgcaatacctgccgtaaacgaaccaagtcataaggtgctatcaagtcttcattacctgaacgtttaatcatatcggtcattttgacggccgcatcaactaactcaagtaatgttggatacgtggtatcacgctcttcaatgaattttagatgactgaatacatttttcaaacccagtttcatataatcatgattgtctgggaataccagtaatgcttcattgattgcataagaaatccagtgatcatggtatttaccatagtcattagccaccatgtaatccaagatttgcttcaccagatccatcacattcttatcatgtgttaactcatatagtcgggaaagcgcaaatgcgacttctccttcataatagataattcgataagctgctttgaccgttaaatctggatttaggacatgaattaacttaccagacggttcttggaagaaatggacgcctttaaaagctttcattaaaactggcacgaaagtatcatccttggtaacgtcttgatatttactcaatgcaagtattaacaaggcctgtccacccaactttagctcgccattatcatcgacgaagattgcgccctctttttcaatcgtggcgttttttaagccccactgaatcgctaacttaacttttgcaaaatcttcagtacgctttgtgaatggaatggcttccagcaaggcatataaggatgaaaaatgccgcacaacattgtaattgctaagaactctttgacgagccggaaaataaccgtagacaaattttccattgccttttaactgattaattaggaaagtttcaccatgttcaatagctgattgcagctcgctctgctcgtcagtcaccacccgaacgcccttaccacaatcctcttgctcagatagattccagattttctgcccgtcagtaaatacaccagcggttgtaaagacccaaacattttctgtctttcgaatatcgactggtagcgctccttcacgcttgttaagatacggctctactcgatcatagtcgacccaagaacccgaacgattcttaccaattcgatgcgctttgctaggacggaaaaatgcttgtccattactttccatctccaataaggctgtcttgaaatctgcatcaaaactaataccgtatcgccaatagttcatccgaaaagtagctgccaatcgcttttcaaaagtttctcttggtaacttctgtgttgattgaactgcttctaatcgaacccaactcgcttgaggggttttggctaattgttgtgcaactgctatccaagcttgcttgaaagaatcgcaacgatagaatcgcacttgggcccgatgtcgatgatccgataccgaaagtgccaaggttacggtacttgtaccgtaatctttcaaatttccagttgcaatcagtgcttgcttaagcttggtgacagtagatttttgcatcttagtcttacctctttcaattttcttttatgtacgccaaaacgggcttcacgcccgttttggttaatagtcttattttacaacgtatatcgttagcagtactaacaaatcagctttaaattttaactatttttgattctcgtcatcttcatcatcatctttacgacgacgaccgaacaagaagaaccaccagccgagtccagcagctgcagccgcggtcaacaagccaccgaaaatcgttccggcattattacttgtatcagatgcagtcttaccattctcgtcagtattacttgagccaaccttatcatcagcactatcagtatcagctgacttcttatccttatcagaatcattactactcttcgaatctgaatcagtctgatcagaagttgcatcaacgtcttgagcgctagcagcggcataaaccactgatgtagcagcagttgctgacgttgttgcagcaccgtcactggatggtgtcgtaaccgccaacgttgcggctgtggccgagacaccacttgttgctgcagcactcaagctagtcgtacttgtcgaagcagcaccgttgttagaagcagtcgatgaagttgtcgtaccagtgccagtacctgaattatttccagtagagcccgtcgtattgcccgaacctgatccagtatttgaactggaacttccatctgagccagaattactaccattgtcagaattggttccatcatttgaatctgaatctgtgattgtatcggagtcactgtcgttattcgaatcactgtctgagtctgagtcgttgtcggaacctgagtcgctgtctgagtcagcgtcactgtcggaatccgagtcgctgtccgaatcggaatcactgtcggaatccgaatcactatccgagtcggaatcgctgtctgagtcggaatcactatctgagtccgagtcactgtcggaatctgaatcactatctgagtccgagtcactgtcgctatccgaatcgctgtccgagtctgagtcactatcggaatccgaatcactatccgagtccgaatcactatcggaatccgagtcgctgtcggaatccgaatcgctatccgaatccgaatcactgtcggaatctgagtcgctgtcggaatccgaatcactatccgagtccgaatcgctgtccgagtccgaatcgctgtccgagtccgaatcgctgtccgagtccgaatcactgtccgagtccgaatcactgtccgagtccgaatcactgtcggaatccgaatcgctgtcggaatccgaatcgctgtccgaatcggaatcactatccgagtccgaatcggagtcactatcggaatcgctgtctgagtcggaatcactatccgagtcggaatcactatccgaatccgaatcactgtcggaatctgagtcgctgtcggaatcagaatcactatccgagtccgaatcgctgtcggagtctgagtcgctgtcgctatctgaatcactgtcagagtcagaatcactatccgagtctgagtcgctgtcagaatcggaatcgctgtcgctatctgagtcactgtccgagtctgagtcgctgtcgctatccgaatcactgtcagaatcggaatcgctatcagagtctgaatcgctgtcggagtctgagtcggaatcactgtcagaatcggaatcactatcagagtctgagtcactgtcactgtccgaatcggaatcactgtcggagtcggaatcggagtcgctatcagagtcggaatcactatcagagtctgagtcactgtcggaatctgaatcactatcagagtcagaatcactatcggaatctgagtcactgtcggagtcggaatcactgtctgagtctgaatcgctgtcggaatccgaatcactatcggaatcggagtcgctatcggagtcggaatcactgtctgagtctgagtcactatcggaatcggaatcgctatcagagtctgaatcgctgtcgctatctgaatcactatcagagtccgaattactgtcggaatccgaatcactatccgagtcggagtcactatcagagtccgaatcactgtcgctgtccgaatcattatcggaatcggagtcactatcagagtcggaatcactgtcggaatctgaatcactgtctgagtctgagtcgctgtccgagtcggaatcgctatcggagtctgagtcactgtcgctatccgaatcactgtctgagtccgaatcactgtcggaatcggagtcactgtcgctatccgaatcactgtctgagtcagaatcactatcggaatccgaatcactgtcggaatctgaatcactatccgaatcggaatcactatccgaatccgaatcgctgtcggaatctgaatcactgtcggaatccgagtcgctatcagagtcagaatcactatcggaatctgagtcactgtcggaatcgctgtcgctatccgaatcactgtctgagtcagaatcggaatcactgtctgagtcggaatcgctgtcgctatctgaatcactatccgaatcggaatcactgtcggaatcgctgtcagaatcactatccgagtcggagtcactgtcgctgtccgaatccgagtcactgtctgagtcggaatcactgtcagaatcagaatcactatccgagtcggagtcagaatcactgtctgagtctgagtcactgtcggaatctgagtcactgtcgctatccgaatcactgtctgagtccgagtcactgtctgagtctgaatcgctgtcagaatccgaatcactatcggagtcggaatcactgtctgagtctgagtcactatccgaatctgaatcactatcggaatctgaatcactatccgagtcagaatcactgtcagaatcggagtcactgtcagaatcggagtcactatcggaatctgagtcactgtcgctatccgaatctgagtcgctgtccgagtcagaatcgctatcagtgtcggaatcactatcagaatcagaatcgctgtcagaatctgagtcgctgtcggagtctgagtcactgtcggagtcagaatcggaatcgctgtccgagtcggaatcggagtcactatcagagtcggaatcactgtcagaatcggagtcgctgtccgagtcggaatcactgtctgagtctgaatcgctgtccgagtctgagtcactgtcactatcagaatcagaatcactgtcggagtcggaatcactatccgaatccgagtcgctgtccgagtcggaatcactgtctgaatccgaatcactatcagagtctgagtcactgtcgctatccgaatccgaatcactgtccgaatccgagtctgaatcgctgtcggaatctgagtcactgtcgctatccgaatccgaatcactgtccgaatccgagtctgaatcgctgtcggaatctgagtcactgtcgctatccgaatcactgtcggagtctgaatcactgtcgctatccgaatcactgtcggagtccgaatcactatcggaatctgaatcgctgtccgagtctgaatcgctatcggaatccgagtcgctgtccgagtccgaatcactatcagagtctgagtcactgtcgctatccgaatcactgtctgaatcggaatcgctgtccgagtctgaatcactatccgaatccgagtcgctgtccgagtccgaatcactatccgaatccgagtcgctgtccgagtctgaatcactatcggaatccgaatcgctgtcggagtccgaatcactgtctgaatcggaatcactatcggagtcggagtcactgtcgctatccgaatcactgtctgaatcggagtcgctgtcggaatccgaatcactgtctgaatctgagtcgctatcggagtccgaatcactatcagagtctgagtcactgtctgaatccgaatcactatccgaatccgagtcactgtcggagtccgaatcactatccgaatccgagtcgctgtccgagtccgaatcactgtctgagtcggaatcgctgtcggagtcggaatcactatccgaatctgagtcactgtcgctgtccgaatcactatcggaatctgagtcactatccgagtcggaatcactgtccgagtcggaatcgctatcggaatccgaatcgctgtcggagtctgaatcactgtcagaatcggagtcactatccgagtcggaatcactatcggaatccgaatcgctgtcggagtccgaatcactgtctgaatcggaatcactgtctgaatcggaatcactatcggagtcggagtcactgtcgctatccgaatcactgtcggagtccgaatcactgtctgaatcggagtcgctgtccgagtccgaatcgctgtcggagtccgaatcactgtcggaatcggagtcgctatcggagtcggaatcactgtcggaatctgagtcgctatcagagtcggaatcactgtcagaatcggagtcgctatccgaatcggaatcactgtccgagtcagaatcaccatccgagtcagaatcactatccgagtcagaatcactgtcagaatcggagtcgctatccgaatcggaatcactgtccgagtcggagtcactgtcgctatctgaatcactgtcggagtcactgtcggagtcggaatcactgtccgaatctgagtcactgtcgctgtccgaatcactatcggaatctgagtcactatccgagtcggaatcgctgtcggagtcggaatcactgtcgctatctgaatcactgtcagagtcggaatcactatccgagtcggaatcactgtcgctatctgaatcgctgtccgagtccgagtcactgtcagaatcggagtcgctatcggagtcggagtcgctgtccgagtcgctatcggaatccgaatcactgtcagagtcggaatcactgtcggaatctgagtcgctgtcgctatccgaatcactatcagaatccgagtcactgtcggaatccgaatcactatcagaatccgaatcactatcagaatccgagtcgctgtctgagtcagaatcactgtcggaatccgaatcactgtcagagtcggaatcactgtcgctatccgaatcactgtcgccgtcagaatcactatccgagtcatcttcactaacattagcagctaaatcagcatagtaacctgcatcatcagcggcacttgaagctttctttttagcttcagatgcttcggacgctttctttttagcttcctctgcataactggaagcagccgagttttcgccagcagcttccgcagaatctgcatttgattgggcggctgccgcattagaggctgcagttgaagcagctgttgcggctgactgtgcatcagaagctgctgccgttgcttgttctgcgtaggagcttgcttctgagtttttacttgcatattcgcccgcaatgttcgcataagaactagcaactgaaccatattccgtcgcttgatttgcgtagttagctgcttcgctagctgcagaatctgccgcttcagttgaaacagcattaacagtcaagtaagcccggcctaaagttacagttgtcgtggtagtagtcccgttagtcgtattggatccagtaataactaggtagtaataaccggattgccctactgtcagatccgacagattaagtgtcgtaccagtctgaccactcagcgctgttccagtaccgtccgctgttgaagaataataccattgataagtaacattagtcccagtacccgtagtcgagccatctggaacccacgtcaaatcacttcctgcatcaacagttgcatcctcaaggccactaccaattgtaattgtctttgaagatgaatagctagttccgtctgcatttgtaattgttgctgtgattgtcaccgttccattagacacaacggtcaaaaggccagaatcatcaattgtcgcaatgcttgaatcacttgtcgtccaggtaatcgttcccgtagcattctcagggttagtcgttgatgtaaactggctagtaaccttatcgtttgagccactcgaactgttcgttggattaatgacgtaatcatcaccagctatggaaatgtttgttgctggaatattgctactataaacatctacttccgctaaattacttgcaaatgtataaactgtagccaagtttaataagtcccaagaaaacccttgtacggcttggaatagtaatgatccagtatagcccgctttgatagtaactgttaatgagctactggttgacagtaaaccagcactgtcaactgcatcatatgattcaatataagcgctggccttatctaaggtcatccaagtgccgttgacttgaacataccaagttgtttttgatgatagtgcaaccccacctagtcctaatgctgacgaagctgacaaggtaaaggtcccaccagaaacggtcgacgtcactgctgcgggttgagaagtcatcccaccagaaataacaatccctagaattgtcgttgcattacccgtattagtgcttttatatgaattcgtattgtttgaataattcgtcgcgttgctagccgccgtactacctaaagccgcattggatgtagacaatgccgcatatgaggttgcttcactagctgctgctgaggcattggtcacatatgagctggccatagcataatcgcccgcagctactgccgatgaagcctggcttgtatactgagctgccatttccgcagctgaagttgcggccgccgctgcacccaaagttgtcacggcataattattagtttgtgcaacgtatgagctacccaacgtggtgtttgacgcatactttgcacttaatgaactcgcgacactgattgcgttcccggctgccgattcagctgctgacgctgcgctagaagcagccgttgcaatcgaattataataactggattgtgcttgcacgaccgtttgggtaatcgcactcgccgcactcgaagcagcattcaattgatctgtggcataggttaaacgcaaagccgcgtagctttgttgcaaggcagccgaattataattcccgtccgctgcatatgaagcagcaagacttgctgcttcactagctgccgcagcgtatgaactagccgctacagctgcagaacttgccgctgcattataactgctagttgcagtggtattaaatgaagaaccagcaacgttatatgcattagcagcgttggccgcataggatgcagctaacgaggcttggtcaccggccacatttgccgatgacgcagccatactggcataacttgatgctaaataatcagcagcggtatcaccaccatcttcattaaccgcatttttcaaagcagtatcgagactagctgctgcctcagatgccgcactacttgcagaactagcatattcagttgcaacactcgcataactcgatgccattcctgcccagatattagcactggtatacgccccttcggcttcataagaagcggccgaagtactggccatagttgcaatacttgccgcctccgaagccacactcgcatatgagctagctgcgttgtatgaagaattagcctgtgatgtgtagtagctagctaatgagcccgtcaagttagctgaagaactggccaaactgatcgcactacttgcagcggcagcttgagaggttgccactgaggctgcgctgttggcttggctggcataactgctggcaatttcagtgtaggtcccttctggattggtaacaacaatggtaatcacattaccagctgcttcaaaatttgaagtcaagattaatgctgtaacccgcttaccactaacgactgcttgataataatacgtccctgaagtagttgcagttgttgtatacgttgccgatgttgcaccactaatggtcgtccaagttgctccatccgttgagacataccaaacataagttggtgtaccacttactgaatatcctgaatccaaacccaccttgttggtaattgtcacagtatctccagtcgagacactttgcgttgccgtactcgtcgttaaagtcgcattggaactaacggtttgttcattggcgacattcgtcgaaaacttagcagctaaagtcgcgttagactcagcagttgcagcgtaactagcagccaatgaagatgccgattgggccacccgagcgtatgagtccgcggtggcaggatcactagcactgacagcagattttgcagccgtgctggcgacggcgtaggctgacgaagcagagctagcggccgttgcagcacttgaagcataagctgacgcttgagtaccagtttgcgttgccgccacactggccgcacttgaagccgtactctttgacgtattcgccacgtttgcacttgaagaagccgcactcgccaaatcactaattgcagtactattggcaaaaatggctgccgaactagcggtgctagtagctgtgctcccggcggcgtattgactaagcgcctccgttgcggcggaggaagtaactgcataggcagtactagtggcttcatagtcattatttgccgcattaccacttacagcggcatatgctgaagatgctgccatcgcagcggtcgttgcgttaaccgcggccgttgaagccgcagctgccgtgctagaagcgacggcgtaagctgaggtaacggccgtattatttttgtcgtattgcatggctaagtatgcactgttggctgcttcagctgccgagctggctgctaccgtggctgcagatgccgcactagatgcggcggaataattgctacttgctaaattaattaagccttgggtagcagcactgctggccgttgaggtggccgttgaagccagggctgcgtatgaactggccgcactggctgcactaaatgctaaagagttggcattagcgtatgccaatgtattatctacattggaccccacaccatttgtcattgcgtctaagtacatgtttgcaatactattgtagtgccgtgacaaatcagccgcgttaagcgcttcttgataggcactttgggccgcactcactgctgcttgcgtcgttaggttattgaccaaactagcataactgctggcaagtgtggcgtatgaaccggctaatgaagctgacgatgaagccgccttagctgcggtactatcggtatttgagctggcagccgattccgacgagtaagctgcaatggctgccgttgaagccgccgtacttgcagacttagtcgtgctggcaacactgcttgctgtcgagacagtacttgccgctacgctagcactgcttgacaaactcgtcgtacttgagctagctgcggaagaactgctgctatcagttaaactcgatgaagtagcgcttgacgagctcgaactactacttgaacttgcgctggatgcgctcgaactagccgttgaaacactgctactactagtacttgatgtacttgtcgcattagtcgtacttgtttcgctcgcagaacttgcgtctgaagcactgtcatcgctgcttgaactatccgatgaagattcggaattactgttcgaggcagtttcgctcgaagaagatgccgtagacgagtcactggtagtactagttgacgtactacttgccgttgcagcagctagtgccgccgcactcgctgctgcagaagacgtatccgcccccgagctggcactactagtggcactacttgccgtatcgctactagtatccgccgaaaccgtatctgcatgagatactaactgaggtgcagcagtcaatacaaatgatgccatcgccgtaaatacccaagtacggccgactttaaacatcttgtagtgaacttgcggatctcccctaaaagatttatgtctcagaaatttcatggttttgccttccttctctaacctaatcaaacccgtttatatatgatacaaaaaacacatatatagcatcattggtatacaccatcaatcgttaggctatgcactcataatactatgattatgttttgttagcaatagttgataccgtcaatcttgttacacgttttccattaattttcctaaaatagttaccaaataaataatattaatgaaaacgagtgtaataggcctcataaagcccattacactcgtctaacaacttaaaatttatttataacacttatggaaattttattgaaaatttttcggatttttttacgtcaatatcaaataaacgacaaattatgagtcactttgacaattaatttgttgatactaagccgactaatcctgattttggtttaaatcagccgcgtgttgtgctgccgttttttgtggtccgcgatccaaactattcacaataaaggctagaataaccaaaccaaggccaatcaggtagacccaatgtaagcccgtatataagatacgatgaagtgtcggcaacaaatgagacggtaattgcgttgctgtctgtggattgatcaacttgttcatcatcgccatgttcgttcctgcatggtgctgaataccttggttcatcccaacgttcaacgcaattccaaagattgaaatcatcaacgtttggccaatcgttcgactcaacgtattgaaggacgttgcgacgcccacgttctcagctggcacaaggtgttgcgacgtgacggtcgttgctgtaattgtaattccgaagcccacgccaccaatcgctgtgatcaggaagaaccatgggaaagcagtattaactggcaaccacgctaagcaaatgcttgtcacgaggatgaaagccaaactcagatacaaaatccgtcgcggcgcccactttgccaataaccgccccgtcacgaatgacccgacgatccacattaacgagctcggtgtcactgcgaatcccgccaaagaagccggtacacccagtatcccctgagtccaagttggaatataaacttcaacggccattaggaaaccactgactaaggccgccacggcattctgaataataaacgtgtggtttttgaataaatccatcgaaatcactggttcatccgtgcgactttcacgacgaataaatagccacaaactgagcgcactaatgatccaagcagtcccaacggccacccaactgatagtggcgtttcccaatagttggaagcttagcatcaagcacagcaagaagagcatcagccaaaagctacccaagtagtcgattttcacgttattgtgacgtttgggttctcgtaaataaaattgaaataggaaaagggtgatcaacccaactggcacattaatgaagaaaatccaatgccagctgagcttatcgacaattagtccaccaatcaacggtgccagcactgaagcaatgccccacgctgaactattgaagcctagcactttggcccggcgttcgaatgaataaatatctgcgataattgtcattgagactggcattagcgccccggcaccgatcccctgaatggcccgccaaaaaattagcaccggcatcgaattagacaaaccgctcatcatagacccgataataaaaataattagtccggcttgcatcactggttttcggccgaccaagtcagtcagctttccataaattggcgtcatcatcgcattagtcaataaataaattgagaaaacccaattcatcaatgaaaccccgtgtaaatcaccaacaatcgttggcaaggcggtcgacacaattgtcccttcaatcgcactcataaacgtcgcgacgtaaatggcaaccgtaaccgccattacgttagttttacgctgttgcatcttagtaattctccttctctatcaatcattttaaaaccccgtgcatctaaaatagcccgcaaaaaaaagcgaccttgaaaaaaggtcgcttttagcgtcgagtacctacagaccgtaacgaatcaacgttaccgcattatttaaatgctgcttttaaagcatccactttatcagtatgttcccatggcaaatcaatatcggtccgaccaaagtggccgtatgccgcagtttgccgataaattggacgttgcaaatcgagcattttgataatcccagctgggcgtaaatcaaagttttcgcgaatggcgttaatcaacgcttcatcactaaccttcccggtcccggcagtatccactgcaatcgaaactggttcggcaaccccgatggcatatgccaattgcacttcgacctgatcagctaaaccggcagccacaacgtttttggcaatgtaacgagcagcgtaacttgcagaacgatcaaccttggtcgcgtccttaccagaaaaggcaccaccaccatgatgggcaaaaccaccgtacgtatccacgatgactttccgaccagtcaaaccggcatccccttgaggaccaccaataacaaaacgaccagttgggttcacaagatacttagtttggtcatctaataaatcagctggtaacacagccttgatgacttgatcaatgaccgtttgccgaattgtatccaaatcaacatcaggatcatgctgagtagacaagaccactgtgtcgattcgcttaggttggttgtcttcgtcatattcgaccgtgacttgggccttagcatctggacgtaaccacttaatggtaccatccttacgtagcgctgcaattttacgcatcaaccgatggctcaatgcgattggcagtggcattaattcaggggtttcgttgatggcataaccaaacatcatcccttgatcaccagcaccgatttgatctaatgggtcagcatcgccagaacgcgtctccaaggaatcatcgaccccttgcgcgatatctggtgattgttcatccaatgagacaaggacggcacagttgtcaccgtcaaagccgtattgaccgtcaacatagccaatcgacttgatcgtgtcacgcacgaccttttgaatatcaacgtaggccttggtcgaaacttcaccgaagaccagcactaatccagtcgtcactgaagtttcaacagcgacccgtgcttgtggatcctgggctaacattgcgtccaagatagcgtcactgatttggtcagcaatcttatcaggatgaccttcagagacagattcagatgtaaataagtgtctttcactcacaataaattcccccttgataatttcggttacaaggcatctaagcatcacttattcttcattgaacaagctaaacttatcctttcgggaacggctcataactatataaggttatcacaatcaccattttttttaaagatttctgtcaaattattgacgggaactgccccgaccggtacgattaactcattatcctaattagagagtgttgacaatatgattcgaatcggaaaattacatattaaacgcgattacatcgccttggcgatctttaccatcgttcaaagcatcattagttggtgggccgccctcgattacgggcgctcatttcaaacggcctcattttcagccgcgcagttaccactgattggctacaccttagccgtggccgccgcggtcttcattatcttagatcggcggattgctccccagtggagcctcattgcaattggaattaccgtggcctttgcatttaccaacattattgccaaggaatccgaactactgtacctgctattaacgtgcagtgcgtggttgctcgtgatggctgttccacgcttcggtatgcaaaactactttggtctagtcgttttcggcgtcatcatgacgttcacgatcccagtggccgtcttcgatttacaaaataactatttatcaactacttttctctggaagctgacccccatgctggctagttatgtcttcctatatgttccgagcttcagccgtcaacgccaaatcaatcaactgatttcggccatcaccggcctgctacttgttatcaccatcttcctgcagccgttgacctggcaaacgatcgttgcaattctcatcacgattgctgtctggttcagtcaacagtcctttggccgtactcggttacatctcatgatcaacgtagccgttcagttggcactgattttattactttattaatatctagataacaacaaggcgtctacctagtctctcaaactaggtagacgccttgtttgcccctatcaccagttcttaaagtgctgctattaactggcgccaattttcaataatcgtctgcttgctgtaacgagttgctgaattgtaggcattcgtaatcagttgtgcttgtcgttcagggtgctgtaaatactgacgaactttcattgtcaactcatcaacatcattgggtgtcactaagtacccgttaacgccatcttcgataatatcttccggcccgtacgcaattcgatagccaataaccggcacgccatagctttcagcttccattgtggctagcgaaaagccctcttccacactcgtcattaaggcgaggcttgcccgctggtactcttctgccagattgggcaagaaaccccgaataacgatatttttttctagatgattggcctgaataaattgacgcatttgcatttcaatcttttgcccatgcccaaacaactgcaaagtcaggtcgggaaattcaccaactaaccgacgaaccacttccagttgatgtggtaattgcttttctggcgaatagcgcgccacactaataatccggtgcgggtcacgaccatcaattttaaccggatgaaccgttgtatagccgactggaatcacgacaactggtggtaaattatcatagcgtgccaataaatcacgcttttgatgctcggtcgacacaataattcggtgaaattggtctggatgggctaggacataccgatagaccgatttcaaatgcccacttaccacgtcctcaccaatccgtagatgcgtgctatgtaagactgaacacacgcgagttgcggggcgcgtatgacctaaggccgccgccgtttgtcggttacgatcacagaaatagacgtcatcagcagtggccaattcattgaagaagaatgtctgaaaagcctgttcggtattgaagaaaaagtctctttgttgatagttcttcaacgtaatcagtcgtagttttggctctggcccggtaatatcatactgtttgataattttgacttgcccttgtaaatcataatacacttctgtgtgcacttcctgatgtttcactaaaaagcttgtccggctcaggaagccccggttatcataaaattcgcgtcggactttaacaccctgattatcaaaataatttacataatccaattgttgtcgcccggcgtccacaaaatgaacgtacatcaaatattgaccatcggtatccaggacgcgaaaatccgtcgtatttggaacctgaatcaccttaaagtgacaaacagcttgccaatagtgcatccaatcatgatggattttagtcactgcttcaggcatcgtcccctgaaagaaatcatacaaactaaagcattttccttccgcaccaaagcgggccgcatgctcatgtaaacgcggattataagtgacatagacgcatcgagcctgataaccagcggcgtcaaatagcgccagtcggttcaactgtgccttttcaattcccgtcaatttcaatcctaaaccagtacccacaaaataatacatcacctagccgttcccttctcaatctgaaaaatcaactcatcctgtcaccgagttcaaaaacttcgagtacgcacggacgattgaccacttcatctgttatatctatacactatctttaccctaccatattttacgttactcgaccaagatatgaacagttttattgacatacaaaaatcgctagtcgtgaacaactaccgtatcagcagtgcccgactagtgatttttcaccagtttcaattaaattgctagccatacctagtgacgctcagcacgctaggtattgttttgctcaaatataattaaatcaataattagtgtgtaacgaacaccccaagacaacttagatctcggagacacgcccaccatgaactaaaacaccgtcatttcttaacatttttcaaagcttggcggaatccgaaacactgagagcccgtgccaccgtcgcaatatccttcggcgttgtgcgacaacagccgccgataatgcgggccccggcggctaaccactgggggacaaaggatgcaaattgatgactcaaatgagtttcttgccaagtcttcgtcacgggatcatattgatcaccagaattaggataaacgatcaacggaaccgctacagcagccttcaaagtggttaacgctggtgcaatgttttccagcgtagtgcaattgacccccacagcgaccacgttcggctgggccgccacccactttgcggccacagctaatgacgtcccatcacataatgtctgtggatccttgatactaaagcttacccagtatggttgttgcgtccaagtggttgtgattagttgtaccaaagcctgtacttcgtctaaacgtggcatcgtttctaatgcaagcacgtccaccccggcggccatgatcaacgccaggcgttcgcggtgaaagtcttgataggcactcggcgttaactgatatgcacccgtgtactcactaccatccgctaagtaagcaccgtacgggccaatactaccagcaatcacagcatccgtgacatgactagcatcacgcgccgtatgagcaattgtcaccgcctgttgtatcaattgacgcgcttgtgcggcagcaataccagcctgctcaaatgcaggcacgttggcctggtatgtattagttgtcatgatttttgcgcccgcatccagatagctctgatggaccgcttgaatcgcatccgggtggtccaacattgccgtggctgaccacagtgcgctattggttgccacgccccgtttttctaattccgtagccatcgcaccgtccgagacgactgggccccggttcaattgttcagttaatgaaagcattgcaataattgccttcctttctacttataaattatgttattctaatagcattgttgattttttaatcatagtctaatcatattaattctgcaagtaaggaaggccggtacattatgtcaaaacaaacccacctcagtcgccagatggaatcacggcacgtactgatgatttcgctcggtggcgtgattgggaccggattatttttaagttccggttacacgattcatcaagcggggccaattgggaccctgctcgcctataccattggagccatcctcgtctatctcgtcatgctctgtctaggtgagctgtcagttgcaatgccctacaccggggcgtttcacgtctatgcgaaaaaatatattggtcctggcacaggctttacggttgccatcctatattggttgacttggacgattgccctcggttcagaatttacagcagcggggctcatcatgcaaacgtggtttccgcacattgcgacctggatctggagcctcgtctttatggtggtcatcttcaccgttaacgccctctccgtacgctggtttgcggaagcggaattctggtttgccagtatcaaagtcatcgcgatcattgcttttattgtgttaggcggactggcaatggtcggtatcctgccacttcacggtcataccagtgccccgtttctgagcaactatacgcgtaacggttggttccccaatggttttggtggcgtctttacgactatgctaacggtcaactttgccttttccggaactgagctaattggaattacagctggtgagactaaggatccggcccacaccattccgaccgcaatcaaaacgaccctctggcgcctgattattttcttcatcggtagcatgtccgtcatggccgcactgattccttacaaacaagcaggtgtgacgcaaagtccattcgtgctcgtcttcaaagcgattgggattccctacgccgctgatttaatgaatttcgtcgtattgaccgccattatgtcggccgctaattctggcctctacgcgtctacccgcatgctgtggtcacttgcgaacgagggaaccattccaaaggttttcaaacgaaccacgaagcgtgatgtgccgttagtcgccctaattactagcatgctgggtggcattctggccctattgtcgagtgtctatgccgccggttcggtgtacctggtcttagtatccatttcaggacttgccgtcgtcattgtttggatggcaattgccctttcggagatcaacttccgcaaaacctacctgaaaagtgggcagtcgcttgatcaattgacctttaaaacgcccggctacccggtcgtcccgtggctggcctttatcttaagtgggctctcttgtatcttgatttggtttgaccctaaccagcggattgccttgtattacaccattcccttcgtggcgatttgctatctaggctactatctcaatcaacgttatcgacggacccacgccgcaaagtaagcccgttagtcagctcaactcaccaagtccacccagcaatcgtcttttgatgctgacgacctgaaaacgaacatggtcatggcttttgctggcatttctgaatctacttttaaagtgcgatccagccgacgacaccgatttttgaactgcaacaaaaccaaatatcaatttcagatctcttgctagcccggccagttgctagcaagagattttatttatttcagcagtaaattgattatcactagataatcgaacaaataaaccattaaccccgtatacaagctgacgattatgctatgattaatttatcaagagcattggaggggtttctatgcacccaggattattactcgtcaatttaggctccccagcatccccacggactaaggatgtcaaaacatacttacaagaattcttaagtgatccaagcgtcatcgagatgccagccgcactctggcaaccgctgttgcgtggtattatcttaccgacccgttcttggcgttcggccaccttttatcaggatagttggctcccacaaggctcaccattaatcgtctacagtcaagccatctgccaacaagtacaagcagcattacccgattgggacgtccgactagcaatgacgtacggtcaacccgatatcggtgcgaccttgaaagccatggttgctgatgggtgtgaaaagccaattattttaccactttttccgcaatacacccagagcacgcacggcggcatccatcgtcaagttgaagcaactggattaccacacacctttatcgacagtttctacgaccaaccgacctacattcacttactagcaaccaaagtctggcaaagctatcaggcgcatcattatgatgcggtcatcttcagctaccacagcatccccactgcaatggtccgccatggtgatccctatcaacgcgaatgcgaggccacgaccaaagctgtgttggcggagcgaccagaattaccagctgataaggtcattacggcgtatcagtccaagttcggaccgatgccgtggttgaagccttacttaaaaaatgagctcatgcagttggtcgaacttggcaaacgcaacgtattagtagttacgccatcctttgtcgtggactgcttggaaaccctcgaggaagactacgttcaaaattatcaaacctttcgggcaagcggtggtgatcggtttgacttagtaccaccgatgaataaggataccagcttcagccaatttctggctgacctcgctatccaaaagcaggaggcgtcgaaccatgcaatcacatcgtcatcaaagtcttgaagaaatcaatcagagcgtcgcggttcccgacgttcatcagacggccttttggcgcaaatttttagcctatagcggtcccggtgcactagtggcagtcggctatatggatcccggcaactggttgacatccctagccggtggcggtcagtttcagtaccggcttttagccgtgctcgcattagccatcattgtcgccatgttcatgcaaggcctggcaatcaggctaggcgttgtagcccggcaagacttagcacaagccatcgctagcaagctgccccggcccgtgcgttacgccgcgtggattttaaacgaagtcgcgatgatggcgactgatatgacgggcgtaattggaaccgcaatcgccttaaaaatgttattcggcttaccactacttgcaggaattttactgacgattgcggacgtcttagttgtcttgttgtttttgagatttggcattcggcgtgtcgaagtaatcgtcctcgtcgctattttgaccgtcggcattatttttggtatcgaggtgggacgggcccacgttcaatttggcaacgtgttgctcggcttagttccaacaccattgatcgtcaaaaatcataccgcactagtcctcagtctcggaatcttgggcgcaaccatcatgccacataacttatacttacactcatcgcttgcacaaagccggcgttatgattatcataatccagcccaagtcacagaagcactgcgcttcgccaattgggactcaacagtgcacttgattgcggcttttctcatcaacgcacttttgctcgtccttggtgggacgcttttcttcggtcacaccaacgcgttagcgagtctgcaggccgtcttcgatgggttaaaaagtaccaccgtggttggcgcccttgctagcccggtcatgagctggttatttgcattagccctactaattaccggcctaatttcatccatcactagcaccttagctggtcagatcgtcatggaaggttatttacacatccgcttaccgctatggcaacgccggctgcttactcgcgctgtcacgctaattccgattctgattatcggtatgttagtcggctttagtgacgctgcctttgaaaacttgatcatttacgcgcaagtggcactcagcatcgccctcccctttaccttgttgccactagttgcgctgacaaatgacgccagcctgatgaaggcccacgttaatcgcccggcggtaacgtgggtgggatatggactggccggaattattacggtgttgaatatttatttggtgtatagcttgttttgagatgagatccattcacatagctactttgacttcagcactaaactaaaggccgtcaaccgcgaagcatatacgcagattgatggccttttgatactccaactcaattatcgtggatactaatttcccaatttttagcgataaatagtcataccccgcaatgtatcttctatcagacagtatcgcaacgttatcactagttgctatgctaggtaaaaattccccagtacaacccgcacccatgaatcgcaacagtcccaattgctaaaatgaccattttagccaagctacatgcccaatatcaatggtgctggctcgaatcatattactaaataacattgaaaagacaacaagacactagtcaaattaattgccagctttagtcgaggcgcatccgttacgttaacttttttgtaaggtgtcatcatttatccaaaacctctttcacaaacaattagtttaaccactatatttagaagcaatccattcagcttaaacaatatcacaccatatgtaagtcaccttgaactctgggcaattacatgtgtggtaacccacccgcattccatgtactgatacaattaaatgacaccaaccaaactaatcataaggcactatggtaaaataaaaaccgtgattatcgcaaggataaccacggcacgaaacgaattggcttgaatatacgtgctatatattacttcgtttcatacccattataacagataaaagttacgatggcttttcatagtggttacattcataaatttttaaaacccacgtttaccagaataaaacatctcaccagagtttagattacatagtagaaaggaagcatctcaacatggtaaaaattgcagtcctatctgacgttcacggtaacgctactgcactcgaagcagtcttagcagacgcccagaaacaacacgttgacgaatactggacagtaggcgacatgaccgttcgcgggccagaatcggagcgctgtctcaccttactagaccgcgttcaccccaccgcctacgttctcggaaatcacgaggaaaactaccaaaaagtaatggcagccaatcccaacacgtttactaaacccaaacaaattatggcaacggttctcaccgcttttgatcggcgccagctgagttcgacacactttgaacggttactgaacttaccaatgacagtcatcaaacacgtcggcccgttaaccatccgtctccaacacgttttaccgaccgtcgctagtggacacgcgctcgcaccaactgccagtcaggccaactttgaccaagccgctgaaggcgatgtcgatatcgtcatctacgcgcacacacaccagcccatcatgcgctacgcaaccacgggacagttgattctaaacgcagggacagttggtcttccgactgccattaatccccacctacgccaaccacgagcaaactacttgcttctgacaattgatgagactggcctccagcatgctgattaccgcgccgtagatttcgattggcagcgtgctatcacgattgcgcaaaatacccacttaccctacttcgaattctatgaacaaactttgcggactaatacttaccaatatgcaccgagtgcggtcgctgcttataatacgcaacatgacatggcccaagaagcgcgcaagattttacttgaaaatcgtcactgaaaatctcctaagaatcgggagaaaatagtttcatttttctaaaaattctgtatacttttaaaagtcgattactgcttcggcagtcaatcgctgttcaagagaggagctagaattatgtactttaaaaaagcgaccctcgatgatctcgatacgatcatcgacattctgagtgacggccgtaatcaacttgctgaagctggggtcaaccagtggcaaggcgactacccgtctcgcaaacaaatcacggccgacatcatgcaaggatcagcatacttattcaatgccgacgacaacgcaacggtcggcgctgtcgctgtcgtgccttcaccagacgaaacttacgatactgcgaaggccgaatggttaaataccacggcaccttacgtcgtgattcaccgagtcgcgattcattctagccatgcaggtcatggttatgccactcaattattcgaaaaaatcattgctcatattgctgcggatcatcctgaaatcaagagcatccgtatcgatactcatgccgacaatcaagcgatgcaacatctgattgcaaagatgaacttcaagcgagttggcgaaatggtcggtgtataccatgtcgatgacgtttgctacgtctatgaaaaaatgctctaattaatctgagaacctgaccacttgtggcaggttctttttttacgatcaaatccaatcagtcatgctaaatgactactcgtttgcggcagttgtcacagctaagtccttttgctcagcaaatacacaacgagtggctgtttgattcttataaccggcgcactagttgcagcccgattaagacaagcttggcttcatttttgtaacaaagtcgccagtgctgcataccgtttgcgccagtccaaaatagttagcgactcacagggttgcgttaatagccaatccaactgtgcttgccggtcaggctgatctaagaagacgtaactccgcggcgtaacaaagttttcaaactgacgacgtaactgtgccaacggaatgttaggtaaggttgtaaaagccgtaatcggtaacgccaatccgactttagctccttcaaaataagccgcggtggttgtgggcgcgtcatgctgtaacaatgcgcccacaagcgctaattgttcaggcacgagttgcatgccctgatcacaacgcaaaaagagttgaattcccccattagcccctgtcgtatagacaaatgcttgaaacggacgtgcaaaaaaacgccgacgatattccagaatcttggtgccattgataatcgcttgtgttggttctggatgcaacgaaaataataatgttggccgctttggcaagtaataatctttaatcgttggcatggtgccacccctccttcactaattagcactaagtataccccatttgcgagcgtgcgccaactaatcgtgattcgtgaaaacacgaactataaatagttagcaaacaatattattctgactttgtcctaaatttgctggatttaaaccctaatcagtcgtatattattcgtataaacaaaaaaggcggtattaatatgcattggttggcggatctattggcagcaatcggggtcgttttaaacgggatcccacaaggaattatggcgatgagtctcggttttgcggtctttccgactgcattttcattcggattagttggtttaatcaacggcgtggctagttcagttgcaccggtttcatttcaagcggaatccctcgcactagtcgggcacctgggacacgatttacgcgaacggtcgtcgattatctttttaggtgcgagtctgatgttcgtgattggcttgaccggtactctgccgctcatcgttcatagtctgggcaatcagcttatggcagcgatgatggcaggagttggcctgatgttggctaaaatcgcgttgcaaatggcgcacgaacaaccccaatttgggtggctgtcaatcggcttggcgggtgtgacttatttgatcagtaaagatttagtatggacaattgccgtttcagtgattggaaccagctgttacgcagcgacgacacattatcgcgtcgcactaccggaacatgtgacgacccgcaaattacaatttgtcaggccacagttcagttttaaaatcctgcgaggtgctctgagtctagcttgtcttaatatcggtgctaacctctcgtacggcttaattactggccaaatgacgggacaacaccccaacccggtcaatctaaatctactgactagtagtcaggcattagcagacctgggaactagccttctgggtggtgcgccagtagaaacgattatttccgcgacagccagcgcgcctgaaccagtaatcgcgggtatcctaatgatgttgatcatgatgctgattctattactgggatggctgccaaagctgggaaaagttgtgcctagcactgcaatcgccggttttttgtttatcttagggaccattgtcattttcccggaaaatgcaaccaccgctttgcacggctcgttaagtacggttgcaggcgtaacgctcgtcgtgaccgcccttgtcgatccattcgcggggctaatgaccggggcactcctaaaatttggtttaccattaattggattggggttataaatatgcaaacttatcagttaacattaggatcgctgacacggcagttaccattgattcgattaaatgccacgactagcatcgcctctttcgttctattgggcgacgctgagctgaccggctatgctgcccgtcagctcagtcaacggctaactaccactaaatttgattatttagtcacgatggaaagtaagggcattccgctagcccaggcactaagccaggccacaaaccaccctcgctttatcgttttacgtaagaatcgtaaggattacatgcagcacccgcttatcgaaccggtaagcgcaattacgaccagcaccccacaacagctagttttagacggtactgacgccgcactaatcaatcataagcgcgttatcattatcgacgacgtcattagcagtgggggctcgttgacagctgccaacgccctcctacaccaagctggcgcccaagtggtcaagcagatggcaattttagcagaaggcgccgccagcgaacgaacagatatcgattttttggcaccgttaccattatttgactagctgcggttcagaaacacattacaactcactagcgagtcacaaagcagaacaagcaccatggacttaaaccaactacttcagttatcaccgagtgcaacgagcaagttttagatggatggattcgttttaaagacctaccataatatgaaaagccctatgttagcatgatttatgctaatacagggcttttcgatgcttacgagactatttctacgttcatattcatgcaatgctaatattgtaaatttattctttgcaattggaaaattcacccaaaaatcattttgcctattttcgcatgattctaagaatacaaaaaagccgttatatcaacgatataacgacttcttaaaggtacttagagcttcctgaaaacctcttagtaccggcgatcggggtcgaaccgatactccctcaacgggaactggattttgagtccagcgcgtctgccaattccgccacgccggcaaaataataactagatggaacataaatctgatcaggattataaccttttcaggaaaggcggtaaccggatttgaaccggtgatgaaggttttgcagacctctgccttaccacttggctataccgccatcatttattgcccaaacccaactgggttagctggattcgaaccagcgcatgatggagtcaaagtccattgccttaccacttggctataacccaatcaaagggcggtaggtgggaatcgaacccacgcgtgccggagccacaatccggtgcgttaaccacttcgccactaccgccatcatggcagggatagtaggagttgaacccacaccgacggttttggagaccgttgttctaccattaaactatatccctataaagaatggaggggagtggattcgaaccaccgaacccgaaggagcggatttacagtccgccgcgtttagccagacttcgctacccctccataaatggcgcgggacggaatcgaaccgccgacacatggagcttcaatccattgctctaccgactgagctaccgagccatatcattcttcatgatggagtctattaaattattgatgagtaactctcatcagatggaggatacagggctcgaacctgtgaccctctgcttgtaaggcagacgctctcccaactgagctaatcctccataatgacccctacgggattcgaacccatgttactgccgtgaaagggcagtgtcttaaaccacttgaccaaggggtcatatttattatatctaactaacggagagtaagggattcgaacccttgaaacaggtataacccgtttacagcatttccaatgctgctccttcagccactcggacaactctccatggcttaccgtagataactccgacaggcgggctcgaaccgtcgacatcttgattaacagtcaagcgctctaccaactgagctatgtcggaataatcgcatggcaacgtcctaccctcgcagggagcgatcccccaactactcttacggtgagtctgcccggaagcttgccacttgctgaagccacgcaattcagttaaggaaccgtgcgcggcaaaatgacgccgcggtaactcgggagaatggtgctgacgcaatcatcaagaacaaccgcagacctgaacatacggaccccaaggcgactgtttttagtgatattcaaaaacacaggtttcctgacaaaatcgtaagatgaaagtataggggctgacgcctgccgcccggtgctggaaggttaaaaggatgggttagcttcgcgaagctcagaatttgaagcccagtaaaacggcggccgataactataacgtcctaaggtagcgaaattccttgtcgggtaagttccgaccccgcacgaaaggcgtaacgatctgggcactgtctcaacgagagactcggtggaaattatatatgtggaagaagcaggctacccggaacggacggaaagacccctggactttactgtagcttgatattgagtgtttgtacgcttgtacagataggtaggagccagtagaccgacgctagtttcgggcggaggctaggtgggatactacccggctcgctgatatgaccactctaataaccgcacactatcgtggtgggaacagtgtcagtgggcagtttgactgtggcggtcgcctcctaaaagtaaagagaggcggagcccaaaggttccctcagaatggttggaaatcattcgcagacgtgtaaaggcacaagggagcttgactgcgagacagacaggtcgagcagggacgaaagtcgggcttagtgatccggtggtaccgtatggaagggcctcgctcaacggactaaagctaccctggggataacaggcttactcccccaagagtccacatcgacggggaggttgtgcacctcgatgtcggctcatcgcatcctggggctgtagtcggctccaaggggttgggctgttcgcccattaagcggttacgcgagctgggtttagaacgtcgtgagacagttcggtccctacctcgcgggcgaggaaatttgagaggacctgtccttagtacgagaggacgcgggatggacataccgtcggtgtacagagttgttccgacagggagcgtgggtagctagtatggatgagataaacgctgaaagcatctaagtgtgaaacaccctcgagatgagatttcccatcttttcggaaagtagacccctcagagatgatgagtagatgaggttagaaagtggcaagtgcgtgatgcatgagagcggactcaatactaagcggtcgatgacttaaccaagtaatgcgcggtgatagctgtaagaaaagtcagatatttgatttagtagtttttgagagcacgaagtttctataggtgtggtgtgacgcgatggcgtggagaaaggatacaaacctggtccatgtcgcacacagagttaagcttctgtagcgaaggccg

SEQ ID NO: 724 - DNA, 371989 bp, Unknown
  Metagenome-assembled genome
acattatgaaactggtcacggtagggaccaactttaaaaatcaaaggcgtaagcaaatgggacgagaaaccaaaattcggtttctcgtcccatttgcttatacagaggctagttatgtcacagcctcattttaattaatgctcgttttccgtaactgcgtaataccgaattctcttatgttgacgctgtgcatagccaatttcttgcctagtccgctcaccaatgtagccagcaacattaatgaccactacttcatctgccaagtcgattttttcaaatgtgtctggcgtaaattctgaagttcaattggtgttaatacttcatcactgaaagctggctttaaaacaataacaccttgtttactcagagccagctcaaccgtttcaaatactgccgcatattttctagacccacataaagtaactattttaacagccattcgtcaaccttccctaaagtgaactgatcgaccaacgattaaacttccgtcgcagtcacatgcttagttttcactgcagttcgctgattcaagtgcgccataccaacaccagtgaaaccgctgattaccgagataactggacaaagtaaactgaagaaaacaaacggtaagtattggacggttggtactcccagcgtcgtcgtcaggaagacgccgccaacgccccacgggactaggtaattgatcaccgtaccgccatcttcaaggacccgccccagtgcatttccggataagccaccatcattgaatgcctggcgaaaagcgcgccctggtaagataatcgaaagaaattgttcaccaacaaacacgttgacaccaatacaagttaatacacccgccaatactaacttgccatcgctattcaagtgcttagcaaccggggtcataatttgattgatcagtccaaacttgaccaacaatcctcctaaggatagcgtaaccacaattaacgcgaccatactcatcatgctgacgattccgccccgtgaaagcaacgtatcaacactcgtattccccgtcttcgaaacaaatcccgtgttaataatggcggttaacttcgccagtgataactcaggctgttcaaatagaatcaagcccgccgaaataaaaatatttaaaagcatcgttggaatggctggcattttaaacccggcacaaatgaagactaagacgattggtaacaatgccaaggctgagatactgaaatgaccatttaaaaccgcaactgtttgattgatcttggctaagcttgtctccgtattactgtgccccagcatagcaaacaagcctaatgaaatgagcccggccggtagcgtgctccataagatatgcttaatgtgcgtaaaaagatcagtatccactacggctgaagctaaattattggtttctgataatggtgataatttatcgccgaagattccaccactgataattgcaccggcaactaaggctggattcagattcatggtcacgcccatgccgaaaaaggcaattccgaccgtcgatgttaccgtaaaggcactgccgaccgccgcaccgactagggtacaaacaataaagactgatggcaaaaaccactgaatattaataattttgaatccaatcaccatgagcgtaggaatcgttcccgccgcaatccaagttgaaatcatcgcaccaatgagaataaagatgaagattggcacgatccctttatcaatgccctctttaatcccagcattaactgctgaccatggaaaaccgcgcaacatcgcccaaacagtgacaacgcccattgcgagtaatacgggaacttggggcgataatccccaaccaatcacacccgcactcataattccgaggacgaccagtaagacaatgactgcttctaaggtactaatttgtggtgcttttgttttgttcataatttattaccccttcgattgataaaattccagtgacgcatattcatcatcaaaattttaatatcgtgcaatcccaccacagcgttgatttgtcattattctcatcctcttcatcaaaaaaatcgtccccattgttcatatgaacaacagggacgattagactagtcgcggtaccacccaggttgcggattattgacacttaatccaccactcactagaagataacggttctagttattatccgttcagtcgaaactcggttaccgtatttcaatcatagtagctgaccggttcgcagcaaccaccggcttcctgacacctaccactatgtctacttgatgtaacgttatcgtacagttattaacttgtgattaacaataccaccatcttttatcatcgtcaagccattttataatataattctcattttaagattacgaccgtgttacagctcgcaagcgcgcttggtgggcaaaagtgatgccaccaaatagtaacgtccaaataatcgcaccgattgcaccgacaatatcagcttgaatgaagaatagactggcaaaaatgagaacaaaaaaggcaatcgtcagtgggctcgtgattcggtacgccggcatcttaaacccatccgccagatagtcattagatagccggtacttccggtgggccagcatcgccagcgtgtaaacaatcaggtacatatcactagagatcccggtcacgacggtaaaaactgccgtcgttgcagcacttaaactcatgatgggggtcactagcactagtaccgcggacaacacgattgctgctgccggcacaccacttttcgaaatctgaccaaagatttggtgcatgcgactcgtaactggcatttcagtggctagctgatagaagtgacgtccagctgagaacaaacaactatttagcgatgaggctgccgacgttaagacgacaaagttaatgatggcggccgctgctgggtatcctgccaacttgaagacttgcacaaacggactgctatcgggtgacagtgatgtccacggaataatgcccataatgacaattaacgcaccaatataaaacaacaagatccgcaacaaagtttcattgaccgcctttttgataacgcggtgagggttcttggcctcaccaatcgttatactgacaaattcaatgccctgaaaagcaaagaagaccattggaaatgccgagataaagttagctatcccattgggaaagacctgataattatggaacaaattgccgattgaagcctggcctaatggggttgggtgatgtcccaccatcatgaaaataccagtgacaatcagtgcaatgattgcgacgatcttaatcatcgcaaaccagaactctgcttcgccaaataaccgtgcagccgttaaattaacgcccgccaaaattaacaggaagctaatctcaattagccaggcggggacatttggtaaccaaaatttgacatacgttgccgtagccgtcagctcagccatacagacaaaaatcaaaccgatccaataggtccaccctgtaaaatgaccaacactcggtcccaaatagcgggaaataaacgccacgaatgtgtgttggataggatcagaatagaacatctcaccaattgcccgcatcattaaaaagaagaagaagcccaacaccaagtacacccacatgactgacggtcccgtctttgaaatcgtactccctgaaccaagaaataatcctgtcccaatcgtgccaccaattgcaatcatttggacatgccggttactaagcgcccggattgtgccatcagcattagttattttcataaaacccctccacaaattttaatgactttgttgctaaaatttaatgttgtgccattatagcacgctctagctttcacttaattgcgatttttaactgttaacccctgtttttaacgacgaataggtcgcaatactttgttttctaaagctgtcttccttattgaaaacgtcaccaaaactgtagttgctgcgtttgaccgcctaatttggcgctacgaaaaaagccgcccgagtatttacccgaacgacctcatttatttaatacacccatcctgacacaataacacttaccacaaaaaggcaatcatcttgtgagcgacacttggattctgattcaacgcgcaatgcgccgcctgttccccactatagaaagcttcttgatactgtgctaattttccgcgcaacaagtaccgaattgagcgcgctgaagcgacacccacaaaaccatcattgttataccccgtgtttgtatctccatagacattgagtagtttcacgttgtctggaaaattgtggcgatacttgagcatttctgaaaaatgcttcgtgaaacgacttggtttaacatccaagcgccggaccgttgcttccgtctgcgtgctcagaaacccggtcaggccatcgaacggtccgccaatcgtcacgattttattcaacgttggtaagcgtttgtcatgcccatacttcaatgcctgattgacaatatcattggccccgagggaatgaccaaccgcattataagctttgacgccatacttcgcttttagttggactaagacttggtgtaaccaataaatctgggctttttgtgaggcgtgattatcttgaaaaacaacttgaaccatcggattcttgattgacttttgccaataacccttaaaggccatcacaccattcttgtacacgtgcaccactaacgctttttgggcagcccccgctttttcggctttacgaatcagatagttcgtcgaatacgccccaccattgtagccatgtaaaaagaccgtcgctgtctttgactggtcatattgattctttaatattcgtgcagaacgcggtgtcaattgactcgttactttcgtaatcttggtatcatgattccgggccccaactaaaatcacagccgcaccgataacaaaaacaatcaataacaattgaatcaccgttcgccaacgtttcatcaaaattatcttacccttcattatgtttaacagtcttattttacgcgtttcaattaaaataaccagtcatcgttttcaacaatcgcctttttaacccgcaccaacgaatattgaacccaaatcatattctttagccgctcatctcgttataatggacttactaggttaaataactaacctactcaaattgtttatttctggagggtaactatggaaaaaccaacgtttaaatatcctgataaggctgcgtatgagttcgtcattcaagccttagccgcaaaagggattacttatcatgaaattgcgcatatcacttataacttacaaacaaaatacgtccctaacttaacgatcgaagagtgcgaaatggagacgcaagaagtactgcacaagcgcgaactattgaacaatgcgatggttgcgttagaactcgaccgccttgccacagaaggccagctaaacgagccgctccaatctatcattgccagtgacgccggcgtcttcggtgttgatgaaggcttagcacttaatatggcgaatatttacggcaccatcggcgtcactaattatggttacgtggataaagttaaagaaggcgtcattaagaagttagatactgataagtcaggcgttgttaacacgtttattgatgacctagttggtgcgatcgcggcggccgttgcggctaaaattgcacataagtatgcctaagcattgtatttgctagtcgttatcgcttataaaaatcagcaggcatcctacttcaatgcctgtttgcttgaattagctagtctgtactggatatgtccgctaaaaaacagttacctcaaaatgaggtaactgtttttttgttgaccatgctcaccactgaattaacccacaactgccaaatgacatgtctactcctcgacctaactactgtaactgatccgcataatctcgtaagtaagttgtcatcgtatgcggagcgtgacccagcactttttcagccgtatcggtcacgcgtttagcgttgcccaactgggtaatcaaatacagcattaccataacattaacatagtccttcttgattccccgcttcaacatcacgcggcgaaaccgccataagctcggtcgatgatacgttaccgggtgaccaaaggattcagtcattagcaccgcaatttgctgataagtcaacgcttctggaccagtcacagtcaatttctgttgtaaatattgtgtatctagtaacgccacgcccgcaatctcaccaatatcacgtgtatcaataaaactcgtcttcgaccgcccggctgggataaacaaatcgtgattttgctgaatgtcgacgcgatgcgtggtattcaaattttgcataaagaagctcggtcgaatgaatgtgtacggtaactgtaactgttcgatcatctgctcgatttgatgatgtggcgtcattggattatgctcaacacccatcagcgaaacaaatacgacctgctcaatgtggtgtgcttgtaagcattttaggaagggccacatatcttgcttgggtttagcaagttgtggtggccgcacgaaaaaaaccttttggattccccgtaacgccgcatcaaaggtcgtctcgtccaaaaaatcaaagcgtcgaatttcaacatccgaatacgcagccaatagttgctcgtctttatgcaaattgtgggcaccagcaacaacttgcacccctacctgttgatctagatattgaattaacggtaagccaatatttcccgtcccacctatcaccagtattttcattttattaattgctccctagtttttttaacagttgtcttaaagactgtttttcagcagccgtcaatttctgaagccccgtcgcaacgacctgatcgctaatacgctgaccggcctgcaattcttgtatgccaacttgggtcaagcgtagtagctttgctcgctgatccgctggattaacgtcctgttcaaccaattgcttggcagctaagcgtcgaagaattcctgacatcgtcggccggtccatatcgagaacgtggcacagctggttggcagtcggctgttgcgccgttctttcgacccaaagactgatttgttgcatcacagcccattgttgaatcgtcaatccgttagcaattagccgttgatttagctgataacgtaactgtttggaaaactgcattagtaaataaccaatattatccatttcatcctccgctatttagttagtatactaactaaatagctataatttgtcaatttacacacaaagcagtaccgcttaactgtgccaatcagtttatgttggcaagtaagtagtactgttttataatgtttcgccccaaaaacacggcatcaactcataagccgatcattttaagccatctgatgttctgacattgcttgcatcttgagtacgcgctgttcacgtggaataaacatccgaatctcatcttggttaaagccgcacagaagtcggtgatcgtcaaaaataattggccgccgcaataattgcggtgtttggcttaatacccgaacagcttcgcttaatggcatatcttcaatcggtgtcgtcttactcagttggtgataagcattggacttagtactgatcaaatcatcaatgccattgtacgtgtactgtagcaggtgcttgatttcagtctccgttaacggctgtgcattcatattacgttcatgaaacgggatccggtgttcgagtaaccaccggtgggccttgcgacaacttgcggtacttggtaacacacataagtttatcataaaattatccccaatcttgcttgcctaacaatgcagcccccattattgtgcactgtaatagttgacgtcattaattaacaacataatcatagcaaaattcgcagctaattgctagcgttttcaaaaaataattaaaataatttgatggtcgcagtttattgcaggcctaatcccaatttcatctataccaatattacgcaatttatattaagcggttggtaattgcccactatccttcaggtaatcacgcagtaccactgcctgattatgttgttcgtccttggcaccgaacaataagatcacattcgtcttcgtcagttgttcagcaacttgactaataaagctggccgtcaggggattctcatccaattcagcccggtaacgctcgacaaattcgggatatttcgccggttcatgattgaaccacttacgtaacgtggtcgacgggccaatttcctttacccaattgtccaactgagcgttaaccttcgaaataccccggggccacaagcgatctaccaacacccgataaccatccgtatcaactggtttcgtgtaaatccgttctaattttaattgcataatgaacactcctcctatcgtacgctgcggtaaacaatctatgaccatttacaataacctatcacatttcatgaccataagttgactccattataacgcaggtgccggtatcgttaaatcgaaccaacactttcccgcaaccacatattgatcagtcctcatgacagccactatcatcaattcagtacaaaaaaaatcaggtcccacgaatggccctgattttcatcacaatgagttgactaacatcttatcatgattatgacaatcacgttagccttcaccgatcacaacttcaacttggccccttttcggcacaaaattaatgttataaatcggttcccgcaataccttttcatattcttctaagacatcttgtggcaatggcgtatgggcggccaatgcgcgcattaagtcatcgaccgaataaacatcttccatgttaataaagatccgcatatttcccacaacatcattcaataattctgtcaaaatcgcattgggcttaccgttaccatctgtaacaaccacttgattactgtcgacttctttatggtctatctttgttaacttaacgatatcaaatacatttaacatgcgcgaccctccgtcacaatattgatttgctatattctaccacaaccatagcacatctgaagggtgaaaagtatttaatgttgactgaattaatcaattgaatagcgtgcaaaaattttttcttgaaccttaggcattggaagtttctgccgctcaatcaacgtaaaggtctgaccagcaaagtaggctaagtcacttaacccaacttgaccactcaaaccttgaatggtccacttctgatgcgtaaacgtatgggtcacaggccgcccggtcagataatgggccgttagctggagctgatattcacgtttaaaataattttctaccgccgtaactagttcttcaggttggtaatcatcatctaagtctaaatctgcaatcggaatcaggggaaccgtccataaattagccaacatcccgttactcggtcgcttcgtcatcaaccactgatcctgcatcttagctaataccgccacgtaagcaaccggcttgggccgcggtttcttcgtcttgaccggataggctaactcatccccatccaaataagcttgattaaagcgtttgaccggcgaatgagccgtatctggttgccgcgctgtcatgtagcttgaaccgaggtccataatcgcctggttaaaatctccaggtcgctcttgtgaaacaatctgactgattacccgttcaaaaacagcgcgggtctggggcttcgcaatatccgcatcaatcttgagcaaccggctaaagacgcgataggcattaccatccacagctggaactggttcattgaacgcaatgctggcaatcgctcctgcagtgtacgggccaatcccaatcaactccgtcagctcagcggcagtttgaggccactgtccatcgtaatcggttaacaattgtttggcacaccgttgcatattgcggacacgtgaataataacccaggccctcccacgcctttaacaactgtgactcaggtgcggcagctaggtccgctaccgttggaaaaagtgccataaagcgctgataataaggaatcacagtttgaacctgcgtctgctgtaacataatttcagagacccagacgtggtaaggctcatggtcatgtcgccatggtaaatcgcggccttcgtgatcaaaccaatctaatagcgtcgtctgaaaatctttaattgttgccgcatcccattcaatcattactaaccctccaaaaaaggccacgaggcttcgtctatccgaagttcgtgaccaccttatttacaaattaatccaaagtgttagccaaatctacgagtgttttttcgtagtgatccgtcacactttcatcctggaaatcggcattgaaaacggccaatgtcaaatactcggggtattttaagatgaccgctgccagccgcttattaatatctggatatttttgatcttcattattcaaaatatccagactcgcttggtaacaaacattggctaaaaacaaataatccacaaaataattaaatcctggttcgttttttaattcaaaatgcgccttcacgtccactgtttccgaaatattcgttaaatacttcgttacaatttcttgatactgacgtaacaactccgcctttgcttctgcatgtaccgttgccataaaatatccccacctaatttaatctctgtgaagattatagcatacggcgtaacccctgctgaatgttagctgctaatccagctaactgatcgtactgccactgacgctcggcagtgaccgcaaccatgtcatttggttgcgttaaattaaccaatttaattgcttggtccgaggcccgcagcgcattttcatccgcatctgcggaagctacggcccagcgaacgcagtccagtgccgccgcaccaatggaactcgtcgtcgttgcacttaacttagtcaatcttgtcagtgcctgccgtacctggtagccactaacaagattaacttgccacaattcattagcatcaattgcgagtcgcaattgtcgatcatatttctgttggttatcaacatactgcaaggctttcttggcgataattaacgcccatttagccaattgttgttgtgagagttcaccagtcaaagcttcgatttgagcccgtattccagggtcatcgtcaatctcaatcttagggtgactcggtctaaaaccttccgtcatcacgcattcctactttcttacaaatccgacaacaaacatatcctatcattatcaatattcagttcaattgatatatcgataggattaaattgtaccagaaatccagcaaagatgtgagtatctgactccagatttcatcaaaaatttacaaattcttgtaaccgtttcatccactataaatacaataaaaagacgccctgccaccaatcgcggcaagtcgtcatataaaccattactgaatttcaatatgatgggtatccgcagctgccttctttggcaaagttaactgcaacaccccattttcatatcgtgcttcgatcttgtcaacatcaacgtcgggtaaagaatattgccggccaaagcgaccagtttgacgttcgctcgcgataatattaccatctttatcgctttcatcactaatactatcgcgttttacagcaatcgataatgtgccatcccgatacttcaaggcaatattctgtttatcgattccaggaacatcgactttcatcgtgtactgatcgtcattttctttaatatcagtctttaggaccgacccatgactaccagcatttaagaatgtccgaccgaatccattaaccaaatcgtccatcttagtccagtcattcaaccgatcaaataaatcattgtgccaattcatcatatcgttagccattatgaaatcaccctttcaatttgtttacatcattaataataagcactttcatcaagattgcaacaatttagcactctccgtatcagagtgctaaatcacttcacttgatatgcccgcatatcaactgggatcaccctgaccattttatgtggcgtgattgttagttgctgggtcgtcatcttcgtaggccagcgagactgcgggcgatcagctaattccaaaccgaccaacattctgattcgatccagaatatcaggcaccccaaatacattattaccctgattaaatgaagtttggagcatattaatggcaacctgtaagcgctgattatggaagctaaaggttactggcacgtacaccagatcagtagacgataattgctcttgtgccaacgtcttatcaagctgcgccataaacgctgtaaattgatccatttgcgtcacccccatcattaattaccgctattatactgcaagactgatgtgacagctattcaaatggatggctgtcatagcattgctaacaaccgaccatcagtctccgtgccaactgcaattttgctcgaaccagtcaatcatcaccaggcgatcccgtgcactcattttggacaaaataaaagggcgcgaccaatgtctcgccctaactgaagaatcacgctaattattagttattagataactttttagcatcttcatcgatcgtttcgaaaccggaaacgccactcttcttctttggatgctttgcacgttcttcttcggctttttgaatcatagcctttttttgttccttgctaagcttttgtgccatgattatcgcctcttttatcttggacagcgaagtacaacttcgctacatgttcattataagtctaaattcaaaaagtggcacaaatttgcttaacttttttgaaactgcttacttgaattctgtaataattaagtttacagttaagatgttcaggaggggattatatgacaaatgtattgatcttaggggctgcgggccaaattgctcgtttagccgaacagcaatttttagccaacacaactgataatttgacactttacttacgtaatagtagccgggtcgcagaccaacaatctgaccgggtgacgattatcgatggtgacacgactgatgaagccaaattaacccaggcgatgacgggacaagatgtcgtttatgctaatttggctggtcaaaacatcaaacagcaggctgaaacagtgttaaaagccatgcataccagcggcctcaaacggctcatttggatctcaactttagggatctatgacgaagttcccggcaagttcggtcaatggaacaacgcaacgttgggtagctacctgacgcgctactacgccgcggctgaagtcctagaaaattccgatctcgactacacaatcattcgccctgcgtggttgactaataaggacgaaatcgactacgaaataacccagcgacacgatccgtttaagggaactgaagtttctcgtaagagcattgcggcactcgtcgttaaattaacccaagatcccacaagtaacattcgcacgtctttaggtgttaacaaacctaataccgatagtgacaaacctgcttggtattaattaattaccaggccgtcaaaaaaacaatttaaagatcaaccagaatcaccacaataggcaatgcgtggtggttcttttattatccatcaaattatgagaaaaatgataatatctagacagttaactaacgatgactgataatcaagctatcaattcactggtacaaccagcaatccgttctcatgtttttttcatcaaaagcaatacctgtaaccattgataaatcgcgggtctttgcaattgacggtcaaaaatacaagtgttaaattatagactcaatttgaaaataactggcgatattcttcagttttcaaggaggctttcacttgaatttgaaatggtacgttaagcaatttaatggtctaaccaccacccaactgcacgatatttatcaacttcgtgccaagacctttattaaagaacaagatcggtcttaccaagaccctgatgatactgacttggacgcgcgtcacgtcttcgcctacgatcaggggcaactcgtcgcttatgcacgaatttacgaacatgctggggtcgtttcgttcggccggataacgactgacagttgctatcgtgggacgggccttggcaagcaactcatgaatcacgtcatggcaattcttaaagtgcattacagcgccgccaccattgaaatcgatgcccaaacgcacgcccagaagttttacgagaagttcggattgattgcggaaggtcagccttatattgacctgggtgccgaagttattaaaatgcacgcccccgcccggaaactggtgttggcgtagcacaacttaccaaccatcgtcccccaagataactttaatctactcaaattatgattaaagctgcgcatcagaatgttaaaattctgacacgcagcttttatttttggtcatttcacaaatggtcaagtcctgctgagcccttattcaagggccctaactaaacaaaaatgataactatcattacaactaatcactagccggatcactccgatactgctgcaagatataaatcgcgacaatcaccaataacgagccgaggatttcgacccatgtcacttgtaagcctaagaaaataatacttagtacaaaagtcactactggttggacggcatcaacaatactgaccaccgcagacggcgcgtactgtagactatgtagcaacgataagaaagcaaaaatcgtcccgattaaaacgatggcgccaattgaagtcactagcgttggtgtaatttttggtgcaccgatccaaattgggtgatataaattaaataggattcccgcaatcaatgtcccccaaccaagaatcacgaccggtgaattttcggctacaatctttcgcggcaagactacgtacaaggccgctgttacccccgaaaggattccccagacgagtgcatccatcggaatcgccaactcatgaatgttacccttagtgattgctaaaaacacccccaacaaggagaccgcaaacgcaattaaatcagttcgtaaaggcagttcccgtttaaacagcaacgttcctagtacaataaacaaaggacttaagtattgtaaaatagtggcggcagcggctgttccgcgctcaatactgatgtaaaaagtatacatattcgccatcaatcccactgtcgcgtatgccactaattgtccaaccgacgcccaagatctaaagactttgaagattttggtaccctgttgcacaaatccaatcgctaacagaatgattccagcagataacgtccttacagataagaaccaatcagccgggatggcttggttttgtgatacgaactgcatcactgtacctgagactccccacagggtcgaggccaacatcgcccacatgatgcccttcatataacggttagttgtcatatttttcaatttcgctctacctcaatttaattaatggcaatattataccgagacttaattaaaactcactgaaaatcgagcgttgttttttaggaagattcagtaatctttatcataatcaagttctatcatctataagcaacgataaatccgaacttttattactcattgtgcgcaattacacggaaaccgccctcaactaaatagcactggggcaggtaactacagtaattgcccgccccagtgctatttaagttcgtaccgatcctaacaatttgcgcccatactgatgccgtttccagcacaccgtacttcaagtgccgtttggttagctattgtttcactgttgacaatccctagtccgaactgaccaggacagaagtacttaaaagagcgtcccaacgtagtagtgaatgaacatcgtcacgatcccaacgagcacgttgcgaatcaccgccgtcttcacattgcccttacctaatacggccgataaatatcctgttaaggccacggcaacggacaccgcgataattgttgccggccactgccaatgagccggtgcaaacgtcatcgcgagcaacgggaagacgcctcctgctgacgctgagaatagcgatgcaaacgctgcatcccaaggattcatatagtgtcctagttgcatatcatatttgatgctgacaacggttgccaatggttttttagttaataaatcgcgtgcaatcgccatcgccgtctcttccgttacgccaagagtcatatagtggcgttgaacagcatgcaattcaccctcaaaatccgtcttcagcaattgccgctccttttcaaccacggctttttcagtatccttctgcgtgctgaccgaagcatattctcctgacgccatcgaaaaagcacaggctaataaatcagataatccagcaataaaaatcgtgaactgattagtcgtggcggccgccacactaaacagcacccccacaacggttaaaataccatcattagaacctaagacacctgctcgtaatgagtttaacttctcatccatcgtttgtttggtcttctcagactttgtccttgtcagttgcataagctcgctccccttgaccctttaattaagcaaataagtgaccaataaagtacgttacgatcatcgtcaataacccggcaacgacgttacgaaccattccacgccgacgattagcattacccagcatcgccgctacgtatcccgtaatcattaatgcaattccgacagccaacaccgttgctaacaccttcacccgtggtgggaaaaaggtgatcgaaactaatggcaaaattgagccagtgggaaaagcaatcatcgacgcaataccagccgcatacggactgatgaactggttcggattgaaaccatagcgctcacgcaccgtcgtagtcagcgcatcttccgccatcatttcccgggttgcttgttgcgccaacggtttactgattccttgattgacatatttttgtacgactagcgacgcttctgcttcataatcatcggcaagtgctgccttctgcttagtaatcgccattttttgtgaatctttttgcgtattcacggagacgtattcacccatggccattgaaatcgtcccagccaacatcccggctagtccagatattaaaatcgaaaaactattggtggttgcccccgcaacgccaacaacaatgccggcaactgatagaattccatcattcgctcccatgacacttgctcgcaaaatattaacccgctgtgccaaagacatcctttttttcatgtttgccgcctccgtaaatactttataatcattattacctagtaaatattatatctttcagaaagaaaatgcaaggcttatttgtaatcattatcgagtataagttatgtatccctaaactataatatagtgtaccaccatttaattattaaagttaatttgaataattattataggtcattgaaagtgctattctgcctagaatcaaaaaaagcagcaccgttagcattttatgctaacggtgctgctttcatattttgaccctaatatattccaacttagtttgctaaccggaactgttgggttgtctttaattcaaattcagtcggttgcgcggccgtcattaaagctggtgtcaattcgacccgcgtaatcgtctgatccgcgtatggttgcatgtaaaatgctggttcattcatgctcatataggcgcggtactgggtataatctggcgtcccgttatcttgcatcttaacgcccttaggaatctccactgagttcagcatgtgtgataatgcgttgacagcttctgcatcagtcgttactgcatccgtatgttcacgcatgaagaccgtccgaacgaagcgtgcaactgacgtatagtcaccaggcattcccaacgccccagttccaggaccgaaaggattcaccgtcatgtcaccgtattgacgactaggatgagggccgggttgtaagttgacgtaattactcaaattcttgagatgccattcaaaatctggtgtgttcgtcatgacgcccaccggattcttcatgtagtgaacaccgtcattttccaattctaagacgtaagtagaaccactcttgtcactaatgatccagtgtagtggtaccacaatattcaatagtggcgcggcggcttccatcacgttcaagtcagcaatccgttcgcctaattcagcggtgctcttcacgtttcctaaaatccacattaaaacttcgtggggtgccaagttaaccttgccagccttagtctgctgagtaaagtgagcttgtcccgagaaatagagtgcagcagcactgaccccgtgctcattgacaccatcgacaaagatatagccatttaagtcacggcccgttccaacaaagctatacgggctatcaaaaccgtccgcattggtaacactgtcaaaatggtgattccgtgggattgccactggtcgaccaccaagttcaaaagcaaagtccatggtgcgtgctaaaaactgatcacccgccgtggtttgaatcgttaaactagtacacatgggtttcacatccttgatttaaatactattattctagtatctaaacccattataaacacacatttgcacaaattaatttacgccaatcagtttatcttagtcttttaatcgtaacgtcatcgcattaattgccacgattaccgtgcttaatgacatcactaccgcaccaaacatcgggttcaaaataaagccgagtggtgcgagaataccagcagccaaggggattgtgatgacattgtatccagcaccccaccataaattttgcgccatcttccgggtcgttcgccgggccagagccaagaaatcgaccacatcatttggattactcttaacgagaacgatatcagcagaatcaatagcaacgtcagtcccagacccaatggcaacgccaatatctgcccgggccagactaggggcatcgttaacaccatcgccaatcatcataacgtggctaccatcagcctgatactgttgaacgagcttagccttatcttcaggcaataaacccgcatgcacttctgtaattccgagctgcttagcaacgacttgggcgctctgcggattatcaccggttagcattactggggtaatgttttgggccttcaaactatcgatcaagttcttggcttccggcttgatctggtcaccctgagcgacaaaacctaagactgtctgctcctgaatcaaaaaactgactgagttaccggcacttgccagtcgattgaacgtttgctggtcataggctaaattttgtttatccaagtaagctgccgaaacgatctgatacgtctgcccatcaatcgtgccgcttaacccgacaccagtaatctgatgaacatcctgactaaccttaggggttaactgatgttccttagcggcagcaagaattccgacagctaagggatgactagagccattttccaaaccggccatcatcgccaagactgcgtccgcagttagccggtcggcgctactttgataatcagcgaccttaaagttaccagctgtcaatgtcccggtcttatccatcaacgcgtagttcaactttttgacttgttccatcgcatcccgattacgaatcagtaacccgtggctggccgcaatcgccgtactccgtgccactaccaatggaattgccaatcctaaagcgtgaggacaagcaatcacgagcactgtcaccgcaattgatagtgctaacgccagattgcccacgagtaaccagacgataaaggcaacgattgcaacggtcaaggcagcgtagaacaagagtccggccactttatccgccatattttcttgcgacgatttggccgcctgtgcgtcactgactaacttcatgacttgggctaagtatccggattcaccagtcccggtgactttcatctcaaacgtcccatcaccattgactgaaccacccacaacttgatccttagcgcgtttttcaactaacttagcttcaccagtaaccatcgcttcattcacactagtcgcaccatttaacactgtgccgtcagctggaatttgttcaccagcccggacctgaacttgatcaccattagctagatcagcaattgccacgtcatggacctgcccatcaactaacttatgtgccgtacttggtaacagttttgctagtttatctaccgccgatcccgcattcatgaccgtattcatctcgatccagtggcctaacaacatgatgacgatcaaagtcgctagttcccagaagaaatcggtcaccattggttttgcatttaacaagtcattggcaaccacagcatagatactgtaaacgtacgccacactgatacccattgtaatcaacgtcatcatggcaggcttatgatttttgacctccgccttggcaccgctgaaaaacggttgcccaccgtatagaaacaggattgtgcctaaaattgcgacgatataatcggaccatggccgaaaaacgatttgaaatggtaaattgacccccatcatcggactcataatgataatcggaatcgtcagaactaacgctacccaaaacttcaacttgagattgcccatgtgcatcatctcaccgttacccatatccatatcgcccatgtcatttgaatcatggtgcgccatgtgttgcatatccatgtctttcataatagcgacctcccctagtcggattgtctacatctgtaatttatggctaaagtttacaattgtagacgataaaagtcaagaaaaacactttcttgactttttgtcgccattcatctgtttcctgagtatcctatcttgaaagtaagtcccttccattagacgcactataactgatggttccgattaaggcctgcacgaatgccccatgatcagttagccaagtatctttaaaatcattctcctcaaaaaatgtcatgttcagattaagaaaatccaaacatgacactcagtgttacttcaatattcgtttataaccacattaacaccgcgtccccggcacacaatcgcagtccaccatttctggcgcatccttggctttttcagccaatactgcctgtaaggcggcgatatccgtttgactcaattccgtttggttaacaaggtccaccagcgtttgaccaacgcgcatctgacataaatgaccgaagagggtgtccacggcttcatccatcgatggctgttcctcaaccattggataataattgaacgctcgaccattcttttcagcacgtaatgcaccttttttgacgagccgtccaagcagtgtcttgaccgttgctgtcttccatcccatcttatccgccatgatttcagcgacctgactactcgtgacattgcccaacgtccaagcaacccgcatgacttcccattcggcatcactgatttcaattttagtttgtgcttccaatggtttgaccacccttcgaattaaattaactgtagtttacaaccgtaaacgtaaaaaagcaactatcactctcgcatggttcaccatctagcatagcgcaattttctttctaataacaacattgactgccattaaccactacccaaatcatcactagttaggttaataacttgattggcgcaaaaaaacggccctaattactgagccgcaacaaaatgatctaataatgatgataacgccgcgacgctatctggataattgctcggatgttgtaataggtaactcttgattttgccgtgatacaataccgtcgtggcggcctgtccgctcgtctgcaataaactccgccgaaattcattgagcaacagttgtaacccgctttgcgctgcgtcttggcgctccaacatcagtgccgcacggctgatagcatcgagaacctgcgtttgcgtgatttgtgattgtgttgacatgtttttccctctatttactgtaatatgcttaagtatacaccgttagtgtcacaaacaggtattatttatctgttgaaaaactatgttatgctactaaatattaattattttagtgacgggggttcagcatttgaaaccaaactcaaaactattacagcgactacgatcatggatgcgtgggcggtacggtcaaaacgatacgttaaaccgctttttaaacaatctcgctttactattgatcgtcatcagttttttcattcgcaccgggtggctactcttaattgccgtgatgctcatcggtattagttactggcgtttgttctctaaaaagatttatcagcaagttgcgatcaatcgcggctttcagcgcttttggtcaccgattattcgcccattcagccgtttaaaataccaggtcaagcagcattggcaataccgctttttccgctgttcacagtgtcaccaacggattcggattccgcgtcatcatggtcgcgttcggataacttgcccccaatgtggacaccaattcgaagctaaagtgtaaccatcgtgcttggatgaaaacataacgattgttgaacataactgatccgcctgcagacctgattttgcttagcaaccacctataataggccaccttagtttgacactgaggtggcctatttacatacaaaaacactattttaacaaccattacgtgctacctttctcgctcaatgaaactgccgacaattgcagtcacagacgtactagttgagtgatggttttcaaactaccgtaaatcaatcctcttttttcagaaaaaacacttacgaaaaaaataattttctggtatgctaacccattgtattcaggaaagtgagtgtgaacaatataatggattcagtacaaagtagcccgcaagctaaacaacgggcccgcgttcccgttgcccatcccatgctagccatgatggggatgttaattggtggttttgttgggatgtttagtgaaacatcactgaacattgccctcccccaattgatggctcagctacacgtgtcaacggcaactgtgcaatggctagtaaccggttacatgcttatgattgggattgtccttccactttcaagcttaattaccaaatggtttacgacccgccaagtgattttatttgccctgattgacttcgccgttggtgcgattatttcggcttcagcgcctggctttggcgtgttattattcggtcgaatgattcaaggtatcgcaactggcctgatcttaccactcatgtttaccgtggctatgcagatttttccaccctacaaattaggggcagctatggggatggtcggtttagtcatcatgttcgcaccggccgtgggtccaacgattgctggagccatcttaggactagcttcatggcgttggattttttggctctttatcccattcttgattattgcctttatctttgccgtcacttcacttaaaaacattgcgaaagtaacccggccgaaagtggacttcttatccattttactttcaatggttggctttggtagccttgttgttggcgttagtcttgctagtgatcaaggttgggggtcgcccgctgtactaggtgccttaattttgggactggttattctggcttggtatgcccatcgacaactcaccatggaatcgccaattctgaaccttaagacatttgctatccctggttttcgggttggcgcttgcctcgttatgattaactttgggattatcttatcagccatgtatttactcccaatgtacattcaaaaggggctgttgattcccgttgccttgactggggtcatcatgttacccggtggcttgatgaacgcaattgtatcggccgtctcgggtcgcttatatgactcgattggcgcccgcactccagcaatgctggggttcttgatttcaatggttggtgccctcatgttggcactgacaaccacgcagagtgcaacgtggtacgttattttggcccacgttatcttaatgattggggcgccattagcgatgtccccttcacagacgcatggtttaaattccttaacgggaccaattgccgccgatggtagtacaatcatgaacacactacagcaagtcgttggtgccatttcaaccgcaattgcaacgagcttattaggcattggccaagcttcttactacgccaatgggggtcatcaagcttctagcgcgttcgtcaacggtgcccattacgggttctactttacgtttattttagcgctcgccggtttgttgcttgcaacccgtttgtctaaaaaaacgactaactaactgtcattaatcaaaactagcgctgttaatcataagcagcctagtttttttattttacgatcgattatcattgaagtagtcttgggtggcttctcatcagcaagccacccaagactactcagtcaccatgcaatgcttagcgttcttaccacactaagaatcctgataaataattgcactttatcgcattttaatgcacaattaaaatgataatatgaggagtcgaaagtaatttatggaattgacaattggtttaattattggcaccagcatcattcttgccatactgtgtggcatactcagtatttactactatcaccacaccaaaaagctgaacggtacgatctgggcactcattggtattgcgctattgtgcctggctggcttttttgtttgggtcgtctggtttgggttataaactaaactgcggctcaccgttactagtaaccaatccgaggaggaattgctcatgaacccagaagacatgtttcaacgttatctcaacaaatatcagatcacgtatcaacatcctgaacatggtctagttatgctgacctcccctgtctggccccaacatcccgagctccagcaggccattcaaagcgcttttcaaggcctaaacggcgtcactagtattacaatcaatagtcccgaacaattagtcatgcgctatcactctgatcagttacggcggctaagtccgctgactttacttagcttagaacgccagttaagcaagcaatatcatcaagctggctattaaacttaatggaacgcaaaaatgcaggctacccggttaaaagtggttagtctgcatttttgcactttattattgatttagaatgttacagctgccatgattttaccttcatcgccgctaaaatcgacgatgtggcgttttaagttagcagtccaagcttgacacccagccttggcaaactgcttgacagcgtctgctagagccagctggccagcaatatattgcttcgcgatttgttcaactgccgcggcatcttcttcacgagcgacccggactgctaagccattcgtccgccgttccacgagataaccgttctcaccaaagtaagttgtggcaccagtagcaacatcatattgaaaatgttgaacgcccaaatcggcttcttttttggcaatcgtggcaaagtctgcgtggtcacctaaattatttaatacgtcatcgatctcagttaatttaaacatcatgacacccctcgttctaatttcgtttacttatctattgtaatccaattagacacgtttggcaggtaacgggtagaaaattcgcattaaagccacgtaaatgaccccgataagcgccatgtcaatgaaagttgcaccagtcaccgtcgcaatccaaacaacgtgcttcaataacaagaagatggccacacctagtacccaacataatagcgcaatccagttcaccccatgatgataccaatactgccccttagagctcgccagttcgttgatatcatagtgctgacgatgccgccaatagtaatcgactaacatcacgctgatcatcggtccaagcaccatcccaatataatctaggaacgccgtgaatgcagctaaaaaactccccatgattaatggaatcagtgtgactaacgtggcaatgattgtcacggcccacagtgctggtcgtaaccgaatccgtgggaagatattcgacagcgccgaaccagccgccaataagtttaccgcgttcgccgtcatactcgttaagacaatcaccagtagtgctaatacccccaagcctagtcgactcgcaatggtactcgggtcagagttattaggatcataagttccagaagtaatcgcgatactgatcgtcgcggcaagcccgataaaggcgaaccagaacaagccggtaaaggcccctaaaaatggcatgccagtcgcgccactctttttgcgcgtaaaccgcgtaaaatcagcacccgctgtcacccaagacaaattgaacgccgctagcgtatccatcccagcccccgccgtcatatgtaaatgtgtcggcgcctgccacgttaacaaatcatgcactgagaccgtctggaacacgacgaccgtctcccataaaacaaataagatgacaagaataatacctaaacgttcaatcatctgaaccgaccgttgaccgaccgaaacactcaataaatgcaacacactcatgacaataattccgaggatcagtcctttagccccaccgggtttaccatagactggccagccaactagatcgtgtaataaatagctgacagaagttgctgcaatgaacgtgtttaccgctgtccagccaatatactgggtcaagttcacaaaggacggaacgtaactgccccgcacaccaaaggaaccacgaatcaagctcatcgtcgccgccccggtcttataccccatgaagccgactaacgataaacataaatacgatagcgtggacgatgctacaatcactttaagcgccgtcaataaaccacacgcagccaatacaccaccaacgtaccacgtgccattattggcattggcgccaatccaagttgcaaacatgtcccaattagacatgtgtcggtgcttaggcgccaccatttctatttgatactttgactcttgctgcacatcgttcaccctttctacaatgttttccattgtagtttttttagtgacgcttggtcaagtctatttaactaagttagttaattgcacaaaacttaaattcgcattaaaataatcttaataagttaattaaggaagtgacagattgtgaagggcgcattgacaggctggcgccggaatctcgctgttctctggctaggaacatttatcgccggaatgggattttctgaagtcatgccattcttatcattatacgttggtcaaatgggggatttctccaaaaacgaactcacgatgtatagtggtattacatacgcagtgactttttttgtcgtcgctgttgtctcaccattatggggtaaactcgctgaccggcgtggtcgcaaaatcatgctgctgcgttcttcgcttgggatggcctttgttatcggtgcgatgggatttgtccataacatttggatactcattctacttcggttcttacaaggcctgtgtgccggctacattcccaatgctagcgccctaatcgccaccgaaactcccaaggaaagtagtgggaccgcaatcggtatcctaacaactggctacgtgtctggtaacttgatcggcccgattctcggtggcgtactcgcccaagttttctctattcgtttgactttcattatcaccggaattttgctactgatcgtcttcgtattgagtctgacactcgtccacgaaagctttaaacccagcgacgcgccgattgctaaacgtgacggcggtctactcagccaatttaaaaatccaacgttgattatcacactgctcgtctccacgatgattattcaaatggggaataattccatcacgcccattattagtctatatgtcaaagaactgatgcataacgtcggcccaatcaccgtcgttgctggaatcattgccgctctacccggaatttcgacgctattatcggcgccgcgactcggacggctcggtgatcaccggggggctgaccgtatccttgtctttggtttcgtctttgccatcctgatgtactttccacaaggcttcgtctccagtgtgtggacattagggctattgcgcttcatgattgggatctctgacggggccctctttccaacggtgcaaacattattatccaaaaatacaccccgcgagttaacaggcactattttcagttggaatcaatctttccaagcggctggcagcatgctcggctccttacttggtggcgccgtctccggctggttcgattacaacggtgtctttatcttcaccgccttgtcattactgcttaacttcatcggcgtactgatctttataccaagtatgcggcacccatttgcaaaacactcggttgattaaccgcgctatttatcaagttcaaaagctatcagcttagtcccggagatcggaccaggacgcggaccggctgacaaacactaatccgactagcatattttaaccataataaaggtcaccaatcagcaatcgctgcttggtgacctttattagttattctattccgttagctcttacttcaaatattttgccatgaactggcttactttttgttgatataattgcggataacgcgtgtatgattccgcgtgaccagctcctggagccacccataattgctttgacttgaccgtcgtagcgcggtagttctgatataccatcttcgtggggacaaaagtatccttagcaccatgaataaagaagattggcaacttattcttcttgagctggtttactgaactcgccgtcataaagttgaagtgggccttcgcttgagctacccagcttgccgtatacagcagtggaaacttcggtaagtgatatagttgattcagctcatatcccaattcatcaccaacactggtatagccacaatcttcaataatcgctttaacttgtgatggaagtttctcgccactcatcatcatgacagtcgcaccacccattgaaacgccaaagagtccaatctgactattttggcctacgcggcgaatcacctgtcgcgtccactttagatagtccaaccggtcaggccaaccaaaaccatagtaatccccctgactctgaccattgccacgatcatccggtgccagcacattatatccttggcgatgccacaatcgaatatagctcgccatctgctccttgttacccatgtaaccatgcgccacaataatcgttttggtggttcggtgcgcagctggtacatagtccgcaactaacttcaaatgatccgttgcggacgtctcatgccaggtctgcttgttgacccgtttcagccacgcttggttctgcttcaacttacttttactcttactagaactatggttcaaaactttcggggtgggttcaaatgcaaagtgatataaataaaaactaccgcccgcgaccccaatgacgatcacggtcaagaatgcaatgagcgcaattgtccattttttgcgtgttgtcatattctctttctctctttcatacctaatcatatctgctaagcctaattcgctttaattcgaatacgctacaagcagccatagcgatattatcaaacgctattctcaattatgtgcctatctcaactcaatctaccaattcgttaagcgctcggatcgttaataaatgtgccgccaccgtttgagctgctaattgaattgcccgtgctaacgggtcaaccgtcgacaagacgaccggttgtccagcaagcgtagactcgaatgcttgccgaaattgctggtaccgcggctcaatctgacgcgaatcacgaatttgcaaaatcgctttactaattactggtaatgaaaaatcagtcttcaaaattgaaacgactagtaccgccacaatctgattccgggtataccgatgtccaaccggccgactgaaaaaatgttgtttcacgtaactattaatcatcgtcttcgttacggcaggtaaccccagcggctgaattgtttcattaacaagttgcaacaactgttccatataaacgggcaccgcgggcaactcttcccacgaaagtaaatagttactagttgatccaaattcctccatcatccaatcctcctcactaccctatttaatttagcccaatttagattttaattcaacaatatctaattgttaccttattataaatagaattataatctacatatccactctgctaattattattcgcctcaaaaattattaaaaggtgcttattttgaaagttcaaaaatagccagcttaggcccgctggaaaaagttcgaatcagcgtaaacatgcttggttggttcgtcctacaccgacttccaggcatttctgccaattgccggaacgtggtgggcacagacttgagccgaaaaatcacgtctcaaatactggcctttcaataaccaagcacaggacacttgctaagtgaaatttcaccactgggcattgtcagaaacgccttccagtcgggagagtattcgaatggcagacgaagctgtacttaacttttgatgaatttgccgttgctttttgtaaacagtaatttggttaatcaactgtcaaactgaaaatgatattgaggtagctcattaatcctgaatcggcatagtaagattcaaactcctgacagagtgcctagtgcaccctaaccctttgtctttgtttaatatcaaaatagtcaacgataaattgtgctaagttaagtggccgttcatcagccattcgagcggcttaccgaaacgtgttcggtgccactaaagcctgtgcttgctacgccaatggactaatgccaaaaccgcattaatccgttggcaggcaatgctcggcttcaacccgtggcccctcgcaagcttgagactggaggggctgggtgacaatgctcagtagccaaattattcttagtcggaagtggtctgcttccggcttagaataagactcgtatttgagaccgggcgggttgtgtacgggctcaaatcgacgtcggcttacgttccagcaattgtcacccagccccggaggtcggaataggacgatcattgctgacgaacagcaatccaaaaataagcaccttttaataatgattcacgccaaatcaaggcttgaaagccaccccatatttccgctaaaataggcttatccaaattttgttatccagaaaggaaatcattatgaataacgtttacctagctgcaccgttttttgacgaggctcagaaggaacgcatccaacaagtgaagtcggcgctgttggctaacccgacgatcaaccccgatggtatcttcatcccagaagaacatcaatttgaagaagaaccttttggtagccgtgcttggcaacaatacgtctacgcatccgatatgcgtcaagttcatcgggccgatgtcgttgttgccattcttgacttcgacatgactagtgcaaccaatgagccagattctggcacaatgtttgaaatcggtgcggccgtagctgaaaagacacccgtcatcgtcgttcagtttgatgcgaataaagaactcaacttaatgattgcccaaggattaacggcctatttcgatgctagtaaagatggtctgaaagaattatctgcctacaattgtgatgacttacgttctaagcccgctcaccggccagtattttaggcacacaacttaatgacacgaaaaaatgctgcttgcaaacgaataacgtttgtaagcagcattttaactaacttgaattgataatccttattcagcagtattcacgactaatcgtgactgtcgccgcgcctgccagcgcttattcaattccagcacgaatgttggaatcagcgtagctactagcaccgttaaccagcctaacgctggtagtgtcactaagctaaagaaactacggaacggtggtatcactgcaattgccaagaccaccagaattcctaacagcaatcctcggttcagcattggattacgcatcatgcttgaccagctgagtggtcggcgatccttaattgcatagatgtcgatcattgatcctaatgccaatactagaaagaccatcgtcatcccgactggggcttgaccattttgttaagccaaagcggccaaacgcgtaaattccgagggttagtacggtaaaagtagctgcccggataaaaaccgttgaccaaggccccgagctaaaatactttcgtcattggtactggtggttgttgcatggcttggggttcacctggctcttggctaataaagaatcctggatcccatcagcagtacgttaataatcagcaattgttctgctaacagtggcgccccccaaccaaaggactgcaccaaccatcaagaagatttgtgcaaagttgacacctcccaagaattcaacggctttaatgatattctgataaactgtccgaccttccttaactgctgccatgatcgtcgcaaaattatcatccgttaacaccatgtcgcggcttctttagatacttcggtacccgtaattcccattgcaatgccaacatccgccgctttcaatgccggcgcatcgttgacaccatcaccggtcatcgcaaccgtcttaccaagactttgccaagcctgaacgattctaattttgtcactcggcgacactcgggcgtacactgcaatctgatcgatttgagccgtcaattctccatcgctcaattggcgtaactcatcaccgctaattgcttgcagctcaggggtaatgccaatttcctcagcgatagcttcgcattaaccaaatgatctcctgatcataatggaaaaataccaccgcctgtttggctgctcgaatggccgaaaatcacttctggtcgtggtggatcaatcaaaccaatcaatcctgccaattggaggtcagctgtcaggcgtcccagtcagtagtttggacatccgcgggaatgatgcgatagccaagctaaaacgcgagcgccgcctgcccaaattcatcatgggccacttgtccagcagctaggcagcttggtcaggcttcagtggtaaccgtcccaagcccctttgacgataactaaccgtcgaccatgcgctaatttgcactgcacgtcgtcatcatcttctttcgagtcaaacgggtcttccgcaattcgtgggtctgcgcctccaagctgggccgatctaaatcatctgagccagccaacgaataacggctaattccgttgcgtccccaatagcttgttcttcaccgtcaacggttgatctcggcattcgtcgctaatcctaagtaacgcatcatgtttgtcccgctgatggcaagggctgttcggtcgtgtcataatgccgtggtcggcgtccaatactttgtaattgtcattcgattttgcgtcaagttccgtcttgtcagacgcgattacatcgatactcccaatcgtttcaacggcactaactcggcgcatgatggcatttctgtctgccatccgtcgaacaccgtgtgaagacaatggtcatgatgatcggcaagagtctctggcacggccgcgaccgctaatgaaacccccaaatgctcaagctacgggccaaaccttggttttgcacaccaaacactcagcgcaaaaatcgtaataccacctaagacagcaaatgtcgttaaccagcttgatagccgataagccgccccctgtaatggcgtggcccgttgcttcgtcttgttcaacaacctgcaatttgacctaactctgtggccattccggtcggtaacctgaatcaatgcagtaccgcgctggacggccgttctcccgcatacattgacagttatctccaactcaccggtgtcctgataaatacttttttcaacagcttcactttcacctgtcagactgcctcatcacggctaagttcgtggcctctaacacgaccgcatcggctggaacctggcacacccgcttttagtagcactaaatcaccgggaacgatttctggtgccgcaatcgtttgtaccttcccatcccgtcgaacattagctgtgggtaaactcattgacttcagtgccgccaaacgacttttctgcgggctcttggtacaaaccaatacagacattaataactaaatggcgccaatcacaatggtctttgtccagcccccttctgggcagagccaagtacgtggctaaaccaactgcaaataataacctagcgatgaaacgtcgctcatatgttgccaaattttacgccataacggttacggggcgcgcagctcactaattcatttttgccgaatttagttagctggtcgttcaaccgtcggcttgtcgttacgaaaccggactcgggggtaggtttgaatggtgcattctgataattctgcatcgtttattcctccgtaattcgattatcgttgtcattcgtcactattaatgatagcggaaacattttgtcgttttacgtacaaattgtgaaaaagtcgtgaagattagaacgtacaattaaagcagccattaaacattaaccacaggtcatcatcaaaaaactgttcaatttatgactaaaatcaagttaccagccatgaatattgttataatagaacacaaatattccttggaggcacgttatgaaaatcaaattaatctcaactagtgatgtgcacggttacctcgcgccaactgactacagtcgtcgtgataacatcgcaccatttagtcttagtcgtgccgctactgttattcatcaactgtcacgtgaagatacggctgatgtctggccaatcgtgattgataatggcgactacgtacagggatcaccgttgacctatttcattgctcgccaccaccaagaagctgcaccgttatactcgcgccttgcaaattgcaaccacgttcaagctggtattttcggtaaccatgaattcaactacgggctcgactacctcgacctgtgtgaatcaagccgccaatatccgatgctggccgctaatattcatgatgacctgcaccgcaccttattctccaagccatacacaattctggaacgcgccggagttaaagtggcaattttgggactaacgacgcaattcgttgcccactgggaacaaccacatcacattgccggcctgcactttgaggacgtggttgcaactgctaaacattgggtgcccaaattgcgccaactggctgacgtcgttgtcatcgcctaccacggtggtcttgaacgcgatccccaaactgatcgtccaaccgaacacatgaatggtgaaaaccgaggttccgcactattagctgaagtccccggcattgatgccatgattactggccaccagcatcgacaattagccgttacggttcacggtgttcccgtgacacaacctggtatgaaaggtactaatgttgctatgattacccttgagctcgaccgcaatcatcaagtgacgaccagtcatccggaaatctatccggtcgcagatgccacccccaatacccaggtaatgcaactagttggaccaatcaatgaccagatggaagactggttagacacaccacttggccaaattaacggcaatatgctcgtacacgatcatcttcaagcacggctgcataatcatccttacatcgattttattaatcgcgttgaaatggccgcaaccggtaccgatattgccgcaacggcattatttaatgacgacgtaccaggcctcaaacaacacgtgacgatgcgggaagtcatgaacagttacgtctacccaaacaaacttgccgttgaagccattactggtgctgatttacgcgccgctcttgaacgttgcgcgagttactttctcctccaagacggacacgttcgggtcaatcccgagttcatgcaccctaagttgcgccactatgtctatgatatttacagtggcatcgactatactttcgaccttaccaaaccctttggtcaacgtgtcgttcaactcgattatcatggggccccagtcaccgctgaccaaaaattaacggtcactctgaatcattaccgcgctggtggcggtgggaattacccaatgtatcaaacagctaagattatccggcgcttacctactgatatgaccgtattaattgccgactactttgcgcaacatcccgtcgtcaacgcaacgcaaccgactaattttcaagttcactattaagactaacgcgacaaacccgctcaaatatgcactatttgagcgggtttgtctatactgacgttcacaacgtctggtttagcatcgtcgttaaaccgtgccaattaacctttgtcaatcgggaatcataacagcactgaccgcaagtcgtgccctcctttgtgggcgtctcacaaacccagcatggtaatcaaaaggtgcccgtcatacgagctgcaatccccacattaagaatcccatggtcagcggcgcaatgaccgtacttaacatttgcgtcgccacatactcatctggtgccaagtggttttggacggccaacatggtcgcgatggttgcagtggggattgcgagcgtcaggacgactaattgttggttacttaatgacacacctagactagccataatcccccaaatgagcaccggtaagcctaaatttttcagtagcacgtttaagacaaccatgcgcgtcagtcgccacggtctagtcgttaacagaagtcccagcgcaaataacgccacgcccccagctgcttgtcccaactccgtaaaattcgttagccaagcactgggcaaccgcaatccggccaaatttaagagaaaagcactgattggcgcccacacgactggttgccgactcgcacgacacagtttctgccaaccggctcgccaacgttgctcaggtgtcgaaccgcccgctagcgttaacagcaacacgctcactggcacttgtaccaaattcatgtacaggccgcctaacgcgaccaataaaacactgattttaccaaaaaccaccagtaaaacggaaacacccatgaatggaattgaaggactggcgatcactagcgctcgtaatgtccccgtttctagttgttgatggaaacagcattggctcacaatgacgataaccatgccacctagcatgcctagcgccaaccacagcgctaccgaggagttttgaataatggtagcgcgctttaatgacaagattcctccgaaaagacttaacggcaaggcgtaatgcatgaccaactgaatcaaaatatcactggtcgttggcgcaaattggtgacgtagccccgcaaacacgcctaatcccaccgtcacaacaattggtaaaattgctaatatcagtaacattcacaggcccccagacttaataattaaaactgagtgtaccatagtccaatcgctgtgatagtcaggttgctagtcaacaatcggacatcttatgacgtttcattagtctaattaggggcctacctcatattattaagcggccgcgccacactttttacgataacaacgaattttctaatttaactagctgactcccgacaattaggtgattagccaaataaaaaggatgctgccagtggctgcatccttaataacaatgaaacttagaaattaacttgatcaggatcattagctaacccggcaacaccgtggaaaccatcaatgaccttcatatcatcatcgctgagttcgaaatcaaataattccgtattttgtttaatccgatccgcatgaactgattttggtaatggtaagaaaccgtgttgtaatgaccaacgtagcacaacttgggcaacgctcttatcatacttatcagccaacgtctttaattctgggatactgaagatcttaccagtacctaatggactataagcttctgataaaatgtcatgtttgcggttgtaggccacaacttcatcttccatatcactaggattgaggaagatttggttaacggctggcacaaccttggctgtcttaagcagcgcgtctaaatgcttaggacggaagttagaaaccccgatagcccgtgctttacgtgccgtgtaagcttcttccattgcccgccaagtatcggcgttcaattgttcccaattgtcgcgcattgcggctgggtttggccagtggatcaagtagaggtcaacatagtccaaacctaacttagccaacgaggtatccagcgccttcttggcagcgtcatagccatggtcggcattccataatttggtcgtgacaaataggtcttcacgtgccacaccactatcggcaatagctttaccaacactttcctcgttaccataggccgccgccgtgtcaatgtgccggtaccccgcctttaatgcggctaatacggaatcgtaagcaacctgaccatcaggtgtttgccacgttccaaaaccaacaatcggaatcttagtgccgttatttaacgtgtacgtatcggtgagtttagtcaatgcagtcatcaaaaatgcctccaagaatttatttgttaagataattctacccataaccgaccacttccggcaaacattctgttccaaactaatgacgatacgcaaaattcgtgagaaaatataaacattctgatgtgggaggggttttgatgagcgatacggcagttatgttaaaaaccacgttattggccggcgccattttgctagaaaatggggctgaaatcaaacgagttgaagacacgatgcaacgaattgcaaccaacgcgggctaccctgacgcgcaggtcttcgtactgttaacagggattaccgtctccttgccggaaaatgccactagcgaagtgcgagcaatccataatcggggtatggacctcgaaaaagtggatcaggtcaacagcctgtcagggcagtttgctaatcacgatattgatttaactgaatttgccgcagccctcgaacgggtcaatcaagccgtaccgaccttcccattcagctggttatgtctagcggccgttgtcgttagtgtgccgttgatggtcgcctttactggacggacaactcctgccgacttgattacttgtgggctagccgggttggctggttttgctgccttttattggatcaatcggctggggtcaattcggtttctcagcgaatttatgggcgcttttattattggtctaattaccctactcggcttttatctcactaacggtcattatcatcccgacgccatcattattggcgctgtgatgccattagtgccgggtgtcgccattactaatgccgtccgtgacacaatgacgggtaacttgctgagtggtcctgcccgcgctgtagaggccgttttatccgcgtgtgcgattggtgttggtatcgcactgacttcatttttctactaaaggaggcgtgacatgctacattggctcttaacaaccggtttatttcaaattatcttagcttacttagctacggctggttttggggtacttctcaatattccgcgtcgcgccgttaacctcagtggttgggtgggtgctgctggctggtttacgtatgaggtcctctatcacatcctgccattaggaatcgacgccaaacttgcgattggtaacctcgtcgcagctatcgtgattggcgtcgctagcggtatggccgcacgctacaaacgaatgccgatgatcatctttaatatccctagtctggtcccactggttcctggtggccagtcttatcgagtcgttcgtaacttggtcactggtcaaccagacttggcctaccagtactttgtacaagttgtcattattgctggcgtgattgcaattggctttctcgtcgctgaatttatcaatcgcattactttacactttgtttaatcaggaaaatcagctagtgcatctttgtcggttagcaaaatgacaccacgttatcttgatttacagctgttagacttcttaaatgattagcaaaaaaatagataacgccttttactaagtacttacaataaaagtaagttaataggtctaatatagttcaaattgtgggcttataagcctgcaacatttacaataataattgtatttaacccgagattttctaacttggagggagaaaagctcaatttattatttagatactgacaaaataagcttagagaaaaagaaaaatacccttggtaagattggcataaaattattaccttcattaatatttttcaaaactgaaaattcaattaaaatactgcctaattacgattctacagctgcaatttcaatgtggttgcgaagccttaaaaggtagtatacgaggagaatactacaatgaatactaggtctaatcatctcatcgaatggctgctcaccttattattaataatcacaattctgataaatgttggttggtttatttttcgatatggcggtcattactactacatgaaaatatcgagtagtaccggaacttccccaattacactaccggtcaatgtctcagctactgggtatcaataccaaggactagcaactaattctaagggcgaaaaaaagtatcttcattttaatacagttgctgctgatccagccccattcaaacgcggacaaattgtcagaatcacattcaatcaaaggtacggcgtaaccaactataaattagttcatcggtaacacgattacttcaaaaaagccgtcataacgattggtctatcacttatccaatcgttatgacggtccatccattactagaatgatataatctaaaaagtcagcaactaatttatagtcgctgactttatttattcatgatatttgcggcaacaagcttagccaaaagtgacgcttctagtatttaatgaatcaacgtaaagtagccaatcacaagtacccccaggacaattcggtaccaaccgaacgccttgaagtcgtttttcttgatgtaatccaacaagaaacgaatcgacaagtaagcgactatgaaggacacgatcaccccaacggctaagactgctccttgcaaaccagctaaagaaccaccgtgagcaaagaatttcacaagcttcagtaatgacgccccaaacattgttggaattgccatgaagaatgaaaactcagttgcgacgtagcgtgaagttccaatcaagatagcccctaaaatggttgcaccggaacgtgaagtccctggaatcaacgagagcaactggaagcacccaatgaacaatgccgtcgtataaggtaacgtttgtagattagcgaagcggggtgttaagcgcttattatgattttcaatcacaatgaataggaccccataaataatcaacgtggcagaaacgaccgcccaattcattaaatgttcgtccatccaatcatttaacggtagccccacgatcactgatggaatgaccgctaataacaccttactccagagaacccaagtatttcgcttttccgtggtatccttgcgtggtgacaacggatttagtttatggaaatacaggacaacgaccgccatgatcgcccctaattgaatcacaacgttgaacatatccgtaaactgcgtggactgttgcatcttgataaattcgtcaactaggactaaatgccccgttgaactaattggtaagaattcagtaatcccttcaacaatccccaagattaccgctttaaaaatatctaacacaatggattcctttcttgttggcaatgattatcgcttgataatcccaatacataaagatttacgaccatccccgatggccggtatatcaacattatagcaagcagctactcaagatagtagcgtccatgtgtatttttttggtaaagattaatttgtcagcgctgccaacgccgtactaaatacattttgcgtttggtcatcaaaacaaacaatcgtgattgtctgaaccgtgtgggccgttgtctgcgcaattgcttgtaacgtttttaacgctaacggtgccgcaattgatagcggaaagtgatagacgccggtactgatagacggaaaagcaaccgtttgacaatgattctcagcggccaaattcagactgttgcgataactgttcgctaacaattgtaattcattatgctggccaccttgccaaacgggacccggcgtgtgaatcacatacttcgccggtagtcgaaagcccggcgtaattttggcttcaccagttgcacaaccgtgtaatgggcgacaggcagccagcaatgctggcccagctgcccgatgaatggcaccatcgacgccgccaccaccaagcaaactcgtattggccgcattaacaattgcatcaacggtcattttggtaatatcaccgtgaatgactttaatctcaaccatcttaaactgcccccataatcagattaacactcgtttgggcctgttgttttagctgtgccccactaggatcctgttttgccaataactgaatgccgctgcgaacctgcattaaacttgctgcagcctcagcgaccgtggtcggtaaggttttagcctgaggtgaaagtaaaccgacgagtcgggtctgtaaatcagcatagatcgtttgcagttgggccatcaaggacgcatcctgcgacccaatttcggccatcaggttcaccatcaaacatcctgctggccaccgttcactctgaaacggcagtcgcaaacaagccgcaattaaagcgggcaatggtgtttgccgcgcccgctcacgttgaatcaattgatcaagttgttcatctaacgttatttgatagcgttcaagtgaacggcgtaacgcaacccgcttactgtgatactggcgataaaactgcgttcgtgacaactggctaacggtgagcaagtcgtcaactgtcgtttgataataaccacgctgccaaaattgaatcatcattgctgtttcaaccactgatgcgtccttaacaaccatgctaaaccctcctgaacctaacgctactacattaatcagcaattaaatactgaattccgcgaataatcgaccataagtagctagccactgcgactaatccaaataccgctaaaagaaccacggccaaccagccactattaacgatactgtccatataaataccgctaacgcctaaaataacgagcagtgtaattcctaaaattgtcggcaacaaatgtaaccaaaaagcccgtcctgcaacccgatgtgcttctggattagtactcgtcagcaaccaaacaattaatggaaataaaactggtaagaataaaatgcttaaatagctcaacgcgttaatcacccgattttgtgtcattgttataacctcccccgatatttatttcgagtatagcgaaagtctggtacttcggcaaataataaacaaattgttaaaatacttaggactctcccaaggttacgcgccgaatgttaacttacgaccacggtctgctataataatgacataacctaaccttgcaatcgctagttgccactgtacaacccgggagcgaacggttcatgttaggatttaggtgcattagttaagatgcggaggaaaagaaaatgacgaaacgaatgagtttcaaatttaaatgggttgccctcgttgccaccctgatcgttgggattggcagctggcaagtccttgcgcacgctgacagtagcagcgatgaaccaattgtcacattaggcagtagcctgactagcagtcaaaagactgggacgatcaacacgttaacggctagcttgaacggtgccgattatcagacgctaactgttaacggcgatactctagttaaatacctcaacccagccggtgaaagtttcacaagtagctcaggtgtgtggtccagtgcgatgattcaaaaaacaagttctggttctggaattaatgtcaaaattttaaattataatggtagtaataacatcaccactattacggctaaccagtataaaaacgccgcactaacggctgggattaccgatgctaatatttacgtcacatcagctactccaatcgacggttcgggcgcactagccggtgtttacgcagcgtacgcaaaatctggtaacagcttaaacacgaagcaagtaaccgccgcccaagatgagttaagtactctcagtggcatcacccaagcaaataagagcaaggatggttatactgattcccagttgaacaacgctgtggctggtgccaaaaaggaaatggcccaaaaaggaagtaacatcactaaaaacgaaatcacgaccattgtcaatcaacaaattaccaataacaatttaacaaatgtcattactaataatcaaaagactgaaattattaatttgttagtcaagatccgtgattcaggtgcattagattcttcaagctttaagactcaagccaactcgttgatgaagaacattcaatcaaatgccaagggtgtcttcagcaaactcaatactaaagaaaatcaaaacttgctccaaaaaatgtggagcgcgattgttaacttcttcagctctattttcaaatcaatctttggctaattattaatctcggatactcaaaatcggacgacaaaactgcaatcagttttgtcgtccgattctttttaagccttgaagcataccattaaataacgatcactggcttggcaaactattcaattgccaagtgatagttccagaataatttttagccatcacacgaccacccttgacgtgcaacgcaacgttattaacattccaaatttgttgattagtcccgacgccttgttgactagtcgtcccagctattaacgtttgttgggtagcacctggggttaacttaatcacggctggtaaggttgcctgattttggtcagttgccgtaacccatttactagtactagcattcaaatattgcgctgttcctgatgttaacgtcacgtaactacccgtcatggtcgtcccatcagtagctgtcaacgctgataattgggccgtcaattgccaaccacttggggtgtcccgtgtatcagtcacttgtgtatacacactatcctgcccatttttctgaccaccaactgttgcatacttctgtccatcagtagcagtagccaattggtcttcagcggctgatggtgacaacaatgggtacgctgtatccattgttggaatgctgtgctgtccaaagttcaaatgtgtaggtacagcgtccaacgataatgggcccaaattgttcgtcccgccagtcccaggcttgctaggatcatcaggatcaattggattgacgattaaatccttagctactgtaaatatcggtgctggttggaaagtcgcatcatgatactgctgcccatttggataactattaggatcaggattacgatttcctagactatcagccatataaataataatcttgtcaccaatttttaacgataatccggttaagttcagtgaccaagtcccattggcattgacaaccgttttgacattagtttgaatctgcccatttaatgctaatgtgacctgcgcacctggttctccattttgaccactcaccgttcctgttgaaactctaatggggtccggtgataccattgtggccggattaggcggcgtcacatcaaccaccgtcccggtagccgtgaccgtcgttccactggtattgctagtcgatgctgtgaccgtcgttccagcttttaaaaaggtcccgacattagctgttgcgtagccattactatcagtttgggcagtgattgtcttaccattaacgctataactcacggttaattgccctgcactagcatactgtggaatataattaaccgttccgtcatcttgaacaccattagtatcaggaaccatcgccacaatgactcgcgtccgcagcttctgatccgcatctgttagtttgtttgtcccatcatacggattattaaatgctaattgtggcttctggttagtggcactaatccgacgcattttagaagataaataattactttgcaaattactatccgtggccgtcactgctgaaccctgttgtaataactgagatacgttactatacgaataatccgcaccgcccgtaaccgatgatgctaatttccacaagctaatattactatcttggatttcaaaagtgcccacattatcttggttaatcgaactagccgctgcagtcgttccagttgagctattacgtaaatccaagttgttcggattaataaatcgaacagtagccaaacgcgcgtaatttcccgaaataagcggtgctcccgtagcagcaattacataaatattggcaccactactactttgaatcgtcgaagttgcattatcagaaaaagagattggcgattgacttctagctagtgacgttagattaacggtgctaccagtatccgcgtaaaaattacgatgatattgtgacccataaaagtacttgttagagtatgcatttcctggcacgctagcattaaacgtggcatttttacccacattaatactttcatacgcatcaaaaataaccggataggtagtataggcggttgacgtagaactagcaggtcgtcgaatacaatttagcgtcgcgccttcttcaacattaacttgccgattaccagttccttgatagtcataaacaaaccagataaatgaattatcatcaccattggctattttcgatccagtgaatgtctgtccagcagctacatcaaggccaccacataagatgttttctcgaaccgttgttactcggcaattgccggtaatattgacttggttcccttgcgcactgacaaatcgccgacttgtattggtataactagtcccacttgggaccgtaatattactaacattaaatgtccaattcaaagcccctccggcaccatcgccaccggtggatgagccaatcaaacccgcatcatttccaaaagatccgattaatgatgcaaaattcataaaagtggccgtgtacatcgtaccgctagttgcagtattatttcgggtatgaaaaccagcccgaccaatattcacgctatgaccatttccattcacaataatattaccggataatcgtgaatccaaagcacctgaagcggcagtcggattactaatatcagccgtaatattaatttcatcaacactcgcatccttccaagcatcgactaattgagaccactgactaacatcaaccacattcgaactcagctgagctaaacgagtgactggtattaatggactagatttggcactcgccgttgcttgcttagttggtgctgatgagaacacttgactagcagtggatgacgatgagatgctggccgaactatcagttgtctcacccgcagattccgtgaccgatgacgattgattagcagcagtttcttgtgaaggctcgctactgctagcactcgtttggtttaccgcctgacttgaaagcgtcgttgccgctgaacgtgaactgtccaaacttgctgctgatgatgtcgcttgtcgacttgacgatgccgtcgaactatttgtatcggttgccgctgaagaactagctgaactcgtactggcctgatcagcctgcgtttgtggttgcttaatctcgacattcaacgccggccctttttgatcatcggctacagcaactaacgccagtttttctgctttaacagctgttaatctaattggtaccttcgtttgcggatattcatctgaccactgaaccgttatcctgcgcttatcaggattgtacgaaactgtcagatgcttagccgtaattgtaaaggcgccattatcccccgttgtgtactgactatcatcgaaaactcgttttatttgcttaaactcctctggcccatctaaattaacctcgttcggtaaatcaatcgtatttattttagaggccgtatcaccaatctgtagttcaacatcaaaatgttgattcgttaaaatattatcgctagccgttgattttgcaaaagttaactgtggtaacgtagctgcttgagcggtcatatcggcgcctaagcttaccgttgcaccagcggctatgacttgtaacaataccatcaatatgacaacaattgctcttagctttttgatagtatcaccccttagcgcttattttgacgccgtttaattacccagaatatgattaaagcaatgagcaataatactaacaacacgataccaatcaaccaaccccaagtagttggagacgtgacgttaacagcatccgtagcgccaactacaaaatcttgctttagcgaccagacatgcggcttagcgaacttttcatccgtagttcgatacttgacgtatagagtgtaagtcccaggtaaaatgatcccccgattagtacgccactttaatggtaagtcaaagttagaattaggagccatcgaactactttttagatcagccaccgcgagctttttggtctgcccagctttgctaacgtaggcagtgacagtccctttgcctagaattgaagcgtggtaattttgaatattaccgataactgtcttgatgccactccgcttttttaattgaacatcagccaagcgtaattttggcaatggatcacgatttgacgttagtttgatccccacattgtaggcatattcgctagttaacgtcgcccccttggttttaagatgttgatctgcaattttaacttgccaacttcctaaaataatccctttgttcaatttcgttggcgtttttaactgtgcccgcacgatccgtgatttattagctgggatcgtcgtttcctcattcggtacggtaataatatcagctagttttacttttaaactagtgtcatcattcagattagcagcaccataatcaataacacctttcgcattagtatacgattgtaggaattgatttttgactttaatttcatgatttgagcgattattaacacgcatcgctaacgaatatgttctcttcggttgaattttaaaatcccaataataagcgtcctttgataattgttgcttttcattaagcattggctgaacatcaaaagttaccgcattattggccgtgtcagcagcatggccaatcacagtcataccagccaacaaagtcattattagggttaacatccctaataatagcttcttattccagccgttcataaaagggcctcccttcaaaaaaacgagttaactattcaacatagccactcgttttcgttcattaagccgttggtgtcgagttcaatgtccaaacaatattccctgaataattcttagcggctgcgtgaccacctttaacatgtaattgcacattattaatattccagtattgttggttgacccccataccttgaccgtcaccaactttagaccctgccgtggctgttgcaacatcggttgtcgatgaagcgccggcattgagcacaattggtgttgcaacggttgcctggttcgcatccgccgcagtgacccaagattgttgattagcttcccctgtcagatattgtggtgtcccaccacttaaaacaactgacgcgttcgttaacacttggccgtcagaagccgtaatatcagaaagctgtgcctttaattgccagccagcaccagtcccccgtgagtcagaaacttgcgtgtaaatgatatcattaccatttttcttaccactagtcgtcacattttgggtcttatcatcattagctgtcgcaaggctctcctgactagcatcttttgaaagtaaagtgtaggccgtatcaacattaggttgcgtatgcgtcccaaaattaagatacgttggtaccgcatctaacgaaagtggcccgttgttcccagtaccaccgccgccaggattatccggattgtctggatcaacaggattagtcgaaccaccgttagacgtaaacgaaacatctgcttgagactttccagttgaaggcaaggtgtccgcggaagctcctaaattattgaatgataaacaagcaatactggctactgaaaccagcatagctgctttgagcgtacgtgactttgtcataagtcaattccccctaaaatttaattagcatattaatcttcttcatcaatagcgcgtaatacctttttgtacaaacatattaatatttaaatcaatattataaactcacctttattaataaacttttagcaaactaattgacgaagaatatttatatgtctatactggataacttaaatcagtcattatccttgaaccaattaaagcataccaattaaagttaatcaagtacactattatgtacgtttactatttgtataaaattcactatttttgtaacttatgggggaggaactgtccattgaattttccagagctcaaactttctcaaacagaacgcgatttcaattttgattttgctatattggaacatgatttaagttattttttcgaaaagcgttgtcttgactacgccttggaacatatcaatagatttaatcacaaaatcaaggataacttatacaacgtccgcccactcattctaaaagaagccttaatttcactaacctgtgatctagcaagtgtcagcttttatcattatttgaacatgatcacattcgttaacttaagaaaggacattttgcattacctcacaacaacaacactaacgaatgatgattttatgccacttttagagtcaatcgttaacaattattttagcaatcttgatacacttgatattccaattgatggtacccgcctctctaagcaagtcgcgctagttgtctattatattgataatcattgtgatgagccattaagagcaaataccatcttagaagaactgacgttagatcctgaatacactaagcgtaaatttcgtaaagaactagggtttaccatcaacttctacattcgccacgctaaattacagcgagcaaagcaattattaattaatacccatcttcctataggtgaaattgcagaaagaatcaacttctacaatagcgccgaatttgcacgccagtttcaaaaagaattcgatattactccgagtaaatatcgcgagttgaatcaaattttttataaagaagaataaataggatatttactttgtacaataaaatatttttttgtgttttaaaattcgcatataagtttaatcactcttaaacttgatattaattctgcaatatcaagcaagctcctaaccaaaccttgaacgcgctattaggttaaaaggcaaccaaagttcatatgagtaagacgagtatttgtccgctcgtcttatttatacaaatcacccaatcaatgtgactactatacaaacagtaagcgctcactttttccaaaaataattactaataagtcttattttaagtacaagcacggattatatctgatagcgcaaacaaccagcttgacacctattaccatcgagacttcatagcacctatcgtcttgatcatttccgaatcacgatcagtggtcattaatgattataaaaacaaccctgttagcaccaaaagacgccaacagggttgtttttgtaattatctttaattgtaactgacactcaattaagcttcagcccgcttcaaatcagtatcagcatacgttgtctttttagtttgcttgctagcatcttcattaacaaacttgtccataaactcttcaaccaagttcaaagtctgatattgtttagctaaactgaagctttgacgccattcccggttgcgttgaatcaattcagtaaagacttcatgttcaatccgagcgccttctggtgttaacttcaaaactttgttacgacggtcatggtcttcagcttcttgatataagtaatctttccgtaataagcgaccaattaagcgtgagattgctgaacgcgtcacaccgtgactttcggcaatatccatcagacggatcttaccttttgcttcagcaatatcatataaaatgtaaaattcatccaaagtaatcccatgttccgttgcaggttcagcaaacatatctgataagtttttaaagccatgtaaatacatatggctaaagcgattaaaaaattccatatcttcattcattattcaagtctccctttcactagtcgaattatcattaaattcccaatcataattcgccccatacttttttcataaattagtaagcgtcgtttatcatttccccgctttaaagtgtactagtatattttacgaaatacaagtaatttagattactttaatattaaatttttatttcagtactcaagtcaagggtcgcgtgtttatgcagatacgtgatgaattgctgataataatagtcagtattatacttggctgtgctcaaataaatttgatcaattttctcagtattctcacctaataacaagtaaaacgcttggtcgatattttctgcaatcatgccaacactagctcttagaattttacgcttgaaaaaaacagccataccaccagataacgcgaagttcaacgcgtatctaatcatagcagcttcaccttctacgccgatagcttctagccagtctagtgtcactagcaccatctcagtcgtcagttccggactctcgaagatgtcctgaataaagtgttccatggtcggattttcatctaacatccgcaaaacaaagctcatttgaatcattgttcgctgatacgaagacagcatggtcagctgttcattactatagataaaagcactaagcgtcaactcatttaacatcgtacttaataaaacgattttcttcgggaaatagtgttgtagcaacgacttactgatatcacaggcaatggcaatgtccttcatctgaacgttcgcatacccctgctcggcaaacaagcgaaacgctgtattaacaatctccattcgccgttgcgtgttccttcttcgtggcaagaaaggtgcctccctatcactgattttcaatcattctcttttaataaactatactaatatagctttgaacgcaagtgataatttaattggaaagttaattaataacagcctcaactatcaaaatgatcattacttatcaataaaatccgcgagtacttccaactacaagttagttaacaaccactgcggcttaacgtcttaatcgtctaaacgcactagcagctattcatcagccaaaaaagaaaacgctttcttatgtgaaagtttgtgctaaaattaacttatcaacttgcagggaggctacaatatgagcactaaaaattcttatcaattagccgatatcggtcgccataatccgatcttttcacagatccgttctaccgtcgaaacggccttttacggtaataatatgcaccacgttgatgatatcgctgccgcttaccaccgcgctactaaggaccccggaaccgttattacggacctcccaatctatcgcgcaacggatttaggcttaccagctgatgcaaaaatgttgattgccaatacaggtaaggttgttggccgaaccgcacaagcgcgccggattctaggcaacccgggcgttagcgaagccgatatggccggtcgcctacgccaagcactatttgctagtgctcacaaggacttcatcacgacggacgttctggtcggtttagacgaagacttcatcgtgcgggcccacctcgcgattccggacggttttgccaataatctactttcttacatgcttaacttccagcccatcaccgctgcttatcaagaaatgttcgatcggtccgttgcttatccagaaggcgatatttacatttacgctgaccctacttaccatgatccagattatccagacggcctggctatttttgatccgcaacataatacggctgccattctaggaatgccatactttggtgagttgaagaaatcgactttgaccttagcttggtcgatcgcccatcgtcacggcttcgttgcttgtcacggtggcttgaaggccttccacttcaaggacaagcaagaccaagtcttcgccatgttcgggttatcaggttccggtaagtcaacactaacccacgctaaacacggctataaatacgatatcaccgttctccacgacgacgcctttgtcatcaatcgcaaggatggtagttccgtggccctcgagccttcttactttgacaaaaccaacgactatccgatgacgtccgatgagaccaagtattttatgacgatccaaaacgtcggcgtcaccttagacgatcagggtcgcaaggtccttgtcactgaagatctgcgcaacggtaacggccggacgatcaagtcacggtacgcttcgactaaccgggttgataaggaagccgctcccatcaatgcaatcttctggattatgaaagatgatagcttaccacccgtgattaaagtagatgatcccgtattagcagcgacattcggcgccactttagcgaccaaacggagctcggccgaaaatattattggtaatgtcgaccgtaacgccctagtgatcgaaccatttgcaaacccatttagggtctatccactatcagaagattaccatgatttcaaggcactcttcgaagaacgccatttagattgttatctattgaatactggcttctttggcgataagaagattcctaaggaagttaccttgggtgcgctggaagccattgtcaatgatacgaccgagtgggagtcattcgcaggcttggagcacatgcaaaacctaaagttagctgatttcccagttgattatgccaatgcagactaccgtaacttggtcgccactcgtttaggaattcgggctaacttcattgatcaatatcaacacaacaatcatgaccagcttccccatgagattattgatattctggtccacctacaaggtcaattaaaacaaccaattacaaaataggatggcattcgttccccgcttcagaccaattaaggttataataaaagtagcaggtatatggcactgaacttttacgaattctaaaaatcggggtgaggagcatggaactaccattaagtcaattatcagaaaagctcatcagttttgaacgcgagcaccatcttacagataacgaccttgcgtttggcagtcaattatcagttgaacggattcacaacattaaatctggtgaagcaacgccaactcaggaagaattgcaactgttgaagaaattcatgaatagcaaagccaaagcttaactgctagttcagcgataaagcctaattggggcaaagatcctcactaaaaactggtcgtccattcgaccagtttttttgttacctaccatccagattgcattttaatttaccctgttatcacctcgtgctatactcggcacaacttataaagataagggtgaccaacatggcaatgttatacggtaaacacaatcatgaagctgaagaatacttggaaccagtctttggtgcgccttctgaacaacatgatcttcctaagtatcggttaccaaagcattcattatcccctcgagaagccgatcgcttagttcgtgatgaattattagatgaaggcaattcacgactgaacctggcaactttttgtcagacctatatggaacccgaagccgttgaattgatgaaggatacgctggctaagaatgccatcgacaaatctgagtacccccgcacggccgagattgaaaatcggtgtgtgaacattattgccaatctgtggcacgcacctgatgacgaacactttacgggtacctctacgattggctcctctgaagcttgtatgttaggcggtttagcaatgaaattcgcctggcgtaaacgcgctcaagcggcaggtttagatctgaatgcccatcgacctaacctcgttatttcggctggctatcaagtttgctgggaaaagttttgtgtctactgggacgttgacatgcacgtggtcccaatggatgagcaacacatggcccttgacgttaaccacgtcttagactacgtggacgaatacacaattggtatcgtcggtatcatgggcatcacttataccggtcaatatgacgacctagccgcactcgataaggtcgttactcactacaatcatcagcatcccaaattaccagtctacattcacgttgacgcagcgtcaggtggcttctataccccatttattgagccgcaactcatctgggacttccggttggctaacgtcgtttcgatcaacgcctccgggcacaagtacggtttagtttatcccggggtcggctgggtcgtttggcgtgatcgtcagtttttaccgccagaattagtcttcaaagttagttatttaggtggggagttgccgacaatggcgatcaatttctcacatagtgcagcccagctcattggacaatactataatttcattcgctttggtatgggcggttaccgcgagattcaaacaaagactcacgatgttgcccgctacctggcagccgctctggataaagttggtgagtttaagatgatcaataacggacaccaactccccctgatttgttaccaactagccccgcgcgaagatcgtgaatggaccctttatgatttatcggatcgcctattaatgaacggttggcaagtaccaacgtatcctttacctgctaatctggaacaacaagtcatccaacgaatcgtcgttcgggctgactttggcatgaatatggcccacgatttcatggatgacctgaccaaggctgtccatgacttaaaccacgcccacattgtctatcatcatgacgcggcacctaagaaatacggattcacacactgaatcatcacgttattttgataaaatagttaaacttcagaaaacaattattatcactcgtggatacaaaaaatagcaccatccagattctgacgaaccgggatgatgctatttatccatttaagggatattaattacatgtggatagcaaagcttggtgtgtagtaagctgtgctcttaattgaaacagtttcaccataagttggtgaagcgatgtattggccaccgcctaagtaaatcccaacgtggtaaggtgctgaatcagaaccccagaaaatcaagtcgccagcttgggcttggctgaatgatacgtgagtaccaatcgtagcttgagcatatgtggtccgaccgattgaacgaccaaccttagcaaaggcagcttgcgtgaatgcagaacaatccatttgttcgtaaggtgtgccaatgaaggtcttagcagcagcaattactgaactgtatgatgcagttgaactagtcgttgatgtactagttgatgctgaagcactgtaggccgttgcagtagcagtcgttgttgatgaactagtcgtgttacttgcagttgagctagcttgtgagctcgttgaagtagcagctgattgcgtactagttgcagtcgtgctagtagacgatgctaatgaagttgagctttgtgatgcttgtgaagctgaactttggctagctgagctttgtgaagttgctgaactagttacagcacttgagctagcttgtgaagctactgaactcgttgaagcacttgaagtgacactgcttgcactagcagttgaagtgctacttgattgagcagctactgagctacttgatactgcttggctcgtactacttgcactagtagttgatgagctggtagtagcagcgctagtagcttgtgaactagttgaagttgcggcactagttgacttagcactgcttgcactagcagtggtcgtcttagtcgtaaccttttcaccagttttaacgccaggaatattgatggttttaccagcaataattaagttagggttgcttaagccattagcttcagcaatcttgtcaacagaaacatggtacttttgtgcgtatgcccaaacagtatcccctgctttgattgtcattgaatcggcattggcaactgcttgactagtaactaacataccagctaaagcagcagttcctaacatcacttgtttaatatttactttcactttaataatgatcactccaaaaagaatgtcacgtatgtacttcaagccaacgtctatactactcaatttgtgttacataccaataccagcaaaataacaatatgttacgaaagttacaaaaccgtaacaataattagccatcgtaacattttcgcgctgaaaccctatcataccggcatcgttttattactaaaatttgaaactatttagcaactttgacgaaaaaaagttatttttattttaaaaagccgaatttccagtgacaattcctggaaattcggttaaatttcaatttaattacgaccaaacgttcggctaatttggactatttagatattcgttggcgatgatgcgttcgcggtaatcctaatagccatcgaatatcattacccgtaaagttcaacttcaagaattcgccactttgtccctgttgatacatggtcggtaatacctggtcttgcaacttgatcacttgctgtgcgatctcttcgtcaaataaatattgccgtgtcgcggcagcaattttaccgaccgtaaaaatctgagcagcgttagcaaatatctgctctttgctcagcgccaactgggcttgtttaaactgggcgtaggactgatccaagacttggcctgcttgagtttccaatgcggttactgtggtcatgatgcgcacctcctaaatttatccctattgtaaccgccaccgctgactttgaccacgctaaaccatgctttttaaataaaatttgctatactaaaatgacaaaggggaaattaacttgacgaatacagacaatcgttattatcaaccaaccgacatcaaagatgcacttcaaacaattcaaaaattatttaatacttataccgatgccccattaacacccgaattaatgacttaccatcaaaaattagttaatcagttagctactaatttattaccactagcacaacaacaacatgacaaattacggatcacccaaattaattcaatgatggccgttatgcaagattggctaaaattaaggctgaatggtcaagtcttcggcggcaaaatgcaacacttcaagtttgtcagcaaccaaaaagcacagtacaaacgacgagtgcataaaattcgtggcaatcaaaatcatcgtgctagtcgccattgatgaccaaactagacttgcacgactagcattttgcggtatactaaaagtgtattgggcccttagctcagttgggagagcgcctgcttcgcatgcaggaggtcgtcggttcaaatccggtagggtccattttaatagacgtcaaaaacaaggtgtgttgcaatcaactttcgattgcaacacaccttattttttggatcatcatttatttatatttatcaaagtaacggtctgttattttaacgaatgtactaaattattttcgtttctggttacaagacgctaaaagtatttgattttacatgatatcgctttttttattttaccttcaactatgctccagctcgcaaccacgcattcgtttccttgtacaatcgctcaacttcttctggtcgatccgtccctaataaatcctgactaatttgaccaccgacagcttgtcggacataggctaggaattgatacgaggaccgtaaaccgttaaaatcttgaggtatcacgtgtaaatcctgtcccacaatgactggtcgtaaattatcactttcgttaattgaggtcaatcgactaatcttccacttagtatcacggcgttcgacgcggtaaatcagtcgccgatatgattctaattccgctaaagtaccattgaccatcatgcgcatatgcgtcgtggttggtagttccacgtatgccttatcgccattcagatgaacgacaggcgtactgacgctccccacaataacaaagcgcggatcaacttccttcgattctgcgccaataaatgtacttagtggtccttgttgccaactagttgccacagtcgcgtcggcgtaatagcaatctcggatttcagggttatgccgggcacgaaataagcgctcacgggccactagttcactaattagtgccatatcagttccgttactcattgacgatttcctccaatcattttagcaatcaccggccgacatttcgcgacgatcaatgacagcgctattcaaaaaccaatgacgatgccagtcgccacttaatgccgtaaatggcaccggcgtcttcccgcctgcttccaccttttcaatcaaataattacgtaagatccacggatcgttcaaagattgttgtgttaagtcaaataagtgatcgagcttagttgaactaatccctaaatcatcagctacctgggctttcgtaagaccagtcaacgcaaagttagcttgtaattcatcccgggttgcctgcatttgttgtgcgtttaatgacattatttcgttcctcctataatttaaataacgtggttgccgtgccaaacgcgatttgagctcgttgttcatcggtcaagtcggcgatatccaggaaacttccactcgtctccggctgcttatacgggtaatcgatcgaatacatcaggtgatccgcccccatctccgctaacataaattgcaactgaggcgcactcaaaataccacttggcgtcacgtacacattatgccgataataagtactaaacggatactgtaagtctgtatatgttgttaactcatcatccaaacgttccaaaaatagtgggactagttcgccccagtgtcctgaaatgagcttcaagccaggcaacttatcaaaaataccactagcaatcatccgtatcacttgaatcccaacatccatatgccaaccataaccggcagatgataagatccccgtgacaacgtcagaccattggttactttcaaaataatgactcgttactgcttgcggaataaatgaggggtgaaaatacacagggacatcaagcgccgcagctgcttcaaagattggtaagaagaatggctcatcaaaaaatttattctgataatttcctttcagcaacacaccccgtaatcccagcgtcgtcaccgctcggtttaattcagcgaccgcagcttgcggatcaccaactggtagaacggctaacccagcataacgatcaggatgagctaccactgctttcgctaattcatcattagctaattgtgagagtggaactgcttgttccggcgataagttctgtggtgatgaattaccataagataacacctgcatatcaatgccatattgagccataaatgccagacgttcatgctgggtgtcttgcataattgcaggactcggtaaattgtcccgcatgtactggcgtagcgctggactaactgctggtaacacagcgttaccaacagcttgacgcattgcggcagtcacagctgccgattcaaaatgctcttcaacggtaattaatttcattagtccacaatctccttaattggtcagttatatctaactgtgacagctattatagacgctttcatatgctaaaaaagggacgttttgagacatatcgtaatctggtgtatcattaacatatgacaaaattaattatgaacaatcaattgcatattgatcagcgaactcatcaaactcatcgtaaattgattactgccctgcaagcgaattttaagtcttaaaagtccttcaacgagttgactgtcaaacaactttgtctggatgcccacgttggacgtgccaccttttatcgtcatcaccaggatattgaagatatcattgtgattgaatacttaattgccttacaacagttaggacacgcgttgaatgacttaacgaccacatcttacgcgaccattgctggtgcgatcgtcacgacgattcgtgcacatctgggcctccccttactcgtgtcatgggcccagtgtcgcgagcgggtcatcccattagaggttggctttgcccaacagctactaactagcttagccatccatcctaagcaacggcattttatggcaacctatctcggcaactgtcttcatcagttagcttggcaacttgcaaccacacagacaacactcagcaaaattgagacttaccggctatttattcaattaattcctaatgtcttacaagcaccaacgattccaaccgactagtccgtttagtgattaggatacacaccacgttagtttggccgcctacccctgatgctagcgaatgtcgtcattattcacacccgccgtttgcctttatttgacgctacccttaccaccatgtacgctaacaatatcaaacaatttatggaggaaatatgtcatgccaatcaatccaaatcgcgcccaagatgtctggaaggatgtcggtgaacacgttcaatttaccgttcttcaattaaatcggcaggatcagcaacacgaccgtgaagtctttcaagaatttgcagatcggtcacaagccatcattcgctcattacgcatccgggacgccaaacctgaaactggcacccaattaaaagttagcatcggcatcagtagtgccgcttgggattacctgtttcctggcgcacccaaacctaaagaattagaaacctacaccaccttaagtgggcccaaatacaccatgccagcaacacccggcgacctcttcttccacattcgcgcaagcaacgaagcggtcgtctacgaatgccaaacgcagttccagcgggtcttagcgccaattacgaccgtcctcgatgagacgaaaggctttcgttacttcgagggccgggccatcattggctttatcgacggtacggaagcgccggccgtagaagatgccgctgattatgccttagttggtgacgaagacccccagttcatcaacggttcttacgcctttgcacagaaatggcaacatgatatgcccgtgtgggaacatatgcacaccgaggatcaggaaaaagccgtgggccgcgaaaaattcagcgacttcgagttagaagacgaagacaagtttaagaatgctcacaacgttgcttcaaaattggaaattgatggtgtcgaacaaaaaatcgttcggatgaatgtcccgtactccaatccagcagctggtaacacagggacgtacttcattggttatgcccgtcactggacggttaccaaaggcatgctgcaaaacatggtcgaccaaagtgactttttactaactttctcaactttactatccggacaagcgttcttcatcccatcacgtgacctgttcgctcaaattgcagataatgatttttaagctattactagcgtactcgttttgacgttaaggcttcgactaggaacacgctgttaaaaaaggcagtcttgattggtacttaatacataccgatcgagactgcctttatgttgttttaactttagtttaacggtttattcacgaacaatattgattatcattccttttcacggtaactggcaaccaacatctgctatagtagtaagtaaagcaactatcaggaggtatcatttatggcaaatcgttatttacataatgtccaaggtttgttcgacaccatcgcgccgaactatgatcggatgaataacatcatcagtctcggaacgcatcgtcattggcgcaagcaaacgatggcccagatccatctagcgtctaacgcccatattctcgacctctgttgtggtacgggtgattggacgatcgcgctggctaaagaattacaggcacccggtgaagtcatcggattagacttttcagccccaatgttaaaactggcacaacaaaaagtgacccagcaacaggttgccgatcgggtctggttgcgccgcggcaatgcgatgcatcttccgtttaaggacaacacctttgacctcgtcacgattggcttcggactccgcaacttgcctgataaagcccaagctttaactgaaatttatcgcgtactaaaaccgggggctcgcttggtctgcttagagacgtctcaacccgatcagccattgattaaaccagtctggcagtggtatttcacgaaagtagtcccactattcgggcgcttattcgcccatcaatatcaggaatattcctatttacaggaaaccactcgtcactttgcaagctaccaacagttagcaacgatgtttcagcaagcaggctttcaaaatgttcacttccaacggttcaactttggagccgcagcggctcactttgggactaaggaggccaagtaattggacgaactgaccgctttcaatcaatgtctggcttggttgacacacaccaccgccttgcctgagcacctcgatggcctggtcctttgtggcaacagcctcccagcaacagccactgcagcgggccagttagcccaagactatcaattaccactactcattattgcgggcggcatcggccacgccactaagtatttgcggcaaaacttaaacctgccaaaatctcaagctagtgaggctgagttgatggcgacgcttgttcgaaagactggctatcaaggtagtatccgcctcgacaagacttctaccaatgctggtagcaatgccacgcatgcccgcgcgttagcccccaccgattggcgccacgtcctactcgtacaagacccgttactcgcgcggcggactaccctaacgttctcagccaattggcccaatgccaactttattcgctatgcgccggcgaccttgcaattaaaccggctacaaccaatgcaatttacgccaaacacaatattagctggctggcaacccgcttactttactgaactcttactcggtgaatttcaacgcctagtggatacccccaacggttatggtccccgtggtcagggcttcatcgcccatgtggatattcccgaaaaggtgctcgctgcggcccggtatttacagtcgcaatcactacaccgccagcgttaacgtttatttttaaaatctagtagtgccaccaaaaaatcccgtttcactgcagcagaacatcgctacagtaaaacgggatttttataagatgggttgatcacgatttaaaaacatctggatactgtgtccgcaacgcttgtgctgttaattcgcccgccatccgggagccagctaaatctaaatgcaccccgtccgtggtactgagttgccaagtagccgtttcaatgagttgcaattgcataaattcggccacgaccgcgcgaataatcgctgcaaaattctgattaaacgggatcattacagcaagccggctattcgggtaaagcgtctgcacctgattaaggaagcgacgcaaaactaccgtgaacgtcgtatcatccgtgtgccgatcattagtaccaacattaatcacaactaaatccgtgggtactggttgccacgtcgttttactatccacggctgttaaaacctccggcagtaccggtacgccaccagttcctggtttactgagaccaacggcactataagcaatgcggacattccgtgcattcaacaagtcactcgcaaccgccgcatagttggcttccgcgcgataatcttcggcagggtacttacccatgacccagcaaccggccgtcagtgaatccccaatccacgtcacgctgtgtcggcctaactgaactggctgtaactcaccatctgtcgtcagggctttcactgcaaaaccttgattgccatcccacacacggtcctcatcagtattaccactcaaaactacccgtaccacgtgaggccgaccatccagtgtcaaccataggggggcattcgtcaccgcctgccgttgaaaaggcaagccatcaatctgaatcgccacccaactcggtagctcatacgccaacggcaagaatgtcaacctcacaaaactagcatcagtgacttgaaaatcgatttctgcacccaaattagtgctatacatcacgtctcgatccgcaatttgcttgaccgcccaacgcccctgaaagtatgccggcatcaagggctgattggcctgcgttatttgataatccacgtttttccctcctatacctcttgtttactcaaacttgatcatcctacccattcttccgttaacttgtcatgaaacatgattaaaacatgccattttttaaattcaaaagcagccagcttagacccactggaaacagttcgggttagcgtaaacctgcttagttcgttcgtcctacgccgacctccaggcatttctgccaattgccggaacgtggtgggcacagatttgagccgaaaaaacacgtctcaaatactggcctttcactaaccaagcaaaggacgcttgctaagtgaaatttcaccactgggcattgtcagaaacgccttccagtcgggacagtattcgaatggcagacggagatgtacccaacttttattggactcatcatttttctttataaacagtaattttgtcgagcaactgtcaggtagaaggtaacattttgatagctcactatttcgaaatcactatagtaataatcgaacgtctcgacaaagtggttaatgtaaccttaaagtctcgtttaaaattccattatcaaaatagtcaacgaccaattgtaccaagttaagtggccgttcatctgccattcgagcggcttcccgactggaggggctggatgacaatgctcagtagccaaattattcttagtcggaagtgcctttcttccggcttagaataagactcgtatttgagatgacgcggtttgtgcgttagctcaaatcgacgtcggctgcgttccagcaattgtcatccagccccggaggtcggaatagaacgctcaccggctgacgaacagtaagccaactaaatggcatgttttaatcataatcactgccagcaatccagaattaatactgttattttgcaaaacttgacgcctatcaagttgccatcaagctgaactcactatactagggtcatcaaatcaaataaggagttgcaaattatgaaattccaattatttctcactaaacatacgaatcaaattacattagttacggggattctgattgtccttgggatgctcagtaaatatctcttacaatttacgctcggttaccaagtcattttagcagttgcttcaattattgccgtcattccgattgcggttcgtgcttggagcgcacttcggaacaaagttttcagtattgaactgttagttagtaccgcagtgattggggcattcattattggtgaattcaacgaatccgcaatcgttactttcctcttcttgtttggctcctatctcgaaagcaagaccttgcagaagacgcggaccgcaatcaaaggcttgactgacatgtcaccaactaccgcaactttagttactgatgatggcaccgaagaagtcgacgttgatgatgtggacgaaggtgacgttgtcctagttaaaaccgggagtcaggttcccgttgacgggattgttgttgaaggtaacggctaccttaacgaagcctcaattacgggtgaagcacgccaaatcaacaagcaactcaaggactcggtttactccggaacaatggttgaaaatggctatctgaagatcaaagcgactcaggttggcgacgacacgacttttgcaaaaattattgaattggttgaagaagctcaagataccaagtccaaagctgaaaagttcatcgaccgctttgctcaatattatacgcctgccgtcctcgttttagcagtcctagtcttcgccttctcccatgacttccgcttagcaatcactgcactagttctcggttgcccaggtgccttagttatcggcgccccagtgtcaaacgttgccggaattgggaatggcgccaagcgcggtatcctaatcaagggtggtgaagtcgtcgatacttttgccaaagtcgataccctggtcttcgataagaccggtactttaacggaaggtaacactgccgttacaaccatgcacacttacacaaacaatgcggataatcaactagctctcgccgccgctattgagggggtttccgaccatccgttaggccaagcaatcgtcagttatgccgaccagcagtcagcggggggcgctcccgtcctagatgacactgaaaccgttaagggccaaggaatctgtgcacaagtcggtaagcaagaagttgtcattggtaatcaaaaaatgttgacggctcataatatcaaactaaatcctacccaactcaaagatctcaatgatttacaagctggtggtcaatcaaccgttatcatggcagtcgacggacaagttcaactcatcttcggtattgccgatacgattcgtccaggcgtgaaggattccctcgccgcattaaaagcccaaggaatcaagaaactcgttatgttaactggagacaatgaactcactgcccaagccgttgccaacgaattgaacctagatgaagttcacgctaacctcttgccagaagaaaaagtcgaatacgttaagaaactaaaagcagccggtaacacggtcgcctttattggagatggcatcaacgacagtccttcaatcgctaacgccgatattggaatcgcaatgggtagtgggactgatgttgccatcgacacatccgatgtcgtcttgatgcaatcaagcttccccgcattagtacacgcccacggtctcgccaagaagactgtcttgaacactcgtgaaaacatcttcatcgccattgccaccgtggccttcctactgattgggctaatcttcggttatatctacatggccagtgggatgtttgtccatgaagctagtatcttagtcgttatcttcaacgctatgcggttaatcaatttccaaaccaagttcgacaaacaccaaccaactaaaaccattcaagcagccacagcttaatcaagtctccccaacttggttacaggcctagcaaccaataacggtccgccgactagtcttcccagctagtcggcggaccgttttagcatattgcaatcaaaaatgatagaccaataataatttcataaatacgctcggttaattaattgcgattataaaccaaaaaagatcttataaatccaaattccaataacggcaccaacaattggggcaaccacgggaacccaactatattcccagtgagaactacccttgttcggtactgggaataacgcgtgtactagccgtggtcccaagtcacgggccggatttagggccggaccggttggaccgcctaacgaaataaccatggcagcaatcaaaagtccaacgccaatattggcgatatcgatattttgatgaaaaaacatcccgcgatataatcccatggcaccaaaaatcaggactgcggttcctaccatttccgtaacaaaaccgtttaactgactgttcgcatgatcactagttgcaaacgtccctaagaccgcctcattatcagtcgtttgccgataatggggccagtacagtgccaaaatcaagcattggcctgcaattgctcctagaaattgccagattaagtaaggcgcaacgtgcgcccagggaaagattccaatcacggcttgcccaatcgtaatcgcggggtttaaatggttaccagaaatcgagccaaacatcatggctgggagcatgacccccagtccatatcccgatgcaaccaggagccatcctccattggcgagtcctggatcatcgttaccagtcgtgttcttcaggaatgcgttagcgacagcaccattacctagtagtactaggatcagcgtgccaaaaaattcagcggcgtagcgtgcttcccatgaacctgtcatctgtaaatcctcctcgtaaggtaccgagcatctatgataatttgaagataccagataaaaccgtttatgtaaacgctttattttgcttaaataagcggtttctaataattcaacataattctaccagataccctgggttgtataattatgaagcgctagtataacacgctcgcgtcaacatgagatcttcaacgttaatgctcgcgatcacaactagaagattctcaggtgacgctagcttccacaacaaatcgttagtatctaattacccaatacatcagtactttttaaatccctccacggccagaagcagaatacttgcttgcgtatacctatgggggtatattgtttagtgacaaatacttactaaaggagtcaactaaaatgattaaagaaatacatgatcaagattttgccaaagaaacagatactggtatcgccgttattgattttcgcgcagactggtgcccaccatgtcgcatgatggacccaattcttaagtccctttctgaagacccagcttacaaggatcaggtcaacttcgtttcattgaacattgaccatgaccaagctacggccagtcaattccaagttcaaggaattccaaccttcctgattaagaaagatggccaagtcgtcagtcacatggtcggagcacgtcctaagcctgattttgaagccgaactcaaaaaagcacttgcctaattacgaagggggcatcatgaatcatggcaactactgaagaatatgtcactagcaagcagatcaagacccgactgaaacgctcggctggtcagctggacggcgttttacgtatgatggacgaaaatcgtccttgcgaagatgtcttggttcaactttcagcagtgaaatcaagtatcgacaaggccatgaaactcgtcatcgcccgtaatattaataattgtgtagatgcgatgaccacggctgatgttcagaatcttgaacactcattggatctactgctaaaaaccaaataacgccaaaaaagacggtgtcgccaatctcagttggttataccgtctttttagtgccagttgacgcagttaaacatcgtatctgtcaggcaacttatcgagtcaatctttccaatcgccctttttccagtcatcatggttccaatcatcttttttccagtcatcgtcgtcatcactgtgggactgctcggcatccttgggcgctcgttttgctcgcttcaacagtaccgccgttgaaaccaccgttacgaacccagtcgcaataataaagacaaatgtccacatcacaatgtcactaatcgccatctcggggccctcccatataatttaattgtcgttagtatagcgcaggcccgttgtaatagcaaaaaagccctggatagtttgcccacacaatcgctatccagagcgtttaattcttctgcgacaacggcctaatcgtcatcctcatcttcttcatccaaaccagttcgagcatcgttaccaagataaacttgtaattcccgaatattgcgattgttactgccacgataagcaactaaccaagctgccagtgccggccgggtttctttttcagcaagcttgatagcccggtcaacgaataggttttccgtatcaaaatccttgattgttgcggccacgagttcatcagcagattgatacttgaaagccccattttcttccaacatagaatacttggttaattcagccgttgtggaagatggcttttggttttcatctaggagtaactcgcctaattcagcaaactgacggacattctgatctaacaaacgttgatatgctgtccgcaatgccaatgattgtggtcctttaacgtaccacttcacttgggtcaacttaacgtaagcaaccattaagttagataaaatgtgattagtcattgcgcccgctgttgggacatgatgatcaatgtcactctgttttaattccgctgcgtattgttcgtcgatcgttagttcactcatcgtttattcctcctacttaaccttgacgttttcaacttcgtaaccaagtccggtaacaacttgtgccaaatcatcggcattcgtcacttcaggatcaaagttagccttgaccttgctggcattgaatagcaccttaacattctcaacgccgtcatggttagcaacggccttttcgatcttagtcatgcatgatgggcaagtcaacgttcctaattgcataataattttcataatcaattacctccgtgtcgttcatttgatggttctatcataaccggatttgattgaccagaacttgacggccgtcaagaaattcaaaaaagttttacgctacaatatagttattaaaatagcaggaaatttaaaacgtcaaaccctatctaccaagcaaaatctgttatagttagggtgaatttattcaggaggtgggccttatggcagaacatgaatgtgtgcagttagtcccaatttttagcgaactcggtagtgaacaattagacactatcgaatcgatcgttcgtcaccaccactatccagccggcagcactttatttggtgctgacgatccactggattcactgatgattgttgccaatgggcaggttaaagtctatcagctagctgccaatggtcgcgagcagttactatatctattacaaactggtgatatcgatggcgaagctgccttatttgaaaatcaacggcgaacctcattcggtgaagccttagtaccgacggatgtttgcagtattcgccgttcagactttcaagacttgatgcaaaaatatcccagtatcagcatcaacgtcttaaacgtctttggcaaacgtctcagtcaactggagcgtcaaacaaccagcacggccactgaatccgtcgaagcccgtttagcgaactatatcactgaaacagcggcagcgctcaaaaccgacacgtttaaactaccattaaagaaaaaggacctggcgacgttcctcggcaccacccctgaaagcatcagccgtaagctcgccttattcgagcgtcaaggcctaattacgcaaaagcctggcaagatcatcgaaattaacgatgccgaccagctattattaactgaataatgactactaattaaattatccttaatcccccggatgactagcgaaatcaccgttagtcatccgggggcttttacgtcaaccctcacgctgcctcataaggtgatttacaggcactaacagctcctgcatgccgataattcagaagtaatcttgacctttacattaacattcacaacccatcagctactgattcaggactattaagatgattagtatcattttttactgagtcggtaccagatgataccactgagaataatctaaggtataattaacttagtattagaaaatttattaaggagtggatttaatggcaaccattaatcaagcagcagtaaaacaagatctctacgatgccgtcaacggcgagtggctcaaaaccgccgtcattccggatgaccattcttcaaccgggggctttatggacttagttgatgccattgaaaaaacgttaatgcatgactttgatgcaatggcggcgggaacagttacccccgacgatcctcagctaaccgaattcattaagttttaccgcttagctaaagatttcgaccaacgcaatgccaatggtgcggaaccaattctgccgtgtctcaagcaaattgatagtttaagcgactttgctgacttacaacaacggatgcccgattggatctacgacggcctcccattaccattcagcttggatgtcgacgctgatatgaaaaataccaaggtcaacgccttatttgcccaagcacctgggactatcttgccagacaagacatactacgacgaaggcaaccaggccggccctaagttactagcaatttacgctaaaatgatgaccgaactgttgcaaaaaactggttacgaaaaggacgaagcacaaaaaatcgttgatgacacgctgcaattcgatcgtttgatcgttccgtggatcaaatccgctgaagagtcggctgattacagtaagatgtataatcctcgcaaattcaacgattttgttaacactagtcgttatttagacttagccgccatcacctactccgtcatcgatggtaatcccgacctcgtcatcttgccagaacccgccttcttcgatcactttaacgaagtagtcaatcctgataacttcggtctgatgaagaactggatgaaagctaaactcgttcaacggtacagtggttacctcagtgatgaaatgcgggtattagccacgacttattcacgggcattgtctggtcaaaaagaaccgcggaaccaggctaagagtgcctactatctagctaccggaacttttgatcaagtcgttggactctattacggccacaagtattttggtgaagcggccaaagcggacgttcatcagatggtcgaaaagatgattgccgtctacaaacgccgattgcaagcgaacacttggctcagtgcagatacgcgtgctaaagccgtgaccaagcttgataaactcggcattcaagtcggttaccctgataaactagaaacgatttacacgaaattcaagacgcacacgcccgaacaaggtggcaacgtattgagcaatgtcctccactttaaccgtttggcacgccaagacatgttctcaaagtggggcaaagccactgatcggacccgctgggaaatgagtgcggacaccgtcaatgcttactaccacccatttatgaacattattgtctttccagctgctatcctacaagcacctttctacagcttagaacaatcttctagcgctaactatggtggtattggtgcagttattgctcatgaaatctcgcacgcttttgacaacaatggtgccctatttgatgaattcggtaacttgcataattggtggaccgaggaagattctgcccacttcaaggaacttgccaagtccatgatcagtgaattcgatggcttagactttgctggtgcgaaagttaacgggacgttgaccgtatccgaaaacatcgccgatgcgggaggcttaagttgcgcggaagaagctgctaagggcgaagatgacgttgatttgagtgcgttcttcactaactgggccatggtttggcgtatgaaggccacgactgaatacatgcaactcttactttcaatcgacgtccacgctccagctaagctccgagcaaacgtacaacctaagaacttagatgatttctacacaaccttcgacattcaacccgacgatgccatgtatttggcaccagataagcgggtcaaaatctggtaaaaagctttaatcaatgaacactaagaccgactaacaagcggtgcgattgcttgttagtcggtcttttatctgttccatcattatgggtcttattcattcaaattacgcgttagtatattacaatagaactgtcgtctgatgccgttacatcgttattggactgtgacccagtctcaatcacgactgcaccgcaaatcacaccagcagacgcgttattagtcgacttaacgccattttcagtgagggtcatcaacaaggcaatcccagtccacttgacgcttaaatcagcatatttggacactggtaaccatcgaaaacaactagcattaactatgattaaaacgtgccatttagttggcttattgttcgtcagccggtgagtgtcctattccgacctccggggctgggtgacaattgctggaacgtaagccgacgtcgatttgagctaacgcccagcccgcgtcatctcaaatacgagtcttattctaagccggaagcaacccacttccgactaagaataatttggctactgagcattgtcacccaacccctccggtcggtaagccgctcgaatggcagatgaacagccacttaacttggtacaatttgtcgttggctattttgatattggaactttaggtgaaatatcagagtgccttcttcactttgccaaaacgttcagttgttactacggcgattcagaataacgagctatcacaatatcatttttagcctaacagttgattgacaaaattactgtttataagaaacaacgacaaagccatcaaaaactgagtacgcacatgtccgccattcgaatactgtcccgactggaaggcgtttcggccaatgctcagcggtgaaattccacttagcaagcgtccttggcttggttagtggaagaccagtatttaagacgtggtcttcggcttaaatctgtgtccactgcgttccagcaattggcagaaatgcctggaagtcggcgtaggacgaactaactaagcaagtttacgctaactcgaactgtttccagcgaacctaaactggctgattttgaactcaaaaaatggcacgttttaatcatgattcataacagtttaactagtacaataggaattactaaatattcatgacgcattttaaaggaggcactatgtcacaatttgaaaagtatcatcccattctaacgccacactatacgttcgattggttaacaaaggtgcgcgttatcgacgttttcaacttatatcagaccagcaatgcgacagccactatggaaacaaccgctgcacaaattaaccacaccatgcgcgagatttttcatgaccaccagcttgtttggggcgtaacggatcgagacacgaatgcgttcgtcggtcaggtcggctttgccccaatcgatacggctaagcatgaagcaactctcagtgttgacctgactgctacttatcagcaagtaactacgctcagggaaatcttagaacggttggtggcatttggtaccgttgagttaaagttgaaccgactcacattgattttaccaaagcacgatgacctaatggcacaaatactggctggccttaactttagtaccaccgaccacttaacattcaattatcaccaataaacaaataacgcgatgctaccttcatgaagcaaggtaagcatcgcgttattttaacttattattcagtgacagcttcggccgcatgggcaatcgctgcttgaccaagtaagttcaaatagttaaatggccggtcgtaaattggttggaagaacatatctacgaaccctaagtcgtcaatggtattgtgattttgaatcatcactgaaatcacattggctgattgcgaaacatcatgttcactcatgaattgtgcacctaggatttcgcgagtttcaggattgtaaaccaattgcattaaaacaggcttagtggttggcataaattctggccggtagttgtcttcaaaagtgacagcggctgccggaacattttcggcctgtgcatgttctagggtcatcccagatgaaacgatggtttggccgaacaacattaacccagaagttgattgtgtccccatgtacttccgcgttggcttgaagatgttcaaaccaactaaggttccttggcgaaccgcattcgttgctaatgggatataagcatctttcttagttgggttatagtgaacagcaaccgagtcaccagccccgtaaatgtctggatcagaagtttgcatgtagtcattggtcttgatcgagccattagcgttcatatcgaccttgcccttgagtaagccggtatttggccggaagccaacacaaagaatcgccatgtcggctgtgtagctgcccttgtcagtcttgaccgtaacttctttaccatcatcactgaagccttgcaccatttgattcaaagccatcttgataccgtgatcaacaaagtcttgttcaacccggtcagtgaattctttgtctaagtatttatttaaaatccgtggtaaaccatcaattagtgtgacttccttaccttgcttctggtaagcttcaactaattcagtaccgatataaccgccaccgatcacaatgacccgcttagctggtttggctgcttcccataaattctgagcgtgcgtccagttcttgcataagtagacattgggactatcgatgccgtcaattggtggaataacaggccatgaaccagtagtgacaactaacttgtcatagtgatcagtcttagattcaccagtctttaagtcagtaaccgtaatttcatgtttgtcagtattcacatccgtcacatcatgttgcatatgaacagttgcgcctaacttagctaactgttcaggactggaataaaataggccttgaggatcagcaacttggccgccaaggtaaagtgcgatcccacaggataggaacgagacattgtcatttctttcataaatcgtcacttcagtatctggatttgatgctaaaatctgattaacggcagcagtgccggcatgggtacaaccaattacaataactttcatttttaaatcgctccttaaatgtgtttatattcacaatcatgcttgtgcaacatgtatttggtaacaattacattgtactaaagtaaaaagaaaacgcaaccaaaaacacgtaaaaagtgtaaatacttcactaatcacatgataaacaaatgccttgattacaacgttctcagtcattcaggctgattattcattcacttaactgtggtaattaaaattattattatctttaaccattatggctaataactagaaagcaaaagcactcacaatcttgcgtgtgagtgcttttgattctcttataccaacccgatcattacttaggtgcatctgttaacgtccacgtaatatcccccgtgtaagaacccggagtagctcccgcattgctttgatataaaatgcctgacttattcgtccagtctgccaagacatcataatcatcgttatcactagtagccgtgtgactgtcaatcaccgtacccgcagaattcagcgtggtcgtctgctcgccgtcgcggaaaatcacgtcgcccgccaaattctgaccaccggttgttttaaaattagtcgcactagcttgtagttgccaactagagcccttaccacgactatcccgtacaactagttgccaatcgtcttcccggtctgtcgtttgagccgaaccatctaaagtaatggttttaaacgtgctgcttttggcaaccgtcttaaaaccaagttcacctgcagtaacaataatctgcgctttatcaactggtgagacgttctcgtaacggtcagatgcccatagttcaatctcattatcatcaccgacgtgtaaatcctctgctttgaccttgtagtagaagtaaccttgttcgtcatcatccgacatttgaaccgttggcatttccttgccattaagcgttgggtgtagtgtcacttgaccgttagttaattgttccgaatcctcggctgcaacaatccctctgatgatcacgtcttccccattggcgacagtatacggactattacgaattttaaggtatagcggctgatcgactgtaatcatgtaatccggtgcttccgtcgttgtttcaaacaccttatttttaaatgtcgccgtcgttgcagttgtctgttcattgacaacgacattctcggccgtcccattgagcgtgatcgtcgcggtcggttgactagccgatactgctttatctagagtatagtcaactttagtatcactactcgttggcgccgtcaaagtctgctcactaccatccgcatacgttaccttggcactgtcaaacgtaatatgctgtggtagattgagttcagccgtaatgttatcccagtcaatttgaccaccttggtaagtcaattgatagtcgtactgaactttatgctgagctttgagctggccgcctgtcttgatttcacgattcttggtcttatccgtaaccttaaccgccgcctgtacgtcaactaaattcggcgcgctttcaatcacgaccatgttattaccagaattactaccagtcgcccccatgaatccccagcgaaccaggccatcactactgttgaattggctagtatctaacacttcactctgagtaaagccgctacccgtcgccgacccatctggattgatgtcattataagtgtacgtcatcgttttagtcgccgcatgccagtccatcaccaggtggtgccacttgctatctcctaatgacatattcgtcactaggttggtatgtttttgcgtaaagtagtaccgggttgaccaaattatcccggtaacgtctaaactcctgacagactgattttcatactgactagccagcccaggatacccggtcgcaatgtgttgtttcttaataccatcatcaaacgaatcacccttaccagcattactatagctagttgaagtattggtataggtatcaaactctaaggcccaactattttggatggccgttttcgcaaattcttcgccgtccttcaatttattatccgtatcaacaccccaaacaccgagtgtctcaccaataatgctggacgaactgacttgtgcggatgcggcagtaccatttggatcattttgtaagacaaaagccatcccatcgccggccttactagtactcgtggatgttcccaaatacacccacattttaaacgtagcatctttatttaaatctaggcgattggcgtcgttcgaccaaaagccacccacttgcttcttgccgttaataacctgaacggcctgcgtatttggcgagcttgcattggtcacattcccaatattcgcactattactaatgccactactgaatgccgctggtagcgtaaagagtttatccaactgattcaggccagacggtgccgttgccaacgtcgcttcgtcagcagcctgaatttgggcggtcccggcccataatcccattaatgcagttaatgcaactagtatttgtttcggtcccttccacatgttgaaaactcctctcgctagttagtcctgacgacggcggtttttcaatagtagccagataattgcgcctaataggacaacaatcagtgcgcccaacgcaacaaaccaccagaaatagttcgattgtttttctgtaacagctgtatcatttaaagtctgagcttctttatcagtaatggtaaagttctttgtaaattgccacttacccttatcagccgttgccgttaaatgtaaagtgtacttgcccgccttcaattgttgcgtcccgtcaccaactgcaaagtcaaaattactattcggcgccattgacatgttttccttagtcgtcgtcaataattttttagacgaaccagctttagtcacgtagcttttgatctttaagccatgcataataacgggctggttgttttgcagattagccgtaacgtaattacgatagttacgttgcttggcttttaccgcgtgcaacttcatcacaggtttgatcccgcttggatcagattcacgtaactgcaagccaatcacgtacgcatattgattattgatggccatgccactactagattgtttcgccttggtactgagttcctggatgatattgattccacccagcgccacgcccgcaaactttttctcgggtaccgtcaatttaatagtgacttttttgcttgacttagcgggaacggtcacgacctgtgactttgaaagtgctgtcttgatgttaaacttcaaggagtcatcggccttagcctttgcttggctgtaatcgatgataccgttattatttgtaaccaccagattaggtgataccgtgtatcgatgttctttactatcactattttttatggttaaagtgagattttgcgtttgacctggtgtgaccttcaagtcaaaataggacactttttgattaatttggttatcaggcaaatcagcctggaccgtgtaattgaggtcatccgctctagcagtcattgtcaaacctgccataacgatgctcacaacggcaattaactgccaaaatatttttttcataggctttacccttcctttattcaacggtaagtgacgagctatgtatgattgaagctgccattctttacaagtagcagcttcacatcaaaccatttaattaactaggtgcgttcgttaatgaccaagccagcgtacccgtgtagtcgccagcacgcaattggcgatcatggacttcaagttccgtgggtacctgcccgcgattcagaacgaccagccaagtacctagaccagtattaggcggggcaatcacgacattattcgctaaaccagcaactaattcaccagtattaacaacgttaggtgcagtactaacattgccagcacctggccgtaattggactgcgcctaattttaaagacgtcgttaaggtctgctgaccactttgcaacccgcttggcgtgacctgtaacgtccatccagcagccgtggcgcggcgatcagttatttgaatcatcgcccgctcattcttggcagtcgtcttaaacggcccacccgcggtcgtaattgcattgaatttcaaattactgacgaaatcaatggttaactttccccgtgagcccgtaccagcgacattgtcttcatcgaccgggtcacccgggtatggtttactgggatcatcagggtcgaccggagaaactgcattgtcatcatccgagggggtcatttctacctgcacctgtgactgtgtcgttgcagcttgcgttgcgataaaccagccccagttactaatgatgagacaacctatcacagtcattaataaccgacctgttaccaacaatccctttttcatcggtcacacctcagttctcctctggcgcattaactggttagctaggggcgttacctaatgtccatgtcaaggttgaagtgtaagcgccagccgcgttaccagcagggatcaacaggctaacttcattggttgcatacttactcgtaaacttaccgatcccttcattagcttctgcgtccatgataatttgattttggtcagtgatatccaccttataagcttttgctttagagatgttattagcatcatccgcagttgcattaacttgtgcaaaagttaacgcggcgccccgtaattcacgagtatcatctgcattcatgaacttcgaacctttaacttgtactaaccatccgtccgtattcccagggttggtcactttcaagtcgccagtaacgttcttagcatcataggttttactgtcattagtgattttttcggtcccaaagctaacaccaggtgcttgatccaaggtaatatctttattagtgtcatcctggattaattcaacttcagctttggtcgttgtctccgtatctgcagcttggccaacaagtggtaatcctgccattagtgtcatgcctgcaacgagagttccgagatattttttcattttggctgctcctttattgtttgacggttgcgccaccagattagaattaataatattaataaactaagtccacatacgccgataccgaacagaatccattgctgggtcccattcatttgcggtaatacaccttgtagcgggctcgcaattttatcggccgccgcattgccacctgaattagaagtgatcgttaagtggtaagtgcctgattgcgtatcagctactagtggtaacttgactagctgactaatacctaagtcttgaaagctgcccatccaattaatatgaccacatcctttccagatattgacttaagcttagtatcattattaacgcttagtaccaatagtgaatcgttgtgagtaaccctatcagcaacgaaaatatatcatggttttggaatcgctgtcaattgatgacgccccttaactattgattaaaattcctattttaacggacttctgagccatttttaatattatagtgattacaaatattttaatataaactactgtaatcagtttaacggcaagctttcctactgctttcatttatccgattaggtccaactagttggcgtgttcaactaaacaagccgtcaacattatattatcgttagactttgatgaggccacacataagttaaaaattttgataattataaatattgaaatcctatatatatttagaatatcgttgtaacagcaagctattacataaattatcttcaatttataaaattatgtaatcgatttaatgtggaaatcttttatcaattttaaagtgcaacacaatcaactaattaaaatcggctttaaaaacagtaaaagccccctaatcaaataatttcaaacgttaatattcatttaccaaacaatgaagtgtgctgtggtatacttaaaacacttatttttaaccagaaaggcggttcgaatcatgcccgctaaaaagacatttcaagacgatcaagttatcgaaaaaatcatgcacttattttggcagcaaggctattatcatacttccatggacgaaatcgtaataactagtggcgtcaagaagcaaagtttatataacgctatcggggacaagcacacactttacctgcgtgcactccagcgctatcaccaacaagctttaatgcgttgtacccaagcaatgcaacgcttagagcaagatggcgccgcccccttagctatcctgagtatgctctttagccacgatttaacgacatccgaacaaccagccggtgacctaatggctaacgccgtcgctgaatttggcactactgatactgatgttcagcaagccgtcagctggttttacgacgactacctgaccctcatggctgcggtcatcctcaaaggtcaagctaacgagcaaattatcaataatcagtcaagtatgacactagctcaggcactgctagaagcccgcattggccttcaaacgcgactccgtcaaggcagtcagccagatattcaagcgcagcaacaagcctggatggcttttctagcacgtcgttgaacctaaagcagttaatcagcgcataaaataagcaagcttctcacgaacactttgggaaaagcttgctttattttttcatctatataagtcacagtcatacttttgggtcataactagcgattgacttataaatatttttgcactaaccagtgctgtgctgaactcgtcaattgactaccataatgttgtcgcaaccgttgcacacccgcgtaatggtcaaattcaaattgacttgtcagcgtctcactagctagcaacgccttagcaaactgtaaatcgtcaatcgtaatctgttgtcggtaagccaaatcttcatcggctatgattcgttgccactgatccgttaagatggcactggcccgctgataacgacggtcatgggttaacaaggattgcatatcatctggattaagtggtgtccccatattattcatcctccaagttcaaattaactacatgaccgattgctggctcaatcgacaatcgatcttcagcccgcgctaacaaccaaatcacatttgtaaaacggtgtgactcaacgtgccgttcaccacggccatccgttaagatcagcgccaaggtcgtcgcattcgtcttatgatgtgttagtaaatcatcaaaaatactttgataaacggttccaccaccgccacggcgcgtaaagcgaatctgctgtggcaaactcacctgatacgtttgaccaggctgtacgattgcatcaaacggcttaacggtgatggttgctgcaaataatcgggttaaagcagccacctgtgccagtaatcgttgcagcatcagatcactgatagaacctgaattatcaacataaacttgcaagtccaagcgcgtatcgccaatttgaccgggtatttccatccgcgcgggttgccgtcgattaaagcgcgcgtgcgaggccttagtaccgctcggaatctgacccaggccccgaactagtaattgtcgccaatcaagctgggccggctgcgtcattacagtgagctgagctcgaacattgccggccactaaccctcggccagcttcatttgtttgctgccaagcatctttcgccaactgttttaaacgggcagttgccaaattgggattcgttaactgttcagaggctgaccagccacttggatcatcgatcaactgttgcgacttttggtcgccagacccttttgctggctgccgctggtccttatttcgcgaagtggcggtgggcgcgccattcggctgaagttgcgaccgcgactgctgctgtaataatttcaaataacagccagaatctgctcgtcgcggtagctgggcatcgactaacggctggacagtcgttaaactgaccgcatctttaggcagaccgtcgacatactggttaacggccaggtcggtcgccaacgtcactaactccggctgctgcttgacctgatcacgataccgaacggggtgttgccagacaatgtgtagtgccacgtgttttaaccccgcttgtaagtaagaaaactgtgaaaaagctcgagcaattactgttggcgcatattgtaagaccaactgattattctgccaagctaagataaacggcgccgttaacgtcgtatttaactgtctgggaagtcgggtcaacaactcgccataaaattgatcggtggctagtaactcaataatggcccgatcaatcatggtcgcacctgcctggatcgtgtctgctgttggcgtcactaacatcgcttgttgccaacgtgtgtactcattggcattgttaatcatgatgactcactgctttcttactgatttgaccaactggcgacctgttgtaaatactgatacaaagcggtcacatacggactttgcttggcaacatttgctgtatataattgctttaataagtcgcgttcatggccgatttgttgaaccaatgcaaactgaccatcttgactgagtgtttgtaggagttgcatgaaccgaccagcgtgctgatcgtccgtcaacggatacgtggttgttagagccaaacagcttgccaaaaccgttcgcttttgaatttcattcatcgccgtaaactgcttaagaatcggtgccggcaccacggcccccactggttgactgtcataaatcatcgctggtgtcagatgaatggcttgttgttccaagaattgctcgaataaaagccctagctcagtacccacatctccttgaaagatatccagtgccacagccgtttgttgatgcacaggaagtttttcaatctcatataaattagccgaaacacgcgcccacgcacgtggcgtcgctgttaaatcagcctggacatcagcctgattaagccgcgttacatcttcactaataaactgctggacgagtggatgaatgtttggtcggttcatgcgctcatccacttgtttggcccaagcaagccagtctgccgcatctgctcgcataactagacgcacggtacgatctttgatggccgcatcgccagcagtaacaccatacgtactactttcgaatccagtcatactagcatctggattttcagcaatgatcaattgcacctgttctggcaatttcaatgtgttaatcgtccgttgcaagaccagattcatcaattcactttgaacagcctgcgtcccacgattaaattcgtctaaaaaccataaaattggctgctgaggatgctgctcagcatactgaataatttcaatcaacgtgtgtgcatagccgaattgtacgtcagccaactggccatagcgcttcgtttgaataaatgaatcgctcgttagtggtgggactgggatcgctaaatcccccttttcggacaggctcacaacggtcgtgtataattgcgcccccatccgcttagcaacctcggctaccaaggccgactttccaatcccggcttcaccgacaatgttcggtacgttccccgcttttaaaacgaccggaactgctgttaatagagcttgatatgataacgccattaattaaaccttcctttactgttccacgtgaaacaaatttaattcgttttcaaaaacatcagcttacttgtcctaaccattataaaacagaagccaccattatcgacaattagcgttcacagtcacgttaggtcacacaccaatcatactgactactatcaatagtgactatgcaaaaataaaatttttatttattatagttttaacaatccacaactgccataaaacgtttttataccaacgttttaccagtgtcttatccattaatataattataaaaatcttatcagaaatattcacaaatcaaacaaattccgtcgttttcacgagcaggtattgtaaaataggttaagttagcaattattcaaaaagggagtgtgcaactatgcgcaagtatctcgccgaatttctcggcacatttatgttagttttcttagggactgcaaccgttgtgattgctaagggtgacgtcctcgctattgggttagccttcgggttagcgattaccgtttcggcctatgcctttggtggtatttctggtggtcactttaaccccgccgttacgactgcgatgttaatcaaccgtcgaatcgatgccgccgatgccattggctatatcatcgcccaaatcattggggccatcgttgcttccgcagcagttaagtcgtttgttagtgcattaggcttatccgcaacatcgcttggtcaaaccgattttccaaaaatcggcagtggtatggccttctttgtagaagcactagtcacattcttattcttaatggttattctgaacgttactagtaatgaccatggtaacgcagactttgctggtttgaccattggggtgaccttagcattcttgattattgtcgctctcaacttaacgggcggttctttgaatcctgcccgttcaatcggccccgctatttttgctggtggtagcgccttatcacatctatgggtctacatcttagcaccagaagtcggcgccatcttagccgcattctgtgctcgggttatgggatcagaagactagttagcaattgacagtcgtaccattaaccacgatcaatttgatactgaaacatgattaataaaacagcggtaccgtgatgattttatggcttggaatcatcacggtaccgctgtttttcgtatgcttatattttaggcagtctcaattagacgaatctacgttgccaacttctcatgacgcatggccctatagcctaaccctacgccaagttttacttgcgtcgccaatgcgtgtaccaggaatggagcgttccaatcaataggccaataatgacgacaactgctgaaacatagccaaaaataccaatgtttgtaatccaactattatcaggatggctttgaactagtagtgatgatccaacaatcagcgctgccagaataacggacagtacaatcttattgaccatcgaatcaatccgatcaataaacatcttgcggtgtgcaaagaccaagttgacccgcgtctgaccattctcaaacgtatctagagctgataataagcgtgacggaatcttcggggcatcacgcaggctttgaaggctagacaacatgccatcttccagttcattgcgccaattaaaattctcgcggatgtacttgcgcgcaaacggccgcgccacgtccatcattgataaggttgggtcgagcgtctccacaataccttcgatcgttccaaacgccttacctaacatggtaaccgctggattcatttgaatattattactgcgacaaaccttgaccatttcaaacaacaagccttgaaaatcaatgtcgcccagtcccgaattataatactgacttaaaaatggtgctaactcactaaagaacgcttcttcatcaaccacgccagttcggtttgaaatcgctaagattgctttgccgacttgatgggtatcttcggttgtcactgccacgacaacattagcaattcctgccatcaaagctggactgatctcacccatcatgccaaaatccagataaactaaccggtatggtggtaactgccgtttgccaattttcccgccatgcttgggaaccgtatcgtgatacccaatatcatctggttgcaattcccgcaataagatattccctggatgaggatcagcgtgaaaaaagccatcttcaaaaacctgcttcaagaaattttgcaccaagacatgggccaaatagcggcgttcgtcatcatactggtgatttccgtcttcatcggccgcaagcatttgcgccataaaatgctgaatcgtcgttcccggcatatactggttaacaagcactttttgcgtactatacttcgcataaacccggggtacccgaataatatcgtccgcattattcaatcggtaaaaccgtaatccattttttacctcaatactggtatccaattcattgaatagtgaccgtttgatttcaccaaccatttcgcgcaaatcaacaactgaagattccggaatatatcgcaataggggtaacgcccgctcaaataatgaaatatctagggccacctcggcgtcaatacccggatgctgcaccttcaccacgaccttctgcccattgagcagcgtcgcatggtgcgtctggcccattgatgctgatgcaaacggtcgctcgtcaaactgggcaaacatttcattgattggcttccctgtctgctgctcgatcgtttgcttgaccacactaaaatcatcggcccggacattattttgcaatttcttgaattcgttagcaaattctggcttaacgatatctgtacgtgaagaaagaatctggccaattttaataaacgtcggtccaagttcttcaaacgccgcgcgcacttgatcaggatttttctgacgtgcaaggttgctcaaaacgttatagcgccgcaagacactgacaatcgtccgaaaacgggtatggcggttctgattcacttgccattggggcctttcctcattgttgttggtcatcagcggaccctcctcacaaatttccttattacagctattatccatctttatttaagaatccgcactagctaactaactttttttgaaaaaagattgacaaatactaatcgcggttgtaaattagaaccacattaaaaatcgattaacaaacacgccgatgaacaaagtaaaccttctggaaatgcctagagagtgtcagtttggtgcaatgacatcatgaccagatcgttgaaaatcagttctgagtggcagtgacgagcttgatgttagttgctgttggttgctcccattattgagccgaagtatcgcaagtggccggccacttgccgtactttttaaggtgattcgtcgtaaggcagtcacaaagctaaggtggtaacacgtgttcaaacgtcctggtttctgagtctaactcagatatcaggacgttttttggttaatcgcaacttttatttaatgattattgtctcaatcaaataagggagtgctgttgatatgttaaatcgagttcaaaagcgaaacttaaccaaacgtgattacgtcaccttaagttcaatgattttcgccttattcttcggggctggcaacctcatttttccacttcacttgggtcagctagcgggcggtcactgggggattgctgcggccggctttctcatcacggcggttttattgcccttactatcggttttagccgtctgtgtcactaaatctaagggcgtttatgacattggtaaaccactaggcgcaacctttgccgttgtcttcatggttctcatacactttacaattggccccttctttggaacaccacggacagccaccgtatcattcaccgttggtctggcaccgtttttcccagcaaagtatcaatcactcgcattactgctgttttccgccgcatttttcggactcgcctactacttgtccgttgaacagagcaaaattatggctcgggtcggcaaattattaaatccattatttttgctattattagtcgccatcttcgccgtagctttcagcagtccgctagctcatgccggtagcaccagtgcaactgctgcctatcagaccgcaggctttaccaatggtttcttgcaaggctacaacacgatggacgccttagctgggttggcgttaggtgtcactatcgtcactgccgttaatttcatgggccaaaccgacccgaacaaagccgcgtgggtgaccgcccgagctggcttcttctcaatggcctttgaaggcttgatttacgtgctcttaatcttgttaggcgcgcaatcgttaggtcaattcaaattatccgataacggcggggtcgcctttgaccaaatcgttaaccactacatgggtaatgtcggacaagccattttagccgtgttgatcattaccacttgtttgaccaccgctatcgggctcgtcgccgccttcgctcaggacttccataagcacttcggtttcttgagttacaaagcctggttaagaatcacgtgcctcgcctcatttttaactgctaatgtgggattaaatcagatcattgcctggtccacccccgtcctgatgttcctttacccattagccatggcactaatcttcttatcgatcctttcgccactcttccacaagtcaagtgtcgtctatgtttgggtcgtcgtcttcaccgtcgtccccgccgtctttgatatggttgccgctttccccgccgttgttagccaaagtactttcggccaagcaatggcgcatgtccaaagcttcttaccacttgccagcagcggaatggattggttagtccctgcgctagttggtgccgtctttggcacggcccactacttgttgttacagcgggcaaaggccagcactggcatggaagtaccgatgaaacgctaaccggtaccgtacttgttaaacaatttaacgaatgccaaataagcactgcccactattttgtgagcagtgcttatttgatacctcaagtctaacacgaacaattatcgcaatgagtcggcgttgtcatgaccgacaactccaatctatttgaatgttactttcattgctgattgaccatgctgtacttctgttgaccaatcttcagtgtgtgctgtaacgcgaccaggttgcgtaaagaaagtaacaaccacatcgtcataaccactctgtttgatcagatcacgatcaaaggtcatcagtaaatcaccagcgtgtacgacttgcccatcttgataataagtcgtaaagccagcaccacggaggttaaccgtcccgattcccacgtgaataattgtttcaagaccgtcagctgacacgattcctaacgtatgtttagttgagaacgtaaaccgaatcgtcccatcgaatggcgcatagaggcgaccatcacttggcctgatggcgaaaccaactcccggtaagccttgtggctgtgcggcacttttgacatccgctaatgcgagcggttgaccgcttactggtgctaagatttcagtggtcagaatgtcagatgcaggcgttaccgcaacatccgctgcttcccctgttgccaatttggcctgtaactcttcaacaatttcggcatgtttcttttcggtaatggttactttgaatgtaaagactaacaatgacaagattgcacatgctaacggcaagtaaaacgctaagagttcaaacgtatgaatattacttgcagtcatatcggcggccgttgcactaccagtcataccagcaactaaagcaatggcaccgacgataccgttggaaaaggcaccagtaattttgtcgagcatcggccgaacggcaagcaccaccgcttcattacgattgccattcttcaattgaccgtattcaatggcatcggtcattgataggaccgtgactaattgggcaaagttaatattgaaaaggactaatccgatgatcaataaggtcaaattcgtctgcgcaacaataaagataatataggctaaaatcattgagcattgaccgagtgcaaagagcactttccgtggaataaaccggttcaagattggatatagtggtgacgtcacaaaaccgatcacagttgcgaccgccccagcaatccaaaattcaccaggtttaccaatcacgaatttaaaaagatagaatagaaccccgttggttgtcacgtatgctaatgaatagaataagtaacccagactgacccacataatttggtcattcttgataatgcccataaagacacctttgatcgtcgtcttttgtttggctgcttcccgaatcgcattgtgcttctcactggttccaaaggcgacaaatagtgcagaaatgactgccacaataccgacaataacagcaaacgctagccagccttgtggaccttgggtatgcttaccagttgcgataaaggtaaagtacgtggtaattggtacaacgaccattgtcaggccgttccaaccgatcgtcccagtaaaactgccaagagccgtgaaaattccccgggcatgactatcttcactaatcgctggaaccatgccccaatacgagacatctgttaacgaatagaagacatccaagataataaataaaatcacaaaaacaattgcaaataaaatccagtttacctttgctaatccaaagattcctgagaaaataacgactaataagaccgaactgataatactcccaatgacttgccaaggcttaaacttaccccaacgtgtttccgtattatcaacaatatttcctaagattggatcgacaacgacttccgctaaacgaatcaccaccaccagtcctgtgattaaaccaatcaaccgattggcgatagctggtgcaacgccgctaaacatcccactagtgacaaagacaataaaataggtactcaacgcaccatagaatgccgagtgtcctaagttacctaatccaaaggcaacaccttcattaatttgatgccatgataactttttcttggttactggttgttgttcaacattttgtgccattaatttcaccccacttaattatttattcatcatatagacttgaacaccatagctggctaagtcttgcttgccactgaccacttgattctcaaaaatctgccgtaacggcacttcaagtgtcaccgtcgttggtcgatgactaaaattgatcacgaagtaatagcgcgtcgtcgcattctctctaacttgaatacttaccttggcattcgctttgatcactggcaaggccggtttaagtgccaaacttgtggcaagccgttcatagaaagcatccaagaagtcagtagcggtccgcgcagccaaataatacgccgctccctggcccaattgattgaccgttacagccggcgttccagcataaaagtctttttgatacgtgccgaggacttgtgctgttgtcgtctcaactacatcacaataatcattcacttgatacgcttggtgataagcagtcagtgcattatgttgttgcggatataatgtatcagtttcctgaactttaattccgtaagttgcttctaagtcagctaacccatcaccttgataggctaagaagtcatgatcaacgacgcccgtaatataggtgccgatcagatggccgccctgttgcacatatgctttaagcttagtcgcaaactgggcgctcatcatgaagtgcatcggatcaatcaccaaatcataggccatcaaatcatcagtagtcgcaataatttcaactggaatatcatgtttccagaaatactggtaatgttcttgaatcgtgcgccaatactttttagtttcgttagcgtagttgcgggcatcatctaacccccacatgttgtcataatcaaaaacaatagcgactttagctgcagttctggtcgttccatgcgcggcctgtaagctttgtaagtcctgaccaactttttgaacgtccttaaatgcccgcgtatttgagccacgatggttggcaatgacggcgccatgaaacatttcagaagctcctaatgattgatgtagttggaaatacaaaactgagtcggcgccatgggcaacctgttgcaagctccccatttcgtgcatgcctggtcgtttggcacgattatatgggtgccaattaacctgtgacggtgtactttccataatcaagtagttatcatgcttgaggctccgcatcacgtcattcatcaaagcagttttcatggccaagtgggccgtactttcgtaaccattactccaattaggatatgaatcccaactcacaatatcgacatgcttcgcaaacttctgataatctaaatcataaaagacgtgtgattctgatgggttgccacccataaaattggctgtcacagggatattaggtgtcagcgctcgtaacggtttaatttcattatcaaaaaagtcaatcgtacggtctgttacaaaacgatgccaatccaggttaagtcccattacattcgtatcacccagcggcgacggtgcctgaacctgatcccaacttgtataatcgtgactccaaaaagcaccacagtaagcatggttcaaattggctaacgtttgatactttttttgaacccaatgacggaaggcttgctggcacaaatcacagtaacaagcaccgccatattcattagagatatgccatagcagcaagcttggtcgttgaccgtaacgttccgccaacttctggttaatcatctgaaccttttctcggtaaactggcgatgtgtaacagtgattatgtcgctcgccgaattgatttcgctgtccgtgttcattgacacgtaacacttctggatatttctcagctaaccagcgtggacgagccccgcttggcgtcgacaaaatgatcttagtcccttgggcttcggcacgatcgaaaatttgatctaaccagctaaaatcatactgcccctcagcaggctctaacttgtcccaagcaaagattcccaatgtcaccgtatttaacttagcagccttaaacgctttaaaatcctgcttaatcacctcgggttggtcaagccactggtctggattataatcaccaccatgcaaaaattctgttgtctttaatggattggacattcaaacgcaccctcacttctatcaacttaattacgctttaacagctcttatgataagcgctttcatttgtgaatgtaacccgttttactaaaataattactaaatatcggtaaacactatttacgttttgtttatattcattactgcttttattagcgctaatgaaagcgtattattataagtgaagctttttaactctggtaatcatctgtttagcaacttgtttgtcgaaaggagtcttccactgtgccgactattcgtgaaattgccgctaaagcgggctattcaccggcaaccgtctcacggctgttgaataatgatccgtcattttcaatctcggatcacgctcgcaaaaaaatactacaaactgctcaaaacttgaattacgaacaaccaaacaccactcacggccttgcctatcagatagctacaatcttcgctgtccaaccaaaacaagaacttgaagatatttatttcagtaatttgcgtcagagtctcgttgaacacggaaaacaggctaatttaaagctcaccttttatccggatatcgaccacattccccacgacatcgacggtgtgatggcagttggcgaattcgattctgatgcgctccataaattgcgccagctaacaccccacagaatcttcgttgattccaatccagacccgcatcacttcaattctgtacagcctaacctccaagcaattaccgaacaagccatcgatcaattgatagccgcaggtgatacgcccattggtctcattaacggcggctactggaataaagatcaacaagtcacccatcaacaagatccgcgccaaaaatactttgaaagtcggctacgcgagttacaactatttgattcgcggtttctattcattggtggtgaattctccgttgccagtggctatcgcttgggacaacaagtcgtgcaatcgttgagtaaacaagcattgcccaaagggttcttagtcggttcagatccgttggccgtgggtgtcttacaggctttcaatgaaaacaaaatcacagtccccactgataccgcaattattagtattaacgatatcgacattgcgcgctacgtttcaccaccattgacgactttccacattgacacagacgacttagccgcacaggctatcacaacattgaaagatacgattatttttgaccgttcacagaagcgcatggtattagttgatgctaaattaatttatcggaaaagttttgtgaagccgacgaataaatcatagtttgacacaaatcaaagacacttttggtatgcacttgcttcaacaagcgcataccaaaagtgtcttctaaattaacccattaaaataatgacggctacactgggaccaccgcagttctattaggttccaaagattgtctttgcccatccacaatcaatgtcccaccagctcggctagcagtgactgatagttggtgttgatcttttacgacagtcacggtaccgcctttaatgggtaacacggtgtgtaaatgatgaaattctgataactcaggcttgatctcaaaagtctggtatcctggagccgtgggccgtaatcctacaaaatgacgacctaataaatatatcggactggctccccaggcatggcacaggctcttaccatagggatcaccatacatggcatacatatccttgccatgctgcgacggatcgaattcttcccagaaggtcacggccccgcgatctaacatgccgccccaatagtctaataaaacttggtaaacacggtgttgttcccccagcttacataaagcatcttgttcaaaaaacttaaaatacggcgtggtaatttgagtaatcgcattattcaacaaaacattctttaaaattaattgttgtttgttctcatcaacaacgtcaaacaaaatggcaaaaatattagcatgacgagtaacgtgccgcttacccgattcataactatcaataaatgctccttgttcatcatcccaaaagtatttcattaagttcttaaacaactggtcatacttcgcttggtagcccgccacatctttgcctaagacctcaccacaagtcataattgtcttgtaatcttcaagtaataagatttgttcagccgccacggtaccctgtttatccatttctgaccaatcgacaaagatccagtcatttttccgaccataaataaaaccatgctcatttgtctgttgaataaagtattgcaccatactctctaacttagggtaaataattttgagaaattcacggtcacccgtcatctggtaatgatttagaacaccaatcacccacaacatggaatagtcgacaattgtattcatatgttgcttaatatcatcttgcccacgcaacgctaataacgtccgtttatcaatatcttcgttgaagaaagaatattgattgataaaattagcttggtacgcgtcaccagcccaaatccaccgatcacgtttgatcccatcgataaagaacaagtcactgcaaaggtttaacgtttccgtcgctacattccaaatttgattgatcaacttattatcagaggtaaaactggagggattatttttaggaatatattcgtgcatagcagttaattcaatgtcacctaactgacaatgaggcacaaagacatatcgaaacgcacgtttacgaacctttgttgtagctgtaacgtccgactgcttgtaataacacatctcaacatcccgtgcttcagtttcggactccccgtaacatagtgtaactggcccattcgttttgactgtgacagttccattcacagcgcgaccaaaatcatataaaacgccaccatcaactgcttgttgtgctttggccactactttttctgtccgatattcaatcacattaggatcctggttacggtcagtgtagagaatatcgtgaccagcgggtaatgtggtgacaaaattgctagctaaccaaccactatcagatttgataatctcaccaacaatataaattgtcggcaatccctgaacgttaccaacaaacacttgaatatcagtcgcacccgcatcacaattaatcgcatgatttaagcgatatttagtgccattaacatcaacatagcccgttcctttggcgagtactgtaaattgtgtggattcttttaaatcatagtgccgtttaaaattaacattacgattgcaatcatcaatataccaataggcaggccaacccatcccacgttcttcgcgtttaaaattttgtaacatcccttggtggatttcaaaatcaccaggataccataaccaaacagcctcttttgacatgagcattatcctccttgattttaaataaataagcccgacaatgcccggcttacatttttaattcttagtaatattaatcaatttattcagaaaccgctttcatcattgggtcttttaaaccggtcttcttaataatagcgacaatgatcactgcacaggcaccgaatagcaccgtacatccaaccataatccataataagagttgcggcgaatatcccattaatgttggcgttactagtgagaaagcagcggtcagcacccgaactaagccataagaaaaacccgtcatcgttgcccgtgcatccactggatagaaagtctgactccaaattttataaagggcctcaccacataatactgtgctaccagagtagaaaatataaacaacggtgaaaatctgccagtcatcactaaagatccctgcagtcacaaaggaaagcaatgctacggcaatacctaaatacatcactcggtagcgatacctagtgtctgaaacctttaaatagatcaggttaactaacagacacacgatattggcaattaatgccacgattgtcgaataggcttgcgtacggccatcaacagtcactaagaaatagttaacaaatgacccccacgtattggccggcaaattccaaaatagataaaaaacagttagtagaatcattggtactaacaaaccacctgttcgcaatagctgacctaatcgatacttcttaaccgattgaccgttagatgcacagtccacatgttcatggtcaactaagtctgtttcaatctgtttaaaacgctttgaaaagacccgcacgcaccaattaataattgccactaatccaatccaaccaaataaggctgccgggcttcccataccactgttagcagttataaaaccaataaactgtgacaacaaaatgcccatcgtccaaaaaatctgagttgaagaaattgcccgaccataaactttactagacatccgttccgaaataaccgccaatgacgttggtaaatcagcaccagaggccaaaccagcaatcacaacaccaataatcaatatcgtcgtattttgtgcaatcgcaataataaacgagccaatcgcgacaaaaaagatatcagcattaaacaccgcgacccggccaaatttatccgacagccagccgcccacaaatgaaccaattgcaaccgcgaccgtcagcatagtacttagtagtccgaccatccagctattcagtgctaaatattttgtccagataggtagcgctactcccagactaacgagcaacgctgcatccatataggaagctagaccagcaacaattattaagagtacgtttgctttactcagctttactttttcgtcaaccatcgcagacactcctcctaaacgaggtacttattaatcaagtacaccggtgtacagctccaagcatgacaataactatttaaaatgggactcccatacggcgaataatcaggttgattaggatcaaatgcttcccaataagtatccgcacctagcgtaatcattttgccccagtaatctttcattaattggacggcctcttgctttaagcctgcttcaaataatgcttccgtaatatggtgatacatatacggcgttgcaataccagtaattggaaacagtttcgtgacggtcgtttgcataagcgccgtggtttgctcaggatccaaaacatgtgctagtgtcatccacacttggcttgccacattaacttcacgctgatcccctgagacaaataaccccgattgcgaatcaaacaattgagttttagcgtactggtttaatttacgcagtatcgctgtataggtctctaagcttgtatcattaaccagttccgcaagcgtaataaattgttttagcgtataaataataatggcctgcccagccgtttctttgtcaaaatcatttgaccagtcgatgaaaaccggattttcttcagtcaatttcaatttaccttcagaagtaacttgtgccaacgccaaatccatttgatttttagcaacacgatataaatcattcaaaactgttttatcagaactaaacgcctcataatcagccaaaattgaaataaagaatagactgtaatcaaacaagaaggtgtcatctggaactgccgttggtttagtaaaaacattggcaggaatccggccagccgttgtaggcatcgcaccgaacaaatacagacaccgcttgaccagatctgtatctttgaacgttgcataattggccaatgcttgtagccgaagatcaccaatccataatcgccgatcgcgctttggtccatcttcaaagacatcctgcatacaatcagctaatgttttcaagccaacctcataaatccgttgtaattgtgcatcggctaatttcggttgatgcactgtcgcagtgtctaccgcacttgtcgccgtgaccactggattgctaaaaacagctcgccattttggtgacgtatcaacaactgtgatctcagcataacgaaaactatagcgtcgtggtaacgtcagcgtggttggcagcacatctaagtgaacagtttcttcttgaatccaagatttgctcaaccaaccgtcgtaatcttcactcttgcgtgctaattctgcaggcatttcagcaaacttaatcttaaaacatagtggtgcatccattggtgaaccaacagcgttaatattaatactaaattgaccaacctgatgatcgccaaaatctatgataatttggtcgtcacgtttcaactcataacttgataatcgttcaataggtgcaatttgtttaacaccccatccttcaaggtattgcgtatcacgctcgagcgccacaatcgatgccgccttaacttgggtttctttcagtattggccgatagcttgccgacttgtctaataatgcttgattatgccgaaattgaacatcattattgatttgaaaagtaaacgccatctcttccactcgctttctaaatactttgtttaaaagttattaataccatgtttcttttccaatcgcatcattgtcagccctgctacaaagctaataaagacaatggcagcgaacccaaacatcgtgttacgaattgctgatggcacaactaacgcaggtgtaattaaggcaaataggccacaacatacccgtgaaaagccattaataaatccttgaactgatgcccgaacttcaactggaaatgcttcctgtgtccaaactttatacatcgcttcaccagcaatattattcccaatgttgtaacagccaatcgtgatgacaattggccataacgaatgactactcattgctagtccgagcattgccaaaaattgaacggtaatcccaactaagaagaacttattacgatacttacccccagcgactgatgcaaaagccatggttgccaacaacgagataaagtttaggactatcccagcaccagttgcgaaactttgactcgcatgtgcttgaaccagcgtaaacgtttgaaactgtccgaacgtattggccagtagattccagcaaacatagaagattaaaatactgaagaagaatgccataaagcgtcccttgttggcaccagcgaagaccgtcttaatcgagaccttctctgttgtctgtgaagctgcttcgcgatcaatacgccgttgttcaccttcttcatgaaatgctcggaacttagttgaaaaagtccgccatgcccaagtaatcaaggcaaaaattgctaaaatcgaaaaaacaatccgagcaccggaagcaccggccattttagaaacaataaaggcacaaacataagacatgaaaaccccaatttgccagaagatttgcgtcgacgatactaaactagccgaggtcttatcatccggtgcatcatgcgaaactacggttaaactaattggtaaatcagcacccgaagctaacccggtaatgatgacgccaatcaaaagcatgatataattattcgagaaaacacagatcaaggcgccaattgcataaatcaggtttaaccaattaaacgatttaactagaccaaaagattttgttatctgtcctgctaataaggatccaattgcaattgcaaaagttagtgcacctgaaataataccaacttgactgttagtaagacctagtccgttctgccacactgtaatagtcgcggataagccaacgataattcctgatcctagaattgaaccaattcctgcagctactgctaatggccgatatttttttaccattgaagttgacgtctcgccgttattcatatgaagaacctccctttatttatacgaatattgtaagcgattactgtaaggggtaccatatctcgactacatgaatgatcgtgcaaaatcacaggttccactaaacgataaatattaaagaaagttagtattaatgactagtaaatttctcaattacgaattatttgctctgacaccggttgagctaaagcaacgccaatcacatggtaacgttaactacatggacttagattatgtgaataatccgattccccagatgccccgctcagatttttttaagcacggtgatattgctgttaccaaaaataatcgcttttcctatgttccagctcacacgcatagctttattgagcttaattatatgtatgctggcacttgtactcagtatattaatggcgaaaaagtgaccctccatcagcacaacctaattttgatggataaagacattgttcagcaaattgaatcaacgggcagtaatgatattttgattaacatcttgctcaagaatgactcaacgatgaaccaacttttcgactatattgccgtttcaaccaatgaaatcactcaatttttatataatgcatcccacatcaatacgttgcacaacaactttattctgtttgacttaacacaccaagaagttgccatcaatctagttgaaagtttaattatcaagggccttacaaagagccgccaacgtaataaatcaatgggcctgctgctatctacattaattcttgaattatcgcaatcgattgagcaagaatacattaacttttctgacaatacggacgacaatcttttgccaatcattcagtacatcaatcagaatttcgccagcgtgacattacgtgatgtcagcgccaagttctcttataatacgaattatctgggtaacaaattaaaagaagcgacaggcaagacctttaaagaacttgttgaccgccgccgaatttctgctgcccaaaacctgatgatcaagactaactgtacactcgctgacatttgcgacatcatcggatatcaaaacacctcatcactctttcgtctgtttaaaaaatacctaaagaccaccccatccgaatataaacgaaaagttagtggcccactcaagcagtaaaattgaccgctgcaacaaacgtcatatatctcactaaactaaaacaacaagtgcactcagattagaaattcccgagtgcacttgttgttttactttaagaccattcttagtatcacgactaacaataattgatctatttggttagtacttccaggaacacctgtgccatcatcttgaattaacgcttgcatgtaagcatcctgctgtgcctgggtatagttgatgtcaaaaccatgctgccaagccaaaacctcagtaaacagccgcgtcgtgcggccattaccttcccgaaacggatgaaacatgttgatttcggtgacaacttgccctaacgcctgtgcaacttgttcccggtcatccggtaacagcgcaaaattatcgagttggcgttgaatatctatctcagcattaccaaataaagccaccgggtgaaaaaacgtcactacgccattcgcggtcttgttgaaatcaacttcgcgatagtgaccggcccagtcgtaaatttcaccgagcaaaaacccattgatcaattttagctctccaatttgacgtcctgtcaattgatgagagtctggcagaagatagtgattgcgggataattgctgttgccgttgcgtactcactttgtactcatttttctgcaaagtagccgcttcagtaatgcctaagcgatttttcaaagtaccgtttggttgtaggtagtccgcccatacctttctcattcggctttacgattggtcgaagtacgtattcttgctagcatctcttgtgcgctaatcgggccttcgtcatagaaacgacgagcgtcttgaacatcttccttagtcggctcaaaaccctcatacatattgctgataattgcattcatggtcgcccggtattcctcttgattccgaaactgcacacccatgatggtgaacttctgatcatcgtgttctaaatacataatcgtattctcctcctcgaggtttgtcagtgcggtatacaccgcatcgtccgtagccaaaatctgaatcaaacgtaccgcggtgccacttggttggtagtccgcttgttcccagtgctgtaccgttctaaccgatgtgttgagtaactttgccagctttgcctgactaatttggtaatgttgccgaatctccttaaggattgtggcagttgttttcattttcatcacctcactcacaattatacccttgaagggtacaattgtcgttattatggcctcacaccttagcaaaacagaccaactaatcagaaagtagtagcatgaccaatcaacccattcacgtgcgctattcaataccaaccagtgcccatcaaagtcatgcaccactttttaacaatcgggtggcacattaattaattacgatatttctgccaaatttcacgaacactcgatgatttcatttggtgctttcacgttctaccaacgtcgttcccagttcaatgcgctgggctgcttgacgatcatcttggaatcggctcaccaacaaatcgatggccgtctttcccatcagttcagtctcaacattgaccgagctaatctctggatacacatattcggccagcgtcgtgttattgaaactaaacaacttgacccgctgtggcacagcaatatcagcttgctgtaacgctttgagcgcaccggctgccatcggatcattagcgataaagaaagcgtgtggtaagcggtcacctaacatttcaatggcccgtttcatcatcagataaccagattgactagtgtaatcaccagctaatacatactcagcatgataggcatgatgccgctgcaacgcctgttcaaagctttgctgacgttgattgggaatctccacctgctgatcagtggaccactctttgccataaatcataccgatatctcggataccacgccgccaaaaataatcaacgacgcggttagtagcaaacgtaaaatcagtcaccacactgctgaatccctgagcaaagtgatcgtcatcaacaaaaacaagctggcttgacaaacgactcaactgttgtacttggacagggctaaattttcccaccgccacgattgcatcaatatcatcgccaacctgatctaaattattctggaagatactagtcgtcgtaaaaccacacacttgagcttgatgctcaattcctttacgaatcgctaaataatataagtcatcatgttcttgaatcttagagtaccactgaatcacagcgatatttttccgcattagcgcctttatatgctgacgtttacgcttactgtaccgcagctcgccagcaatcgtaaacacgcgcttgcgtgtctgctcgctcactgatagtgtcttgtcataatttaagacccgcgataccgtcgccaatgagacatctgctcgttgcgcaatatcttttaacgttacggccatcgtcattcctcttttctcttaattaattagcactgaataacaaacgtggggcaactgggcgtgacactattcaccaatcatgactcatcggtaaatcgcgtctgcaacaccccgttgccccacgtcttcatttgattaacaacttaatcgtgcattgctgcgacaaaacgatcaaaggctgcctcaccagcgtcatcccacttaaagaccccagcatcggccagaacccgggcaaagacgttgccgaccgccgtatcaatgacagtcgtcacattgtcagcggtgatggtattagtggccttcaattgatcagcccatgcttgatgcatcgcgaccatttgattaggctgatccaacaagtatttgccgacttcagctaattcggtcttcaaccgggctggtaaaatggcccggcccatcacttcaatcaaaccaatattttccttcttgatatgttgaacatcctgatgtggatggaagatgccatctggaaattcagcagacgtctgattatcacgcaaaacgatatctaatacgtagtcatcgccaactttgcgtgcaatcggtgtcgttgtgtgatgacgtgtgccatccgtataagcacgaacatccacactctcgtccgaataattcttccacgtctcatgaatcttcacagcggcatccgttaatgcaaccaagtcctgactcgtcagccgaatcgtcgacattggccatttaacaatcccagccttaacacccgcgatacctaagtcaatcgtgcgtgcaattggcgctttcatcattggaaattcgtgccgaccaccttggtaatgctcgtgtgacagcattgaaccaccaacaattggcaagtccgcattactgcccacaaagtaatgtggaaattgctgaacaatttcaagtaagttggtaaaagtttgccggttaatgaccattggccggtgctcttgatccaagaaaatcgagtgttcattaaagtaagcatatggagaatattggaaaccccaagtattgccaccaagtgttaaccgaataattcggtgattgctccgtgctgggtaaccgagccggcctagatagccttcattctgcatacatagttggcaaagtggatagccatcttgcggttggttacgcgctgccgcaatcgctttaggatccttttcaggctttgataagttgatggtaatctctaagtcaccaaatggcgtttttgctggaaagaccacgtttttcgcaatggcccgcgtcttgatataatcattagctttgcttaagttaaagaaatagtcggttgccgtttgcggactaacctgatacttatcccaaaaacgttggtttaatacggatggtaacggggtcacaagatccatcaattgatccgctaagatatcttcatccgattgggtcgcttcgatcttgccattttgaatcgccgttttaaccaaggcatcggttaaacttgttaattggtcatcgcttgccgcaatcggatcaccctcgccgaccaaaccaagaacccggttatgcacatagattcgatctaattcagtatattgcgaaggcgacgcgatcaccgccgtgacaaattgatccaaactcgtcattatgcttggcctccccgatcatcatagccggccggatgactttctttccaagtccaagccgtcttgataatttctttcacatcatcatactgaggtgtccaacctaaaacagtacgtgccttgtcgctagctgcaaccaatgtgcttggatcaccagcgcggcgtggtgccatgattgctggaattggcttaccagtgacttcacgagcagcgtccaacatttgtttgttggagaagccagttgaagaacccaagttaaacgcatcactatcgtgcccctgctttaggtattccaaggctaagatatgtgcatcagctaaatcgacaacgtgaacatagtcccgaacattggtcccgtctggagtgggatagtcgtcaccgaagatttgtaattgatcccgttcaccagcagctacttgtaaaataattgggacgagatgcgtttctggtgcgtgatcttcgccgatgctgccgtcaggcttagcccccgccacgttgaagtaacgtaaggccacgaacttaatcccgtaagccacatctgaccagtgcatgatcttttccatcgctaatttactttcgccgtatgggttagttggcacttgtgggtccgattccttgattggcacctgcttaggttcaccataagttgctgcggtcgatgagaagacgattttcttcacatcgtgcttagccatcacttcgagcaacttaaccatccctgccgtgttgttatcaaagtacttgagcggatccttcatcgattcaggaacaactgagaaagctgcaaaatgaatgacaccttcaacgttttcttggtcaaacacggtattcatgaacaccgtatcccggacatcaccttcataaaaacgcgcgtgttcattgactgctgcccggtgccccgtgaccaagttatcaacaaccgccacgtcatacccctttgcaaccaaccgatcaactgcgtgtgaaccgatgtagccggcaccacctaaaactaaaactgccattctaattcctcctcaatatttctcaatgcttactgctaatttgtattttaaatcaattcttttattaaagttccttagggccgtctgcgatttcagcaatgtagaaatcagcgtcgtaaccaatcgtgtcgcgataaactttaccgacgttttccttaaaggcatcgacttggtccttatcaacgatggcaataccacagccaccaaagccagcaccagtcatccgcgcaccaagcacgcctggttgtttccaagctgtttcggccaacgtatccaattctttcccagtcacttcatagtcaaagtgtagtgaaacgtgggaagccgtcactaattcgccaaaggtcgttaaatcatcgtcagccaaggccttagttgcgcgaatggcccgttgattttcgaaaacggcatgccgggcacgtttgattaaggtttcatcattgattaagtaggccgcttcgtcaaactggtcgttagttaaatcgccaagtgatttgatgtctaacttagtttgtaatcggcgtaatgcttcttcacattcggagcggcgttcattatattttgaatccgccaattcgcgccgtttgttcgtattcatgataacgattacgttgttgcctaactttacgggtgcataagaatagtccatggtgttggtatcaagtaaaattgcttggtcctttttacccattccaacagcaaattgatccatgatcccggagttaacaccaacatagttgttttcgcacttttgaccaatcttaacaagatctaattggctaataccgagattaaaaccagtgtttaacatgattccagttaataactcaattgacgcagatgatgataatccagcaccatcaggcatgttgccatggacgtagaaatcaaaaccatgatcgaatttaacgccggtcttcgcgatttcgtccatcattcccttaggataatttgtccaaccagcggctttgtcatatgaaaggtcgttgacatcaaacgtgacgatcccagcatctggaatattagctgagtacatccgcactgtcgtatctgtccggggtgcataaacaccatatgtcccgattgtaatcgcacatgggaaaacatggcccccgttataatcagtatgttcaccgatcaagttgattcgaccaggtgagaaaaagacccgttctggcttggtatcaaaggcttcggtaaactcctgttttaagtcgctagtattcatgaaaaatccctccgtaaatagttttactaaaattttattagtttgactataatgctttttttgattgttgtcaacaccccataagacctttagaacaagatttggtaacgctttacaaatttatcacgctatcgattcaaattcttcttatcgcccgttgtcgttgtcagtagttgttgtcatttagttaaaatttaactaaaacgacatatacaaatttaatattttgttttatgataattgtaagcgtttttatttatgtaactttgaaaggagcttcctcatgcaagctaatcttcaatggttagatgacccagaagtcttccgggtcaaccaattacccgcacatagtgatcaccattattatcacgacacagcagaattcaaaacgggtagtcgcttcatcaagagtctcaatggcgcttggcgttttaacttcgccaagacaccggctgaacgcccagttgatttttatcaacccgatttcgatgcaaccgactttgatacgattcaagttcccggtcatattgaactagccggctatggtcaaattcaatacattaacacgctatacccatgggaaggtaaaatttatcgtcgcccaccgtataccctcaatcaagatcaattaacaccaggcctattcagcgacgctgcggacaacaccgtcggctcgtacctcaaaacctttgatctcgacgatgcttttaaaggacaacgtattatcattcagttccaaggggtagaagaagccctgtacgtctggttaaatggccattttattggctacgctgaagatagtttcaccccttcagaatttgatttgacgccgtatattcaggaccaaggtaatgttttagcggttcgggtctacaaacgcagtactgctgcctttattgaagaccaagatatgttccgtttctctggtattttccgtgacgtcaatatactggcggagcctgctagccatattactgatttagacatccgaccagttccaaatgccaatctcaaaagcggtgagctcaacatcactactaaagtaaccggcgaaccagccactttagcgctgaccgttaaagaccatgacgggcgagtactgacgagtcaaacgcaaaccggtagtggcagtgtaacctttgataccatgttattcgaccaactgcacttgtggtcaccacaaacgccgtatctctatcaattgacaattgaagtttacgatgctgatcaccaactcttggaagtcgtcccatatcagtttgggttccggacggtcgagctgcgcgatgacaaagtcatttacgtcaacaataaacggttggtgatcaacggggttaaccggcacgaatggaacgcccacaccggtcgcgttatcagtatggatgatatgcgcgctgatatccaaaccatgttagctaacaatatcaatgccgatcggacctgccattatcctgatcaattaccttggtatcaattatgtgacgaggccggtatctacctaatggccgaaaacaacctcgaatcgcacgggtcatggcaaaagatgggtgctatcgagccttcttacaatgttcctggcgataatccacactggttagcagcggtgatcgaccgggcccgttcaaactacgaatggtttaaaaaccacccatcgatcattttttggtcacttggcaatgaatcgtatgctggcgaagatatcgcggcgatgcaggctttttataaagaacacgatgattcacgactcgtccactacgaaggtgttgtccacacaccagaattaaaagatcgcatttctgatgttgaaagtcggatgtacgaaaagccccaaaatattgtagcttacttggaagataacccaaccaaacctttcctagattgtgaatatatgcatgacatggggaattctctgggcggtatgcaatcatataatgatttgatcgacaagtatccgatgtatcaaggtggctttatttgggactttattgatcaagccctcttcgttcatgacccaattaccgaccaagacgtgctccggtatggcggtgatttcgacgaacgccactccgattatgaattctccggtgacggcttaatgtttgccgaccggacaccaaaaccagcaatgcaagaggtgaaatattattatggcttacacaaataatcaactacacgttatttacggcgacgggagtttaggactacagggggctaatttccactacctctttagctacgaacgtggcggacttgaatcactcgtcgtcaacgataaagagtggctctatcgtacacccacgcccatcttttggcgggcgacaaccgataatgatcacggtagcggcttttcagtcaaatccgcacagtggtacgcggccgataagttctcaacttgtcaagatatcgaattgacggttgacgaccaaccagtcacaccgttaccaatcgcgccactcaataacaaatacacggatcacgaaatcgccacgaaagtttcactggcttaccacttcgttaccacgaccgttcctagtaccatcgtcacagtgacttatacggtgacagcagacggtcagatcaatatcgccacccattatagcggtcagtctgatttgccagagctacccgcatttggtctgcggtttatcatgccaactaccgcgaccggcttcgactataccggtttgtccggtgagacttatcctgaccggctggctggcgcaacgcacggacaattccacgttgacagtctgccagtcacaccatacttggtcccacaagaatgcggcatgcacatgcaaactgaacaagtgacagtaacgcgatcaacaacacaaaataacgctgaccacgacaacacaccattcagtttgacatttagccaagccgatgcaccattcgccttcagctgccttccctataccgccgctgaactagaaaacgcaacgcacatggaagaattaccattagcacggcgaacggtcttatcaatctacggtgccgttcgtggggtcggtggcattgatagttggggaacagacgtagaatccccatatcatatccccgctgatcaagacattgacttcagctttaatattcatttctaaaagttattttgatttcaaaagaacgctccggcgagttatttgccagagcgttcttttagattaacgatgattaagttttaatatgtttaatggctgagcttagtccttagccttgaagtaatgtacctgcgccgtaaagtcactagtttgaacgggagtcgtgtagagtcctagttgcatcaattcatcgccaccgtacattttgtttgtgtcggtctcaacgtaggtctgctgagggtctaatcccgctaacttcgtaatatgcggttctggttgaactgcacctaaaataacgaaggtgagcagcaaggcttctttctgatccggactaacaaacatccacgccaccgtattagattcaaacgggctctctaatcgataaaaggtcccgtattgaactaactcacggtgctgcttatagaaggcaacctgtcttttaacggcctgcttgtccgcatcacttagttgggccgcgtccagttcatagcccaaggtaccactcattgccacagcaccacgcatcttcatcgacgtcgaccgtcctaacaattcatccgggctcgtcccaacatgggcggtaattgcagaaattggataaacgagtgaagtcccatattgaattttgagccgttcaatcgggtcattattatctgatggccaactctgtggcatataatacattaaaccagcatcaaagcggccaccaccgccagagcagccttcaaataagatctgtggatagcgttttgttaaacgctccatcaagtcatatacacctaagataaagcggtggctagtctcaccttcatgagttgaatcgctatgtggcgaatagacttccgttaaattgcggttcatatcccacttgatataatcaatgggcaccttatcaagaactgcggtcatttgttcaaaaatattgtcgacaacatccggctggctgaaatcaagcacgtattcgttccgcgataacgttcggccacgatctggtacgcctaacacccaatcaggatgggcccgataaagatcggaatcggctgaaatattttctggctcgaaccaaagtccgaaccgcatccctttatcatgggtccgtttgctaatatccgctaagcctcctggtaacttgttccgattaacaaaccagtcacctagcgaactattatcatcatttcgatgaccgaaccaaccgtcatccagcacaaacatttcgatacccagtggtgctgcagcatccaagattgattgaatcttgtccgcatcaaagtcaaagtaagtggcttcccaattgttgatcaagatcggccggagatcgtgcttgtaacgactgcgcgccacgcgatcacgcaataaatcatggtaggtttgcgacataccattaagccccgtcgtcgagtataccattgcaacctcgggcgtttggaaactatcaccggccgccaatcgccagtcgaagttatattcattgattcccatagtcaagcgtgtctgaccaattgggtcccgttctaaactaatctggtggttacctgaataaattagcaatgcaccaaggacattgccttgaaattcattagtattcggatcagctagcgccacaaaaggattcatatgatgagaactagcaccccggcgactttcaaactgagttacacctcgatggagccgttcacgactaagctggcgctcacgcgcatagcttccaggtaacgaaatggcatctaatggttgggttggcaggtccatctgcatcgaagccactttttctaagtcgacagcttgctcactgtgattaatcaaccgggcgctacgcgtgataactggccgatcccgataaatcgtgtaggctaattcgagtgtcacgcctaatgtggcatctcgcaacgtcacaatcaaagtttgggcttcatcctcatcttcgacataagtttgtggcaagcccttaagtttcggcttaccggcttccatccggcagtcttgataacgaaaatcaactgttcgagcaccattggccgcgcgaataatcgcggcgggttgccgataatcaccggtattattgccaccgtattcctgtggcaaatcatccttggaatagcttcgatcagtcgtattcggtaaatttcctgagaacccccgatcaatccggggatactgacgctcgccatgataaccccgaacccgtgggccaaagtacaagtgggccaacacgttgcctgtctccacacctagaatatacgagatttgatcgttatgcaggtgaaagacaagttgttcttcatcaatgtcaattaaagtttgctgcaacgttactgccatagtaaaatcttcccttcgctattagctttttctatttcagttcacaaaaagagctattaatggctcgcgtcattaatagctctcctcgtaaagaaactatgcttgatccggtaagccgacattcgataattgtaagacatcttcatcatcttgtacggtggttcctgaatctttaagatacgtaaattcgggcatatctttatagtttgtaataacgaccataacggtatcatccaagccagccttttcaattgctggttgccagaattcaattaattcttgcccttgtgtgacatggtcgcccttctcaacgtactgaacaaatccagttccacgcatcttaacggtaccaatcccaatatgaattagcgttaaaataccggtatcagaacgtaatccgattgcatggcgagtcgggaaggttgcaacaacttcaccatcaaatggtgcgacaacgcgaccatccgttggtttaatggcgaaacctttacccatactaccgtttgcgaaggattcgtcagcaacatctttcaaactgatcagttccccggcaacaggatcttgataaaccgtcgtcttggcatcggcttctgcttcaacttcagcaggagtttcatcggtttccaagtgagttgaccatgttttttcaagttcatcaacgatttgtgcatgcatcttttcatccaacttaaccttcttgaagaagatgaatgtcccaatcaaaatcatagcagcaggtacaccgaacatcattaacttgaagatggcagcgccatggctagtcacatcaccagcagtggcaccagctgtcatcccagcccaaacagcagttaaaccaacgacaccgttagaaatcgcaccgcctaatttatcaagtaaaggccgaacggataaggttaaagattcgtcacgatgaccaaacttcaactgcccatattcaacagaatcactcaaaaccatcaaaacaactaagaaaattaatggttgtggaatgtagaataatacggccgctgttaagatcattggtaatgactgaccagcaaaggcaaacatgatcagtgaaatcatcataataacaactgctaagaagaacactttacgacgactaaacttctttgctaatggtgggaaggccaatacggcaaaaatcccaataatcgcatttagcgaacctaatagtgtaaacttcgaggcgtcacccaaaatataggtgaagtagtaaagttctagtgagttcgtaatggcaatccctgccgtgtagatcccatacatcaatgataaccacatcaattgatcgttacgggctaacactttgaagacttccttgaagctagtcttttcagtgttcttacgcaattcagaatcattttctttggttccaagtgcaacaactaaggcagaaatcaaagcgattgcggcaataatgatcccaaatgccatccaaccacggttgtcaccttgaccactgttagacttaacagaaaacattaagacgattggcataacgataaccccaacgatgttggcaccaatgttagagccaacccgggcgtatgtcgccgtcttttcacgttctgctgagtcaaatgagattgctggaatcattgaccaaaaaccaacatctttaaacgaatagaaaatatccattgtaatgtataaaattgcaaaaataattaaatatagaatggggtttgaggtatttaatccgcctaaactcgtgaataaaagtgctaaaacgacggaacctataattccaccaatgacaatccatggtttaaagtggccccaccgagaattagtattatcaatggcattcccgatcaaaggatcaattgctagttccacgaaccgcaaacctgcaataatcatggtgatccaagcaatcatttgtgttccttgagccccactactcttatcgaacaagtgggaggtcacaaacataataaaataagttgataaagtggcatagaaggcatcgtgcccaaacgccccaaacgaataagcaagtcgcgatgttattttacgacctttactctgctttgtctctgcatccataatctcgcctcacatcttccttgaataatttacaagtttaaatgtaatcgttttcagaagtaatgtcaatgatttttagtaaaatttgttcaaaagttttatctataccgcttttgattaggacctgctaatgcgcctatcgacactgattgcccgctttccaagggcttaagcagtatagtactcattatcttaccaatgatcatcgttttactaatcacggtattaatcagatgctcgggactttgttaactaaattaaacattgtttactcatacgtttacaaaaaaggcgccaggcagaactcgcctgacacctcaactagtattaatttaaccgttcatattggtaccgaatcgtatgcgtcactggtgctcctggacgtaacacaatatcaccaaaatcaggatgattgattgcatcaggaagtgtctgggcttccgtcgctaacgcattatattgatgcgcgtcttccttatcagcatcaaacggattagccgtgaagataataagactattgcgatctgaataaatttttacttggcgcttatcatcagtatccccaacgatagcaattggttctgccgcacttggggcaacttcatacgcatcgtcaaattcaatgccaccattctcagtcttcagctggtctaatgccttttcaactggttgtgcctggttaaagtcatacgctgtgcctttaactgctaatttcttaccagttgggactttttcatcatcaaattccaagtgagctgcactcgtaatctgtaatttttgttgggccaaactggtccgatcatcagttgtgttccaataaacgtgattagttggattaaagagggttgctgcatcagtatcaccggtaaatgcaatggatacttgatcctgattatctaatgtaaacttgatagcgacatccatatttcccgggtaattatcatcactggcgttgatatgcttcttcaaagtcacactgacactatcattggtttggctaaaagcaccttcaaagttcagcgtgttaaaaccatgattcccgccgtgtagcgaatgggtttgttcgttcatatcaacttgataggattgatcatcgattttgaacttagcgccgccaatccggccagcaacccgaccaattgattgacataggcagtatcccactcgttgatagtcagtcatgttatcaaggccccaaatcaagggatgttcaacgccgtcttcattgacgacgaattcttgccacgtcccaccataactaaggaccgagatacgagtttgatggtcattgaccagcgtataacgcattacatcttgaccatctagttggtcaaacaccgtttttttagtttccaaaatcatgcacctccgtgttatttaaaccgctttcatttagaagtataccagaatttcttgaagttgagtaaaacttttagttaaaatactaaaagaacgatctggtttctatcccagatcgcccttcactacttggaacttgctcgctcaaccagattagtacccagctcaacccgttgtgtcgttgttcgccctgctagtcgactgatgaccaaattaactgcggtcgcccccattaactcagtatctacgttaactgcgcttaattcgggataaacgaatgtcgccagcgaagtattgttaaagctaaatagcttcactcgttctggcacctggatgccactagcttgcaacgctttaagcgcacctgccgccatcggatcatttgccacaaaaaaggctcctggtagttgatctcccaacttacgaatggctttttgcatcattttaaacccagattcactagtataatcgcccttaaaaacgaacttaggatcaaacgcatgccgtcgttccatcgcggcccgaaaacctagcatgcgtcgatcaactaccgctaactgatggtcggttgtcatttcttgaccgtgaataaagccaatatgatgaaagttgcgttgccaaaaataatcgacaactttttctgtggccaaccgaaaatcagtaatgacactatcaaaaccagcatcaaactgatcatcatctacgaatactaagttgtcagttactgatgccaagtccttgacttgtggctcgctgaactttccaactgcaatcactgcatctacgtctggtcccaattcttgtaaattattttggaagatccgagtcacttcaaactgattatcttgtccacgacgttcaatccccatccggactgacatataatacaaatcatcttgttccttagattccgaataccattgaacaatagcaagtcgcttacgcgccgtcgtgacagtatgccgtttattttttgaatactgtaatgcttctgctgcatctagaattcgttggcgcgttgtatcactaacagacaatgactgatctttgtttaacacgcgcgataccgttgccaatgatacgccaactttatttgcaatatcttttagcgtcgccgccatgaattggcccccttaaattcaaactaattcttactaccatctaaagtcgctatcgcatgatttatttgcaaattattttaattttcaagtattgcgccgaacttcaacgcataatcgtgataactatcatgtaaaactttatcattaattgtgaaaattggcgaatttaaacactaatttatttagtaaaggcccccctgtgcgtgcaaatctgcaaaattatgttattattaacttaactattaggtacagaaaggccatatcctcggatatggccctttcttttgcggctctataacattgactatagcgaattgtgcaaacgctatgatcgaccagcattccaatcaattgccggttgttcggtaagaatctgttcaatcgttgctaattctgattcactaaatttcaacttttccaatgcagcaacgttattaaccacctgctctggccggctagcaccaatcaagacacttgctaaggctggctgacgtaggttccaagccaaagccatttgagctaagctttgctcccgttgttgcgcgacttcatttaagcgctttaccgtagctagtgtctgttctacctggactggactcaaaaatggaattgtttgcttattggcccgtgaatctgtcgtgattccgtgcagatacttgtccgtcaataacccctgtgatagtgagctaaagccaaccgccgccttatgagttgcttgtagaacggggaacaagtcctgttccacctgtcgattaaacatattatagcgtggttggtgaataatgtatggggttcctaatgattcaaatatcttggtcatagcagccgtctgcttgccattataatttgaaatgcctacatacagtgtcttaccctgccgtactagctgatcaagcgcagtggccgtctcctccattggtgtttcaggatcaggacggtgactataaaaaatatcaaagtagtctaaaccagttcgctgcagactctgatcagcactggcaataatactttttcgtgacccccaattgccgtatggtcccggccacatcacatagcccgctttactagcaatgaccatttcgtcacggtatggccgcatatcggtagccataatacgaccaaaattagtttctgcactgccgggctccgggccatagttattggctaagtcgtagtaggtaattcccaaatcaaaagcttgatgaatgattgccttttgattagcgatcggatcaacgcttccaaaattattccaaagacctagcccgattgctgacagcttcaaaccactattgcctactcgattataaatcatatggtcatagcgcttctggcttgcttgatacatattaaacacccctcgttattcgttcctagctaaagttaccgctttcattagtaaaaagcaacgcctggttttaccatgctacctccgctaagattattgagacatcgaacactctcacttgataatttatatatatcaattacaatatattatgagaatataaacgtaaaggagtacttattatggaccctaaatttattgaagtgatcaaagacacgacccccgcaaccatcgtcacggtcaacgccgcaccagcacacgtcgtcaacacctggagtcattatatgcagcttattgatgatcataccctattgatcccatcggctggcatgcactcaattgaggccgattttgctaccgacaaccacattacaattgctgtcggtagttacaagattcccggcacaactggtactggctgtggtttccacattcatggtaccggcaagtttgaaactagtggcgcttatttcgatcaaatgcatactaagtttgattggattcgcgcgaccctggttgtcacaatcgacgatgtggaacaaaagatttaacaactaaaatctagactaaaagaacgtacacgagttgtgtacgttcttttagtctagacagtagttaattcgtcactgtcttcttagatgctaattcaagcccctctaaaaagtgcccaaagcactgcttcaagaagtgttcactaccgtcatcattcagatgatcgttctcatcaaacttattgccggcttgaggtaacatgaactcgttaccaggcataactttggcatccacaccgggtgagtccaaaatctgtcgtaagttcatctgagcacgtaccgtaccttgaatacctaacgaagtcccaacaatcatcactggtttgtctttgaatggatgttctgcacaggacagccattcaatggcactcttcaaggcagctggaatcgaatgatcatattctggcacgccaaagacgacaccatcagcggcttcaatcttagcggctaacgcttttacacttgccggttcccgatccatatcatcttcattgaatagcggtaaatctttaatttcacaaatttcaaaattaacttgcgtttcaaataattctttcatggcatacaacaacttacggttatatgattttgaagcgttagtccccacaatggccacaatattggcttcgtcatcgcccgcggttgcctgccgctgagcgttttcgctagccgcggcgccggcaacgtaacccgacgaaatcccccaagtattcatcatacttggcattgaatcatgtccgttagcgccgccgatgatttcccccgcaccaaagtaattagctaccggtgcatttttagtcgttaccaattgcaagttatcagcatcaacactatagccacctaaagtcgtcgcaaagcgatcacgttgttcaatgatgtagaatgtttcaccttcaaattggtgcaagtacttcggatcacgaccgaaatcatgatcgtgaccatcttgaacatagccttgataatttttgaccgtttggactaattcatcaaccacaattccggcctgctcagcagcactttccaaagaacccttaacaaatactggccgtttacccttattctcaaagaagctcttaatttcttctggtgtgaaatcatgcaggatcagtaggtcgtaaactttcttccaagtccgttcatccattactaggtaagcaactttatccgcttgtttaaggatggcattccgaaaagtcgtataaacatttgattcgttaacgattcgatcacccttagagttaacgtaaattgcacccatatcagttgcttgtttcgacgcgtacgtggtcaatttagcaacgcctggttccacttcaacaccatgtggatacagcttgtaccaacctaaatcgtgcgtttgcaaatccaaatcaccattaaattgataggcatccccagtggaagtcattgggccataataatcaatgccttcgctttcagtaccacgcatcttttggttagcgccatgaccacctgcagcaagcacaactgaacgtgccttgatgttgactgtttggtccttttgagcagcaatcacaccgcgtaactttttatcgttgtccaacataagcttctcgactcgagtatccaacataatttgaccacccgcagcagcaaacgccttcgaaactttttgaatgaattcatagctacttgctgaaggtagttcaatctgacggttaatcgaatgttctggcgtttgcgtctgtgctttttgataatgtaaatctgcaaacttactaataaaatcaatggctggaccaatgttatgcaccattaggtcggtcaaagctggatagttcgtctccaagctttcacgagcaacatcttgtgccaacatttctggcgtatcatgattattatcaaaaatttgcgcagcaacatcagacccggtaccaacaacgttagaaccattcagaatcgtcgcaccaccaagatagccgttcttttcaactaagataaccttctgacccattgtcaacgctcgacagccagcgactaagcccgcttctccgccaccaataatgagcacgtcggtccgcaagttttgcgtcttgggggcttttttcttaggaactggctgcacatcaacaccagcatcggttacagccttatctgccgacttaagtaacgcttgggtcatcaccgttgcaccactaattgtgtcaacattgaatgattgttccgtaatgatattttgtttcaatttatcaatgacttggttaaagatccccgacgtttcggaatgctttaatattttcaaatcctcaatcttattatcttgcacgtcaacttcataattgataataccgttgtggcccattgcttggccggtaatttgttttttactcaatagtaaacactcctttgcgtcgcggcgttaagccactggtaactgttacctgttgttcatgatcaataaaaattgcttccgtatgtggcaactgttcgattagttgacaaccacggtttggcccttcaaagtaggccaccgttgataacacttcagctaattctgaccgttcagttataatcgacacctgatcaacttgattttcaaccggataaccagttcgcggatcaaggatatggtggtagcggtgattgccaattttaaaatatcgttcgaagatacctgacgtcactaccgttctagcaggcgtttcaacctgtagcgctggatagccacgtggcgcttcgggtgcttgaattccaacttgccaacgccgattatcggttagcggattggcccctaatagcttaacgttaccaccaagattaacaatagcgctggtaatgccagcctgctgtaactgcttaacgacctgatcggcaaaataccccttggcaatcgcaccaagatctaattgcatgccagattgacgcaagtagatactcgattgggcttcatctaggataacttcgtgcgtatctaataaggctaatcgttggctaattcccttggccgctggtacttgatgcccaccaaaaccaatcttccaaagtttaaccaacggtccaattagcacattaaaactatccgcatattgctttgtgtacttaatagcatccgacactagttgaaagcattcagtgctaaccaaaactggatgaataccggcatattgattgatcgcagctaattctgaatcggcacgattgacagaaaagacaccatccatccgctgcaagtaatcatagaccgcttcgaccgctaactgattcggctcaaataatgtcagcgagatgacggttcccatcatcgtaaattgtgaaacatactttttttgtgtcccaatcatcactctgacctcacgatttctttcagttatgctttaatttaacttcagatcttccaattccggccgtaaattttcaagtgcaatttgcccaggtgccgaagccgccccgaccgttgcaaatgataaacaagagccgaacacttcaccagcaagccgtgacacttttcctaagtcacccatcgacattgtgattactggctgtggtagtgtttggcgtgcaatattagtcgctgtcagtaatgttaagacatcctccaccgattgtggcatcacagccatcttagcaacgtcagcaccataatcgaccatactagtaaggcgcttaacgatctcagcaaccgccggcgttttatcaaaatcatgattactcatgatcacaactacttgatgctcatgagctgctgcaacaatttgtttaacagcttgttcgtcatggtaacgctcaacatctaaggcatccgtgaacccaccatctaagaccgtctcacacagtttaaaatactcagtatctgatagtgctaattcgccgccttcacctttagttcggaaagtagttaataaggcaatatcacctaaagcctgacgaagttgctgaccggccgatttcaacttttctggattaattacatccttgaaaaaatcaattcgccattcaacgacatctggctgtgcagctaaaatcggtgtcgtcgctgctaaaatatcattaatcgtcgttcctgtgataggcactgccaacttaggtcgaccactaccaagttcaatatttcgtagctttatcgctggttgcatcttaacttgcctcctgtcatcaattatttatcctgatcatcactaaacagaatctgatgaatgtaatcaactggcatgtcttcgccagtccacagcttaaaggctgctgcaccttgttcaagcatcatacctaaaccattgtaaacatgcttcaatcctgcttgacgagctaccttcattaatttagtcgttcgtggtgcatatactgtatcaaacacaatttggtctgagctgaaccaactaggatcgtccacaagcgtcttatcttcaagtggtttcattccaacacctgtcgaatcagtatagatataagagctttggatttcccgtttgaaatcatcacgatcttctaatgagtgtaaagtggcgtgacagtcggtctgctcattaattagtttaacgttccgttcggcatttgcccatgttgcatcgtgcatattaaaaatagatatttctttgacaccatccaatgcagcctgcactgcgatcgcagtcccggcaccaccagcaccagctagcgtcattttatgttcgcgaatatccaagccttcatccgcgagcgctttcataaatccgatgccatcagtcgtataacctgttaaaacaccatcatcattaacaattgtattaaccgcacccaccattttagctgctggatcaagcttatcaagcaatggaatcactttttgcttgtttggcattgaaatattggagccacgcatatcaagtgttctgattgactcaattgcacttggcagcgtttcattcgtcacttcaaatgctaagtaagcgtaatttagtcctaatttagcaaaagcattgttatgcatagttggggacattgaatgacgaattggatacgccattaaaccaatcagtaaagtatgcccatcaattcgttctgccatgaaaaaccactcctaaatattatttttatctgtttgttactcaattcacttgttatgttagcaaattagcttaatataataaatatggatgagttgtttaaatcatcaaagttatctatgagtaaaggagcattcctcatgaatttaagacatttagtttttttcaaagagctagctcgaacacaacatatggcaaaggctgccgaaaacttaggtatctcacagccttcgttgagttatgccatcaaaaaactcgaacacgaattgggtgttccactttttgaagcagatggccgtaatatcaagttaacatcaattggcggtgtttatttgaaatacgtcactgctactttaaatgatttatcacaaggcaacgaactcgtcaaacaacttatggatccagataccggtcatgttaaattaggatttacctacacccttggacagcaactagttcctgagttactgtcccatttcaaaaatcaaagcgaaaatcaagcaattacttttgagcttggtcaaggaaactccggtgtgctcctgcaagcactagccgatgaaaaatacgacatcgttctagcctctaacgtcgatagactgggtgagcagctaactgcccatctctttgactttatcccactagttcaacaagaaattgttgcagttgttccaaatgatcatcccgcggtacaaaaaaatccgctacacgttgaagacctagcaccttatccaatgatcttattttcacagaatagcggcttgcgaccattaatcgaccaaatcctatcagcagcccacgttcagcccaaggtagcttatgaagtagaagaagatcatactatggctgggtttgttcgttacaatatgggtgttgcgctaatgccctacttaccacttttaaatcccgagcgtgttcaaatcaaacacttagctgatcagccattacaacatcaaatttacttagtcgttcgtcgcagtggttttattacacctgccgtccaccgtttccaagagtttattcgcagttattgttggcaacattacactaatcaagaacgatcaatctaaaaattgcgcctttattgaaggcgcaatttttaattaactttcaacaccggaagcagccgacgtacgtgttgaccgaccaccatgtttcacaatcaatgctaaaccaaccccaattaacgtaatcacaatgttcattagaattatcatccgtggcgcatcagcaccggtaacttttgtcaagtatgccgcagctgataatacagcataattagccacgcttgaggcaatcattacaagggatgtcgctagacctttactatctggaaagaaaccaatggtcgtagaggtcgccaattgtagtaccccaccagcagcagcgtaaccaataacaaaactaccaatatagagaatgactggattattaatgaaataacataacattaacatgacgattgaaatacttggatatagtactaatacggtcgtctctttcagccccatatggataaactgagcagttaataagaccgctaccgttgcaccaaccgcataaaatgattgcaggatactggggtctttgattccgtaactagctcctagctcttgattgcaattcaaccaaatcataaacgtcgctgaactagtaaaaccaattaaaattgatgcaatcgcagctggtgtgaaacgatgcttcggtttgtcagtagtcgttttagcctcagcagttgctttatcttgcttaggaaatggtaaaaccagaactaagattgcatcagcaatcattaaaattccacacccgataaaaatgactcgatatgacatttgagcactagcaaccaaaccaataacgaacggcaatacaaactgagcaaccgttatggcaaactttgtaaatagatttgcaattgaggccgatttaggaaagatttccatcacacttggtgacacacaggtatccaagaacgaattagcaatcccgttaataataccaatagcatacgcccaccacatgctgtgaactgtgatcatcccaaaaaagaatacggcgtacaacgcaattccaatgaaaccactgatacgacgcccaatcctatcagagactggaccagcaaatgggtaagcaatcagccgtcccagaccataggcagcaatgacagaaactaccatactaacatcaatggttccgttagccagcgtggatgcgccccacgcctttgcaaactcagttttatactgtcccattattgaagaggcaattcctaaaataaagtaagcaaagtacaatgccaatgctgttacataatatttacggtttgaatttgtgttacttgtcatcttaacgtcccccatcatctgagaagaaccgttgcgttacttcttcaacgggcatttcttggcctgtgtacaatttgaacgctgcggcaccttgccaaaccagcatccccttaccgccaattgttttgcttccatgttcagctgcatctgctaacatttttgtggtaacaggattataaacagtatctgtcacaactaaatcagaacgaaaaacggtcatatccttaatattagtttgttcaacattcggtgccataccggccttggttgcgttagccaaaatatcactttgtgcaattgcttgtgtcaagacttcctggtcattaatatcgcctacagtaacttggcatgcgggaactttatccatgatcttttgagccgttaactcagcattttgataaaacgagtccttaggattaaagatatgaatcgcctgagcgccatctagtgccatttgaacggcaattgctgtagcagcaccaccagcacctaacaccgtaaggcgctttccctgtgggtcaacaccatgctggcgtagattttcaacatagcccgcaccgtccgtattatgaccaactaacacgccatcattattgacaatcgtattcacagcaccgattaattctgcagctggtgacaattcatcaactaattctgcagcaacctttttacaaggcatcgttacgttagcaccacgcatatttaaaacgcgcattttagttaacgcactggccatttcatcagcctgaatgtcaaaagccaggtatgcatcattaatacctgccttttcaaaactgtagttatacattgctggtgagcctgaatggccaaccggcgagccgaaaaggcctagcatagttgtgtgtccatcaattcgtgcttccatctttttattgcccctttctaatgctgcttagctgcttgacgtgcctcgtaggcttgatattcggccgttggcatagccttacctgtaaagagtgtgtatgctgcatcaccttgccacaataacatgcctttccccggcgctaccgtgcatcctaatgcctcggcgtcttcaattaacttggtctttagggggttgtaaacagtatccgcaacaaccaagtctgaacgtaaatagcttggatcgactaatgattgaccgtccagcggcttcataccaacaatagtagcgttaaccagaatatcagccttctcaatctcagcttttaacttgtcttggtcttctagatgatagacgttaacgtcgacttctggctttgcttccttaatcttcttttgagtgttttcggcattcgcataaaagtcgtcctcacggttaaaaatagccaatgatttagcaccatctaatgcacattgaacttgtagcgccgtagcagcaccaccagcaccaatcacgactagctttttaccagcaatatctacaccgttctctttcagattgcgtacaaaaccaatgccatccgtaatatgacctgtcaacttaccattatcgttaacaatgacattaatagcccccacaatctttgcggccggtgacaactcatcaacaagtgttgcggcaacgcccttacatggcatcgttacgttgctaccgcgaaccttaaataatcgtaatgcatcaatcgcttctggcatttgtgcttttttaacatcaaaagctaaatatgcatagtctaatccttgctcttgaaagctaaagttatacattgccggtgaacctgaatgacctactggagaaccgagtaaggtaaataaaccagtggtacctgaaattcgtttttccataattgttatctcctcttaattaataaagaaagagaccgagacagtcgtcccagtctcatccacgagttcatgtaactgaattaatttctattttttcgctggttgatgatgatcaatcgcgtattgacgacgaccatctggctttggaatcatgtcagaaatcatcatattcaaaccaccatcaacggtcacttcaccaccattagtgtagtcagaacggtcactagccatgaataagaccgtattagcaatatcatccaaagtcccaatgcggcgactagccactaaccgctcacggccctcttcaactttaggatcactgtaaaagttctcagataacggcgtcttaaccagacaaggtaagacacagttactccgaacaccatactgtccccattcagcagccatttgcttagacatcatattaaccgctgctttagttgtactataggccccactatatgtttcaggataacgtgacgctacggttgagatgtgtaccatcgcaccatgtttctgttgaatcatgacgcgaccaaaccgttgtgacattaagaagtaacccgttaagttaacattcaaggcagcttgccattcatccaaacgcaagtcttcaagtggtgagaagcgtaaaatagcagccgtattaactagcacatcgacttcaccaaacttatcagtcacggccttaacagcagcatcaacttcctcttcgttagtcgtattgcacttaacggccaacgtttcaacgccatacttttctgtcaatttctttgcgtacgcttcggttttatccgcaatcatatcaatcaagacaattttggcaccctgcttagcaaactcttcacagaacttggtacccataccaccaacagcacccgtaattgcaacaactttatccgttaatcctaaccaattattattcattaataatcactccttataatcaaatatctaagcttgaactggggcttttaaaatttcaggccacgcttcctttaaaacagacacagtctgcttataggtgtaatccgcaacataatcaatacccttagccatgtattgatcagagattacttcgacaccaatcaccttaggatcaacacctgcatcttttatcatcttgacaaacccagcggtatccaaatcaccagcacctggagccaaccgatcatgcattgattcatcccgtaagatagaatcagcatatggccgagtatatgcatcatcaatttgaattgaaataacccgctttgcttgttcctcggtcaacaagtcatatggttggttggctcgtacccaatgccacatatctagtaacatatatacattgtcacagttggctttttgcataatcttccaagtcttgtccaagttaggtaagccactgtaaggcattggttccaatgcaataattaaatcacccgcccgggctgctaattcttgtaacttctttgctgtatagtcaatatcataatcttccatcaatccggtattaatatgctttacaccaaataattcacacatatggaagcaagcctgttccttatatttttgttcgtatgtgcgcgttgcttcacaccactgaacaatatattcgacttcggtgcaacgaatattatacttatccaaaatagcgagaatatcatcgtccgttaaaccttcgttcaaggcatccacgtaagtttcagcgcgtaacccaatgccatcgtaaccagcagcactagccgctttgcaacgatcttcaaatgtacattgatcaccaagtgtccaggaactaattgtaattggatgtgattttgtcataataatttcctccaaatagtggattcgacacatgcatgttttgtgattcacataatttattttacaagttaaatgtaatcgctatcactcgactcgtccaattgcttttagttggggctatccatagccaaaagttattaattctgttatattaaccgtagttgttaacttttgagtatcaatcgttacccgtcagaatgaacttcgggaggttatttctatcatgaatttggatcatttacgatacttcgtcgcattatcaagaactgaaaactatacacaaactgccaagctgttacatattacacaaccaagtttaactaaagccatacactccttagaagcagaattgaacattgatctctttcaaaaagccggacgtagtgttactttaactcctgctggtaaggttttcgctagtgatgtcgaatccgcactcctactactcgacaaaagtgtgactaatattaaacgttttgatcaacaaaaagcccccattcgtattgccgcactccgaacactaagtattaagtggttgccagatattgcccagcgttttcttcaactaagcccccatgccgctgtccaatttcaattcaacactgatactggcctgtccccagatattctgaacggtttacgtaacaacaaatatgatgttgctttttgctcaaagatggatcactttagcgatatcgagttttttcccgtcgctgaacaaactatggtttgcatcacaccaactacacacccactggcaaaccgctccagtatcaatttggcagaaacattagcctatccccaaatcactttttcgcaacgcagtggacttcatccaattatgcaaaaactatttaacgactgtggcggtcaacccattagtgcatatgccgtagaagaagatcaggccatcgccggtttagtggccagcggttttggaattgccgttgtacctaatatgtctattcttcaaaccatgccagtcaagattattccattgtcatttccaacatggcaacgaattttgtacatgggtacccttaagcaccgtacacctcaacccgctgttgaagagttcatcaccttcgttcgtgatcaaagcaaaacactctctgttaacaatatttaactctgaaccaataaaatcgcattcgattaatagcttctagctatcgattgaatgcgattttgttattagacacttctcgagaccgtgttaaaatttgaagtgaatcaacgattgtgaatttagtatcaattaaaaatattaataattataaaccgtttacttgattgatttttcaacatttatattggatattaaaaatgccatttttgttgcttataacgtttaaaaatgcacactttgtgaaaataagaattggtgggtgatactatggaacttaaagaaaagcaggatataaccatgaaacataagacatatttaccattagctgccggaatttacttaaattatgctattttaggaatggctactattattgtgtctcaatacgggactcaattccaagcactatggcacactgatgttaaagggctctcaactgtcattgcaatgattggaattggccgcttattgacaattctcattgcgggttatctttctgatcgcttggggcgtaagggaactatgttaatcggtatggttgcacaaattctatttcttatgggcctgttctttagtactaatctcatcagtgcttgcatcgctgcactctttatgggcgcaaccaattcctttggtgatacagctagttatccagcactgacagatgctttccaagagcaagctgctagcatgaattcgttagtaaaagcggccatgtctcttgcacaattcgtcctgccgttcattgttgctgctcagccaaacgctcaaatcacactagtcgtcatggtagttgtgatggttttagatatcatcttaattggacttgccagcttcgcaccacaaacattaactcaaaaacacactaaaattagcgacgagcctaaaacaaccattaatcctagtggcaatcagccttcgatgttaattgatggtagtttgctaataattgttggttttacactttcatttacgttttacattttctctcaatacgcaccaaacttcggtagtagcgtcttaaagttggggctaaacagctctaaatcactaatttcatggtatgcaatggcctcactagtatccgtttttattacctcctcattagtaactcgcattaagccaatcaagttgatctttgcttacactctgatttcgttcctagcattactccaaatggtggttatccctagtgctgacggtgctcggttaactgccattgcaattggcttcttcgcagccggaggtatttggcaattaggattaactttactaagccaatactttccagctgagaaaggtaaggtgactggctactatagttttgctactgcactgacattctttgtaggtccattagtctctagcttcatcattgatgacacagctgtcagtgttctacatgttttcgaaatcgatactggcgtgacgctgctcagtcttgtaatcgttatcattttaatgattcgaaatcgcaagttttctatgtaaaacagcacaaaaattagtaaaatggctatagtttgaggaacttgattgctcaatctgtagccattttactattcaataatatcgttaatctcatagtgccaacttcacacctgacaaaccactcaccgactaacacttaccaagatttgaaccaccaccatcaaagtcgccaaaatatccaacacccagctgctccacacatagtagttctccattggccgatatttttggcgggttaccttgagatttttttcatataaccggttgaagaagataaatagccagataaagaaccacagaatcaggcaaaagacgggataaatgaagatattgctcttgattccccacggcgtcagactggtgacagcggttggcacgtagacacgattaggtagcagtggatatgcgataattgccaataatagcggtaataacgctaatcccgtctgccgccacaaattatagtggccgtgctcatctttaacattaaacattgcgccaacctcccttaattaaccagtgcatcgcaaatggtaattgatgattccagagccgccaatcatggtgacccggttgtaactgccattcaaactggtctttaaacacagccgccaactctggcttgaaggcttcatccattgaccgtaacatatcttgatcacccgtcgccattagaacacgtaacgtcccccagtttgtcggttgctgtaccaagtaagacaaatccgctggcgtcccttgcatctgtgctggtgagaaagccagctcaaggtctggcataattgccgattgttccacgtgaaaccttttgagatccgtcaccggtgatagtgccgcgacagccgcaaaccgctgcggataggtaaaggcataacgtaatgccccatagccacccatggagttccccaacaaataattgtcttccggtcgtgccgacaacgggaagatataacgcattcgtgttggtaactcgtgggtcaagtaatcccaatagcgtggaccatggaccatattcgtataaaatccccgccccgtttccggcatgacgaccgctactcggtattgcgttgccagtagttcgatttccgttcgccgtaaccacgacgttgcgtccccacctaagccatgcaacagccacacagttggaagttgctgttcaccactactgtagtctggtaaaatttgtccgaccgcgttcactggttccggcaagataacttggacttgcactgactgtcgtaacacgttggaataaaagttattgctatgaattgacattgtgtgccactcctctctttatgcatcgatcatcgaattcggttaggatctaccgacttggaatcactagttagcgccagcccaaaatagttaggcaacatgtaactaacggtatattccagcgtttcttccccttgaaatacccaccgttcgatcttaatcaccatcgtatccagactcacgtgcaaataatccgcaattcgttgattaggaacgcaggtcgccgcatattcttgctcaaagggctggcgtgataaatcaagctgcgcatgtttcctaattagtgcataaatcgaatgtacggcccgtaacttcttcattgctgtggcaggaatcagcgtcgccaaataccacgactgcgaaaattcaaatggtgcgtgtctaatttcgcgtaatcgctctaaataccaggttgtcgattcagccgtaaacttagcccgtgttggtagtggcgtcgtctgattggccactaagattgcaacctgttcctcatcaacatcgtatgtatgggtatccgtaattcgtaccgcagtcccccgattaaatttggaaacaaagctgcccttaccctgaatacgatagatataaccctgatcggctaacatattcagtacccgcacgactgtcgtggaactgacttgatacttcttccgtagctcactctcactataaaacggatcattctttcgaaaatggttcgtgttcaattccagaatcaaggcgcttaaaatggtttgataaattggttctttacgactcatggctgccccccttattattaacttaatacattaaatgtctatacttaatcaaaatttacccatgtcaattaactaacaacaatgaaagcgttaactatactgttatattatgctatactcactcatgaaatcaagttaatgtgttaactcaaatcaaaaagggaggacttaattcaacactaacttgtcattactaatttgttaaggagatgaatgaattatggataattcacgtacgtggaaagataagacgattgatgtcatgagtaagatcgcagccaaccgttatttacgtgctattcgagacggaatggccgtcattattccagttaccatcgttggctcattctttacgatcgtcacgcaactacctattactgcttggacaaactttattaaaccctatgccgctggtttagcaattccaattaatttttcaatggggtttatggctatttacgccgcgtttgccattgcaggtcggttagctgaagattatcacttcgatcatatttcaaccggggtcgtctcagtgatggtctttctattgttggcagttaaaccaattacgaccaccccagcagctttcaaagcgttaggactaaaggccgctgccaccgtggtgccgctaacacacttcggggctgcggggttatttacagcaatgctcgctgggattctaacggccgaagtgactcggatctgccgcgatcatcacctcgtcatcacattaccagatggagtcccaccggctgttgcagcttcattctcagctttgattcccgcgacttttttaatcgttggtgcttgggtcattcacgttggtttgaactttgacgttaatgctttcctacaatgggtcttcagcccattagcctactttggtcgtgacaatttactttcagttatcgtaccaatcctcttaactgatattgtttggctattcgggattcacggtgctgctttagccaccccaatcttctggccattatggtatccaaacctgaacgataacttagctgccatttccaaaggtgcaactgctgcaacggttcctcacttcatgactgaacaatttttccaatggttcgtctacattggtggtgctggggcaacactgtctctctgtatcttattagcatttttctctaagtccgcttacggtaaaacaattggacgggttaccattatcccaggaatcttcaacatcaacgaacccgttatctttggtgttccaattgtcatgaacccatactttgcaatcccatttgtcctcgcaccgttaaccatggggattatcacttgggctgcaactgttctacatctcgttagtcggacagtagctttagttccatggacattaccaggaccaattggggcgttgatgaccactgcttgggactggcgagcagccgttctatgtattattaatattattgtggccacctttatctattacccattcttcaagatctgggatcgtaaccaattgaaggctgaacaagacgctgctaaagccgatgctgaaaaagcagctcaagcagccgttgccgaataatagcttgcacaaaaatcacacggatttgtcattacggtatgcttaaactaacgactactttcaatgaacatgattgcttatttgctgacaatcggtctgactttagcgccaaccgtaattagccattatgatcatgattctgggaggactgctgcattggccgcagtcctctttgtacatattctaagaaacgagggaaaacgattgaaatctgatattaaccaacttactactgagggtcgtaatcctgccagtaacgacttagacgaaatgtcgatcctggcaattgcccagttaatgaatcaagaagacgctaaagtcagtcaaagcatcacacccgaactaccacaaattgccgctgctattgcccttatcgtcactgcctttaaagctaacggccgcttaatttacatgggcgctggtactagcggtcgcctaggcgttttagacgctgctgaatgtgtcccaacatttggtactgaaccagagatggttcaaggactcattgctggcggggctcaagctatgacggtcgccgttgaaggtgctgaggataatcctaatttaggcgcacaagacttgaaagatctggccttaactgctaatgatgccgtggtcggcctggcagcaagtggtcgcacaccttacgttatcggtgcactggactacgcacaaaaaatcggtgcggcaacgatcagtctagcctgcaataatcaggcactaatcagtcaacacgctcgggttgccatcgaagtaacccccggccctgaagttctcgctggttcaacccgtttgaaagccggcacagcagaaaagatggttcttaacatgctatcgacaatttcgatggccaagatcggcaaagtttaccataacttgatggtggacgttaaaccaactaacgaaaaactcgtgattcgcgcgaaacacatgatcgaactggccaccggcgtttctgccgatgaagccagcgaactattcgctgcagctcatcaaaacgttaagacagcgattgtcatggacttggctggcgtctctgtcagcgacgccgagcagcgtttacagcgcgcacacggtgtcgttcgtgacgcactcgcactgcaatgaggaggtctaaaatgacatatttaattggcgttgactgtggtggcacgcacatcgttggccaaacttggacaacagcccccgagcatctggtccaaagcgttacgggtggccctggtaacgttgtcctagactactctgctgccgttactaacttaaccactgtcttagaccagctcactgccgcaatttcagctagtcagattgggttgattttaatcggaattgctggcattgaaactgctggccgggctgatcaggtccaaaaaaccatcacccaacgttaccacgctaatacccaggtcataagcgatgcaaaactggccctactgaacggtcttgcaggagcagacggcgccttagtgattgccggcacgggttcggtcgtttatggccgccaagccgaaaaatttctgcgcgttggcggctggggttacgttttaggtgacgaaggcagtgcctatgacattagcaagcgggcacttaaacaggttctgacccagactgataacggtcagactagtcaactaacagctcccctattggcacaacttaaagttaccgatattgctgccgccgtccagaaattttacgctcaagatcgacaaactaacgctcaattagcacagttaatcgccaaactggccgagcaacaaaattctgaagccatcacggtattagtcacgtcagcccaagcactggcacaacaagtcgttaccttatatcagcggtttgcagagtcccggccacaacgggtcgccctctctggttccgttttacaacacaatcgcctggtccgcgacacgttaacgacgacagtgcaccagtcaataccaacaattgcatttaacgatattacaactaacaacgcccacgccgtcatctattggcaccggtggactcaggaggaaattaattcatgacaatgcgtcaactaggtttatccatttatcccgatcatagcgactttgaagaaaacgccgcttatctcaaattaggccaacactacggcttcactcgaatttttatgagcatgctggaagtatctggtacggtcgccgaaaccaaagctaagtaccagaaaatcattgacgttggaaatcagttgggttaccaaacgattttggacgtttcaccacggatttttaaacaactaggaatttcctataaagatctaaagtttttcgctgatttacacgtcgccggtattcgactagatgagggtttcgatggcgcgaccgaggcgctgctctcgtataatccgtacggcttgatcatcgaacttaatatgagtaatgacgtcgattatctgaataatattctcagctaccaagcaaacgtcccatttatttatggctgccataatttctatccccaagttggaaccgcactaccttacaactttttcgttaagtgtagcgaacgttttcgtaagttcggcattcactccgccgctttcgtggcaagtcaggttggtacgatggggccatggaacgtcaacgatggtctgccaacattggaagctgatcggcgcttaccaatcgccgtccaggccaagcatctcttcgcttccggactaatcgacgatgtaattatcggtaacgcttatgcgagtgaagccgaactggccgcattatcagcaatcaatcggtaccaagtacaatttcacattgaatttgaagctcagacgaatgcgatcgaaagaaccattgccttgaccccacaacattttcgccgtggcgatattaacccaaatgtcatccgttcaaccatgccccgtgtgacctacaaggaaacgcccaacagtccacacgataatgatgtggaatttcagcgtggcgacgtattagtaggcaacgataacttcggcatttataaaaatgaattgcaaatcgtcttgcaaccccactgtgaaccccgaaagaatcggattggtcggattgcacctgaggaactgttactgcttgactttattaaaccttggagtaaattccggtttgtggattgaatatagtaaaaaatatgttactgattataaaaaagtctatctcgaaattttaataatttcgagatagacttttttagtttaatccaacttatcaaagcaaatttctgaaattcacatgctattttaaactgggtggatgctaacagtatcatttcccatcagttgatcacaccagcggcaagtcagttcttataccacgtaaatccaccgtcattaaccaattaagctagatcttcaccattagatttaatgaccttctgataccagtagaatgaatctttcttatagcgtttcagacttcctttgccggcatcatcctggtcaacataaataaaaccatatcgcttggacatctctgaggtagaaaaactaatcaaatcgattggcccccacatcgtatagcccattagttgtacgccatcctgaactgcagctttcatttgcgcaatatgtttacgtaaatagtcaattcgatacgtatcatgcacttgttgatcagttgttaattgatctagagcgcctagcccattttcaacaacaaataatggcttacgatagcgatcccacatctcattcagtgtcactcgcaaccccaccggatcaatttgccaaccccaatcggattcctcaaggtaaggattacgaccaccagtagccatattaccgttcacttgttcaggcgcatcagcttgagttaccgttgtcatatagtaactaaaactaataaagtcaaccggatacttcgctaaaatcttctgatcatctggtgccatttgaagttgaatatcattctctgcaaaaaaacgattcatgaattctggatattccccccgagcttgaacatccgtgaagaataagttcttatcgtcttccacttgagcagcctgaacatctgcaggattaggtgtcgctgggtaagtttgcattcttgccagcattgacccaatcttagcatccgggtcaatagcatgtaattgtttggtagccagtgcactagcgataaattgatggtgcagcgcttggtaacgtaactgcatctgatcatgcgccgaattctcagtatcaacagctccagtggcatgaaacccccaagttccggtattaatttcattaaaagttaaatagtacggaacgcgacctttaaaatgtttaaaaacaacttcagtaaaccgattaaaatcggcaatggttgcccggctggcccacccattttgcttaagcgttaatccaatgggcatttcataatgtgacagtgtaactaatggttgaatgtgatagcgtcgtaattcatcaatgactctatcatagaaagcaagtccgtctgaatttggcttgagttcatcaccttttggaaataatcgcgaccaagcaatagagaaacgataaactttaaatcccatctcagcaaatagtttgatatcttctttgtaatgatgataaaaatcaacacctcgacgcttaggatacattgtatcagtttgatcatctagcgccgtttgaattgaagatatcgttacatcatccattgacatatgcttgcgatccgtcgtttttttcactacttctgccgttgtcaggcctttacctgcttcattccaggcaccttcaacttgattagctgctgtcgctccgccccacaaaaagtctttagggaacgttttaggataagttggtttatacattagctggtgctccttccatgatctccttaggttgtaattctaaaatccaattatcactagcctccgtcgcatcagttggcttgaccatttgatagtcagccgtattcgtaataatgaccatgacagttgtatcgtaaccagccgttttgatcttatccacatcaaatttagttaataaatcaccacgtttgactacttggttttgcttaaccattgtttcgaagtattgaccatttaattgaaccgtattaataccaatgtgaatcagaatttcagcaccactattggccgtaattccaatcgcatgaccagtgggatatactgccgtaattgtcccatcaacgggcgctgtgaccgtccctttatttggaacaatggctaatcctttgcccattgcttcagacgcaaatacttcgtcatgaacactagtcaatggaataattgtcccttcaaccggagccattactgtgttatcactttgatcacttactactgagtgatcagcctgctgttgacgagcgaatccaaagaagtacgttaagatcgcaccacctaagaatgctacaatcaatccaatgacttcacccataaacccatgtcctagaaaagttggtaccgctaataagctagggagtgtaaatgagctagcgtgcgtaccagcggcgccaataattgcaccaccaagggcaccacccacaacggcacaatagaatggtcgttttaacttaagcgttaccccgtaaatcgtcggttcggtaattccaaacaatgctgtgacaaaagaagaccctgctaatgctttcattttttgatctcgtgacttcaaaaaaacagctaacgcagcaccagcctgtgataatacggccgcactaagaattggtaacaacgggtcataacccatcttagcaatattattcatcatcaacggtacgaacgtccaatgtacaccaaagataacaaagacttgccagaaggcacccatgataacaccagcaccaattggcatgaagttataaattgccataacaccacttgctaatccattaccaatgagtcccccaattgggccgacaactaacagcgtcaatggcaccatgataattaatgaaaagaggggcgtgaaaatattccgaattgccgctggaaatagcttgtccagtactggctctaaatacgacaatacccaaactgccagcagaattgggataaccgttgacgtgtatgttgttggaaccaccggaataccaaagaaatgtagtgttgttgaattcgtcataacagttactaaagttgggtatagcagagctgcaccaagtgacaccgctacaaattggttaaccttcaactgcttagcagcagtaaatgctagaaaaacaggtaaaaagtaaaaaatagcatcaccagcagaataccaaatcttataagccccactagtcgttgacatcaaattaaaagcaaccgctaaagctagcaaccctttcaaaataccagcaccagccaaagcacctaaaaacggcgtaaagattccggagataaaagcaataaaccgattaatgatgttttgcttttcacccgtatcttccgttgtagtagctgcatcagccgccgtatcaggatttgctaatcctgctaaatctgctaaaacggcaaagacctgcgccacagcattaccaataacaacttgatactggcccgcgctttgaacaaccgtaatgacaccatctaagttttcaatcgcctcagtattcgctttgtccgttgactttaagttgaaacgtagtctggtcgcacagtgccatgctttgctaatattatcttttccaccaatattggtaagaattgattgtgctaattctgaataatccatacactttttcctccctttataaaacgacaaaaacccaagtaggcccgttatcaacactaaaaatacaggttgactggttgctacttgggttttgcctaatcgaatagttacaatcccaaaaatattattgattctcgttcaacatccgctgaatgtgcatgattaagtaaatacgctcattcaccgaaacagtctgttccgtcgacttcttcacaaaaacagcgattttttggacacaggcaaaggctcgggggtattgcttagataaatgttcaaataagaaatcatcatctgccccttgggattgatcaggtcgtttcagcgttaaacgctccgcaaaaaagcgtagatgaactaaaaatcgttgcaaactaacactctcatctggcatcgttaatgacagctgatacttaacaatattcaaaatatcattaatcaacttagtcattgcaagtgtttgatcagtgttagagtcagccatactattctcaacaaacttcattgcaataaatccagcttcatcttccaacaacgtcatatcaaaatgctttttaatcagtgccaatgcttgcataccgacttgaaactcacggtgataaattcgcttagtttcccacaagatttcattatgaatatccatctgatggtggtgccgatagacagcaaagtgaatatggtcagtcaatgaaatcaacaaataaacattaaaagtcgtttgcaattgttgttctgccaactcaataatttgcgaagcaacttcaaaatattccggttcaatatctgccatcaagctttggaaattactaatccaattatctccttctggcgtataaatcttagtaatctgttgttgctcaacatcgtcaccagtatgctttttgaacccgattcctttaccaattaagacaacttcccgtccatttttttcagccaataggacgttattattaaaaacctttttgattcgcatgcgcacgctcctcgactctcatacctaaataaagaaaaaaacctaataacccactgcatccgtgctatcaatcacgaatacaatcgattaattaggttttgcccactagctaatgttagcggtaacaatccttatttacaattagctagtatagcggtttcggaaaacgattgcaagcgttaaatgtcaatttctatcatctcagcaatgatatattgctgtcagatatcactaattgcatttcaactacttcaaatatttaattaacgtttcatacgtatcaacattttgtagctgcacattactgagctgtttaagcctagtgtataaataactgaatacctgcccactatctacacgtttttcgttagcaagtactattagaattaagtaaatggggttaccatcaattttcattattccatcaaaagtaatcgcaaagactttatatgcatcactcaattccgtggaggcgtgcggcaacgaaacatggtttaatactaattgatttccggccgcctctcgtgccagcaaggccttactctgatcattggtcaacagtccctgttctgcaaagttcgttaacccggctttcaatgtttggttaacgtttatatatttagtaggagcatgataaaaatgacttttaggcaaaaagctagacaagtttttctgaatataactttcactactcaggcttttaagatgctcaagctcatcgagactaatgacaccattgaatgtactatcaaaattaattggcaattgtaagtcgttaggatgaacgccattgccaataactaaattataattgatataatttagacgtgattctaactgttcctttgaaaataccatctcaatatcaatattggaaattttctgggtaataatcattttattgatatttgctacagattgttgtgttgcatacattaatgtacgtacatttctcgcagttggcgattcaatcgcatgtaaaacatacaacgcaatatattcatcatcaatctgaacgctttcaaaacactgttgcaacttttttgatagatcaaacgcaaagtcaaaagcaaacggattttgaactttcaaataactaatctgttctgacaaagaggcaggtgcaatcgttggaaacattgcgctacgacaaagatgtttaaaaatctcattaacaaaggaatgattaaacgctgcaagtgtataacgagatctggtcgctctaactgccaactgcacttgacgaattgtcatatgattaagcaattgcttcttagcatcaaaaaacactgccagtgtggctgactgcaagtgcgggacaccgcttttgagcaatactttataaagcgtgcttttcattatcacagtattatctttactaattagtgtacaagccataatttgggcacttagttgtgaatcagttaaataatcaaacattttttccggtatttgttgtttaacaatcatccttatcctagcaagatcctctgactgattaattaatttaaaccttttttctactaattgatgatcgtctgaaatcaaagccgctagtatgtcaatctttgaaatatgattgacgcttacagaaattcctattcgtggccgtaatctgatttttaatatctttgcatattgccgatttatcttctcaatacagttcataatactttgtcgcgacatgaatgttcgctcaataagttcgcccatcgtaatattaggagacactagaagatttagcaatactaacacactctcatggttggactgtgtcagtaatcgatttagatttgccctatttaaaacaagaagatgatatttttttacactttcaatcgagccaatactttcactacgaagtaaaccattaattctagcaatatctcgtacaaccgttcgacgtgatgtctctaagagtgctgccaagtcctcaccagataaatcatgctcttgtagtaataaaataattcttaattctcgtgaattcaacataccttacgaacggatcccgtactccattcttttcagtccttcctgcaatttagaaataggacaagcaatattcatacgtaaataatgactgtcaccatatgttgtccccgacatgatcccaactcgacccgtattaacaagtttatcttgtagtttttcagccgttagacccaattgcgagacatccatccaagccaaataagtcgcttcaggctgcttaaatctaatctctggtaactgactttttaagaaagtagatagataatcaaagttattttgcaaatacgttatgagttgtactaaatagtcacttccagtattataagcagccatctgagattcaattccaaggatgctagctgatgataaagcatttttttgctttaattcacataaaaacatctcacgtagttcagcctcaggctcaaataaatatgcgccaatcaacccaggggtattaaaagttttagtagctgaacaacataggaccacattcttagttgtaaattcggttacaggcgtatatgctgccttttgatacacaatgtccttatgaatatcatctgaaattataaagacattatattgttgacatagtgcaactatatgcttcaattcatcatctgaaaagaccttcccggtaggattatgtggattagtcaaaagtaaaatttttgttgctgtttgctttaaaacagctttcaaagtatcccaatcgatactatagtcttgttgtgcactgcccagtctgaccggcgctaacacccgctgattatcctcaatcacatgataaaaggcgtcatacataggagtgaagaccgctacactttctccaacggctgacttcattcgaataaaggtggcaattgaaaaaacaacactgggactatataaaatccaatctgggtttatagtaacttgattttgagagctaaaccaattaataatactatttttgtaatcctcattattccagcgtgtataaccataaataggatgtttaatacgctgttcaagcgcctcttggacgccaacgggaaccggaaagtcagtatctgaaattgaaaatggtagaatgtcagaacgaccaaagcgatcttgaatataatcccactgagtactgtatgtccctctacgatttataaccttattaaaatcatattgcatgtttaccgctcctattttatacaacaataagcaggtgtgttaattattcacacctgctcgtggtcatttcactatgacaggtgataatcacttatttatcgtcaacctgtgctaacttttcttgttcctttttctcacgacgacgtaaccaagccgttttgaaagtaataataaagaatacgttcaataccagaccaattatgacagacaagtaaaaccaataccacggcttctccaaaccaattaacggatcaaaaataccaattccaggtgccatacgctccacatttaacattattgtaatcgccccagtaatcccaccggctaaagtattagccgcaatcatcggcaatggtgctgctaacgcatatggaattgccggttcggtggcaaccgtcataccaacaagaaaagcgctccaacttgcagcccgttcttgctttgtaaagagtttagggcgaatccaagttgaaattgccgcagccatcggtggcaacaaagttacaacccctacaatcccataccagttataaattccagaactgagtaacgaaaaactgaaaaaccatgctgttttattaattggcccccccatatcaaaggcaagcatacaaccaactaggaagccaccacctatcttcatcgacgttggaatattcttcaaaaatgctaacagaatactcattaaccagcccatgaacggccccagtagataatacgtcagtagcccaaaaactagtaatgttacaaaaggaataatcataaaacctaaaatagactgaaagttcttaccaagacgtacttttttaaagtatttaacaaaatacccaacggatagcccaattacaattgcacctaagaaccctgcaccagactgagtacctagcaagtcagtatcattagccaaaaaagttactaagaatgctggtgcaaaagctggcttatccccgattgcaaacgcaatatatgcacccatgattggaatcataaaagtaaatcccagattcccaatactggtgatcacccaagccaacgacggtgatacacctttagctaaaggtgtattcggcattccaaattgaaccatcatgctgccaattgcaatcaataagccaccgccaattacaaatggcaatgcggcggatacacctgccatgagataactcatgataccgtcagtaaccgcatcctgctcactgcccagtttcacttttgaagccgtaaagatttctgcccgatcctcgatattatcgaataacgtatcaatctcttttaatgcttctgatacgggaagttcaacgacccttttgccattaaaacgttgtttgtcctcatcagtcattcctttacctaatgctaagatgacgtagttggcggtagcaatctgttctggtgtcagtttattttcaacaccactggctccctgagtttcaacgtgaaccccataacctaatgatttagccttttcttcgattgcttcagctaccatgtaagtatgcgcaattccagcaggacaattagtaacggccacaatttttagatttgccatatagatttacctacctttctaactgattgcttgattaataatttccaaaacttctcgtgtatcccctcgttttaaaatctctacaaaatcttgatgcactaattttcgacttaactgcgctaacagttttaagtgcacatcgccttcatttgcgggcacaagcaaactaataaacgtattgacgggtttaccgtctaacgactgccattcaatatcagtagtactacgaccgaataaaatagctgcagttttaacattatttgattttgcatgtggtattgcaataccattaccaaatccagtagttgattcttgctcacgctcctgataatctttcactaaagagtcaagatcaacaactaaattcagtgacgtggctaactccgctagactaactaaaatttctgcttgcgtatgtccttccaagctcatattcatattattaattgtaaacattgccatcttgataaagcctcctctttcgttttcaaatttatcgtataagaaaacgctttctttattaatgaacaatatgtcacaataaaagtgacacatctaatacatatcagttactacacgctctagcgcacttttataccactgtaagttaatttgaataatgttctacacacaaattaacggcaccataaaaggcactaccagtctatttattggctggtaatgctttttaaaaatcttatgcgtcgtagtacgcttaatacttattcaagtttaagctaataaaagttttgacgatattatttcttaattaaaagcgaaaaagatagcgctttccgaaaaacgtgtagagcttttaatagatccaaactatctcaactagcttagcgtaatcttcgctactgtatccatcgccgtcacattttccgtcgaattaacttctatgttcgccactttgtccatattagtcacaactgtaatgactgttgcttttttaccagcagcacgaatcgcttcgagatccatagttactagtggcgttcccgctttgactttgtcaccaatcttgattagggcatcaaatggttttccatctaattcgaccgtatctaatccaagatgtaacaacagctccaatccatctgaagttgtcatcatcactgcatgttttgtatcggcaagtgtcttaatttcaccgtcagcgggtgccgtaatagtaccttgcgttggctcaatagcaaaaccatcacccatcattttctgtgcaaaaacctcatcggggacctgcgtaatgggaaccattttcccacttgcaatcgcctttaaatcaagactcactggctttttcttaaacccaaacaatgaactcaccttctaattaaaattttctttaattgcttcgcgtgaagcaaccagttgtttaatatgtcattcataatcattcgtaataaaagtataataaagtaaatccacaacatataattgagccattaaagatgtagtagcagcagcgcgtgctgtttgattttcttcgctgtcatcatttattaagattatatctgctaacttacctagtgtactggttgcatttctactcagcacaatcacagggatattaattgaatgtgccaagttagccagacgaatactttctgatttttcaccagaattagaaattagtaacaacacaacattttgtcgttgcgttgtcatacctaccgctaacaaatgcggatcctgtgaatgaataacagcttttccaatacgaatgaacttttgttcaaaatctgttgccactacattggaggcgcctaacccataaacataaacacttgctttgtcagcaattaattgactagctgcttgtaaggctgcatcatccaatgaacgattagtttcatcaatcgtatgtgtgattcgcaatgctagtttagatttaatagcatccaagctatctttggggttaatttcatcatataacgtttgatcaacggtgctttcagctgacaaccgtagtttcaacgccggatacccaccgtctgggataagtgtcttcccaaatcgcgccaccgtagctgtgctgacgcccgtggctgcagctaattcagcggtactcattttaatcaccgcattagtatggtctaaaatataacggccaatcttttgttcagcttttgaaaaattctctagtctattatgaatcgtaaataagacactcgtcatatggtgccctcccaattacaattactcgattagttagctatgcctcgataacatggccttccttatctttagcaattttagcactacttgggattccaaagaagtaggtcgcaacaaacccaccagcataggctgctaataatccaatcacgtaacctaaccaatgaccgttagcaatcaatggtatcaaagccacgccagaaggaccgattgcagttgcaccaatatttcctagaccaccaataacggcacctccaataccaccaccaatacatgcagtaataaatggtcggccaagcggcaaggttactccatagattaatggttcaccaacacctaacacaccaaccggtaaagcacctttaatcatatttgatagttgcttgttattgcgacaccgaatccataaagccagtgctgcgccaacttgaccggctccagccattgctaaaattggtagaagtggtgtcattcctaatttattaatcatttcaatatgaattggtgtcaaaatttgatgtaatccaaacataaccattggtaagaagagtaaacctaggacaaacccagaaatagcgccaccaacattcaggatccattcaatcgcaccgactaagctattcgaaataacaccagcaatcggcataactaagaagattgtaaagaccccaacaaccaataacgcaatagttggtgtaataatgatatcaattgaatctggaataaccttgtgtagccatttttcaacaatcgccaatacccaaacagcaaagataaccccaataatcccaccttgaccagcagacaacgcttgtccattgaagatgttgtggattggtgcttgcggtgtcacacctgttaacaacgtaacggccccaatcacgccgcctaatccagcggtagccccaaaaaccgttgcactattaataccaacataaataactaagtatgagaacagtccactattaattacttttaatactgttataaaatctgtccagctcttactaatgtctcctgctaacatcatgttagaaagaattgaagcaatcccagatattaacccagcaccaacaaacaccggaattaatggaataaaaatactagaaatggcactcaacactttacgaactggcgtttgtttgattttagctttttgggcagcgtgaacttccttagccttcgcttcaaccatttccttgtcacgttgatgttcagacttagtagccgttgcatcactagtaaacgtgctaggatcaggaaatggctccccgagtccaaccccaacttgcttaaccattacgtctgcaaccttatcaacagttccagggccaacaataacctgtaaggtatcttcttggacaactcccatcacgccatcaatagcctttaatccatccatatcaactaatgagtaatcgcgaattgtcatccgaacacgtgtcatgcaatgaatcaacttctcaatattctgtggcccacctacatgcgcatagatagcatttgcaatccgagtatacttatcttcagccatatgaaacccctcctttaattaactgcttgtcttacaaaaccgttggcatgatctaatcgaacactagcttcagctttgctcatattggtcaaaaccattacaatggccaacttaacgttctgatcagcagtcataaagactttcaccgctgtctcatccgaacagtccgtagcttgaacgataattcttttagcacgttctaccaacttttcattcgttggtttgacgtcaaccatcaagttcttatagaccttaccgattccgaccattgatgcagtcgataacatgttcaaaactaatttttgtgccgtacctgatttcaaccgcgttgagcctgttaatatttccggtccaacttcaacttcaatcggaatttgagcatgctgactaatactagcatcagcgttacaagcaatacttacagttgttgcacctacttcgcatgcataatctaatccaccaatcacgtagggtgttcgaccgcttgctgcaaccccaacaacagtatcatgggacgttaagtgaagatcaaccaggtcttgctgtcccagctcaattgaatcttcggcaccttcaacagccaccgtcattgctgacattccaccagcaataagcccctgtaccatttctgggctagtgccaaatgttggtacgcattcagcggcatctagaacacccaatcggccactagtccccgctcccatataaattaatcgaccgccagctttaaaattagctacaattttatcaacagcacattcaatttgtggcaattctttagacacagccactggtactcgttgatcctcctgattcattaattccagcatttctttaaccgataacatatccagtgccatcgttttttgattacgtgtttcagtcgttaacttttccaaattcattgcttctcatcctttctaataaattggaccgcttgattgctgcctattaatgccaataaagataagtcagtcgtcaccacttgtcccacaacattcactcgcgggtccgcactcaatgactgtttcaagatttctagctcacccatataccgaccataacgcgaattatctacagtaattgttcctaccgggcgttttcttgtctgcatcggtggcattgtctttattttttgtcgcccttcgaccaaacgaattacatcacgggcgacatctggacgattatgccagatatcttggtaaaggcttgccattgaggtttgaatggatagttgcaaaatattatgttggaaatacaatcgaaattgttccagagccgccctgcttaaagcaatgtcgccgatataaactttatccgttgccaactttcctaataaattcaatgttgaggccagtgggtgccggtaacgatcaccttcaagtgtaggtaacccagcaaatacaggcccgcgtaattcctcatccccggctacgaatgccatagtagtgaagccttgttgctttaaccaattatttttactttggtaccactcataatccagtctagtcgcgggacgtggataataattatgccaagcttccaaatgttgaaaattagcatcacactcatgtaatttagcaacatcgctcgcactgatcgtactagcatttagtgcgactggtagctgtcgtgataattgtgcaatctgcgccggattcaagccatcatctactcgcagagctgttagaccaagatctgttaattgctgaatgttattgatatcaatcgatattcgtttcaagccattagcggagacatcagcagtaagtgtcagccccagctgacggcaaactgttcccaactctttcaatcgtggtacataacaactcgcatcatcttctggaatatgcatcgaagtaaaaacaccttcgaagccggcattcctcattgctttcatctgtgcaattctctcgttagtgagcgattcatttaaataaactgaaaatcccagcataacttcctcctgaatgatagcgttttcatcaacaaataaaatataccacctttgtaatttaattacaataaaatcagcaaaaatatattattaaagaaactaaattacttttattctgatttttgacaaaaaaatattaccggccagtactgccagtaatatttttgtatatccattaaattttctatttctttgtcagcccattatgcttaatcacatcttgataccagtagaacgacttcttgggatagcgagctaacgtcccgtggccctgatcatctaggtccacgtaaataaagccataccgcttactcatctcgccagttgatgcactaacaaggtcgatgcaaccccatggtgtgtagcccatcaaatcgacgccatcatcaatggcaccagccatcgcttcaatatgttgcttcaaataatcaatgcgataatcatcttcaacatagaaattcttatcaggtttatcaatcgcacctaggccattttcaaccacaaacaacggtttctgatagcgatcatatagctcatttaacgcaatccgtaacccggttgggtcaatctgccaaccccagtcactcgccttcaaaaatggattcttgacgccgcccatcaggttaccagcaacagtatcggttacactacccgtggtttccaccgcgctcgacatataataactaaacccaatataatcaactggatattgttgtagtaatgccaagtcgccatctgtggtctccagatcatcaaaggtcagattatattcagccagcagtcgcttggtataggtcggataagctccacgtacttgaacatccgcacagaagaagttgaaatcttgattatgctgcaaattagccagctggttaactgggttcgaatcataagcataactagtggcatagagaatcatacagccaacctgaatatcgtctcgcaattcgtgggcgattttgactgccttagcactggccacaaactgattgtgccatgcctgaaaaacgttctttttgtcattagcacccgtcgatggcactaatccttggcccatcaccggaaaatgtgccgcactattgatttcgttgaaggtcatccaatacttaacctttgaagcataacgcgttaagatggtccgcgcgaaagtttcgtagaattcaatcaaataccggttcttccagccaccataccgtttggccaagttcaatggcaattcataatgtgagattgtaatcactggttcaatattattggccaagcattcgtcaatcacatcatcataaaactttaatccggcttcgttaggttgcgtttcatcaccgtttggaaaaattcgtgaccatgcaattgagaaacgataacacttgaaacccatttcggcaaacagtgcaatatcttctttgtaatgatgatagaaatcaataccttcatggttcggataggtgtacttatctgtatcgatcgtccagtcaaaatctggttgactaacgattttaaatcggtctttgccacctggtaacgcatccgcaatcgataagccacgaccaccttcttggtagccaccttctaactggttggcagcagtcgcgccgccccatagaaatccttctgggaactctgacatttaatcaacaccctttctagttagctaataatgatagcccttacaacaagtataatcaatcattggtctgaatatcaattattaataactatcccaaatcttccccattcgaagcaattactttcttataccagtcaaatgagtctttcttcatccgcttcaaactaccattaccttcatcatcttgatcgacatagatgaagccataccgcttagacatttcggatgtaccggcactaatgacatcaatgcaaccccaggtcgtgtagcccatcaaatcaacaccatccttgactgcttctttcatctgttcaatatgttgacgtaagtagtcaatccgataatcatcatgaatcttaccatcggcgctgatttcatcttcggcacccaagccgttctcaacaacgaataatggtacccgatagcgatcccagaactcgttcaaggtaatccgtaaaccaactgggtcaatctgccagccccaggcactggatttcaagtatggatttttaccacccattgataagttaccactggcttgttcaacatcatcagtcgccgaagtaatcgtcgtcatatagtaactaaaacttaagtaatcgaccttgccttcagctaacaattgttcatcgccagctgccatcgttaattcaatcccgttttctgcaaagtaccggttcatatattctggatattcaccacgtacctgtacgtcagtaaagaacaaattcaattgatcttgcaattgggccgcccgaacatcagctggattaggcgtattggcataagtttgcatccgcgcaagcattgagccaatttgggcctcaggatcaatctcgtgacactgcttaactgcaattgcacttgcaacaaactcatgatgtagcgcttggtagcgtaattgcatttgatcatgtaagcttagatcactatcaattgcaccagtaccagtaaatccccaagttgaagcgttaatttcattgaacgttagccagtacttcacaacacccttatagcgtttgaatagcacttcagtatagcgagtgaaatctgcaattgtcttgcgacttgcccagccattattcgttaatgttaggtttaatggcatttcatagtgggaaatggtcactaggggctcaataccatacttgtgacattcagcaaaaacattgtcataaaacttcaaaccagcttcattaggttcagtttcatcacctttaggaaagatccgagcccatgctaaggataggcggtataccttgaagcccatttccgcgaatagcttaatatcttccttgtagtgatgatagaagtcgacgccacggcgcttaggatagagcttatccgtttgatcatcaatggcagcttggacactctctttagtaacctcgttcatcgacattactttgcggtcagtagccttctgaacaacttcagcagttgttaggcccttcccatcaacgttccaacccccttcaacttggttggcagcagtcgcgccgccccacaaaaagttctttggaaagccagttggcattgtttttgaatacataattgaaaactccctttaattagtttaattgtaataatggttcagttgcattaacttccgtagcagctggaaaagccagtttaacgtcatgatagttcttagaattagtcacaaccattggcgttgtaacgggataccctgccgccttaatcgcttcaatatcaaacttcactagcggctgaccagctttgaccgtctcgcccttttgaactagcgtttcaaaacctttgccctctaattcgacagtatccattccaatatgcatcaagatttcagcaccatctgttgtgtttaaaccaacggcatgtccagttgggaacacgagtgctacttcgccgtcagctggagcgtataagacaccatcagttggttcgattgcaacacctttgcccattgcacctgatgagaagacctcatccttaacttcacttagtgggatgatttggcccgtttcggggctacttaacttagtggccacattgtaagtgacgtttggttctactttagttgctgcaccagttggtgtcgtttctactgaaacaccaccggccatgactggatcagccgttgccgcagtttctacgaccttagtttgcttgtcattactatcaacactcttgtaaccaaataacatttgtagggcaaaaccaaggactgcagcaatggccatcgcaataattaagccatatacagagccgtctaccccagttttagaattaatcgcagctgggattgagaataatcccataccgcccatcatatacatttttgtacctgcaaaaccaataataccgccaccaattgaagcggccacacaactcagaataaatgggcgcttacgtggcaatgttaacccataaatggcaggctccgtaacaccgaaaataccggagataaaggctggtaaagcaataccgcgtgtcttttgatttttcgtttgtaatagaatgcctaatacaactccagtttgggcaaacgaagcggctaatgataatcctaaaatagggtcaaagccttgtgaggctaggttggccatcataacagctacgaacccccagtgaacaccaaagataacgaaaacttgccagaaagcacccatcacaagcccagcaacgatcggactgaagttatagattgcaacacatactgttgaaataccatcacttaaccaacttgcaactggtccaataattaaaaaggtaatcggcactgcaattaataacgtaataaatgggactaagaacgtcttaactaccgttggcacgattcgttttgcaaatgcctgaactttagatgcaaaccaaacggccaagataattggaattactgaagaagtatagctcatcatcacaaccggaatacctaagaaagtcgcgtgaatctgtgattcaaagatactaccactgaacaacgtgcttaatactgtcttactgctgttcaaagcgacaatacttggatagcaaagcgccatcccaatcgccattccgacaaattgatcaacatgaaactttttggctgctgtcaatcccaaaacaattggtaggaaatagaagaaaccatcaccgatcgagtagagaatcttgtatgttcctgaattctctgacaaccaattgaacgcgacaaacatcgcaacgaaccctttgatcatcccagccgcacataaaacacctaacatcggcgtaaaaataccagaaatcaaatcgatgaaccggtcaaagatactcatcttttccccgtcttcataatcatcaggtacactaccaccatcggcaaaaccaccgacgcgaatgagcgtttcataaacgtctgcaacttcatttccaatgactacttggtactgaccaccggactgaacaactgtaataacaccatctgtatcttttaattcatcagtatgggtagcgttttcatctttgagcttaaaccgcaaccgggttgtgcagtgaaccacgctcttaacattatccttaccgccaactccggcgataatctttttacttaaatcttcataagccatcattgttcctcctcatttatctataaatcaataattgcaatttgagtaaacaaaaacccaaatgtcctttcttcaaaccacgccactagggccctagtgactgctgctctcaagaaaagatatttgggttaatgcctgcataaccagtaacacaccgttaataatcttatttattcacttttttgtcggtgggtgacgcgccagatgtgaagggtcaaatagactttgtcatccggctctagtcgccagccagccttactttgtaaaaatgtatcgatccgttccactgttgcataggcatgcgcatattttacttgcatcaactgcagtaatgactgatctaattcactgccagttccattactgcggctaacgcgttgcaccattagcgcacgtaaatgcgcaatgaaacgattgtaattgaaggactctgggtccagatgcatctggtattgatattgcacgatatcaatgatgccactgatcaatttcgtgattttaatcgtttcctgcaacttggaaccatctgaaccagcattgatgaaatgataagtcataaaaaccacttcacttttaggaaggatcacgtccgccgtcacattaattaaatcgaccgcttgactggctgcgtgaaactccttaggaaacaattttttaacttcccaacggactgtgccgttatcgacatcgattccatcattggctcgcttcaacgcaaagtcaatgtggtctgcaagcacaaagtactgataatcactaaaactgaccttcaacagcggctccactaggtgaaccacctttgttgtaatcacaaacgattggggttttaaatcttgaaaagcgtcaatatcaacattctgtttcaaagttgccacaaaacgccgctgaattttctgatcatcaatctgatcaccctgatgcttaccaaaacctacgccattaccaattacaatccattcaacatcctgatcgtccaccactaaagcggcattattattgaagttctttagaaatttcaccactcacgcctcctggattttcaaacaaaaaacctacttaaagagtatcacatctcactgaagagactgtgaatacagatatgagtaggtttatgcctgatcgaatcagtaacacgctttaatttatgttatttatactagcaacaattgtaagcggtgtcaaccgcatgtgaatatttttttgtcatacttccatctggtcaattcgctataatccttcatcattcgctacgggcaccttgcaatacatcatattcttttccagccactaccactactaacggtaagccagtgacaagcttaacttgcgttttatcttgatatagttgaacttctagcactcgaccacgaaaacgcaaccgataactaagatgcgttatctgagttggtaaatgattggtaatgtgtaacttaccgtcagcgacatacatcccagcaaatccatacgttaatcccaaccaactgccgcccagatttgcttcatgaagcccatctttggcattgccttgtagatcaaccaaatccattaacgatgtatccatataataactgaacgccttatcatgatcacctagtcggctcgccaaaatactgaaaatcgatcgtgataaagaggaatcatgcgtcgtaattggttcatagtactcgtaatctcgccgcaattgttccagtgattgatcttctggaaacaacatttccgctaataacgtatctgcctgcttgttgacccggtgacgataaatcatgagcgggtgataatgtaacaacaatggatattgcgttgccgccgtcgtcgcaaaaggccataccggcatctttggtgaattatcatcttgtgcagtgacttgttgttcttgatcatacggtaggtacatgttcgtacttgcctttgtgaactgtgcttgctcatcagcatcgccgtcaatataatgattttcaagtaaccaagctgcaaaagccatattttccttagccatccgattcgtgtagtaattattatctaccaaggcggtatattcatccggccccgtcaccttgtataagcagaattgcgaccggccatcacgctgttgccagctaccaaactgcaaccagaaacgtgcggtttccaggacaactgctgcaccttgttctcgcaagaagttctgatcattagtgacatcaaaatataacttaaccgtatgcgcaatgtccgcattgatgtgatattgcgcagtgccagcaggaaaataggcacttgcttcttcaccattaatcgttcgccatgcgtacaatgcgccccgtgtcacacccaagctccgcgcccgctctcgagcttgcggcaagatactaaaccgataatgtaacagttgcttggcaatttgtggctgcgtataaatgaagaacggtaacatatacatctcggtatcccagaaataatggccctcatagcccggtccagtaatccctttagctgcaatgttcgttaacccgttacgaccagctgattgaaataactggaacaagttatattgaatcccagtttgtaactttttatcactaatttgcacttgcgactgttgccaaaagtccgttaaaatctgccgattacgagccacaatatcgttggtccaacccgttatcttatccggcagcgcttgattaatttcactgatttgacgcgtaaacgaccagctcagcgttgtctgtgcttcgatggtaccactgccatgaaaaccggcatgatcgccatatacttcaaagcctgtcggaaagctggtcaaccaatcccgttgcgttatttgttggtgtgttgaagctaccaacgtctgccactctatttgctgctgacgatcagctggtataaattggttggttaacccagattgtcgttgcgccactcgcggatcgtccgcgtccgccgtcgtcgcagttacatcatgaataatcggccgcgtgaaccgcaacgtccccgtataatcaagcgaagtcagttcgtagttcaagaatagttgatgcgaattatccaacgcaatcattgatttaacgaccagttcaaaatgatggtggtcggaggtaacaatctgaaacttttccgttagtacgcccgtatcaaaatcaagcacggcatcgtcgaccgtcatatcccagtcaccaggaatctcagaacttgtcttctcagttgcaaagtctaagtaccgcgggcttgttaatgaaataatcgtttgatgatttttcgcatatccataggcactttctccatatgtgattggattcgtcgcataatagccattgatgagcatcactggtagtgttgcttgttgattacctgtaaacggtactgagtcccgaacacccatgtgaccatcacccaaggcaaaaatcgtctccagatactgccgattcgtcgttgccacatcttttaatgttaacttatcaatttgcatagtctcccccactttcgacttcatttgctgtagtatagcatccgaaataaagcggtttcatcgatttgagaatcactttgctgcttttcgcataaaacaatcgcttagtaccgacaatatactaacgttaatgagaacgtatttaaagtgacggaataatctcgttgtaaccaaaaagcttcgctgacctgacaatcaagttctcgattatcaggtcagcgaagctgaaattatttctcagtacgctttatatagttgcaacactctcacgttcaaccaatgtgactgggactaaccgcgtggcagatttgccaaccaaacaattaacactttcaataccaatctggacaaaattctgggtaacacttgtcaacgcaggagtcgcaatatcgcagatgagcgttccatcaatgctgacaacagaaagcgccccaggtagcttcacattactctcctgagcagccttttgtagtccggccgccgtcatatcactagctgcaacaaccccagtaatgcccagctcttgataagcattaaaaacattataaccagcctgataactataatctccgggttgcacccattcagcttgcccatgaatcgaataattttttaacgccgcttgatacccagcaagccgttgactacctgtatgataatggtcgattccggctaggccaattgtccgatgaccatgcgaaattaaatactttgtcgccaaataggccgcctgataattgtcagagctaacggatttgacgcgttcatctgctagattgatcgaaacaaaacaaaacggtgtctttgattctgttaataattgtaagtctgctttatctggttcaatcgccattaacaaaatacctgaaacagtacgttccaaggcggtcacaattgcttgatgttgtaactcggtattccgattaccagcatatagaataataacctgtaacccgatctcagtcgcgcgctgttgaataccatcaataattccacttgaaaaattcgtcggcgtgacgttgacaataacggcaatcacgtccgtcttctttttaaccaattccatggctagtgtattcttccgatagccgagatccttagcaacttttaaaatacgctcctgagtcttgtcgctatatgtaccctgttttttcgccaacactcgtgacactgtagcaattgaaaagccagttttagcggcaatatctttgattgttggcttcatttttccagctcccctccgatttaaattaattatagcgctaaaagccggtaaaatcattgtcaaaagcgtaaacgtttactttattattaaatcggtattgtaaacgtttacgtcaagtgctagtattgccctgttgaaaagtgattaacttttaaggagatggattctcatgaaccaacctgcagtacacccgaataaaccaatcgctgatgtttccagtaagcctaagacatccactattgctaattcgctgcccaacctcccattaaaaaccatctttgcaattacctttggtttttgtggggttaatatggccttctcattacaatcatcacagatgagtcggattttccaaaccattggcgctgatccgaccaaactaggactcttcttcattctgccaccattggctggattattcgtccaaccactagtcggtaaatactctgatcgaacttggacgcgctttggtcgtagaatgccctacttactattcagcgcaccattagcggcgttggtcatggtgttattaccaaatgctggttcattcggctttggctacgcttcaactgctgcattactatttggtgctattgttattttatttatggatttatcaagtaatgtttgcatgcaaccattccgcatgattattggagatatggttaatgaaaatcagaaggacaaagcatggtcttggcaacaagctttcagtaacctaggaggcgtacttgctactattctaccgttcgtcctaacttactttggtgttgcaaacacggcgcaaaaaggcgttgtccctctttctgtaagaattgcgttttatattggtgccattattttattaggcatctcagcatatactattcatacggttgaggaatatgatcctgacacgtacgcactttatcatcatatcgatcctgaacaacataagcacaccaaacctatttggcaattagtaaaagaagccccgaaagctttctgggaagttgccctcgttcaactatttgcctggattggtattcaatatatgtggacttatactactggtgctatcgccgaaaacgtttggcacacaactaatgctgcttcggctggctatcaagctgccggtaattggtatggaatcttgaccttcattcaatcaatggccgccgttctatatggtttcttagttctttcacggactaatccatacaagcgaaagttttggtatcgctttggcttagctagcttcgcagttggcctcgtttgggtattcttcattcacaaccagtacctattaattgccccattctgtttaatcggtatcggcttctttacggtgcatgtcgagccctttaatatctttacttcttcactagatggtgccaatgaaggctcatatattggaatttttaacggtacgatttgcttgccacaaattctcgcatccgttgccagctttatggtctttaaattcgttggtaattcgatgcctggaatgatgcttattgctggtatctcaatgttcatcgcagtacttgccattagtattattaagcaagacaagcctcaagaagatttgtcagagaatccaactaaataaaagtcattttactaaggagtgttttttaatatgagtgcattaccaagttacacacagaacggccaaacgatcacgtttgctttcgcccaaccattacaattaactattgttacgtcggaaatcatccgcgtctttattaatcgcggtgagcaaggtgaatcctatgcaattgagggtcataaaattcaggcgactgatttcactattgaaagtgctggtgatcattacattatccggacatcagctttaacgattcacctcgattccgaacggcatcttgatacctttgataaagatggcaatgccttgattaccgattatcgtggcgaacgcattcacttgaaaggcgtcgacaaagtccatgaacgattagttgaggcagaaggccattcagtgactaaggcacctactaaatctgatcaaggttactacgaaatcattaaatcgctagcacctgatgaatatctttatggacttggtgacaagaccggatatctgaacaaacgtggttttgcctatgataattggaacgttgataaccccgctccccagctggagatcctacctaatatttacaagtcaatcccagtgatgttggggctaaaaaatggacatccttacggtatcttcttcgacaatacctaccagagccatttagatatgggtaaggaaagcaaccattactacttttattcagctgtccaaggtaacctcgactactacattattggtggtaccacgttaaaagacattgtcaccaattacacctacttaactggtcgaacgccactacctcaaaagtggacgctcggttaccaacaatcacggtggggttacagtgctagtcaagaagaagtgcaagcaattgcagataaccttgcaaagtacgacttaccatgcgatgcgattcactttgacgtcgattacatggatggttatcgggtcttcacctgggacaaggataaataccagggtaatcccaagaagtttattaccaagttgaaccaacagggtctcaaggtcatcccaatcatcgatcccggtgttaaacaagattctgactatcacatttatgccgagggtcttaaaaaaggctatttcgttaaatctgctgacggtgatgtctatattaacaaagtatggccaggtaacgctgcttttccagacttcggtcgtccagaagttcgtcagtggtgggctaacaacggtaaatttttaactgatttaggtgtcgctggtatttggatcgatatgaacgaacccgctacgttcgaaggtccgattccagatgacgtggtctttaatgatcaagacacgccttcaacacataagaagatgcataacgtttatggccataatatggctaaagcaacctatgctggactaaaagagcaaactggcaaccgaccatttgtcatcacacgggcagcttacgccggaactcagaaatactcgactgtttggaccggtgacaaccgcagtatgtggccacatatccaaatgatgatcccacaactctgcaatctaggattaagtggctttagttttactggaactgacattggtggctttgcctcagacacgacatctgaattactgacacggtggattgaaggggcaattttcagtccactgttacggaaccatgcagcattagggactcgccaacaagaaccatgggcatttggcgagccaacgttaaacatttatcgcaagtatctcaaattgcgttatcgtctgattccttatctatacgatttatttgctaaggaaaccaaaactggcttaccaatcatgcgtcccgttgtcttaaactacgatcaggaccctcgtgtacgcgacttgaatgacgaatacatggttggtgacgacatactagttgcccccgttgttcaaaaatctcaatttaagcggttagtttatttaccagctgggaactgggttgatttttggaacggtgctgagtatgccggtaatcaggatattgtagtcgataccccactcgataaactaccattatttgtaaaacaaaacaccattttgccatggggacccgctgttagccacattagcgatgaaccgttgaaagcgatgacgtttagagtatttggtactcaagggacctaccaacactatcaagataatggacgtgactttaagtatcagtcaggtgaatggaacaattacacaattaccgttgatcataacaaggttaatgtgcaactcactcatcacggttatcaaccagtttatcagcagatcacagttgaattgtctgatcatgttgttaaactcacttacgataatgacagtagctgttatcgagaatagtagcttaatattttaatccttaactttaataaacaccttaggataccaatcactcctaaggtgtttattatttcaattactattggatatattaacgtgctcttttcctaaataaacttgtcattaatatcttaatgtctatccagtcgctcaaattaatccccttattcaaaacatgatcatataaaatttggtaaaaatgtattttagtaggtgtttcaagcatctcataactattatgttttctatcaattaaacccaacttaccatcgagcttaacatgataacttatatcatctagtgtcatattaacagcaatgccagccattggaacttactctgaaaacagtgatacataaaagaggaaatcaactgattaacaaactgattaacaaactgattaacaaactgatttcctcttttaaataattttaactattacagtagtggcttttagttaactgcatagtactgtgcttctgatcgtaatggataagaaattaattcagtcgtatccaagtgctcatggcttaaattgacactgttaatttgactattgttataagttctatagtaataaactcccttgtccatatcacaacaagaagaatagattgtatattcgtactttcctttagtgacttcacaaagccctttttgttgttctacagaccctagtatatggaaaaactgactaacactgccagtctctgtctgcatcggcaacgagtttaatttagtaaaagcggctctaacaaatctagacattgaggacaagtctccaggtaatcctagtccgcccattcctctactataactatctaaatccactttttctgaaaaactattttggggcgtgctatttgataacgcacgatagttgttcaaattaaataattggtagtcaaaattaggattgtttgttaacacacctactggattgtcgtaaatttttagtccttctttaacactttcaataactatcgattcctgtttatcagcaaccaaccaatgtagcggtgataatggtaattgttcactaaaattaatattaatcaagtttagtttttgtatgttctttttcacttctctaacacttgaaaattgtcccaataaccaaggaattaattcaaatggtgtgatattaactttatcagcatcatattttttataatcagcataacctgcaaaattcaatcccgcaatacacaatcctttttcattcatcgcatcgtagtaaagtgggtagctttctacatcagcagtaattccaattattgcataatggtgatctaagttctccaccttacgaaatactagtggatattttctaggcgtaatcgtaaccatttcattgtatgaaatttcataatcgaaatttctaccgaagtaattattataagattgataagttatggcagtacacataactagtaatcctcctcaaaaataatatttagatttgataagccaataagcttacatctttttagtataatatcattgctgaaaaaataaagtttttttcatgaaatcatctctaaaataatttaatctattccaaacactttaagagtcaataatcaattgtaacccttatagccgatataacaatgctgttatacctacttatccttatctcgtgattgcttcaatagcctttgcaaccccatcatgttcattatcgacagttatttcatcagccacttgcttcacttcaggaatagcgttgcccatcgctactccatgtcctgcaaacttaatcatgctcaaatcattagcttcatcaccaattgccatcacgttggcagcagtcaaacttaacttttcacagagtacttgcaaagcgttgcccttactaacaccattagtgttggcctcgtaataaaatggtgcacttttcgtgaaagtaacctgctttttcaacggttcaaatagtttttgctgtttaatggcggcgtctaaaacttcaggttcatcaacatacatcgatttaatcagtttaatattccgcatctcttctggcgtccgatatgagatacccattgaaacgagattagcttcatagagtgtataatcaccaatattacggtcggccgtatacagccgatcctcagataccgcgtgaaaatgcaagcgtaacttacgtgctagggcttccaagtcaatataatcttcataactaatcggtcgttcatcaatcagttcgccactagttgtgtaggttgcagcaccgccaaaacaaacaacgtattgatcatcttgagcatcgagttccaactcctgcaacaatgctttaacacctgttaatggccgtcccgtgcagataaccactttaatcttcttttccttcgccattttaatcgcttgcttgactcgcaatgtcacctgcttttttgaattaactagtgtgccatcgatatcaatcgcaatcatcttaatattttccatcatagccatcctcattctttatcgaacacgaaatagaaaccgagcaacgccccgtttctatttcttcaataattattttaatttcagataagtattcacaacattagttacattaaagccatacttatcaagtaccaagtcaccaggtgccgaagtgccgaagcgatccacaccgatcttagcaccatgatcgccagcatactgatcccagccaaatgttgatccagcttcaattgtcacccttcttgtgaccgcgctcggaagcacactagcgcgatattctggtgattgttgcgcaaaccgatcaaaactcggaattgaaacgaccgcgacatcttgattatgctttgctaactgggctttggcctccaatgctaagttaacttcagaaccagtcgcaattagtaaaccatctggtatttctttttgagcagcactgaccacatagccacccttttcaacgccagcaaaggccgtatcaactgatacaggtaaagtcttcaaggcttgtcgactcaataccagaacggttggtttatcagttgttttcagtgcttgctcccacgcagctgaagtctcattaccatcagctggccgaatcacttgtacgttcggcatgcatcgtaaactagctaattgttcaatcggttcgtgggtcggcccatcctcgccgaccgcaattgaatcatgcgttaagacgtagataaccggtgcgtgttgcagtgcggacaaccggactgccgcacgtaagtaatcagtgaagacaaagaatgttcccccgaatacccgagtgccgccatgtaatacaattccgttcatcgcagccgccatgccaaattcacgtacgccgaaccaaatattacgaccatcgtaggattctggttgaaagtctgatgtttccgcaatcattgttttgttcgaactcgacaaatcggctgcgccaccccataagctaggtattactttggcagcagtgttaatcgccttagcgcttgccgcccgactagccaatgcatctgttaattgatagtgtggtaaagtagatttcaagtcatcagaaaattgtccgttgaacgcttgcttaaaagactgcgcctgatctggatacttcgcctcatattcttcaaatagccgtttccattgctgctcagcacgcgcaccattttcctgaatagttacttcaaaccggtctgaaacagctaacggcacttcaaaatccgagtaattccagccatatactttttcagctgctttaatgccatccgcaccaattgggttaccatgaacagcattagtcccttgtttaggtgcgccataaccaatcaccgttttcacttcaatcaaagaaggacgatcagttgtcttttttgcaagttcgattgccgcgtcaattgcatcaagatcattcccatcttcaaccaccagatgctgccagccataagcagtgaacctgtcaccaacattttcagtaaacgcttgcgacgtcttaccatctaatgaaatgccgttcgaatcgtaaagtgcaattaactttcccagcttaagatgcccagctagtgagccagcttcgtgcgaaattccttccattaagtcgccatcaccgacaattgtataagtgtaatgatcaacaattggaaaattaggtcggttatattgggcagctagatgtgcctccgccattgccattccaacggccataccgaatccttgtcccaacggaccagtagttacttcaacgccatcggtatgtccatactctggatgccccggagtccgactgtcccactgccgaaaatgcttgagatcatcaatcgaaacatcatacccggctaaatgtaacaggctatataacatagctgaaccatgccccgcagatagaataaatcgatcacgattgacccaattcatgtgagtcttgggattaatatttaaatgcttcgtccatagtacgtaagccattggtgcagctcccattggtagtcctggatgccccgagttagctttctgaatcgcttcaatactaagtgtacgaatcgtgttaacacctaattcatcaactttatcaaacattccacttacctcctaagccgtcattgcaactatttctgtgccgcctgaaatgctttccaatccgaagcaaaactggctaagcccttatcagtcagtggatgagaccataatttaccgaatactgtggccggaattgtggcaatatcagcaccagccaacgcagcttcttgaacatgttgtggccctcgaacactggcagcgataatttccgtcttgaatccataagtatctaaaacttggcgcaaatccttaactagctgaattccactgccaccaatatcatcaagacgtcctaagaatggtgaaatataagtagcaccagcctttgccgctaataagccttgcgaaactgagaatacaagggtcacattcgtcttaattccttcttcactcagcatcttgactgcttttaagccttcttccgtcatcggaatcttcaccacaatatttgaagcccacttaacttcgttacgagcctgggcaatcatctcttcggccttggttgccgttacctcagcggacactggacctgatacaatctgcgtaatttctttgataacggtttcaaaatcacgaccttcacgtgacaccaacgttggatttgttgttaccccatctactaaaccaagttccgcgaaatgtttaatatcttcagtattcgcagtatctaagaaaaatttcatgattagatttatctcctttattattagttttcataaattattgaaagtagtactcataattactgattacttagttccatcagtcatacgtttagcacgccgggtaagaaaaatactgcaaagaatcacaataattgtaaacaagataattcctgtaataactgctacacttccgtaactccctaattttcctaacaagattcctggaaccaaatagtcggtatctgcaaacgttgaagctgctaatttcaagcttcccaaaactggtaaaataaacaatggcaaccaactaatcaacaaactatttactgtagcgccaatgattgcaccacgccgaccaccagtagaattaccataaattgctgctgcagcaccacagaagaagtgccccactacacctggaataataacagtagttcctagcgcaatcatgataaacatacttagcgtcccaacaatgaaactgacaaagaatcctaataaaactgcatttggtgcgtatgggaaaataattggaacgtctaatgcaggcttagaattaggaaccaacttggtcgcaataccttgaaaagctggcacaatttcggccaaaatcatccgaacaccttgtaaaacaaccacgaaaccggcagcaaatgttcctgcttgtactaatgcataaacaatataattagtcccaccactcaatttcgattcaatgtaagctggacctgtcacaatcgccaaaataatgtagacaatactcatcaaaatcgtaattgaaactgtcgaatcacgcagaaagcccaaactcttagggatttctagatcctctgtagacttttctgcattaccaaaccatttacccatcaatcctgagagcgcatagccaatgttacccgtgtgtcccatagcaacatcatcgccacccgtgattttacgcataaatggttgtgtcaatgctggtgttaccgttaataatgtcccttcaaatagaccaccaagtacaatcgtttgccaacccgtgccaatgttagcgcttaccaatataactgcagttaaacaagaaacatataacattgcttgccctgtcaagaagatatacttaaagcgagtaaaacgagctaataaaatattaacaatcatcccaactaacataattagtgctgttgttgagccgtatttaaccagggcaattgcaacaactgcttcattactaggaacaactccttgcacatgtaacgcaaacttaaacatggaagcaaagggtgacaatgcattttgaagaattccggcaccaccagttaagactaagaaaccggcaaaggtcttaatagttccttgaacaacttccgtacttttctttttttgaagtagtagccctaacatcgcaattagcgctactaaaatagacggttgggtcacaataccaacaaataagttcaaaacagtcttcatgtgattctcctccttttcagcggctaatcatgttcaatattttcttgatccagaattgtattgacatggttccggacttcttgcttatcaatcaagctttttagtaacacaaccttattctcaggaatacttcctaatgcactttgaagtgttgattcaacaaagaagtaatctgctgaatcagcgccaacgctcccaacatcagaatgatccacttggatatcttctttaacattctcgtcctttaaaatactctgaatgttcatctgaaccataaaactacttcccagaccactttgacatacagctaaaaatttcataatagtaccctcctatttttgtaattcttgctcatgtgcaataacttctaaaatatcaacttcactagttgcatttaacatagctgtcaccgccgactcatcggttaacaactccattaactctttaataacggctaaatggctgttattatctaccgcggccaatacgaaccataaattgatggggtgttcatcattaactagactaatgctatgatttgtttttaagatagataatccgatttcatggacgttacccgctggtctagaatgtgcgagtgcgatttgtggtccgatattgatgtacgggccttctgattccaccacattgagcatttccttgatgtatccatcttcaatcgtcttattattaatcaatggttccgcagctaattcaattgcttgcttccaatctagccctatgccttctgatacttgcacagtctttttattcaataaatccaacagcatttttattcatcctcctttcttgatatcgctatttatctgacaatgaccagtataaacttgaataatagcgccacaagtgcaacaatgtttttgagaatagtgcaactttggcactttggtaccttaatgctttaattttttagtagacttaatacagggaggatactgaattgcgtgtaaatttcagcaaacgaaaacatggtaatgaattattagaaattctattgacgtcatcgggctacaccacagctaacttcttacaacaacatctacatatctcacgtcgtagcctattctatctaataaataaagtaaacgatgagcttgatcagcatgcagaatttccgattactaatgttaaaaaactaggatattaccttccaactgacacgatcaaatttctgcataaaatgacagaaaaagaaacttctagcaagatcatgaccaacaatgctaagcaacgccaactactaattgcatttagtatcctcaacactagtggttgctcgttagcggacctaacttaccaatttaatatttctaagaacacagttattagagatatcaaagtactacactcacaactagcgctatatcatttacaaatcaccaatacagaatccggtaaaataatcacgggttccccgacagcagttcgcaaatgggtgtacgatcatgctactcaactgaagacactcattgaacaaactaggcgggctaccattaagcccactaccataaacgaccagattaaactctttgaaagaataactggaaaatatttaaccgacgatgcaagtatcacaattcgactatttttatattggtacttaactaacattagagactgtaataaccaactaagtgatgttatatccgcacaaactgacttaacactggatcacatttgggctaaaagttttttgaacgattatcatatcgataactctaatgaggttgactacttagtcaagttgatcaattctagtcaatttgctcatgtcaattggaatgacgacttgattcaaaagttaaaaccattctcagttcgaatgatttctagttttaaccacctctccggcgcacatgtttcaatcaagtcgattagtgacagtttaacggttcacttgctttcaacctactatcgtgctcaatataatatgccatttgaataccctgacttaaaaagtattcaacagcattatcaccacacttttgaaatcactcgtaaagttgtcgtaccatttgaacaatatattcatcacacactttctgatgatgaaatcgcattaattgccatttactttggtggtgctattcgtgagcaaaaaacaagcaccccaacacaaaatgaagtacttgtcgtttgttctagtggcatcggtaccagtcgtctattacttcaacaactagaaagccgttaccgcggtattcatttttctagtccaatgaatgtgcttcaatacgaaaattcagatctaagtaatgttcagcttgtcatcagtacaatcaaattgaacacccagcgcaacataccaataactaccgtatctgcttttccttccgagttggagtggaagatcatcgataatgctattattaaggctgggttggcaacttctgacacactcaagttatttaatgtggatacactattggatattgtaggcaactacgctatgataagaaatcctatgggtctgaaactcgcactcaacgactatttgacccagctaactcaggaaccactattagccgcaccccaagaaaatttatcagaattaatcaaactactgccgccagaacatgttggttttctaaatcatcaaaaatcttggaagcaggcggtgcgtacagcactgtcccccctacttgaagactatagtgttgaaaaaaattatatcgatcagatcattcatttaactgaaagtaacggaccatacatggttattgggtcaggcgttatgttggcgcacgctgctccacgtgatggcgttaataatctcggtgctactttctttttacttgataagccgctacctgttatgacaaatcaaaaaatggtccatgtaattattggtctagcccccatagattacgagaagcatctatcatttatcagtgacttgatgacacaattacaacaaaaggattggttaactaatctgtatcatttgaataataaaagggacttattcagatatttgtataaagataactagctcgtcttcatttcatttattaatgtatctaaaagcagaagccaagaaacgaaagttgctatcttggcctctgcttttagagttaaaaaggattttttattattaaataatgcgctctttccagtctaatctcatttacttactgaactattccaacgatatcattcggggtcttagcttgatatttcgcattattaaaatcgacattcggtaatgctccccatttagcaactacaaaatcaacgcctgcattctttgaagcctgcatatcaaagatactatcaccaacatacaacgtcctttcacgtgctaagttaaatctctctaatgtgtaggtaatcggctctccacttggctttggatttttagttaaatcagcagtagtcacaattggcatctttgcgataatcggaaaatgactgacttctttatcaaattgaacacgatccttagatgtaaccactcccactgtgagattcattgccaataaatcatctaacatttgttcaactcccacaaaatacgttagttcattcatattctcgttaaattcaattagatatctggctaatacattctgccaattttgaacaccaaattctctcaggatcatctcaccgggctggccaattctcttacgatattcttcaattggcatatcaacaccctcgcgaactgccccctccttcaataacttagcaattaagtccgctgaattaatcaaggtattatcaatatcgaacaagatattttgatacttcataaagaaccccccctgctcccaaaaaagagcactaagacaaatatctcagcgctctaaattaaggaggttataattttaatattctgtcattcaactacaattagtttagtctgctaaatctggatcatcaggattagaggcaatcataactttgagctctttaccggccatcattgcatcaaaagcgtcacgccagtgttcaagatcaaagaccttcgtaatcattgcatcttggttaatagcacccttgctttcaagatgtaaagcaatcgcccaatcatacggattttgtgaccgtgagccacgatacgtaatttcatgctgaataattgaacgttcatctaattcattcatcggctttgcaaaaagaccaacctgttggaaagttccacccttacggatcaatggtaatgcagagttaaccgctggcgttgcacctgaacagtcataaaccttggtaacgccaacgccatctgtcgcatccatcacgaccttggccaagtcttctttttgggtatctacaataatgtcagcacctaactctttagcaatttgtaaacgatcagcatccttagtgatcccagaaacaataacaaaggcaccaatttctttggcaatctgcaatgagagtagccccattggtcctggtcccataattaataaagtgtcgtgtaacgtgaatggtgtcttttgatacatagcatgaacacaagatgctaaaggttccgacattgcagccatcttgtaggaaacgttatctggtaaaatgtgagcactttcctcacgagttagaacataatttgccattgaaccattagctttagttccgattcctacacggttaggacataaattatattctttatcttggcagtaaacacatgtgccatccgttgcaaaagtcgtttcactagtcacccggtcgccaggctttagcgttttaacatctggtcccacttcaacaacttcacctgaaaattcatggcccaaaacaagtggtgtcaccgcattggcatactgacccttaaatgtatgaatatcagtaccgcagatcccagtgtaggccacttttaataaaactttgtctcctgttacttcagggattggaatttgcttcagttccatattgtcgtaaccagattccgtcttaacgacagcctccatagttttagcgccctttaattcgtcagttttagttgtttttacagtatccataatccattttcctttctacggataatcctttaattaaataatggttgtactaactgtgatagtttcaaaattaaccagttcaagatgttaccacccgtatccaagttagtgacctctgatgcgccctttggaaaggcaacaataccgtgcatcattgatgtcaacgttggcccaaagtcagttgccatcaacaatgcaaataccattacgatagtagcagagagtacagagtggacgatatttcctttacgactaggaacaatcaaggcagcaaagaatggaattgttgctaaatcaccgaatggcaatacccggttaccaggtaaaataatggctaagaataacgtaattggtaccattaatagtccagttgccaaagtagctggtgacccggttgaaagagcagcatccattcctaagtaaatcttccggttcccgtacttctcttgaagtaacttttgagcaccttcttgaattggaattaacccttccattaagatcttaaccatacgcggcattaagaacatcacaccacccatggacattccaagcttcaaaatgttcggtacgctgtaaccacctaaggctgctagtaacatcccaatgacaatccccatgaccatgggttcaccaaagaccccaaaccgtttttgaattgtttgtggatccacatcccattttctgattccaggaattttgctgacaacccatccaattggaataccaagtaggccataagccgcagcagaaccagttggaaagctaatgccatccaagccataaaactcagcgacctttggcgcagttttatcagcaataattaagacagcgatttcatagataatcccgcaaagaattgcaaaccaccagtttttcgtcaccacataagccgtagccgcggccgcaatcatatgccagtaattccaaatatcgatatcaagtgttttagtaagatttaacaaaattaagccaacgttaacgactaaaataattggaatcatgatagctgagatcggctgtgcccatgtcccagcagaaacggcaggccatccagcatcaataatcgttaaatgaaacccaaaccgtttaaccatcgcctgcgcagcaggaccaacactagttgtcaacaaattgatgactaggttaatcccaatcataccgataccaacagtaatcccagatgtgagtgccttacccggtttaaccctaaagattaacccaacaataaagataataatgggaagcataacgctggggccgacattaatgatgctttgtacaacatcagataatactttcataatgcatcctcctgcttaaaaccctagctcttaattattgtgcttgaatttcgcgtgctttagtcaagatttcatcctgcaatttatcaacaccaagaccagttaaaaagcccattgctttaatcgctggaatcttatattcagttggtagtacagttgttgaaatcaacatatccgcgtcatcctgcttagaagcagcttcagcaatcttaatttgaatcaaattagcgtcaatattattttcggcaaacaaatcttcaacttttttcataacaaccgttgaagtggcaattccggcaccgcaagctactaatacatttaattttttcataataatctctcctcgtatttcttctatttatcttttatttgcttaacaactgatgaatttggttaaagttctcggcattttccaatgaatttactaatgaatcatcttgaataattcccattaatgcttgcagcatctctaactgagcatgtggtttattcagaccaagcacaaaaactaattttgcatcaaccttttgatctggatcatccatccgactaaaagcaattggagcatcattaacaaccacggcaacaaattctttgttgattgtatccgcgtcagtatgtggaattgcaacacctcgatgttccagttgcaagccagttggaaaagttgattctcgcttgattattttcggtaaaaattgatcagttacaaacccattttcctgtgccttcgcgttaatcgctgtaaataattccttcgacgttttaaaagaggtgtgtagaaaaataagttggtctctcaaataatcacttacttcaacaaggttctcactcaaaataagtcgctcccttcgtatttatataaatgtaatcgctttcaacagttcaaattgtatcattttgcaaatcttttgcaatacttttctttaaaaactttttaaagtgctctttgcaagcgatactttgcaaggaaatttacataaaaaacaccaaattattatattcacaaagtttatataatcagtatgttaagcgcttacaaatctgggacaaaattaattatttcattcactttactaaaaccagatgcaaataaatgcaaaatatatgatattattacaaatagaaaatacttttatattttagggaggttagcccgatggaagtcatgcaacgtcaaaaatatatcctagaccaactaaggcaacaaggaacaatcaaaatcacagatattagtaaagaaattagtgtctctcgcgaaactgttcgtaaagatatttacactttagataaacaggggctagtccaagccattcgtggcggggcaacaacgccacaaagcgtcaatgagaccaagtatggcaaacgacagcatgaagccgttgcggagaagaaagagattgctaccaatgcacttcgacttatccatgacggcgaatccattttcctagattatggcaccacggcatttcaagtcgctgaaaaaatcaaacatagtcaactaactaacttaacagttattactaactcgactttcgttttaaattcgttacagttcgttaaagacattcaattcgttctattaggcggcactatgcgaactagcgaagggtctctatcagggccaattacattagataacattgataatctctatgcagatatcggattttttggctgtggtggcgttgatctgcaagcaggcattaccaaccactacatcgaagaagttgaagtttcaaaaaaaatgatgtcacattgtcggatgaaagttattttggctgatcataccaaattcgaaaaaaacgcactttataaaactacagacattagtaacgtggacgccattatcaccgatgaacaattagatagtcggcttgcgaaacaaattcggttggctgacatctcattgatcagcggtaaataaacaatagaaggacaaacagtcaagggtacttacataccgcttccctgtttgtcctttgatgttaaactgatagatttgccaaatattgcttgactttacaattgaaaccgctatcataataaccgtaatgataaataaaacaaatatttgcaaaggagttgcaaaataatgagtgaagcaattaaatccaaaacagttgattactcttctgatgaatatctaaaacgcgttgatgaatattggcgtgctgctaactacatctcagttggtcaactctatctactaaataacccgttacttcgggaaccactaaaggcgaccgacgtgaaagttcatccaatcggccattggggcacgattgctggtcaaaactttatttatgcccatttaaaccgggcaatcaataagtatggcttgaacatgttctacattgaaggccctggtcatggtggtcaagtaatggtttctaactcctacttagatggcacctatacggaaacgtatcctaaaatcacccaagacaaagctgggatgaaacgcttattcaagcaattctcattcccaggcggggttgcttcccatgccgatcctaagacgcctggttcgatccatgaaggtggcgaacttggctactcaatcctgcatggtgctggtgcagtattagataatccaggtttaattgccgctaccgttgttggtgatggtgaatctgaaactgggccattggcaacttcttggcaagttaacaagttccttaacccaattacagacgggacagtcttaccaatcttgaacttaaacggcttcaagatttctaatccaacagttctttcacgtgaatcacatgaagaacttgaagactactttaaaggtctaggctgggatccacactttgttgaaggtacagaccctgccaagatgcacaaaattatggctgaagaattggataaagtcattgaagaaatccacgcaattcgtaagaacgccaaggataacaatgatgaatctcgtcctaagtggccaatgattgttttccgggcacctaagggctggaccggtcctaagagttgggacggcgaaccaattgaaggttcattccgggctcaccaaattccaattcctgtcgatcgcaatcacatggaacacgccgacaaattagttgactggctcaaatcatacaaaccagaagaattatttgatgaaaatggtactttaaaaccagaaattgccgcaatcatccctgaaggccaagctcgtatggctgctaaccccgttactaacggcggtaagttaactaaagacttaattacaccaaatatcgatgattatgctttggacaacaagagtcacggtaaggaagacggttcagacatgactgaacttggtaagtatatccgtgatttaattgagttgaacaaagacaacaagaacttccgtggctggggtcctgacgaaaccttatctaacaaactaggcgctgcttttgaagataccaaacgtcagtggatggaaccaatccacgaacctaatgatgctttgttagcacctcaaggccggattattgactccatgttgtcagaacacatggatgaagggatgttggaagcttacaatttaaccggacgttacggtttcttcgcaagttatgaatcattcctgcgcgttgtggattcaatgttaacccaacacttcaagtggttacggaattctcacgaagaaaccccttggcgggctgatgtaccttcactgaatgtgattgcatcatcaacagccttccaacaagatcacaatggttactctcaccaagatccaggtatcatttcacacttggctgaaaagaagaccgaatacgttcgtgcctatcttccaggtgatgccaatactttgattgcaacctttgataaggctatccaaagcaaacaattgattaatttaatcattgccagcaagcaccctcgtccacaatggttcacaatggacgaagctaagcgcttagttcgtgatggccttggtgttgttgattgggcaagcactgatcatggtgaagaacccgacgttgtcttcgcaactgccggctctgaaccaacgactgaaagcttagctgccgtatcaatcttgcatgcacgcttccctgaaatgaagattcgcttcattaacgttgttgatcttctgaagctgaagaaagacgaccctcgtggtttatcagatgctgaatttgatgctttcttcactaaggacaaaccagttatctttgcttatcatgcatacgacgacttagtaaagaccatcttcttcgatcgccataaccataacttacacgttcatggttaccgcgaagaaggcgacattacaacgccattcgacatgcgtgttcgcaacgaactcgatcgtttccacttagtcaaagctgccttattagcaacgccagcttatgccgaaaaaggtgcccatgtcattcaagagatgaacagcattttagacaagcatcatgactatatccgtgctgaaggtaccgatattccagaagttgaaaactggaaatggactgcattgaagtagagttttaatcaataattcagcgtaaattaaaagcgactttcaaatgagaattcatttgaaagtcgctttttgcacattattagtattgcgggtaacgctttataatatcaatttctttgcgattcagcgcatgatcagcacacaaaatgattgcagcgctttcagcattatgccgataatgctgactattcttaattgcaaatggcattgcacatcgattagctaatctgatatattgtcccaaaatctccatatcaagacgaccattaaataatagttgataattacgtttctttttcataaccttctcaagaatcgtcgtccaatcataacgcattgcttcactaaacgttattttaagctcgatccgctcataaaaagtacctaagcagcgattttgttcatcaggctttagtaatggcagccctaaaactgcatttttgacacgagcgtcaatgtctaaatctttattttgcattttctcacctcaagaagataagcgactacactaaagatcacatttccaaattacacgttcaataataatcactaatccttctcataattcccgaatcacccgcgctggattaccaccaacaaccacgttatctccaaaggacttggtgaccacactccccgcagcaacaatcacattatttcccaatgtgacccctggacaaataatcgcgccaccgccaacccataaatcatctcctagattcacagacttaccaatacccatggcaccattgcgtcgtaactgagggtcatcaggatgattcacagaataaatttgtactttgggacctaatagacagtgttttccaatcttaatcggggccacatctaaaatcacgcagtcataattagcaaagaaatcttcaccaacgaataggttatacccgtaatcacaacgaaaggtagcatgaacttcaattttattaccagtcgcgccaaataatcgtttaattatttgttggcttttatggggattcgtctcaccgagctgattgaaagcttctacttgttgccgtgctatggctcgctcaccgactagttctgggtcataaacattaaacaactcaccagcaatcattttggccttttcactcttaatcacactaatcactccacttctgattctgaataaaaatggttatggccacaataagtaaccacaaccattttgtgatattcactttactttaagaatgccttagtcatgccaaccatggttgcatagtcttccatttgttcttcagttaacgagaaggacagcatcgtgtggtgaccaccaccagcttgcatccattctagtgcacctttctttaagcccatctttggggtccataattgcttagcaactggtaaattaggtgtttcggcttctggcttattcgcatctaccgcgtagctaatcatcttgaacccatcacggaaatcggcaacggtgacatcaattgcttcaccttctgaaccagtaaatactaggcgagcaggatcatctttacccccaatatccaatggatgaacttcgacccgtggtttatcacttgcgatagacggatcaacttccaacatgtgtgaacctaagatcgcttcatgaccatgacgcaagtctaacgtgtagtcttccataaaggcggtttgcttgttgtgagacataatcttcataacccgtcctaaagcagccgtcttccagtcaccttcagcaccaaaaccatacccatcacgaattaataattgtgaagctagaccaggtaattgctccatcccccaaagatcttcaaagttcgtggtaaaggctgtgtaaccgcctctttctaagaaccgcttaatacccagatattgtgccaattgaacccgaactgaatgtttatacgtgtccgcatcgttatcaccttggaccatttcataccgagactccaagtcagcgtattccttatcaacatcagcatccgaaaccttattgatctcttcaactaagtcactgataccataatagtcaactgtccagcccatcttaatttgagcctcaaccttgtcaccttcagtaacggccacattacgcattgtgtcgccaaagcgagcaaccttaactttaaagctctcattgtacgctacggcgacgtcttcccaacgtgcaatctgctcttgcacatcttcatcgccccaatagccgtaaacaatcttattatgtttctgcaaccgggcgttaatgtaggcatactcgcggtcgccatgggcactttggttaaggttcatgtaatcaaagtcaatgtctgcatatggaatattattcaaatattgcgttgctaagtgtaataatggtttttgtaacagttcagttccacgaatccagttcttagctggtgagaatgtgtgcatccaagtaataacaccggctaccttatcattgtaattaacttctttcataaagttggtgatactttcagccgtcgtcataacatccttaaagactactttataaggtaacttgccgcttgcattcaatttatccgcaatatcttgcgcatccttagcaacagacttcaattgttcttcaccataaaggtgttgtgaaccggtaacaaaccaaaactcataatcaggtactgataacataattaagcactcctcgtctatttgtatgttttttaattcaactaatccttattacttgcgaactgcatgatccttagaatgcgcattattttgaccataataggcacttgcaccatgcttacgtaaataatgcttatctaataaatattgtggtaattcgctacttgcacgggtcaattgcgcagtatgataatcttcttcggcaaccacttccaacactttagcattgtaaacggctttagctggcgttggtccccaagcaaatgggccgtgctggctgactaatgaggctggtacagcttcataatcgaggccccgttcttggaacgtcttcacaatggttttacccgtgttgccttcataatctgcttcaatttcttccttagtcagcgcatccgcggccggcacgtcaccatagaacgtatcagcatgggtcgtgttcatagctggcacatccatttgggcagctgcataggcaactgcccatggcgaatgagtatggacaattccgccaatattaggaaaagcgttatataacaccgtatgagtcggcgtatcactagacggatttagtttaccttcaaccacttcaccctgtaagttaacaacgactaaatcgcttggttttaattcaccataatcaacaccagatggcttgatcacgaataggcctttttcccggtcaatgcccgagacattgccccaggtaaaagtaaccaggcccagcttcggaagctgcatgttagcctcataaacttcttgttttaatgcttctagcattttattaaccctcttctctaatatttgattgcttgcccagccgctgcttcaactggtaagccagcttgataacgttgaataaattcacgatatccggccacccgttccggttctggactcaacgtcatactttctggctctttaaagacttcttgatctaagaaatcttctaggttcattgcagtttgccgacaagcaaagttggctaacactgccatcccccatgggccgccttcaccagcagtactcattacagtaatcggaatgttcagtgcgttggccaatacttgttggccaattaccggcgttcggaacaatccaccctgtgcaatcataacgtccgtttgaacatgttcttcgttaacaagaatatccataccaagttggaggggtgcgaacgccgcatataattgggtcaacataaagttcggtaaactaaatttactgtttggtgtccgtacaaatagcggccgaccagcttgaatcttagtaatattctcaccggattgataactataattagccaaccctccagcatccgcatcagcgcgagttgattccaagaataacgtttcatataatcgatccagtttcaattccattcccaaccgggctgcaaactcacgaaaaatcgttgcccacgcattaatatctgatgaacaattattaacatgcaccattgcaactggtgacccatctggcgtcataacaatatcaatatcgcgatagactttagacaatggtttatctagaacgttcatcgaaaatgctgaggttcccaccgagatgttacccgtgcgtttacggacgctgttcgtaccgaccattcctgttccagcatccccttctggcggtgcaataacactgccagcgtcgagcgtgccgctctgatcaagtaagctcgccccggcagccgttaactttccagcaatggctcccgctggtaaaacccgcggtaaaatatgctggatatcccatgaatacggtttaactttgtcaagttggctaaacttggttaacatcgtctgattgtatgtgtcagtcgtttcatcaattgggaaaacgccagacgcatcaccgattcctagaactttctcacccgacaatttccaggttacatagccagccagcgttgttatgaagtccacctgtttaacgtgcgcttcattatttaagattgcctggtataagtgcgcgatactccaccgttgtggaatgttgaaatcaaataattcggtcaattcatctgctgcttgccccgtaatgttattacgccaagtccgaaacggaactaataatttcgcttgttgatcaaatgctatgtatccgtgcatcatggcactaatgccaatagcattgatatgcttcaaactcatgtgatatttactgcggacatctgctgataattgcgtataactttgttgaattccggtccagacatcttcaagtgcgtaagtccaagtaccatcaacaaattggttttcccaaacgtaacttcccgaagcaatcgtattaaaatcgtccgtgatcaaaacggctttaattcgagttgagccaagctcaattcctaaagaaactttgccagttttaatcgcttgggctgtttcaactaaattcatctgacctgcctcctaattaatgactcgcttgttgtacgggtacttgtttgtgatgattcgttcctgctgcttcaatctcttcaagtgagtgaccacgagtttctggaacacagaatcgaacgaatagcactcctaatacacagatcacaccgaacaccgcaaaaactgcttcttgtgacattgaagccgtcataattgggaataataaccccacagcccatgacccaatccaattgaatgaagaagctaagcctgatgcccgaccgcgaactgcaagcggaaagacttcacccacgagcacccaagtcaatggtgcccaagtgaatgagtagaaagccacgtaaatcgataagaagacaacaatcatcattggacttgcatttggcaccaaactattaataacagctggtagcaggaatgataatgccatgacggaaccacccaacatcaataaagtccgccgattgaatttttcagcaatccaaatgtaaagtaatgatcctaaaactaataagatgccttgaacaattggccacattagtgctgaacttgcagcactaccggttgccttttcaacgattaacggaatgtagtaaaagattgcattagcaccttgaaattgttgaaaagctgcaaccccaacacctgccatgactaagtaccgatatttcccattgaacaaggtcgcccaggaggtcttttctaaattgttagcctccgtttgggctgttgattgaatcgctttaacttcactgtcaacttcatctggtttacgaacaaaagataaaacttgacgggcttcgtctaaccgattggctttaattaagaaccgtggggattccggcaacttcaagactcccagaaagagaataatcgctggaaccgctgccaatcctaacattagccgccatgacatattctcgggtagatccttcagaatataatcaacaatgtaagaaattaacatccccgacacaatcatggtctgattaatcccagataaactaccgcgcaatcgtgctggtgccatttcagacatatatgcaggtactagtgcagaagcagcacccacggctaaccccaagaagattcgcatgccaatcaaatagtaagttccgttgttaggtgaaaagccacacagaatcgagccaattgcaaaaatcaatgatgacatcaagatcatccgccgacgacctagtcgatccgccaactgaccggcaattgcagcaccaaaaattgcgccaaacattactgctgatgtcacccacccaaccaatgttgcattagtcaatgcccaatcggttttcagaaacggtaatgcgcctgtcattaccccaatgtcatacccaaagagaatgccaccaaacgaaccaaagaagaaaataaatttactggaaacctttttctgcttatccaaagttgttcctcctcatatctggacttgttaataattgcaaaccattttagaaagccctttcaaaaagagttgaattttaattaacaacgttattacgattcaccttttgataaaacgctttcattttcgaacaactacagtctaatatatttatacgtataaatcaacacaaaattgttttattagtacaaattatttatttctttttcgatttgtcacggctactggctgtttcaggcacaaaaaaactgtcctaatccgttttcgattaagacagttataagttcaatagggttaatttaagtctgctactgaagtgcgaacaatcagtttaggcgtatagacgatcgactctactggctgcttgtgcaacaaccgtagcatttgccgccccgtatcctcgcccatcgtcgtcttctcatgattcatcgtggtaattcctggactcatgtaccgtgacatatggtaatcatcaaagccaacaatggatatgtctgttggaatgtttaatcccttccctttgagataatccatcacccgaattgctagttggtcattgtaacaggcgattgctgttggtcgctcattattttgcagataagtatccagccgatgcgctaatttttcaaaaggatcaccagactgatacatcaaaatattactcttatatgaaatctcaggctgctcttgataagctttcacaaaaccattcatacgatgaaccccctgagcatcatccacctgaaaaatacccagaatgctctcatgacccatttcaaacaaatattcaatcatccgctgttcggcctcttgatcactggttgtgacggcttgaaagtccaaattaggataacttgcattaatgaataacacgggaataccattatccttaatttcctgatacaagtccatattaggattgtccaaagcactctgagttggttcaatgattagccccgcaaccttgctattgagcatattgatcaaatttttacgttcacgttgatgattattatgcgtattgccaagtagcaacgagtaaccaccctccgaaataacttgatcaatcccataaataatttgcggaaagatataatctgcaacatgtgtcgcaatcacaccaataattttactgtcatgttcactcgaccagtccttatgccaatcttgaacaaacattcccccgccttgaatacgataaatgaaatgctccgtttcaaggtctcctacagctcgtcgaatcgtatatcttgagacggcaaaacgtttcatcatttccgtctccgtaggtaattttgcatcaattgcatattctcccgaaagaatggcttctttcagggcatctttgactttttgatatttattttccatacactactccactcagtactacctatttatttattcaaactcaggtctgaatcttcatgttgctcttaaccaccgaaccaaagcgctaatattattgctatcattaagccaattatcccacgccatttcgtcagtcagcaattatatttgctattactattataacaaacacaattaatcatataattagttctgactctatcaattcagatactagcgctcctaatttattagcattaattttatatttataaattgtgctgataaataaacgtgctctggtcaatacacgctaattactagcggaattccaccactaaaagattagccttgtcatatacgtcccactcaatttatgataacgttatcataagtacaaataatacggggagagactatccaatgaaaaatacattcttaaatacagttaagggatcattaattatctcgtgtcaggcgttacccaatgaaccactgcatagttcatttattatgtcacgaatggcccttgccgctaaggaagctggggccgcgggtattcgcgctaattccgttgttgatattcaggccattcaagacgaagttgatctaccgctcattggtttaagcaaagtcgactatcccgactcacctgtttacatcacgccaacaatcaaagagatgcggggcgttgctgctacaggctgtgccgtagttgcctgcgatgtcacgggtcagccgcgccctaacggtgagaaattggcggagattgtgaccaccatgcgaacagaattccctgataccctcttgatggctgatactgataccatcgagaacgtcaaagtagcggataagttaggctttgatattattgggaccacgatgcacggctacacaccagccacgactggtgccaacattgctgataatgactttgcctacttaaaggaagtcctccaagccacatcacgccctgttatcgctgaaggtaaggtggatacgcccgagaagatgaaacgttgccttgacttagggtgccacgcggtcgttgtcgggggcgccatcacccggccactcgaaatcgcacaacgcttcattagcgccttataattttagacattaaaaataaaagccagtcgtaaacaaaataacttacggctgacttttcatttgttactgaaccatcgttaatgatggtcgatttgtcctgacgtatattcacaatagcgcaaatgtctcatccagatactatcccgcttgctctctaatggaacctaccaaatcatccgtggctggagcgttcgcaagcaatgcgcgaacatcatcaaggttcaccttaacattccagactaaaacaccaactaacttaccggcatctatgaaatagacaagcgttccatgcgttcgccgatcaaaaatcaattgcaatttaggatcaatattaccaattgcttgccaggaaatatcaaaaatcatggaatagaagtatggggtatgttgatagctcatgtgagcacctgccatattacggccaactaattcaccagaaagtcgggcatggtccacgtgctcaatccgttgccgacccaagatgtgatctggataagaggcaatatctccagcagaccagatggctgggtcactagtattgagatactcattaactttcacaccaccatcagctaaatccaaacaactgtcttcagctaaactaatccgcggcgtaacgcctaacccaacaatgatcgtatcggctgcgatcaccgtaccatcctttgtcaatagagtcaagtggtcaccttggcgttgatatgattggacaaactgaccactcatcagtgtgacaccattgcgtttgaacgtggcttcatactcagtccgaatagactcaggaaatttaccctcacccagcgctttttctggaaaaatcatcgtaacttcagtctcattttgggtcagtgacgatgcgagctctgtaccaacatatccaccaccaatgatcacaactcgcttgttcggaccactaaatttacgtaacttgcgataatctgaccactgtctaaagactagcacatgtggatcagcaggtccctggatttgtcgaggttctccgccagttgccagcaatagctgttcatatttgatttgctcactatcagtcactgtaataaccttatcttgccgattaatagccgtaaccgttgtcttgaacttaaaagtcacattaggataattttcagcaccaatccgaatgttctcttcagtaaactcatcatctagccatagctttttactcagtgccggccgttcatacggaacatccgcctcttgcgaaataactaagattgcgccctctggatcttcctgtcgaattcccttgatggcatagccagcaaccattccgccaccaacaatgacgtatcgataattgtttgtctgatccaaatcactcatttaatcgcctccataactttactttttctaggaccattgtaatataaaaacgccatgattcgaaaaatgacgctcaagattattaatcattgattccttttatcagaacaataattttatttgcataccgccaaacatctatcaaacaccgctgtgatcaaaatttagaactgctgctaacacaacataaaataatgttatttttaattactcaacccaactttcaaggtaagcattctaaggaatgtttgatcatatcagttgttgctatggccgttttttttgatcttgtactaaactattgatcaattcgctatgctataataattgcgaatattcactttaactatccgtcgtttacaatcatcacccgttcaaaagtatcagtatattcggcatcataatgatgagttggtccttttaatattcacctgttaattttaaaattcgataagggagtgtggcctatgcgtctatggcatgaacaattaatccatcaattaccacgacaacaattactaggtcaacaccgtgagcttgccgcattgagaggcaatggttggggtaaaaatcatgcaaccgttaattatgttttcaaatattccccttacaagttgtatcaatttcatgtattagtgatggatgaaatgcaacttcgcggctatcatcctaataaaatatggtatgatccaaattatcgtgggcagttttgcccgccttatgatcacctcactcctattgcattaacaacaccaatctatccagaacacaacgccagctacttagcagaatgtgtccgcaatttagctgctaagggaattatcatgcccaccacatagccgctcttttattttgctgggtaccaactcaaccatcgatacccaaattgtttttccgcagtcataataaggccagttaatattaaaaaaggttgaactagacttgaagtgcaatagaaaagttagacttatttgtttaacgattgtagcgcatttcataccatgttcaacctctttttgtggcatccatcgatgttatctaagccccattctatcaaaaacgtgtcgtttttctaacgccttaatgaagtaaaaaatagcaatcacctgtaatggtatctgaatgatgacgcgtgccaatcttcccaacaataacactttaaaattagtgccaaatagtactgaaatcagccatgagtccatcatcagactaacaaaaatcattacaagtatttgcgtcatcacaacggataaccaattgactgatttacgatataaaaacaaaccgtcaataaatccccctaaaaatgcagttaacaaaaaggcaatctgaaacgcgccggaaccaaaaatagtaaagcttaatatatcggagatcatctccaagagaccaccccaaatgggaccatatagataaccaatacaagccatagacaaaaagccaaaagataattgaaaatacgctggtccgatagcaattttgtataaaataacgtctaaggctaataagaaagccgatgtagtcagcactaataaattcatttttggcaactgaaaaacatttttcgcaataagtttagacataggacaatcctctttttttgattttaatcataccctcattcttaataaaagtaaatattacttttattcgattgaaggtagtttaaaatcgtcgctcttgatttagttccttgaactcaatgatattactcatactaaaagccactaacaggtcaactagtacacccatcagtggctcattgtaaaattaatttttatccatgtaacttatcttgtaatttatcacccaagttatcaattcccttagcagtaagtacggtcccaccaataagaacaccacttacgattaaggttgcagctaaacaaaactttaaaatgcttttaatcatcgcaatcatctccttactaatccatccgtgtcagaacaaatgaggttatcgcaacaacaatcacaccaccaataattgaaggaacaattgccattccggctaattgtggtccccatgatcccaaaagagcttccccaattgcagatccaaccaatccggcaataatattactaatccaccccatcgatttacctttattagtaatagcacctgcaattgcaccaataatagcaccaatgatcaaaacccataaccaatgcataaaatccctcctagacttattaacccgcttaaatacaataatagaattacacgaatatttaagccgattcataaatgattacttcttataattatcattttacaattatcgataatgatagacaaatataacacattatttaataaatgggtcgctactatttctcatgtgacgattccgggtggcctagaaaatatcaaacagcttgatagctgattaaaattaaactacgccacatgaacgattaacttaactgtgcataatgattgaagtcactctgttaaggtgttagcgtttaaattgtgcaagagctttcttgtaatttacgtgaaaagggcgattaaaatgacggaaaaattaacgacggaaaccggccaaccatgggctaacaatgaacattcccaaacggcaggagctcgtggtcccgtattaatgcaagactataatcttttggaaaaactagcccattttgatcgtgaacgaattccagaacgggtcgttcatgctaagggggccggagcaaaaggtttttttgaacttgaaaacgacatgggggaatatactaaggcagacttatttaatggtgtcggtaagaaaactcccgtaatcttaaggttctcacaagttgccggtgaaaaaggttatcctgacaccgttcgagacgtgcgcggttttgccttaaaattttatactcagcaaggcaattatgatctcgttggaaacaacacaccggtcttttttgtaaacgaccctttaaaatttcctgacttcatccattcacaaaaacgggatcctaaaacgaaccgtcgtacacaaaatatgcaatgggatttttgggctcattctccagaatcattgcaccaggtcacttatttaatgggcgaccgaggacttcctgcgtcctatcgaaccatgaatggttacggttcccatacttttaaatgggttaatcagaatggcgaacagttttgggttaagtatcacttcatctcagaccaaggcgttaaaaatatgactgctcaagcagctgaaaaagcaatgagccaagatttagattatttacaagatgacttatatgatgcaattcaagaaaaaaattacccatcatggacgatgtatgtccaaatcttgccatatgaggaaggtctaaactataaatgggacatttttgatgtcactaaagtcatctcccacaaagactatccactaattaaagtcggcaaactaactttaaatgagaatcccactaataactttaccgatattgaagaggcggccatgtcgccagcaaattttgttcctggtatcgaaccatctcccgacaaattactacaaggtcgcctattctcctataaagatgcacagcgatatcggttaggtgccaactttgaagatttacccgtgaacaagccggttgttccagttcataattatgaacgtgatggttacatgaaaattaataatcaaggtgctgaggtcaactacgagcctaatgcactgcatgggacagaagaggtgccggatgccgcactttcacctgattctgttcgtggtgaaacacgcgcacagccttatcgctatcaagttgattacacaactcaagcaggcgacctatatcgcttaatgtcagaacccgagcaagaacgcttaattaatactatcaaagatgcgttaggccaagttactttgcctggtgtcaaagaactcgaaatcaagcaattttatgaggccgacaaaaactacggtacacgcgtggctaatgctctgggaatgaatattgctgatattatcagtgattaatattttgaccggatgttatccagcgcgatattatttttgttataaagaatgatgatgccgtctcatggttattaactaaagagcgacaggttagactcatatcgtgtaagtctagcttgtcgctctttaattaacaaaaaatcttagatatagcttactactcgaccatccttttattaataatgtgatcccctgtattaccatctagacgactcaacaatgcattgaactttagtcgccgaactggtcgtggaataaattggcgaatatcatcttcattaaagccaacttgaattttactatcactaatgatgataggccgacgtaacaacttcggatgatcacacaacaatttaagtgcctcattcaatggcatttcgggtaacttaggcgcaatttcaggatagtctttagatcgagctgagataatatcgtctacaccatgttcggttaaactcaaaatacgttttagatcttgcaccgtgggcgaatcaacactaaaatttttctccttgaactcaatcccatgtgcttccaaccattgccgtgcaactctagaagaatgacagcttgattgtgtatataacctaatcattcctaatctgcccctctctcgttaaaattcatcacagcgtattgatcgacattaacttctgcctgtcacaacatcctttaaactaaacgcattcgttactgtcatgaccaatccaataccccgtgaacacatctttattataggctctgaacaagggacataccgaccgttttaagacgaataatctgaggataatcgttttaagtacacttttaaacggtttaggaaagaacgaacccagtacacgtaatgctgacaaataccactgcaatttctaatcgaataacgctgaattttcatcacgtagcacataaaaagtcgcctactaatttggcaggcgacttccttggaactattatgactttttagcaagccatttagctagataacgattagcttgtgcagaacaaagcactttttcaccatttgccatggttaatcgtcgcaagtgcttgtccaatgacttaatgcgtttcaagttaacaacatatgacttatgacatctatagaaattaggactcaaatcaggaacgtcctttaacagtccatagtattctaattcaccatcatccaaatggactacgattttatggggactggttgaactttcaaaaaatataatgcttttaacattaattgatctgaccgtctcaccaatttttatttgaacatagtcgtcttggtcattttcatcggtttgaaaacgatcttgtgccacgtgtaaaaccttgctaaatcgctcatacaaggaatctggaaaatccttaagaataaaatctaatgcctcaacttgatattgaaacaccatcaaagataactccgtgtgtgtcgtgataaaaataatcttgctgcgccggcccatgtcacgaatctggctagctagttgaataccattaatatctgaattaagggcaatatctaacacatagattgccttttgaggctgctgtgcattaaccttgtctaacaattcgtggggatcttggcatgctaaacagatactcatgtctagctgttgatcgacgattaccttagtaatgatttgccgtatttgttgtaattgtttcggatcatcttcgcaaatatagacactaatcattctgagatactcgcttcaccgtcaagcgttgtaagaataccgctcctaagactctggtttcgagtatcatgttctcattgcgattaacaatcttacttaaactattcaatccaatcccccgattcttgcccttagtggaataacctgcctctttcagcttccataagggtggtaactgttcaaaaacattgttttgaatcaagaacaccgtactatttttttcgataaaaatggcactcataatctctccatcagcatgtcctaccgatgcttcaattgcattatccaacataattcctaatgcaatgtctaaatccaattcattaacagtaatgtcaattaatggttcctttaaatcaaaatgaacttcaatctcttgcgattgtgcatagctcaacttactaaataggatactcttaatcgacttcactttgacccgactcaaatcttcaagattatatttttcttttaacacccgatttgaaaccggtgcaagattcttttgataatattcttgtaaaccttctaaatcatcagttttcaaatattcatctatcgaaatcaacatattctgatagtcatgtctgaaacgtcgcaactcattatagtgagcttcgatttcattcatatagcgagtatcattttgtatttgtattctttgcttttggacttcatatttggctcttacattttttaaatattcgttataaatcaccaatactaaccccattacaactgacaatataattaaattacttaatataacctggaactgattttccagaccttcactcaacataatatacaagtatattatcattaataatagtgcggttatgcgatttaagctctgattactaaacgtgggactgaaattcgtgcgatccattacaatattaagaaaaattaagcttacgacactcaatatgacaaacactaccacatacccattaggaactttcattaaacgagttaatatatcacaaatatggtcaaccataatcgaccatatgaacacttgaaatgttatacatagtgcaccgcttagaactcgtacataccaccaagtgaaaaatataaacatcattaacattaaaaaagaaaaactaattcctaactttgctaaaaaaatataactcatcagcatacagacggataagaatataacatcaaaaagtctcacaaaaaatatatttctcaacaaagatttaattatcaaatagatagataattcttggaagacaatcattaacatatatctacactaatccttgctttttaattcatcaggaattttagtttcgaataatatcccatggcagcacataaccaactgtttagtacctacgtattgaaaaagatggctaagtactttatacattttttctttcataattttccctcctttcatagggcattagtaataaagcggctaatgccatcgcaattaaaatgattgtgccaaaataattattactaactatttgtaacaaactcaaaattaatgacaatccaattgcccgtcgctttaatttttttctcaatgacttcgatgtaataggattctttaccgtatcagctggagcaaaaatacttatgattattacaaatattaaacttaataacaatctgtatacttcagaaataccagttccaatcacatacggcacacccacaaacacaaagatagttaatatcgtacataacaaatccgatttcaagtgacgtccataggcaaagccacgcaaaactaaaaaactacccataaaaactaacactgggaccaactcgtgtagcagcaacgctaagataatagtaattatcagcttaggaataacatttaatacagtatcaatgcctagtttaactagtaatgcctgccgtctttctagttgaagattcttttgaatcgcagcgaataaccggtcgcttaatttataaagcaatagtttttgttctggcttttccatatcccactcctataatgctcaaatacatacctgtatcaacagtttaaaacagtattaattaattgaaaagaatacataaatagattaattattcaatattgttttaagactagaaataaacatttaaagatacatcagtttaattattcatacgaaactaaagtttcatataaaaagatcgttaatataaatcagtttcatcgatactcccccttaatttttccttagattacaagtcaaactagacttaatttcactaattcacattactcaatagattaatatcaaatggtgaaaatcaacgaaaaaaggagatctatcaagcaatctcctcttacataaagttatttatgaacactgatttaagctaagctgccgatatcacaatctcagcatccactaaatcagccttcaagtttttgacatctaagtggtcaaggtagaaatccgttaccttgtcacgaatttgttgttcaattactcgccgtaatggccgcgcacccattgcttcatcatagccttgttccatcagccaatctttggccgctttagttacctcaagtttgatggattttttggctaacgttttttgtacatccgccaacatcaaatcgacaatttgacttaagtcttgcttagtcagatgtgaaaattccacgattccattaaaacggttcagaaattctgggcggaaaaatggtgctaacttatccattaatgactgatctcgttgcttgtcaccacttaatgcttcattaccaaagccagcattagaagtagcaataataatcgtatttttgaaattaatgacattgccttgtccatccgttaagcgcccatcatccatcacttgtaatagtaacgttaatacttgtggatcagccttttcaatttcatctaataatacaatggaatatggattacgccgaacccgttcagttagagtattagcattatcttcatagcctacgtatccagccgaggtaccaattaatttcgacacagctgtacgatcagcatattcactcatatctagccgaataatcgcatttttatttccaaacatatctaaggctaattgcttagctaattcagtctttcctacgccagttgggcccacaaacagaaaacttccaatcggctgatcaccctctgaaaagcccgcacggttacgccgaattgcttttgctaccatttcaaccgcttcatcttgaccgattaccttacttttcagacgcttatcaagatttttcaaatgctcaatatcattagcgcccatatcagcaactggtataccagttaaacgttcaaccgattgtgccacatcatcaatcgtggcagtgattttttctttttgatccgtttttttaattttttgcttggtttcctcgatcgacttcttgatatcagcggcttttgtaaagtcctccgatttaacggcggcctccttagctgcctctaattttttaacgcgttgatccaatgtctcaacatcagtttgcgaatttttagccgctaaatgagccgcagtcatgtcgatcaaatcgatagctttatctggcaaagtgcgttgtggtatatattggattgaataatccacagccgccttcaaaacatcatctggtaatacaacatgatgatgcttttcgtacagctttttaacaccttgtaatatacgtaaagtgtcagcggccgtcggttcattaatcacaacatcattgaatcgccgtgccaaagccgcatttttcaaaatagtattgcgatattcatcttgagtcgtagccccgattacagtcagctcgccacgtgacaaagcaggtttaatgatatcagccaatcccttgccaccgtcttcaccaccagtggcacccgtgccgataatctgatgaatttcatcgaagaatagaataatattaccagctgctttaacttcctttaccagctgtttaatattctcttcaaaagaaccgcgatattgagttcctgcttccaaagacgataaatcaatcgaatagatttctttatcttgaatcgtttctggaactttaccagccacaattgcttgtgccagaccttcgacgactgcagttttacctacaccggcatcaccaactaagattggattatttttcgtcctacgactcaaaatttctgcagtttcttgaatctcattctcacgtccaatcactggatctagtaatccatcacgagcctgttccgtcaaattagtccctaacttttctaaaatccccccttttttaacagcctgtttaccatctttagatacttctattgttttattattttggggtagcttaccagttgctcggtattgagcaaactcatccggtgtcagcgattgtccattaactaaataccgtgcacgctccgaattttgattatccatgcgccgaaataattgattgaaaacatcatccatatcattgttaaaaaaaggatcatttccgtagaaatttgccatattacaacacctccataaaaatttatatgtgtaacttagtgaccataatatcctttaaaactacaactgaatcgtatcacgatttttatgtatcgttaagtaaagtgcttatagaatcaattagaaataattagaataattttgtttaaacaaaagagaaatcaatttcataaaatgaattgatttccctacaaggttccctatttaatagcccttgataaagaacttgaattaacaagttactttccagaccaattttaatttaagagactgcgactcaaaaagcacacccagtatcaagttaaggccaactagttatcgttaatattgccacttaaatatcaatactagcaatcatgacacacgtgtaaaatcataaaccaaaacatattacatgacgtaacggcggtcttgggactgtaaactcacagtaatgattctattgagttggataaggtgccgatgaccagtaattgccataaatgcaattgctttcggtacaatcgtagtgacatagccaactgtctcggccatctgcccatttgttttataaaaccgtaatgagactcgacatttttgatcatgcgcttgttgtaatttacaataattattttcaacactcaaattaaagtctcccgttcaaagaattcaggtttatttattcgtcagtgaatctatgtgtttgtttttctcattgttgacggcgtaagtccacattaaggagtcagctattcagtaaaaactaaataactagtattcatgttcagctcagtataatatgcattgatggttactaatcaaaaatcgatctctaaatatcctaattactatgaaactttgaagttaatttatgagaaaaataactcacaacaaaactcatgattacaaccttgtcatcataactagattatgaaacattcagcctcctaaataaaactggtatgcgcgcatgtgcgcatgtgtacagtatactattgccaagtatgtctgaataaccgttttaagacttgaaaaactcagctgggtgctttaggacgctttttgtgcattttaagacaatatcctaacttcaacgccggcatagcttcaattcgtcaatcagtgtcttagtttctcagctatttctgttcagaacatcttcctattacaataaaaagcgttgatctcagcagaatttacttccaccaaaaccaacgctaaagtgttattatatcaggtattttaaattcatttcagacattatattcagcattacttctactacctaagtaatttagcacgtttaacatcttcaatcgtcttagttcccgctagttgcatatcgatcaacagctcatcattaaggtgactcactacggaagcgacaccctgcgcaccacccaatgctaatccatagataatcggccgagcaagtgccaccagatctgcaccattggctaacgccttaaagacatgggagccacgccgaacaccgctatcaaaaattattgggacgcgcccattaacggcttgcgcaatctcgtgtaaaacatcaaaggaagctggaccaccatttaattgccgaccgccatggtttgaaacatagataccttgagcaccagccccgattgctaacaaggcatcttctggtgactggatccccttcacaataactggtaaattcgtatattccgtaatacgccgaacatcagccgggctaatcttttgcgccgcagcagcatagatttccatgatacctttccctttaccatccccttcgctgaacttagtcaagttagccattgggattggaaactggaaattgttgataatatcagcttcacgataaccgtcaactgttgcatcaactgtcaaaatgattgccttagcaccagccttcactgcttcatccagtaaactctgattaaaatcccaatctttgctcatatataattggaaaaattggggcgcacctttaccagctgcggcagtatctgcaattgacgttgaagagtaagtactctgagccataagtgccccaacttgagccatcccttcagcagtcgcagcttcaccccgtgcatgtgccaatccttgagcggccgctggagccatcataataggcgttttgagatctatgccaaaagcttgagtctgtgtgcttggctgttccatatccgtcaatgctcgtggcacaatttgaacatggttaaaggccattgtattctgctttaaagtccattcgtcttctgacccaccactaatatagccaaagcctccgctcgggatgatctttttagcagctgcttccaatgatggtaaatttaaaatcgttaacttttgctcacgatcactctgttcatatccattaataactgtcattatactaatctcctttacataaccctttataattcatttaataattggctaagtgccggttgatccgcttcagcgataccatatcgttcacgatacttagcaatcgtatctgcatcaaagttttctggatctactggaacaaaactagtatcaattggatcaacatttttaatttttgcatcaatcacaattggtagttgattaccattctgctgtagttgagtaactttctgaaacgttgctttcaactctttaaggttagtcactttaaaaccaatcgcacccatgttgtctgccatcttggcccaatcagcaccaatcaagtcaatcccatacggcgcctgattagcgagtaacttttcatgttgaataaagcctaatactttgttttctaaaaccacgttaatgactggcaaatgatatttaacttccgttagtaagtctggcatcaccatggcataaccaccatcaccagaaatactccaaacctgcttcttaggataattcaattgggcggccaaacctgctggcaaaccaaaacccatcgtgccataccaagccgacatcgtaaaagtctgttgcttattcaatggtaactgtcggattgcccattccgtattattcccaacatccagaccaaagacggcatcatcagtagcattgtctttaatagcttctagcaccccttcagccgtcaaccctccttgatcatcagtagcaattgtcttgagccaccggttccagttttgcttatcacgttgagcagctttcaagaacttagttggcttaattgtcacttcggattgaagtaatgcttggaaaaattcttttgcatctgcaagaacagtaatatcagcatcatgttgtttgcctaaatctgctaaattgttattgacttgaataaacttaattccttgtggcaagtaacgtgcaaacggaaagttagtaccaacaaacaaaactagatctgccgcttgcgagacttcaaaggcgggtttagttcctagtcgaccgcgagagcccatgaaattaggatggtcagttggcataataccagttgctggagccgtcgacaaaaccggcaaactaaatttttcagaaactgcgataacttcttgacgcgcattataggcacccttaccaatccataaaacagggtgttgagcagctttcaaagccgctatcgtctgctgaacatcatctgatttcggcattaagacctgttgactgccgctaagtgaagccgttttaaaaccatcaaactcaatatcttgaccagacaaatcatctggaatgataacaacagaaaccgaacgggtcgcgtatgctgatctaattgcttcatcaaccacgtatggaatctgttcagccgttgtcacttgtttatgaaattcggctacatctgcaaaaattggatcttggttcatttcttgaaagaagttcgtattcataatggatgttgctgattgaccgactaaagctagcaccggtacgtgatccatcttggcatcgtataatccgttcaagagatgaacggcgcctggtcctgctgaaccaaagctaacaccaatcgtccccgttaatttagcatctgccgcggcagctaaagcaccaacttcttcatgacgtacttgaatatacttcaagtggtctttctcttggtagaacccatctaccgtattattaatcgagtcagctgtaataccatagatatgatcaatgttccagtcgaccaacacttgtgccaatgcttgtcctgctttaattttagtcatttccattaccctctttttgctgttacttttttaagcacaaccatatcctaaataaaaacttgatccttgtcaagtctttatcttaaattatgcttgttgttgaacagcgctaatgtcatcaataatatcttgcagcgtcactcgcgacatacgtgcctcagcactattctgaatatcacagtagtatttttccatcactcgcggaattaccgacccgaccggacacgtctccgaagtattatggtcaacgtttaaaaaattacgcttagccaccactgctacatagatatccttcaaggtaatatcattgggcgaacaagctaatgttggtctagcaacgccacgaaccgaagttaacaagcctgcttttcttaacttactcatcattcttctgaccatggtaggatccgtatttaaactactagcaatatgctcacttttcagctggtcatcagtatgcaacgcaatatatgccataatatgcgtcgcatcacttaattgtgtattagccatctagacacctcccatatccatctctattgttacttattttagcacatctagcatgaacataaaagcgattaaggaaataagttaggcttctttccctaatcgcaacataagattatttgataatctccattaattcaataaaacttattcaagacaccgatagtagctgaatttaaaacccaccctgtccaatttgatgttgcaaatcatctaagccaaattgttttaaataagttgaaagtggttgtaaatcttgagcttcataccgttgtttaaatgcttcaatatcagctgccgaactcattgccgaatctaaacgaagcttttcagcaggcagtggccgatctcctgtaatcaccgcatcaatcagaactggttcatactgagcgattgctttggcttgttcaaaaacatcaggtaattgctcaatcttattaactcgaaaagcttgcatgtgcacgccatcggcaatcttactaaaatcaatatcattgaattcaacgccaataaaatcattctgattagtatcttcctgctcatctttgataaatccatattggcagttggtgaaaacaacattaatcactggtaaatggtattgaacttgcgtcgccaaatcttgcatggtcatcgaagcgccaccatcaccagccagattaaacacctgccgctcaggataattaagtttggcagcaattgctcccggaataccaactcccatcgtagcaaataagttagaagtaatgtgccgattggatggcgttaatttcaaatgtcgattcgcattcaaattgatatcaccaacatcaatcgaatagattgcatcaggctccgcaattttattaaccgcacgtagcacttgatatgcttgtaaaggcccttcctgcttatcttctaatgaagctagataagcccgccaatttttaacattggctaaattggcttgccaccaaggtgtcgactcccgttcagatacctgtgctaaaattgcagccagcgtcttttgtgcatcagcaagtaccgcaatatctgttttatgtcgtttacctaacttagctggatcaatatcaatttgtaagaaataacgcgtatttttaaacgctttggaaacttctgcaaacggataattattaccaacaaataaaacaacgtcagcttgcgcaagtgcctcattcgccggtttttgtgccactcgattagcagaacccaaataggctggataacgatctgcgacaatccccttagctggatacgtactcattaatggaattttcaacgttttactcaattgttcgagttctttaccagccttacgagctccaatgccatagtaaataagtggccgttcagctgcgagtaaagtctgtgtcaatctcgtcactgcttgaacgtcgggttctggtaataacggcgtttgataactattagcggaagcataccaatcttcagctggaatctgttgccatggtaaatcgactggaatttgcacaaccgcaacaccttggtgcgcataggcgcgtcgaattgcttcgtcaataacatgtggcaacgtggcagcattgacggctgttacattataatctgcaacgtccgcataaatcggattctcattcatttcttggaacgtatccatgttcatcccagtagtgccaaattgaccaataagcgctagaacagggacatggtcttcacgcgcatcatataacccattcataagatgagtgccaccaggtcccgctgagccgaagcaaaccccgattttacccgttagcttagcatcagcagcggcggccattgcaccaacttcttcatgccgtacttgaatataatggattcgatccctttctgctgataatgcgtccataatcgaattaattgaacctccaggaataccatacaaatgatctactccccaagcttctaaaactttaataactgctgcacctgctaatatgttagtttgttttgtttgtttcataaccataataaagcccccatttcatgcacaatttaattacgcgcaacttaataaacgaatattaccacagcaaacgcttacattcaagtgatcataaactagtgctttttaccacttaatcacgattcaaatgcattttagatcaacaacagcgctagtctgcttacctcgatgaaccaccatcactgttgaaaattagtatctcatacattcgttttttaaacaattttagtaattagtgtatgttttacaggggcatacttccaacaatgtctgcatgtttagaagctagccattcttcgcctcacactactatttttgtttcatacgtccttatttaattgtggataacgctctagcacatctactgtatcccgattcaaagcatgatcagcacataaaataactgcagcactattcgaatctgcacggtaatactgactgtttctaattgcaaataacacaccattttgttttgcagattgaatatattgccccatgatatccatatcaagctgaccatttattaacaattgatatttgctgttttctttcaaaaggcgctgtaagacgccactacagttatactttaacgcttcagcaaacgaaattcgcaactcaatacgttcataaaaagtacctaaacaacgatgctgttcatcgggtctcactaagggtaacccaaacactgcattctgaattcgttgatctaaatctggtcgtttaccttgcatactcacacctcattaagcaaaaatttctgtataaaagacaaaagaagatccaaacctcgccaagagattcagacccccatttaaaaatcaattacgttgcatcgtatctaatccgtaatgctttaaattaagaaagatatgtttatcgaagaaaccaatgaacgtgccttgaaagaacaagcaaataacggtaccaacattgacggcccataagtgcccactaacgccaaacgtaatcatcataataattatcggtggtatatagtgaactatttgcgccactgtagcatttccatgcacatagcggaaccgtataatctgcataaagtcatcgttcggatgcagaactaagtttgcgcgttgataaattgatgtcgctaaagcaacacatagcacaccaaacacatcgatgacaattcgtaatgccaacggtaattctgcaatctcactccgctgaatcaagtcagtaaaccattgaatcaagaaactgaacggtaaagtaaataacaaattaccgattacacgtcgccaaatgatttggtgaatcaagatagcattcatagtaaccaccagcacaccacaagtaaacaatgtcgctcgcaagcttagtggccatagatggtacagatttactgctgaagctgtccatactgcactgcccaagttcataacaacggttaatgcatgaccaatcgaattaattaggagtgataatccgagaaataaccatcgttttagccaatcatgattgggcatcactaacttggtaactgccatgataaccctcttctcaggccaaacttagtcaaccgttgctccgactgcatctggtgttaagaagtcttcattggctttcaagtcaaaacgcttgattaagtcacggaaatctttgtcggtcaacgattgcaagacttctccaccttgttcacgaatcgtcgtgtagattaatgctgacttttcaactgtttcaactaacccgtaagtttcatccagagagtcaccagctgcgaagacgccatggtgtggccatacaactacccggtagtcggccatcttagcagccgtcttttcaccgatttcattagttcctgggcacatatatgggataacgcctacgccttctgggaagacaacgattgattctggatgcatcttccatagcgtccgactgaaccgcttagatgacaacggaatcgtaaaggtcattgcaaccaagttagttgggtggcaatgcatgataacccgttgatcaggatcttgcttcaaccgagcaatgtggctcattaagtgtgatggaaattcgctagttggttcaccaccatcattgaagccccacattaaatcaacactgttgccgacttcgctgattcgaatcaagcccatgtcacgttctggaaattcgaccatattcttaaagtaccggccagttcccgtaactaagtaatacttgcccgctaattcactggcatcaaatttaattggaatctgacgtaaaactttatccgtaccagcacaggcttcaacttcctctttagtcagtcgtagactcacgttgccgccattccgttcgtcccagccatgtcgatataaattttccgttgtttgtgccatatcacgtacatatggtgaatcaataaagtctgtcataatcattgccaaccttttcttgttaatttttgttgtaactaaccgtcgttattccgtaactacttttttgtcccgagggaattggactttctgttcatagttatgaatttcatcaagccaatcagttcctactggtgtattgttcttcaagcagaattcatcccaaacagcaccaaatgggaaggacttcaattcttcagtaaccgccaaccgcttcgtaaagtcgtagtttaattcagctttcttcaaatcatcaattggtgctaacatcgcttgtaataaggccttttgcgttgcccgcgcaccgataacccatgcagatactcggttgatcgtagcatcaaagaagtctaaaccgatgttagtccgttccaactcgttatcacgaaccaatgaccgagtaatccgttgtaaagcttcgtcaaagattacaacatggtcactgtcccaacgaactggacgtgaaacgtgcaacattaatcctttgccaaacggcatgaaagcagagaacttatccgaaacatcttccgttgggtgccagtgcccagcatcaatcgtccagagtttgccccggctgatggcatagttgttatagaacagatgggagccaaccgtataagattcaatccccgtaccgaacagcttaccttcgacagcttcgatcgtattcttttcatcgtacttcttggcaaagacttcatctagggactcaatcaaccgttcccgtggtgcttgtttatcaattgggttatctttaaaaccatctggaatccagaagttattaaccgattgttggcctaattattgcccaaagtaatttgcgatttcccgcgatttcttaccaacttcaatccagtagtctcgtactgacttttcaggactagctaacgtaaagttatgcttaaccattggatgggagaagaaggttggattcatatctaagccaataccttcttgtttagcccaatctacccaatatttgaagtcttccggaccaacttcgttaaaatcttttttcttatctgtaaccgcatacaaagtatgcaaagagactttatgactcccaggaattaatgataatgcttcgtgcaagtcaccagttaattgatctggagtccgcgcaatacctgggtaatcacccgaaacaccgatcccaccagttaattcttgatcagggttcaagaaaccatgaatatcatcaccttgccaacaatgaacagacaacttgaccttctttagtgcttccatggccttttcagtatcaacaccaatttcagcgtaacgttcttttgcaacttgataggctttttcgacttcgtcagttttaaccattagtatttcctcctcgtattcaataagtaattcaggttaatctaaatgaaagacttcttgtaaatcagtcgtgactggactattgtcctcatttgtatccatcaacggctccatatatttccaccactttttacaaatatcagtttcagcgatctcgttgtaagtcgcttcgtctggaacctcaaggtaagcaaaggtttggccagttaatttatttaagaaaattgaataattcgttgcaccatacttcttaagcgccgtcttcatttctggccatagttccgcgtgccgtttagcatattcttcgtaggcgtctttgtgtaaatacatcacttgtcctaaccgaaccatttaaaccatctccttagatttatttgttagaaatcgttgatactcttttaaaatgtcgccatacttattggtctccggcaagtaccgctttagatcaaatgacgtttcaatcaaccgccggcccgctccaatgttctctacttcatcactagtaatcatttgaaccataatgtttccaactgcagtggcttcactcggacccgccacaaccttgatattagccagggtactcgttaactgattcatcagagcaacgttacttccgccaccaacaatattcagtgtatcaatgtggtagcccaagatacggtcaagtttattcaattcattggcatagaacaaagacagattagaatagattgcctggaataattcacccggtgtttccggtatcgtctgctttgtttcacggcaataatcctggagttccttaatcatattttcgggattagtgaagcgttcatcgttgatatcaatgaattgttggaatggtcttacttgttgcgccaagtcagccagttcaccaaagctatactgatcacctagttcatgacgaacacattgggcaacccacaaccccataatgttttttaggaatcggtaagtcccgtatgcgccccattcattcgtatagttctcatgaaatgcttgtaatccattttctggcacatttaactcagttcctagtagtgaccatgttcctgaactaaggaatgcccaccgatcaccttcacctggcgttccaacaaccgccgaggccgtgtcatgggttgcgaccgtcacaacttcaacttccggaatatcatattgagtgtgccatttgtggctcacatttcccagaaccgatccggactcaactagtcgtggaaattggtcttgagacacgttgactttgcctaacaaatctttatcaaataaaccgacacgcaagttcaacatctgagtggtagaggcattcgtgatttcagtaactgcattacccgtcaaaacatatccgagataatccggcatcatcataatcttgtccgtcttagccaataaatcatgattctctttatacaattgatagagcgtgttaaagtcttggaactgaatgccagtcttttcgtaaatgtactctttgggtaggtcgctagttaactgttggatcgcattatgtgtccgcttatcacgataactaattggatcctccaatttatgtccgttttcaccgacaagtacataatcaactgcccaagtatcaattcctaactcaacatcctttatccccatctttttgactttttcaaggcctttaaagatttcatggattaaatgatcaacatcccagcgatcatgaccatccttcatcgcaaatccattggagaaacgatgcacttcctttaacgttagctggccacgcttttgctgaccgagcattaaacgcccgctagaagcgccaatgtctacggcaatataagatttcattacttcacatctccagtagcatttgaattaatcggtgtctgtttatctttggcgtcactttcgtcaaattcgtcaccataacgttcctttgtaatttgttccagtgatttgccgcgagtctgaggtgtccaaatgacaccgataatcaatgaaactaacaataatccaatcataaatgttccggcagctttgaagcccatcgtcgtcagaatagttgggaagataattgaccaaataccagctgagccacggacgacgaagaacatcacgccttgagagcctgcacgatacttagttgggaataattcagtcgcccatagtgcgtaccacgcttgagccccgatccctgcggagatgccccaaacagcaacgaaaatccaaagactagtccagttcatcccggcaaatgtcaggacaacccaagaaacgacggccattgcagccccaactgcaaagaagattcggtgattagcacgatcaccatagcgggcaaaaccaacataagtggcaactgcggtaaagatccaaaggacggcttgcagtaagttggcctgtagatttgttaacccaccagcagtttcataaacgtatggcataaagaagcccattgcaccggcaactagattccagaacatgtaaacaccaattaaaaatagcaatgactttaagttaatgacatttgagaataagtcacgatatggatgtggcttctcaccagtcgcccgctcgtgttgtttctgttcaacccagacttgtgattcgtccaatttactttgaagacgccatgcaataaaggcaacaattgttaagaaaatgaataagatccgattacccatgacacctagtggcgataaggcaacaccggctgcaaaaataatggcgggccctaatgaccaagcgaattgtgaaataccaatgttctccgcccgattagttgattctgacgtttctgaaatataagtccacgatgcaggaaccccagcgccgaccgcaatcccagtaatcaggaagccggctaataacattggaaaattaactgaggctgccacaataatcgtccctagcatataaacaagcatgtcataggtatagataactttccgaccatatttatctgacaagtgaccaccaatcaaagccccaatcgcagaaccaaatgcattggcactcaatgcacctagtagtccaacctgaaagcttgataatcccaaggctttagtccatagtgttaaaccacttgcaccagcaacaattgacccagaatccaaaaaattagtaattgatacggcaattgttgagccgtgtgattctttttggttattactcattttaaataccctccttttggtaagcgttttcatttatttacaagcacattgtaaccgccaccattaaggtgctacaataactcttaaaaggtacattagtatcatatttacagggaggattgtgaatgaacacacgtattttgaacgctttaaagcaaacaacgttgattgaagaaaagcaaaaagcgtctcactgtttcgttgaagacatgccaccctatgccattaaccaggagctttctttaaaggaacatggacgcgtactaagaaattatttttttaagaataaagacatttatatcagtcgtcataatcgctatgcagattatccaactcacactcatacttttttggaaatgaactatatgctacaaggtcatgcaactgaaattgttgatgataagaagataacgctaaataccggtgatttattgcttttagatgaaggatcaacgcactcaatcaaggctttaggtgataatgatttgttaataaacattcttttcagaaccaaaaacatcagtattaacctgttaaatgaccttcgtagaagcaataacattttttatgactttttgctcagtcaagttattgaagatagtaaccataagcgggactacctcgtatttaccaaaaagcgtaataccgaagtccaggaaactttagaccggatcatcgatgagtattatttaaagcgtgatttttcgaacagcattattaaatcctatttatcaattttactggtccaattggttcgtgaatatcctttgaatggccctcatcaagaaaataaatctagtctgctagccattaaggtcctaaaagcaattgccgaagagtataagaccgtaagcttggaggaattagcaaatcgctataattatggcaaattacaagtttaatccgaacaagcccggaatctttcaatggcagtctgttgatgatgtatttttaatggtcgttgattaattagttcaagtgctgctaggatctcatcagtcgttacttggctaaaattggtctttttttcgggaagaaccagcgtaacgtctattaaaaatttcattggaacctcgctcccatggtttatggatggcaaaaataaactttgatctgataatcctgttctacaggcctgataattggcaaactctttaccatgatcaacagtaatggatttttgacttggggaccgaaggcccccataaacttgccaaaggcgggtgtttagagccttagccgttctattaggggctttgatgcccatagaagtcgggtcttacgttctacgaatgtaaccagacatgatcgtgactcacttcgactagaaagcaccgtatctacttcccaatgaccaaaagctaaccgtttgattaacagttgttggccgttgttcgatggaattcccacttgtaaatttcccacgattttcgctcactcggtgctggcggacattccgttgggtagatcagtcaatttgaaggggagccagccacgattaagcacttataaattgagcagtgctcaagttataagcgcccgcatggtttctgggtgaccaggttaatcgtaagtgattggtaattaaagtcgctaatgctgccgtcagcatcgaacgacgacccgcaattccgccgccttttgcgatctgcatcttgctgagctaattctggatcataaggtttaacacccggtccaactcatagctaatcgtagctttggcgacgcctaagcgtcagccattacttggtaagatttatttcccctcattgaccagttgtgctagtgcgccacgttgaaaacgtgataaagtagatgtacccaaagtaatcactccctatattggttggaattagctactaccattgtaagtgattgctttgggctttttaatttctgttcggattaattatagaatttgccatactaatacccatttattcattggtagcacacataggtcgagccaagacctaccaaccaccttcgctttagaacaacaattattctcacagaatcagcaagacacgattgtcacccttagtagcagtcttttaccctttttagtcaatcagcaccaacctgaactgcaagccttgcgcaatagtctctccctggattccgacaataagcagctaatccgcgcgctttatcatacccagggcaacgtccgccaagcagctagcaagttattcctacatcgtaatactctactctatcgaatcgagaagtttgaacgttgtaacggtttaaatcttaagaatatggatgatcttgtgtattgctatttgctgacattggggcaagttattaatcaagtggagaaatgaatagagtagctgccattagcccatatgattcgattaaaaatacgacattaaataatattagtgaacaccttatcagtataaaagtacaataacatagcgtactttatgtaatcttggactagcatagctaggttaaggctttcatatttctctttcacaaagaacatagtattttaagatcagaactttattcagctataatccgtaccacgctaccgactttaaaatcaggataatcgccctgctcaacatataacgtcccaggcaatttagcctcctttgcacccgtaaaactaatagccgtatggcctaatcttccaaggttagtctggacttcgccaccaactgctgtaatttgatagacttgattgtcgacttcaagtttcattcctgctgtgatttgctcacttattgggacaacttcgataataaagcaagaaggccgtaatgcgtctggagcttcatcaccaaataatactgccatgccaatcgatttaaaatcagcagattccgcacctatttctaagacctttgttgaaaagataattctctcttttgtcatcatacaatacacctcaaaccttctaaaaatttattttgaatataatccaaaacttgcaatccaagcaataaagacccgcggaacgccgttgataaaccgactatataacactgatggcaccccaacttcaaccgtcttagaatcagcctcagctagtcctaagccaactggaataaagtcacaaccattttgcgtgttaatcgcgaataatgctggtaatgcatactgtggtggaatattacctttcccgatttcaacgccaatcaaggtcccgataacttgaccgataactgcgcctggcccaagcaatggagataagaatggtaatgagcaaataaatcctaaaaccatcaagccccagacattgcctgctaacggctccatgatactggcaaaaaccttaccaattccagagccattaataatcccaataattaatgccacaaatgccataaatggaataatagtattaataactgtttgaacagcatcttttgcggcctgattaaacgtcgaaacgactcgcccagcaccaatcccaatcttagttaagatcccaggattttttgtttgtgctgttagtgtctttgtattatcgaatttcgtatcgtcatctacattctcaaattggttagcgctttcattttgactgtcagaaaattgctcctcctcagatgttaccaacataatctgatcaacatctacattggaaacataattagcttcattcataaattgcgctaagggaccgctcttaccagtcggtaatacgttaattgttttgatacccttcttgggataaattccacaccttaatgtcccaccacagtctacaaccgctaatgctgtttcttcatcaggaattgacgtcttaaagccatcaacagcttccattcctgtcaacttagcaatcttatcaacaattgctggtttattacctccagtgacataaacaaatttatgcttcgtgatagttggtgtaataattagcgggccgccccagccaccagagcctttaacaactttgatactatgatattcctttgccatgatctcgttcctcactctctcaattagccgttaaattcaactttcttggacaaggtaatcccttgttgtttgcaaacataggctgttgtaaagtcagtaatccaaccaccgataaagttcattactaggccgactaatagatatcgaatcgccaaatccattgtattcaatcccaacttctgaaccccttgcgcaatccctaaccaaatgaaatactcggaaggattgatatgtgggaataccccattactagtgtggcaaaattgagcaatcgatgcataccaactaggtttatagtattctggcaagaaccgtcccattgagtgcgccataggattaccgagcataaatgccgaaacaaacggtaaaattaaataacgggttacaggattctttgacgaagctctggccaacttggccatcttcttgtcaccaacaaaggcaataatcgcgttcatcaagactaacagcaatagcacaacaggaataattgatgtcatccatccaattaatgttttaccaccactctgaaacagccccataaagcccgaggccaaatctgtgactactttcatagtattaatgctcctttacgttcacttgtttttttcgcaaacttgctaagcctttataataaatagatttcagcttttcaatcattggtaggctccaaattttgacactaccatcgaaatcttgtggcgttagctgatttgctttgtaatttaaatagttcttataggcatccaatagacaaactcgcgttagcttatcgaattgttttaattgctggtatgaagcagcaatttccgcaatatttttctgccgcagttgatgcaattccctaaactttgcaaaaatcgtaacccccttcatcatttgagcctctaagatcgtgccgtcatcctttatcgctaatagaattagtgtccccgaccgtaattttttaggatttttgccaattgctactggcgctaacactcgtaattgatgaaaggttttagaaaaattcttaatttgtcttagtccaaggaaaccttgtaatagaaacgcactgactaggatcacgccaaaataaattaacattaaatcgcctccatcaactgatttaatccttgattttcatcataatttttcaagttattataaatattgctgttagctgtgatactgcgaattagatcgtatacttgtgctaatattttgcttaatgttgcatctagtttatacggaattgcgaccaaaaaaaccacgtttaccttttgattatcgaatactaccggtttttcaaacactcctactgttacaaggattcgatttagtccagatttatcaataacgtgtggcaatgcaaccccatcaccaaaaatactactcgattgttgctctcgattaagccaagcttgcataaaatctggtgtcagttgaccatgttgtatctcttgattaattaattttttcactccagtgacgtaggtctcctgttcatcaaactgcgtgacatcaaatcgacactgcccctgattaacagcttcatcaaccaacgaaatttgaagacgttcacgtaacgttccttgattaaaaatagaattcaaccgaataataggcgcgtggttaattaattcattatctgttaaaaaactgttagaaaaaatcagtaaatatttttctggactctgctcccattcactaattgagttaaaaacatcaatctgcaaatcatcatctaacatttctttcaatttctcggaaataaactttttcatactagtattaatgggctcaactagtgcaacccgatgaataattggcgctgccatgtattcttcaagctccatctgaaaatagactgttaaataaccaacctcctgggaacgaatccgaatattcaatttagtggcaatggttgataatgttaattgcgctaactccgttgaaactggatacttacttaacatgtctaccgagataaatccttctgacttgacatcaaaaatagcccgattaatgagaaataataaatgatatcgcaactccatcaacagccgtttaaagtccaaattcacatctaatttttgcttaaggattggaaaaaccgactgcattaaatcctcaacttcgaccaatcccacttgaactaactgattatcatccttcggtagctttctaatgtttaatgggtatgaaataaactcccattcgctagtgcttaacgagctaccaattatctcagtaactagattccgcaagcacgccatcgttacatcactaagaagtggatgatagttattaatacgatcattgatttgaatgttatatttacgtaaccaattaataactgcaatatttcttttaaccatggtcacagtatcattattatgatcaagttttttaacaagattaagcaatttgacatctgtcgctttatcccaggttgcttccagttcgtagtatttcccgactaaagttcgtgtaattactgcatacatataatcatgttcaaccgctaaatgaatcccacgattagtttttgtctcaattctgacttggtaataatcaagctgttgtttgagcgcttttaaatccttattgatagtgccacgactcacagccaatgattctgccaaatcatccagaataacgtaatccgtgatttgctgtaacaattcttttaaaatcgttgcttgtcgctttgagggatcattgaaatctaaatcctttttcaaaaaattagtttgtagcttagccatggcagaataattattgataactaggtaaaacttggcttgattaacgttgatttttgcaatacccaccaaataatcattgattgcacgaatattcttggtaattgtgactctcgaaacagaaaaatgggattgtaattctcttagtgtcaatgcatcattattaataaaaaagtttaatatttcaaaactttgcctatccattgcctcaccatgcccccaactaaaatttaaaggttaaccacgactcttgcctcccgcaacgttaatcgtaaccccggtaatgtaactggcacgttctgatagtaaatagttaactgcatccgcaacttctgatagtttgccactccgaccaagaggtgtggttgacgtactcttatagcctgcccgaatgtcatcaacagttttatgccgggtataagctaacgcctcttcataagagcgtgttcttagcccagtagcttccataatacctggcgcgacaccaacgacccgaatattatgttcacctaattctttagcccacgaacgagtgaacccattaatcgctcccttagttgctgaataaacactctgtccttgtgaaccttcaagtccagcttctgaggacatattaacaataacaccgtactgttgcttctcgaattgatgggtaactgcctgcgatacaaggaagatgcttttcacgttcacggcaaacattttcgcaaaatccgattctgcaaattcatacttaccgtgaggatccttggcgtcagccaataaacgtggcaaattgataccagcattatttacaagcccgtcaatttttccttgttcatcaacaacctttaagaccagccgattaaccgcttccgcatctgtgacattggtttcaacaaagtgtaaattatcattttgctgatcaccttgattgaggtcagcattataaacaatcgccccgttattcaataattcagttacaattgctttaccaataccggatgagcccccagtaacaacgtataccttacccgaaatattaatccatgaattattcatcaaaatcgctccttaatcatttcttttcttcacagataaatatatacgaaagcgcatacattattaatgcactcttttttcattggctttttaaattaatggactaatgattcatcaaacatttagatgtctgatataaactataaatattatgccgaattattttcattatcgccatatcataaagcaaattttgtaatcgaccattgtaatcaataaccgtaaaaatagagtcgctttaaagaagcgtataactccttcaaagcgactctattaaatagtcttatagccatattaatttgttttaaatcgtcaccgtaacagctgctgccgcaataattagtatcagtccaccaatcgtgacccacatttctttggtagtcttcttttggcctaagaaccaaataccggttaacgttgccaatacaacggaggtttgtgaaagaataaagccggttgctaatccgttcatatttggttgcgcagagattaagtaagtcaacgccgcaaacgcgaagaagaaacctgagatgatgtgcgtgtatgacaccccttcaacgagggctaacttttcacctcgtgatgctaagaacagggcatatacgatcgaaacaataaccatcccaattgcttggggaacgaaggcttcctccccaccaatattggttgcttggggcgcagccgaataagcccagtacccgatttcaccaactgctaaccagataacagcttggcgtaaggtccgggcgttacctgcatccttatgttcagaccacactgttagccaggcaccaatgataattccaactaaggctaggccacccaagaccttgtccattgccccaggccagtcacctaaggcgaagacgccccacagtgatgcgcccaacagctggaaggccgtcgtaattggcattgctcgtgaagaaccaaccatcgtaaacactttaaatgtcacgatttgggcacttgcccaaccgatccctgatagaattgaaaaccagagattcatgccgcttggaaaagcaatcccttgcacccatgcataaatcagcgcaaagattaacgttccaatagttgaacccaagatctgattaacaggccgaccaccaattttcgacgcaatcgtggggtaaagtccccaaccaagtaacggccctaagccaattagtaaagcggtagtattcattccaatccctccattaatcaccaactactttaaaaagtaacgccactttccaatagaatatttgaataaggtgtcatttcaccagtccgaacaaaggccttgcagtcagccaagtccttcttcatttcttcatgtggaatgaaggtaattggggtgtctggtaagcgcttcttgatggccgtcaacatcttaggattttgaactttaatttcttctgccaaatagattcgttgtacttcaagctcttccaagacgttattcaagacttgcataaaactaggaataccattatcaacggctaaatcgattttttcggttgaacttggtactggcatgccagcatcaccaatactcaacttatcgaaatggcccatcgttgcaataactcgtgacaaatctgaattaataacttttgtttttttcataattatttaccctccgcggctgtaatttcatttttataaggaattgatggttgcgcaccgaaacgttgtacggcaatcgatgacgcccggttaccatagcgaatcgcatcttcaagattactaaaatctttatttaacacactactcatcgcgccaataaacgtatctccggctgaagtcgtatccacggcttcgactttaaaagctggtacgataccatgtcgcccatcgatatcataaaacgcacccttactaccaatcgtaatgataacagctgaaataccgagggcgtgtaatgcagcggacgcctttaacatgctgacttcatcggtgattgcaatcccagtcaaagtttccgtttccgtctcatttggtacaatcatatcagtaactgctaaaagttcagcggggactttttccatggctggagcgggattcaagattgttcttacgccagcggcctgtgcaattttaaaggcttcgaccgtactatcgacagcgctttcaaattgtgcaaccacaaaatcactagtttcaatgatatcacggtgggcttcaacgtctgctggcgtaaaggccatgttggcaccaccatgaatcataatttggttttcaccggcatcatcaaccgtgacgtaagcttgacctgtcgattgattagtcatctttgtgatccctgccaagttgatcttttcctgcgtcaataaatcaagcatggttttaccagcagcatcgtcaccaaccgcaccaataaagtgggtattagcaccagaacgttgcgctgcgacggcctggttcgcgcccttaccaccaccggctgaaaagatttccttagtgtgaatcgtttcgccaggctttggcatgttttcaacccgaatcgtccggtctaagttgatactcccaataacggttaccgtattcataatggtccctccaaatagttaaattaatctgaatttagtttttattaaaacgttttatgaaaacgttttaataactcgtaaaaaatataacacatctgaataattaattcaaatgtgccgtcgaatttctttcaattaatttaactggtaagtggtgttcttcccatggctgctgcggattagcaatacggtcgagtaactggttggctgtcgtttgccccaactcaaaaatcggttgtgcgatggttgtaagctgtggcgcgacatattggcacatttcgacatcgtcatagccaatgacactgtaatcatccggtatccgcttatcatgttcagccatgcctaagtatacaccgaatgcgatttcgtcattgactgcaaagatccccgtaaccccagtcgccaaaatttccggaacaacttggcgaccacccactttagaaagcggcgtcgcgatgacatgtaccgctgtccgcggatacacactataaaaaccactaagccgcttttggacattggctgacggttttgctggaataagaacggcgacttgccggtgtcccaaatcttttaagtgttgagcagcttgccgccccccatcatagtcatcagtcaacacagaatcactgaacccttcggcgcgcttttggtctaagacgataaatgggtgacccttttgccgtagaatatcattaatcgcattattggaaacggccgaacttgcgataataaagccatccacaccccggcggctgagttcatccaaatagacgcgttctttgtcttcatccagatcagcattacacaacatcgtgatgaaattttgctgatacaagacattttcaatgcctcgaagtagctcaccaaaaaagggattccggatatcaggcacaaggaccccaattgttttgctggtcttcttaatcatccgctgagcaaagtaatcgggctcataatttaattcatcccgggccgcttccaccttagcaaccgtcgccgcactaaacttatcaccatgcccgtttaaaatttgtgacacggtcgcaattgagcgttctgcaaggcgcgcaacatctttgattgtgactgccttatttttcatgggcttctcctccgtaaaattaactcttgcattattgtagcctagaacgccgaattttcctaaccgaatctcaaaaatatttagtacacctataagtatatctatatagtgtgcaagccgataatttatccatatcaagtcttcattttctcctcctctgaaaacaaacagtaaaaactttccaggtagttattctaaaaccacatgacaaaaaagcccgcgctcatcatgagcgcgggctcccttaattcacaaagggctatttttcagtaccttggccgtcccattcacgttcaataatcgcctttaattcactgattaaaggttcgcgtgggttagcggtcgtgcattggtcttcataggccagttcggctaattcgtcgacggtggcgtcaaagtgcttcttttcgacccggttagctttcaaggataaggtcacatccattgagtgagccaagtcaatgtaagctttaactaagctttctttgagttcttcgtcggtcttgcctggtaaccctaaggcccgggcaatgttggcatagtcggctaaggcagtattatggttgtacttcggccacattgctaacttcgttgggatttcagcattgtaacgaacgacttgcggataagtgatcgcaattgccaatccgtgtggtaagttgaattccccgcctaatttatgggcgatcgagtggttgatacccaagaaggcattggcaaaggccatcccagctaacgttgaggcattgtgcatcttctcacgagccatcttgtcaccatcataagaagctttcaagtacttgaaggctaattgcaaggcttgaattgaccagccgcgtgtgaagtcagaagccatcgttgaaacatatgcttcggttgcgtgggtaattacgtcgagaccagtccaagccgtcgtccgctttggcaccgtttcaacaaattgtgggtcaacgatcgcaatatctggttgcattgcgtagtccgtaatcgggtatttgacgtgcgtcttggagtccgtaataaccgcgtatggcgttacttcagaaccagtcccagaagtcgttggaatcccaatataagttactttttcggatactggtactttgtacgtccgcttccggatatccaggaacttctgtttagcacctaagaaggaagcttctgggtgttcatagaagagccacatccccttagcggcgtccattgcagaaccaccaccgagtgcaatgattgtatctggcttaaaggccttcatccgggcaacccctttgtagactgtgtcagtcgacgggttcggttcaacttctgagaagatgtcgatatcaaccggatcagtccgcttgttcaagaccgccgttactcgatcagcatagccaaattcaaccatcccaggatcacaaactaggaaaaccttcttaatcccggccatgtgttccaagtagcgaacggaattgcgttcgaagtagactttgggaggcattttgacccattgcatgttattacgccgttttgccacagttttgatattaatcagatccatatctgtaacgttatgagaaatcgagttgccaccatacgatcccgtgcccagagttaatgaaggcgccatgttattgtagatgttacctaacccaccaactgaagatggcgtgttaactaagatccggcaagctggcatttgtaagccaaattctttgaccaatgcatcatcggtcgtatgaatcccagcagtatggcctaagccaccatagtgaagtaattcattagcccgtttgaacgccgcttcatgcgaatccgctttgtaaacggtcagaactggtgataatttttcgccggataatgggtacttgataccgacaccattaatctccgcaatcaagacccggcagtccttagcgacatctttcaagccagccatttgtgcgatttgataagctgttttaccagcaactggaccacgaactgtgtgccggttaggatcaatgacagcatcactcaaggcttgcacatctttaggtttaacgtagtagcaacccaaacgaataaattcagctttaacttcagcataaatttccttgtcgataatggcactattttcagaagcacaaatcatcccattatcaaacgtcttcgataaaacaatgtcgttaaccgcctgcttaatgtcagctgttttttcaacataagttgggccgttaccaggaccaacacccagtgctggtttacctgatgagtaagcggctgtcaccatacttggaccaccggtagccaagatcgtcgcaacatccgtatggtgcatcaaggcgtcggttgcttcaatgcttgggtgttcgatgtataaaacagcatcagctggaccaccagcagctttaatcgcttcccgcatcacatcagcagccgcagaactacatttctgagcttgaggatggaaaccaaagacgatcgtgttacgcccctttaatgagatcaacgtcttgaaaaccgttgttgaagttggattcgttacgggtgtaaccccggctacgataccaactggttcagcaatttccattagttgctcttcatcgtcttctttaatgacgccgactgtcttatcatggcgcatgctgttccagatatattcgctggcgtagatgttcttaatcgccttatcttcaacaacaccccgaccggtttcctcaaccgccaacttggctaacttcatatgattgtccagtgcggcaaccgcaaccttttcacataaatcatcgatttgtgcttgggtatatgacttcaaaatagctaatgctttcttagaacgttgaactaattgatcaacttcgtcagtaactttgcttgtttgatttttttctgtcttaatcatgaagtgcttcctccgttcaattcctttgtgaattaatttacaaactttattatagccatccttgctcataatgcaacaagaatttgaaaaattatttaatatcatccaaacagtacacttataaactcatgtttagcagtatttatagccaataaaaaaattcaattgttaagttcattaatgaacaatagcagtcaaaaacaaccgcaagctcctcattagccatgatgagcttgcggttgttaaaatttcatcagcttggatcttaatccctgtcccgagtcttgattaccgaacaacgataactgaaataggtgcttttcgggccaaacgcggaccaattgccccagcaatcttagaatgtggaaattcagtatcggcaccggtcactaatagatctggtttaaattctggaataacttgctctaaaatgacgtcatccacatcaccgccttcatagacaagcggctctacttgattaacgcctcgttgttctgcaagctgaacatactcagcaacaacatcttcaacgtgtttccgtttagcttggatcttcgacggtgttaatgaatcaaagatattgatatcttcgctttccagcaccgaacaaattcctaacggaacatcatagtcgtgggccaaagtcgttgcgtatcgaaacgcacgttctgaagaggtattatcgtcctcatcaacggtcagtaaaattcgccgatagacaagtggctcttgcattttttgattttccatagttaatctcctcattgaagtgaattgatattgaccactgccattataccagtttcagaattcaaacggcaccatttctcacacgcatataatcataagctgatttccttcaaacgccgctctaaataattaagggtagcttttaacgctatgattccagccaccagttagagcggcagcactctccccattactccggtaaggctttcaacgtctgcttcaaccaattcacatagtagtcttctcgtccgatcgcatgttgtaagatcaaatagtgaccataatgttgcttagcagctttagcttgcgggaaaacggtcgccaatcgctgttgtaagtgtgctaacttagctgtgtgcagggtgagctgttcctgtaacatcgctagtaggcgtggatcacgatccgtttgaataaagtatagttttaaaataaattcatctttcgtagcggttaagtctggtgtaccgacactgatccactcatgtaacagctgccgaccagttgcggtgatgtggtagagtttcttttcaagtttttcgccactgaccgtaatttcatgcgtgacgtaaccttgttcttctagtcgcttcaattgcggataaatttgactatgttgagcttgccagaattcaccgatctcgtcatcaaaggctttagttagatcatagcccgttaatggttgctggtttaataaccctagaataataaattgtaacttgtttttttgcgccattggaaattcctccttgacgattccttgataacagtatacactaaccttgttgtttaaaacatgtaataaattacatgattaaaatgacatattagacataaggaaggtaattctaatgacaaaaacttttaaaacacttgatgactttctcggcacacactttatctacacttatgataacggctgggaatacgagtggtacgccaagaacgaccacaccgttgattaccgaatccacggtgggatggttgccggtcgttgggtcactgatcaaaaagctgacatcgtcatgttgaccgaaggcatttacaaaatttcttggactgaaccaactgggactgacgttgcactagacttcatgcccaatgagaagaaactacacggtacgattttcttcccaaagtgggttgaagaacaccctgaaattacggtcacttaccaaaacgaacacatcgatttaatggaacagtctcgtgaaaagtatgccacttatccaaaactagttgtacccgaatttgccaatattacttacatgggcgacgccggccaaaacaacgaagatgtaatcagtgaagcaccttacaaagaaatgccgaatgatattcgcaacggcaagtactttgatcaaaactaccatcgtctaaataagtaatgtttcacgtgaaacattctggtctacaaattggataattatcagtctgtccaatctttgaaaattactaatcatctgaaaaacattcatttagcaacacttcaaaaaggccttcataaatgtcatgacatttatgaaggcctttttcgtaattattttacttaggcttccgttacatccagtgcgacctgtcccagcccggcatcgaagtcggcttgccagtgccccgcggtcaaatgtggtggtaggacaaacgtccccgacgaaactcgttgaccagccgttaatgtcttaccttgctctgcaagcttgccgactaaccacttcaatgactcaagcgggttacccaacacttcactcgcttgaccagttttaaccgtctccccatcatggactagcgtacactttggcgttgccactgcatcagctgaagcgaataactcggcagtctcccgttcagttccatataccactagcccaccgactgcggcatccgcgaccaccaaatttttaggcaaatcgggaaaccagtcagcaaaacgtgaatctggcaattcaagtcccggcgcgacagtcgttttttgccataaatcggtcaatgaatcggtggttgacagggcttctttagccttaaagaccaactcaacttcgacgagtgggtccattagttgcccgcgtcgaaccgtggttggtgccgccaaaaagtgatctgcaacctgggcaccgtacagcggcgtatgagcatcaaacatcttttgagtttctgcactcgtcaacgagaccttgtatccaccaaccggctgctgttttaaggccgttaatgcggcttgaactcgatacgcagcgtcttcgtcagcgacactacttgtaagatcagccattgttaacgcatgctgtgtctgataggccgtaaatagctgttgtgcaacttgagtttctgtttctgtggtggtagttgtcattataaaacctccattatgtgtttgtggttactgttatcccaatatgtgttcgtaatgaggccgtctaatcattgctaatacgttaactcattacaattaatctagttgtcacttcattatttggatgtattcagtgcgccagctaattgtacgggcgtcttaaatacgaattattaagactacgggtcataaatatcgttcatgttaaaactatgtgtgtctaaacgtataaattgcacgttgctaaaactatgtgttaatcgatacacgtggtatcgtatgtgatctacccggagtactcagttatactatgtgtttttgattccttgttgacctatgtgttactcgaggagcaagtcctcgtgcgactagttaccattgcccacatttgttggtaactagccacctgaatgtccgattccatactcctcaccacctttaaatcataaaaaaacgtcctttaactaactcctatgagttaattaaaggacgtccagaacgggttaccacctttattcgcgactacttcacaatagtcaccttagtacgtacagcaattgcgatacgccggtacattaatgggtaccatccagcaccatctccacgaatttcgaggcgcaactccaaggtgatctatgttaagtggtattgactgccttacaccaatccgcagctcgctaactaaccagcttagcaccgttccttatcacggtttttaatctaaatttaattaatgattagattctagcgccagattatcacaatgtcaaccttaaaattaaaaataaattagattaattaagcttgcgttcattggccataacatccactaatgccacgtactgctcagtatgcgtatcacgcaacgtataatttggtgggagcgcgtccgcatctgctttgacaattcgaaaccctacttgcgcataaaatcgcagggcattttcgttggccatcacacacttcaacgtgagtggttcggttgcatactggcgcatttctgtcagtagccgctcaccaactttcaagtggcggaaatctggggccacaaaaagcagatgaatgaagttggccagccggtacaacgaacaaaagccagcccgctgaccatcaatccacgcgaccagcacgaattcaccacggctgtcttcgttaaaatcttgcagttgtggatcagtgacccatggaaaatcttgctgacggtccactaaatatatttcagccagcgctgcttgatccgcagctgttgccggttttatctcaattcgtttggtcatcctgtgccctcccccatttaatgattctcattatgacgttagttgttgagaatttcaaacattaatcgccttaatctattcatcaaagctagctttcaactactgacaagcgttataatgttaggcaatactttcaccaaatgaaagcgggggaaaaatgaaaaccgcaattgtaacggatagcgcaagctacctctcagcggccgatgttgaaaagtatcatattcacgtcgtcccaattactgttatttttggtcaccaaacctacttagaaaacgtcgaaataacgtccaaagaattttatgaacgaatgcgtaccgcgcctgagttaccaacgaccactcagattacccttggtcagatgcaaacgacttatgatcagctggcaaaggcgggctatgatgctgtcattagtatccatctttcttctggtatcaccagctttattactaatctcgaaagttacctgccaaacgtaaccaacatcaaggtttatccgtttgattcactaattacggctggtggagaagcttacatggtcttgttagctgctaaattagtcgctgaaggatactcacccgaacaagttattgctcagctcaaaaaaatccgtgaaacaaccggcgtatattttgttgtcgataatctcagtcacttggttcggactggtcggctctcaaacgcttctggactcgttggcaacctcttacgcattaaacccgttctgacctttcaagatggcaagatcgtcgctattcaaaaagaacgaacgatgcggcgggcatacgcagccatcaaagccaagctagctgctgagattgctgccgttgactatccacttcgcgtcacaatcgaaaacggcaacaatccgaaactccaagccgaatggacagctgacttgaaggctagctttcctgatctcaccatcgatgaaggcgagatcggtcccgtcgttggggttcacgttggagaaggcgtcatgggactgatttgggcgcgtgactgggaaaaatggaccatttagttcaccattatcaacccctaatcattcatcatgacagtcaaaaacaacttttgttcctcacgacgagctgaggagcaaaagttgttttttgcattgccttatttccgtttcttgccttttttctttttcttgttctttttccgctttgtgttgggctgttcggccgacttagtcaacaacttccgtgcctttttgatcaacttagatcgttgtttggtatccagctgttcccacaatgttattaattcggggtcaacggcaggggttggcgtgaccgatactggaatcggtaccgcttccggggccaccgctgttgcaacatcagtcgtacctagcagccaatctggcgacacattcagtaccgtcgctaacgccgtaaccttatcatgtttagccacgtatttattacttaaccactggctgattgatgaacgaccaattcccgtttgtttagataactgagcagaggttatgttcgcttgttgcatcgcttcttttaatcgttctgaaaatattcccatcacattaccctcctagtgcaacggatcccatgcgggtagccgctgtgcacgttcgttaagcagcgcctgaaattccggtgccaagaaatgcttgtgaacaactacttcatagacgtactcattaaaccaatcttggctcattacgaagtagccttgatcacctacttgctcaccccaactattttcgaccttccacttagttggcgtatcagccactaagtcaacgccggttaacgtcatggcatggctaacttcaccttcacctgttaacagccgttgcgccttagtcagatgatcgttggttccaaataacttgccagtttcaaataaatgagcatccaagtatcccgtcttccggtccatctgtcgcaacacatcgttgccaaaccaaaccgtttcgccagcctgtaactgttgcacagcaacgtccgtcagcacacccatatcaaggttcaaaaattcgataggcttaccaccaatcacgttatcctcgtctggcaagctataaagtcgattaaacggcttatctggtgaattagtaacgaccacgtaatcatccagatcagtttcaaagtagtcctgatagaattgctgaggcgttaaattagccgtacgatggtactgttgctcatcatcacgatattctaaatcaaagctagttggtggttcaccaaatgagtacgccgtcatccgatagaccgtttgcaacattgatttctccagtgattgtagctcggcctcgcttgcaccatccatcacgagttgccgaagttttaacccatctttacgaagctgccgtgataaactggcttgaaatgccgtcgtattatcagtgttgaaggactctggcatcacactagctggaacgacgccatacttttgaaccaagctggccgccatcgcccactgaccaccatcttcgcccggattagcaaataagaactgaacaagccggtcatcaatcggctgacgcgccgtttgttcaacattccgataaaaaatattagccctttcaatcttatcccagaaaaacaaatagttttgtgataactcaaagtctttgacgtgataccgggtcgcaaacttatgccggagcgtgtttaataatgaaaactcccagcaacgaccgctgtgcttctgattactgaccttacccgttggtacttcaacagaaaaagtccgtgctaagcgactcgcagcttgattatcaaaacttgcagcctcaatcccattcttcgtaatcgctcgcgtcaatactggtgccattcgatcctgcgcatgcgttgtccgtaaagcggcaagtgcatccggtgttagttcagttgccatatttaccagcctccatcgtgatacttgccattattctaggcttattgaccattaaattcaatttagatgctaccttttgtttgcttttctgaacaacattagtcactttaaccatcccacgttgttctccctgtaaagaatgactaaccaacttagttcccccctaccattcagttggtgagcatacaaaaaaagcgcgctcactaacgagtcgcgctggctgctattcagtaactaattgaattaatattatggcgcttagttttattcgagtcccaaaatggcactttgaccacgcccaataccttattggctgggacaaatccccagtaacgactatcatttgacactgaccgatgatcacctaacacaaagtacgaatgcttagggaccttagttgttttcagattccaactgtaacggttctccagcgtactcaaatcccaatttgtcgttccctgcgtccgctcatactgactgatgaacttctgcgggacaagcttgccattgacatagagtcggccgtcttcagatttaactgtatcaccgggcattccgatcactcgtttgacatatttgaccgtcttggagcgtgcttctggatcaacttgataggcgttaaaaacgatgacactgaggtgctgaatcttagctgtcttgaccacggcgacgcgctcattgtcatctaagttaggttccattgacggtccatccacccgaaccatcgtaaaaataaagtgcctgatcaccatggcgacgagtaaccccactacaattggtagtacccagctcataatactcttaaaagttttcatcaaacgttctcccttaccccgctataacttccaatcattatagtccaatcaactcagcttgtctggtattggtgaatcgtttttacaaatttataagtaaccttgcaacgatatcacactaaaatgaccgccaaaacaatcttgacggtcattcataatttccttaatgactaactaacacatcttgatgacatctttcttccactcatcaagattgtggtgtatcttgcaaactccaattgatctttccatgataggatcctgcatacaattcgggctgaacatcgagaaaaataccttgtcgcgcttgccaggttgctgcaatatttgtagtttgttgattaggatttgtatgtgtgccatggcctaccaacgtttcctgattggtcatcacatgtttttgaccagcagcatcaatatagaccaaatccccaattaatgagtgttgagcagacttcattttagttgcggtggcatacacataccactttgaagcaactgatcgcgtatcatgaacctcaatttgccactgatttgtgggcgataataagcgctcgctttgtggaatcgtgttactccgaaaacgcatttgagcattgatttgaccaaacatgagtcctgaatttacattaactgttaacgtatcaatattagatcgttggccgtgttgatctgacacccacactttcacatcattaggcccttgtttaagcgattcagtgggtaatttcagatgaaaataccccgccttatctggctcattcaccgaaccattagccttataattagcgatgggcgttccatcagcatgggcaaagtggatggttagtgcgttattttttaaaacaacatcgcgatcaaaatcattctgatcagtccccaagatcattccggtcactaataccttgcgtcccttagcggttgaaaaggtatgaccattagttaaaaacaagttgagcttaatcgtcgcatccgttcgtggagttccgttattaatcaccgtttcagtgtgccctggaatatcatcatacgcatttgtttccgttaccatcaagtgaccattaccgctaaagcatttcatctgccagcgcccctcatgatcgactcgtgtttttttgatctgattaccaaatttagccgtgattagatcaccaccttgtgtgcccgtcccggtaatgatgcgcttattagcctcaaatccagtaatatgtggtgataatttaatctgactaaccatttgacagtactgcttcgttaccatgtaagcaggcagtgttcgaatgggattactgctcgcattagtactgctcttattaccaatccaaaccggctgacctgctttgattccatgcgtcttgatagtatctgttcgatgcggtcgccaaactcgattattgatattataagccaggaaagttgcaccatactctttgccttggcgattcaaaaccagatcccataaattatataatcccttaccattcggcgaatgtactacacctttccctaaagtaattttcactcgactagtcttgtgcgtcatgtgaccatctcgcacataattagccgcaatgtgtgtaatgggccatggcactcgaccaattgttcgttgttcgaaattagttgtaatatcctgcatcgcactggtcggctcatcgacaacctttgcctgcccattaacagccatgaggcaaactaccaataacagcccacccacgaccaacgtgccagtaagtaaccttctcacttctacggtccctccttacctagcaatagctttctttattaaaccaacggataaccatcaataatatcagtagcacgctaccgaaactcgcataaaaccaggttaagagctgctcatcagtctgtggcaattgataatacccctttggtcttgtcaacgtcttttctgtcaccacacgatatggcctggtcccattaggaatcttaacgttgcgattatctatctgttgctgagttctctgaccagcataaaagctaacggtgactgttgaccgccccccaacggccgcaactcccgttattgttaacattattaaactgattaaaatggttgctacacacacgctaaaccgttgcaccatcctacccccattaattaacctaatccttcgaccgccgttgtcgccgccatagccagacgattacgcctaaccctaaccccagtactagcattgaaattgcgccaattccaattagcatccacatactaacccccttattatcaattgactcatgattatatttttgagctgctgtcatactaatatgaaaatctcgtttaaatcgccaatgatgacgctgattattaaccgtcatttgtaactgataatcacccggttgtaattgttgtgatcctaatggcattggtgctttaaaaactgtgtttggcgccatcatgacacccgttttcgtattcttaataatgaccttttgatgccgcttattaataatcaccgttcggatttttaaattcggaatgattcttgcgacaggattacgtagcgcaacaataatgcttcgatgataattgttcaagccagctttcaccggccctagacacaaattaggaattggcaattttcctgaagataatttcaacccaataacatacgaatactcattcttaacgttgatacttttctccgttactcctgttaccttgtcatcaacccgtttaaaataccatccacccaacaagacgccatttactggctgcttaggtaacttcaccttgattgcgaccgttttggagccttcagccggaatcgttattgtccgctcaccctgaattgtggctaaatcactgactcggtattttaacgactgatcgtacgatttggccggattaatatattcaatcgtcccattagtattcgtatacgcggtatgaatagccgttcgaaccttaatatccttattagtgacattgtaaatgactgtccgtaacgtctgctgttgaccgcttgccattttcaaatcaaaaaaagaattttgtttatgaatctgattttttggtatctcagcggcaacactaaaaccgacattgttgttgtggaccgattgttgccgattagccgacactcctgtctgtccgattaaaatactaaatccaagactcacacccattagtcttatgaattggataaccactttcaatctcaacacaccccatattatgacgcatcttttaaagctatcatttaataaaagggaagccactgctcgcgattacatcaacgattactttatccataataaccgttagccatcgccatctgctttagcttcccctcttggttatattctaactaacttgctggtgtatcactcaaactccagttcaaagttgtttggtacccctgcgctttagccgtgtttgccggcaccgttaacttaacattacttggatcaatttgatcaacagttacaccagcaccatgatctttcgctgccgataatactgtcgccgaattaccatctaacacgttaagagcctcagtggactgcacgccattattagttgcaccagaattagttaccgtaccttttggtagctgaagcgttgcccctttcattacagaaccgtctgtaccagtcaaactactcccggcaacggccagtgtccaaccagcattacttcctcggacatcagatacttctgtgactgcttttttgttccataaacctgataaatccgaatcagtttctgcggcagtgtacgtttctggatttaaaacatcgatctcatggcttccaaaatctaatttattagaaacgtagatcagcgataagccgccaccggctttagcaccgttaccactatcaccgctattatcaggcttattgggattatccggattaactggtgataccggactactattacctttaaacatcgcctgaatatcagtcgtaccagtcgtattggccgtactatctgcgttgggagcagcgggcgtatctgcctgagcgatgacacccgaactcactaataaactacttgccactaaaataccactgactaacttactaactcttaccaacaataactccccctttattttgtaaacactgtaaacaatgtttactagttctgaagtataataccttaatttaatttagtcatcattaattaaagtgttgttgtttttttaatgaaacgtgtactaattaaaaagtaagctcactaaaaaagcacaattccaagttggaattgtgctttatcgttaaaaatattaattttttctttcatcattcgttaatatcaactgaacacaccagtcataacctactactgatgattattgaactttagcgattcgcccctgttgaatataaacactcagaattgcaatatccgcgggattaaccccactgatccgtgaagcttgtgcaatcgttgtcggctgaatcttctttagcttctgatgagcctcagtcgctaatccgtcgatcgcatcataatcgatccgatccggaatctttttagcttccatctttttcaatcgatcaacacgttcctctgctttttggatataaccggcatacttgatctgaatttcaacttgctcaataatatgccgttctagtggttcgggtgctgccgggataaatttcattaaatcagcatattgtacttctggccgctttaagaaatctgccgccaacacaccatccttaagctcaccagagttatgagcacgtaagaaagcattgacctcatcattaggcttgattctgattttgcctaaacggtcaagttcattcttgattgcttggcgtttcgcctcaaatgccgcataccgttcatcatcaatcaatcctaactcgcggcccttatccgttaaccgcaaatcagcattatcatgccgtaagatcaaccggtattcagcccgactcgttagtaaccgatagggttcattggtgcccttagtaactaagtcatcaatcatgactccaatataagcatcactacgcttcaaagtgaattgaccacgatcaagggctcgcaaaccagcgttgataccggcaattaatccttgcccagcggcttcttcatacccagaagtcccattcgtttgaccagcagtatagagattcttgaccaactttgtttccaaggttgcctttaactggtaaggcgccaccacgtcgtattcgatggcataacctgggcgcatcatttcagcgtcttcaagacccttaatggaatgtaaaatccgctgttgaacttcttccggcatcgacgttgaaaggccctgaacataccattcatccgtattacggccttctggttccaagaataattggtgccgcttcttatcagcgaatcgcacgatcttatcttcgatcgatgggcagtaccgtggtccgaccccttcaatcacgcctgtaaacattggtgctcgatcaagattttcacgaatgatcttatgagtcgtctcattcgtataagttaaccagcaagataattgatgctttagatcaatgtagtcagcatccttcgtttcaaaactaaaatgatgtggttcaggatcaccaggttgttcttccgtaacactgtagtcgatcgtattaccatcgactcgtggtggtgtaccggtcttaaaccgttccaagttaaatccaagtcgttccagatcaccagataacttcatcgctggttgcgaattatttggacccgaagaatacattagttcaccaatgataatcttgccacgagccgccgtcccagtcgtcaaaacgacactcttggcactatagcgcgctcccgtattcgtgataacgcccttgcagaccccatcttcaacaattaagccatcgacaattccttgccgtaacgtcagattcggttcccgttcaatcgtgtgtttcatttccgcatggtaagcatgcttatcagcttgggcccgtaaagctcgaacagctgggcctttacccgtattaagcatccgcatctgaacgtaagtcttatcaatgttacggcccatttcaccgcccaaagcatcaatctcacggacgacaattcctttagccggaccaccaaccgatggattacatggcataaaggccaccatgtctaggttgatcgtcattaagagtgtccggttacccattcgggcagcggccaatgctgcttcagaaccggcatgaccagcaccaacgacgataacatcatagtcgcggcctgggtactgctttacttctgtcattccaatttcctcctaccactacttacccagacagaactgactaaatagctggtctaataattcatcttcatagctatccccggtaatttgaccgaggaattcccagcaacgggtcatatcgatttgaaccaaatcaactggcataccagccgcaagtcccgtttgaacatcttgcaacgcttgtttggcttgattcaacaaaccgatgtgacgcgcattggtcaccatcacgttattttgactactttcgataccttcattgaagaacatcttggcaatccgttgttcaagttgcgtgacgccactttgttccaagactgacatgcttaaaacgtcactcaaatcgactaattgcgccaattcagcttgatcaagacgggctggtagatcagtcttgttcaagataacgattcgttttgactggtcagtctcttgcaacaactctcggtcttcagccgtcaacggttggctattatccaacactaataagactaaatcggcggccccgattgctttgcgacttcgctcgaccccaatcttttcgaccttatcttcagtgtcccgaattcctgccgtatcgacgagtttcaatggcactccacgaacattgacgtattcttcaatcacatcgcgggtcgtcccggcaacatccgtcacaatagctttgtcttcatgcaaaaggtggttaagcagactagatttaccgacattgggacgcccaatgatcgccgttgccaaaccttcgcgtaagaccttaccttgcttagccgtcgctaacagttgattaatgctttgggcgacctcggtagccttctccttcagcatcttggtggtcattgtttcaaccgcgtcatactctggataatcaatattgacctctacttgggctaatacgtccaaaatatcttgccgtaaatgtcgaatcagcttagatagatcaccatctaattggtttaacgcgaccttcatggacttatccgtcttagcacgaatcagatccataactgcttccgcctgtgacaagtccagccgaccattcaagaatgcccgcttggtaaattcaccgggttccgccattcgcgcaccgtgactcaagatcaattgtaaaatttcattagttgccacgagtcccccgtgacagttgatttcaactacgtcttcacgcgtataagttttaggcgcgcgcattacggtcgccatgacttcgtcgacttcctgatgggtatcaggatcaacaatatgtccatagttgattgtgtgtgattgcactcgactgagatctttacccttaaaaatctgggtcaccacgttaaacgtttggtccccactaatccgaataattgaaataccaccctcaccaggcggcgttgaaattgccgcgatcgtgtcaaattctgtggtcgttggcataccatcatgtcctttcttgtcagcgtttcatcgcctaataccataccaaatttacttacaattagttaataatatgtcctaaaatgcagaaaaaaagcgcctagtccacgccaccttaaagcgtggataaagcactttgactactttatctaaaagataagaatgattaacacctactataatagctcacccggagtttgtcaaacgcctgtttgcgttactttgaataaactatttgcgaatcgccacaaccacggcccggtgcggatcgcggccttctgagaatgtggttacatggtgattattcgctagttcagcgtgaattaatttccgttcaaacgatggcatcgggtccaagaaaacttgtttgcccgttgcaatcacttctcgagccgtactctcggctaaccgcttaagtgtcgcagcccggcgctcccgataatcatccacatctagcaccacgttaacgtgtgacgcgccatgatgattcatataaacttgcgccaaatcttgcagtgcattgatcgttcgaccgtgtttgccaatcaacaaaccctgcttagttgtatcgaaattcaatgtcgcatagcggttgccgaagtcgacgtcaagatccgccgtgacacctagttctttgaccaccgcaagcaagtaatcacacaacgcccgcaccgcggtctcgttagccgcttggcgcgctgctatttctgcgggtgtccgcggcgtctggctctggtcagcagccactgatttggtcttactagtggtcgctggtttagattggtcggtatcagcgataaccgggccggtggtaaccgccattgaagcgggtttagccactgctttcgccttgctagtcgctggttttgcggcactggtcgtggcctgactagttttagcttgtctggtcggcgttgactttggtgtccgcacggtaggccgcggcatggtcggtgctgtcgttgattcagtagctactgactgttgcgctgtcgccgtagcggaagttggcgtcgttgcaggtgctgcggaggctggcaccaccgttagccgtacttgggcggagtgtttgcctagccccagaaatcctttttttgcttcagcgatcacttcaacttcaacttgatcgcgtgttcggtgcagttgttttagaccagccgcgattgcggccgcgacggtattaccttcaaatactgtcatgcttgaatcctcctcgttaaaaatcctgctttcattatagcattaccattcgccatgcgaacacctgagtatgaacacttaatgaacccttacaacgattaggacttcggccgttctactacccctgaaaactcagactagcaaaatctagtgcttattatgtcaataaccaacctgttcatggcgcgtttcagagacgcggcccacagcctccctttgccgtatttactaattgccactcgcgagccgtatcaaagctgctctaaactcaataaaaccgattttcccgtccgtaatgactagaaaatcggtttataatgctagtatttttagccgactaattcacggcatctgacctactgattggccactaaatcaaaccactatcaaattcaagccagaaccagcccacctgtcagtacactaactggtcatatgacgaatcaagactacccacacttagccctgattctcaataagacggactacccgacctgccgtacaggaacttgctcatcaacaccgtccgttttagccgcttgatgaacttgaatgccatgttggaaaacatccttatcttgctgaataacccgaatatcttcgattggattggcggtcattgcaataaaatctgcaaatttaccagcagaaatcgtcccgtattcatccgcaacatgcatcgcacgggcacagttgattgtggccgtatcgatggcttgtgcgggagtcatgcccgccttatcgacatagagctgcatttcgtatgctgattcatcctcaaagccattataaggcgttccagcatccgtccccatcgcgatgggaatgccagctgccgcggctttagtgatacttgcaaaatgcttcttgatgttgacgattaccttttcacgcgcccatgctggaacggtcttctcgccatatttataaatagcatacatcgcgttcatcgttggtacgatcacagtgccatgttgccgcatcatctcaattgtttcatcatcaatatcaaaggcgtgttcgacagtatcgacgccggcttgaaccgcctcttttaccccggcattcccctgcgcgtgagccgccaccgtcttgcctttatgatgggcctcagcaacggctgcttgaacttcttcaaaattaaactgaatatcatctggggtctcgccgtttcgaagtaccccaccagtaaccatcatcttgatattatcgacgcccattttaagggcctggcgaacaccttgaacgaccgcatccacaccatcgacttcgtggccgccatccgcaccatgaccacccgtaattgaaaaggcctggccagatgtcatcacgcgaggacccgcaatctttccttctcgttgcatctttgaaatcgcaacgtcaatatcatactgggcgccaacattgcgaatataggttaccccatggtttaccatatcttgcatattgtgaatcgcatacatggtattatactcacgtgactccggatggcggtcttcctggccgtcatgccaccagtaagttggaatactggtaatatgtgtatgggcattcatgatgcccggcataacatactttccttgcatgtctgtcgtttgttcagcaatcgtatccggggttcctgtaccgaccgcgatgatttttccggttgcgtcgtcaacagtcatgaattgattatcgataaaagtttgcttttctgaactgtagattgaggcattgatatagttggttttggtcataataatgacttcctttcattttggcaggtcgcacaccgttcattaacggtaacggaccatcattttcatcactgcattgttggttctctaactgactattcaccacgcctcaccacctttcatgacaagtttttatttccaataagcatattgaagttgactggacgttccagaaaattcatcccattgcaagccaccaacatccttgctgaccaaaaatgcagaagaggcttggtaagtgggaatcacggcatcgagtttcatcaaccggcgatcagcttgcttttcataagtccaccgttgcgcggccgtgtatttcgccgtattagataccttggccatcaacgcatcgtacttcgcatctttccactgagtaaagttgatgctattcgagctctgcatcccatccaaaaagttttgggcatccggataatccggcccccaaccgactgtgacgaggtcaaagttccccgtaaaatcacgtgatacgtgggtcgcgtgtggaaccgcaacgatcttgatcgtcacgcctttcaaatacttttcggccacgccctggacgtattcagcgagtttcttctcagtatccgtatcgtcgcatagaaaattcaaattcacattttgcttgccgagttccttttgggccttctgccaatactgcttagcttgcttgatattagtcggtgataagttcccaacttccttaacaaaatcctcaccagtagtcggatcactcgcgtagtttttcggaacaatgttcgtcgcggcttgcgagccgtcttgcaagacatcttttgctagtgttttttgattaatgaccaagcttagcgcgtgccggaaattctcattggcagttacggacttcttactattgaaataaatgtaattattccggccagttttagtgaccgtcatttgactattattggcattattcttcacgtactgccccgaaatgttggtcacttggaccgttccggcgttgaagaggttctgcgccgtattatcatccttagtgaccgtgactttgatgcgcttgatcttaacgttcttggcattccagtagtacttattcttaacgtaataccaactatcattagagcctttccagcccttaataacgtaggcaccgttcgctaccgtcgtcgctgagttactccctaacttagacccgtatttctggactgcctccgtattgagtgggtaaaagctcgtaaactcataattcatataaggcaccggcttgctcaacttgatggaaaacgttcgcttattaatagccgtcacacctaatttattaacggccatttttcctttattaacggcatcaaagttcttgatgtaactaatggcatccaagttttgagacttcgttgttggattagcttgccgccgcaacgccgtcacgaaatcttgtgaagtgatcttggttccattttgccagcgtgcatttttgcgaatcgtaaacgtataccgggtcttgttttcagtaggcttgaccttcttctcgactacccccgcaacaatcttattattcgcgtttttgcggtaaatcccttcaccagtctgtgtaattacggcaccgccgttggtttcgatcgaagtcgttggatcagtcgtcatcggttcgccaggaatcgtgatgcctaacgtcctattttgatcagccgtactggtcgttttcgaagaattagagaccgcccccaagcagccggttaataataaggcgctcaccacccctataatgctatatgtatactttgcttgcatctctaatccctccattatgttttgattttaatcagatcaaccggcatcccgcaaaacaaaaagacgccctactaagctgttatgcttaaaaggacgtcttcacgcggtaccacctcatttgcgagccagtcagactcaccacttacatacggccaaatttattgacgatatgttggtacgttatcgggtacacccggaaattgcttcacgcaacttctcactagtaatcgacttttagctaccagttcagatcgcttttcatcatccgcgactcgctgtaactgactgataaccgactcctcgactgccgttcgcttaatctaattattttttaatgtgattcacatcttagcggtcatttttcaatttgtcaaatctttttttggaactttttcatgcgccgggtcattacgtttttaatcgcccgttctaattacgactgacaaagtagctctctcaaaccgcggcacgctattaaaaacatgtgatcaaatggtgcagacaattatttttataggcaccttgatccccggatgattactattaccagtatttgatcgttcattacaatttcctcatcacggaccgtccaggggccttacataaacgcacattagcatcctgccatcacagtccaaatcatattgaccgatcggtaaaaatgatacagagccaacaaaaaagacccaccacacatggcaggtctacttgtatttaacgtttatgattacgaatcgcgcgctttctagctttttcaagcgttcgtttacgatcacgttcagcttgcttcttagcttcccgttcgcgattaatcttgaatgggttttgtaataacaaggtttgaccaacttggaacgcgttggaaatcacccagtacaaggacaacgctgatggcacgttaatggccgtaatcaaaataatcacaggcatcaaatacgtcattgacgttgtcatcccgttttgttctggctgcgacttcatcgctaaccaggaactagcaaacgtaaagatcgccgctagaattggcaaaacgtagtacggatccttgctacctaattgcaaccataagaacgaaccggtcttcaaggcttgtgtccgccagattgcttggtacaacgcaatcaaaataggcaactgaactagtaatggcaacatgctggccattggatgcacaccatgcttggcatacaacttcttcatttccgcttggagcttttgctgagtttccatatcgcgtgacgaatacttcttttgcaaagccttcatctgcggttggacttcttgcatggctaccatgttgcgggtttggaagatcatcaatggcaagataatgatccggatgatcaacgtaaagacgatgatcccgagaccataactatgaccaaacaagtttgataaccaaataatcgcccgtgagaagttcaagatgattaagccatcccaaaacccggtgctcttatccgtgattggggtattactacacccactcaaaactagtacgatcgctagtacggccagcattgccagtatttttctgtactttttcaaacgaatgtcctcactttaatcattgtccagcaggtgcgctagctttagcgcatggcttagataagctttggtttcggcttgcgacttaccagcaacggttggtcgggcaatgacgagaaagtctgcatcttgcttaagctgcggctttagctcggtgattgattgccgaatccggcgtttgacccagttacgcgcaacggcgttcccgatcttcttaccgaccgaaataccgacgcggaaatggggttgccccggtttttccaaaacgtaaatgacaaattgacgattggcatacgagttgcgggtctcaaaaacttgttggaactcagtttctttttttacccgatatgattttcgcataatccatctccatgtgtgcgctcaagctcttgagcgaattgctacacaactttacagccctaaacacctggtctaggactgtaaagaaaaagccactgattatcagtggcctatgcagacaatacttttctgcctcgttggcgtcgacgggctaacactttacggccattgctggtgctcatccgtttgcggaaaccatgtacacgttgacgatggcgcttctttggttggtaagttctcttcatcatgacacctccttctccataatgacatgaatcaattcgattaagtcgttattttcaaaacgcagtttacatctaaacgcatttcctgactactatagcatatttttatttgtttgaaaaccagtaaattaaatttctccgtagtaattcgaggtcaaaaaattatttaattgcgaatttatttgtggattatagcaaagtgactttccgttattcgcaatttacccacaagtttttcgacaaattaacgggttgttatttagttatccacagggcgtatttgttgtgtgcataactccgataaacgcttttattgcggctttagttttaaactcgcttttgtggataagtgctgttttataaaattcattcctagttttcgacaagctgtgtatattcaaatcccagcctgtgaattctcttaactttaacttgtccacttgtggaaaactctatatgttcatgctaaaatagaattacgttttttaagaaaaggggtatccacgtgctggaacgtaatgacttatggaatctcattaagttctctatggaacaagatctgtccaagatcacgtttcaaacgtttgtcgaaccggcaaaaccactccaactcgataaagcccaaatgacgatcgaagtcccaacacaacttcatcgtgactattgggagaaaaacttggccgcaaagttcacggacattgcgatgcaagcgactaacgagcagattcggccggtcatgataacggaagaagaacgtcagcaacttacgagagacaaggactcgcaagtgactaccggtaacgttgcgggacaacaaccaacaaccgcaactacccccacatttatgcgggaaacgaaactcaacccgaaatacacttttgatactttcgtgatcggtaaaggcaatcaaatggcccatgccgctgcgttagttgtgtcggaagaacccggcaccatgtataatccgttgtttttctacgggggcgttggtctgggaaaaacccacctaatgcacgctatcggtaacaaattgttagaaaccgatccgactagtaacattaaatatgtgactagcgaatcttttacgaatgaattaattaatgccattcaaactaaaaaacaggaggcgttccgcgaagaatatcggaacgttgacctgttattagtcgacgacattcaattttttgccaataaggaagcaacccaagaagagttcttccatacatttaatgctttatatgaagatgataagcaaatcgtgcttacatccgatcgcttaccgaacgaaattccgcaactccaagatcgcctagtttctaggtttaagtggggattatccgttgatattaccccacctgatctcgagacgcggattgctattttgcgcaataaagccgatcttgaagggatcgaaatccctgacgatacgttaagttatatcgccggtcagatcgactcaaacgtgcgagaactcgaaggtgccttagcacgagtgcaggcatactcacgactgaataattcaccgattaccaccagtttagtggcggatgcattgaagagtttgcaccttagcagtaaactatcagaggtttcgattcccgtcattcaggaaaaagtcgccaagtacttccatgtaacaatggctgaccttaagggaaagaaacgcaataaacaaatcgtgattccacgtcaaattgccatgtatttatcacgcgaactgactgaaagttcacttccgcgcatcggtaacgagtttggtggtaaggaccatacgactgtgatccatgcgcatgataaaatcactaaggcactcaaaactgatgctgaattacaaaaagccgtgggtgatttgacaggccagctcaaatcttagtgtggataaaaaaggataactcaaaaagttttccacaacttatacacatgtggaaaacttgataacgccgagtctttactcggttttccacagtacccactgctctactattactacgaacttttattattaatatatatctagtgcccgtcgctagaataaagaggggattaacttatgaaattcacgatcaatcgatctgccttcatcaaagaattaaataacgtccaacgggccatttcttcaaaaacgaccattccaattttgactggtcttaaacttgacgttaatactgacgctattaccttaactggtagtgatgctgatatttctattgaaaccaccattccagcaagtgatgacaacaatacgttagtcgttgaagatgcaggttcaatcgttttacctgcccgtttctttagtgaaatcgtaaaaaaattaccagaagacaccatgactgttaacgtggtcgacggttttcaaacacaaattacttcaggggccgcttactttacaatcaacggcttagaccctgaaaactacccacacttacctgaaattgatacgactaataccatcacgttagctggggatgtactcaaagagttgattggtcagaccgttattgccgtttccaatcaggaaagtcgaccaattctgaccggggttcattttatcttagctaacggtgagttcttagcggtcgcaaccgattcacaccgcctaagtcaacgccggatcaagttgccagaagccaataatgccaattatgatgtaatcattcctggtaaaagtttgacagaattatctcggatgatcggcgacaataatcctgacgtgcagatgcggttatcagaaaaccaagtcctatttgtgctagggaatacgtccttctattctcgcttactcgaaggaaattatcccgacacgtcacggctgattcctaaagaatctaatacgactgttgaaatttcagcacccgcactttcagcagcaattgaacgggcatccctgttatcccacgaaagtcgcaataatgtggttcgcttctccgttaacccaacggacaaaacgattacgattttcggtaactcaccagatgtcggggaagtaacggaacaactacagcccactgatttgtcaggtgacgaacttgaaatttcatttaacccagactacatgaaagaagcgttacgttcgtttgggcaagctatgatcaaaatctcattcacgatggcattgcgcccattcactttagtgccaactgaagaaggcgaaaactttattcagttgattacaccagttcgaacgttttaattagctgaataaatatacaattctaaataaaaggcccgcatttcaccgtgaaatgcgggccttttatgacggctaaaactagctaaagatggggcaatgaataggcaatagcgatgatgtaacttttgaagttttaacttatgcatattatattagctgctggtgaattgtcacgctaactatcgatgttgccctactaaaatcccaccatctgatgaaccccagtccttgcactcgttcgctacaaacgctcgctttcagataatgaatgctggctttagccaatttttataggtaaaaaacaagatattttattaaaatccgcaaaattagggaatttcagcaaatttacccctaggctagtatcccgatattaaaaagccctaaatcgtcttaaaatggctctgagtgcggttataaattgaattttcatcaaaaaacaagtataatataacctgttaggagtgtgtgtagcacgccagacagtcgtttaatagcttgtaatcagataggcaggtgacattgtgaaacagccaatagatattaaaaccccatatatgacgttggggcaactcttaaaagaaacggccatcattggatcgggtggtcaggcgaagtggttcttaaaagaaacaaccgtgttagttaatggtgaaccagatgatcggcggggtcggaaactttatccaggcgatacgattgaagttgaagacaacgggtcattttttattcgctcaaatcaagaaacgactgattagatgtacttagaaaacttagtcttgcatgattttcggaactacgcggatttgaccattaattttagtcagggcgttaatgttctattaggtgaaaatgcgcagggaaagacgaacctgttggaagccatttatgtgttggcgttaacgcgtagtcaccgcaccgctaacgataaggaattaattcggtggcaaaccaccacggcaacgttgcaaggccggttacataaaagtaccggtgctgtccccttggaacttgaattggggcggcggggcaagcgagcgaaagtcaatcatcttgagcaagccaaattatcccagtacgtcggaaatttgaacgtgatcgtgtttgcacctgaagatttatccatcgttaaaggggcacccgcggttcgccgtcggtttatggatatggaatttggtcagatgagccctaaatacctctataacctaagtcagtatcgcacgattttaaaacaacgtaatcaatacttacggcaattaaatcggcagcaggccaaggataaggtttatttgggtgtcttgtcggatcaattggctgcatttggtgcggaaatcatccataaacgactacaactgttgcagcaacttgagaaatgggcgcaagctgttcacagcgagattacgcaagaacaggaacaattaacgtttcactatgtcactcaagtgccaactgccgaccagacgtcggtcgatcacatttatcaaacgctacaggccttatatcagcaacaacaagccaaagaaatttttcaagggacgactttattaggtcctcatcgcgatgatttacaatttggtgttaacggcaaaaatgtgcagacttttggctcccaaggccaacagcgtacaactgctttgtccgttaagcttgctgaaattgatctgatgaaagctgagacgggcgagtacccggtcttattattagacgatgtcttatcagaattagacgctgcacggcagactcatctgctgacagcgatccaagataaagtgcagacctttttaaccacgccaagtcttgacggggtggcccgcaaattaattaatgcgccaaaagtatttgaagttagccatggcactttacatgaggaggaaccgcattgaccgaaaacgaaaaagaaaccaaacttgaacaggctcgcgaatatgatgctagtcaaattcaagttttggaaggtttagaagctgtccggaaacgtcccggaatgtatatcggtacgacgagtagccaaggactccaccacttagtttgggaaattgttgataacggaattgatgaagccctagcagggtttgcaaacgtgatccacgtgaccgttgaaaaggataatagtattacggttactgataacggtcgtgggattcctgttgatattcaagaaaaaacgggtaaaccagcgcttgaaacggtttatacgattttacatgccggtggtaaattcggtggtggcggttataaagtctctggtggtcttcacggggtcggggcttccgttgttaacgccttatcatcgaccctggacgtcaaagtaactcggaatggtcatgtttattacatggactttgaacgtggaaaggttaaaacaccgatgaagatcattggtgatgcgcctgatgatgctcatggtacggcggttcattttgttccggatcctgatattttccgggaaacgaccacctatgacattaatattttgacgactcggattcgcgaactcgctttcttaaataagggattacggatcacgattcgggataatcgccctgatgaacccactgaagatgactttctctacgaaggtgggattcgtcactatgttgaatatctagataagaataagaccgttctatttccagaaccgatttatgtggaaggggaacagaatgggattacggtagaagttgcgttgcaatatactgacgactaccacagtaatttgatgaccttcaccaacaatattcatacgtacgaaggtgggacgcatgaagaaggtttcaaacgtgctttgacgcgggtcatcaacgactatgctcgtaagaataacttgttgaaggaaagcgatgcgaacctatctggcgaagatgttcgtgaagggatgacggctgttgtcagcgtcaagcatccggatcctcaatttgaaggtcaaacgaagacgaaacttggtaattccgatgctcgggcagcagttgaccggttattctcagaacactttagcaagtacttgatggaaaacccaagtgttgcccgtaaagtggtcgacaaagggttacttgcatccaaggcccgggtcgctgctaagcgtgcgcgggaagttacgcgaaaaaagagtggcttggaaattagtaatttaccaggtaagttggcggacaacagtagtaaagaccctgaaattagtgagttgttcattgtcgaaggggattctgccggtgggtcggctaagcagggacgttcccggttgacgcaagcgattttaccgattcggggtaaaattttgaacgttgaaaaggccagcattgataagattttagccaatgaagaaatccggtcattgtttacggcaatgggaactggcttcggtggtgacttcgacttgagcaaagccaattatcacaaattaattatcatgactgatgccgatgtcgatggggcacatattcggaccttgttattgacgttgttttaccggtacatgcggccattagttgacgctggctttgtgtacatcgctcaaccaccgttgtaccaagtccggcaaggtaaatttgtgaagtatattgattcagatgaagaattgagtgaggtcatggggcaattggcaccatcaccgaaaccagttgttcaacggtacaaggggcttggtgaaatggacgcggaacaattatgggaaacgaccatggatccagacaagcggcgcctattacgggttcgtgatgaagacgctgcggatgccgatggggtcttctcgatgttgatgggggaccaagtcaaaccacggcgagaatttattgaagataatgccaagttcgtccaggatctggatgtttagtgtgtcagtttagtcattttgacctaagaactgaggcgcaagctgttaatcagacttagggtcgtaatggcacgacggttgtcttaatggcgacttttacttgagacatgtaaagcttaatcaagctttaatagcggcaaaacggatgaaggaggacgaatattttggctgattcagatttatcgaacaatcgtatttcggatgtgaacctttcgaagaccatgcgaacgtcattcttaagctatgccatgagtgttatcgtggcacgggcactgccggacgtacgtgatgggttaaagccagtgcaccggcggattctttacggtatgagtgaattaggtgtgacgccggataagccgtataagaagtcggcccggattgttggggatgttatggggaagtatcatccccatggtgactccgcaatttatgagtcaatggtgcggatggcccaagactttagctatcgctacatgttagtggatggtcacgggaacttcggttctgtcgatggtgacggggctgccgcgatgcggtataccgaagcccggatgagtaagattgcggttgaaatgctccgcgatattaacaaggataccgttgattggcaaccaaactatgatgatacagaacgggaaccagcagtcttaccagcacgtttcccgaacttactcgttaacggtgccactgggattgctgttgggatgacaacaaacattccgccacataacttagcggaagtcatttcagcaatccacctgttgatggataatcctgatgcaacagttgctgacttgatggaagtcttacctggaccagattttccaactggcgggatcgtaatgggaaagtccggtattcgtaaggcttaccagactggtcgtgggaacattattgttcgtgcgaaggtcgatattcaagaccaaaagaatggtaagcaacgaattatcgtgactgaattaccatatatggtcaataaagctaaattgatcgaacggattgctggtttagctcgagacaaggaaattgaaggtatcactgatatcaatgatgaaagtgaccgtgaagggatgcggatcgtcattgatgttcggcgggatgccagcgcctcggttatcttgaataacctttacaagatgacattgatgcagactaattttggctttaacatgttagccatcgttaagggtgctccaaaagtcttaagcttaaagcaaatcttaatctattacctggaacaccaagaagacgtgattcggcgtcggactgagtttgacttgaagaaagcccaagcacgggcccatattcttgaaggcttacggattgcccttgatcacattgatgaaatcattgcgattattcgtcaatcacaaacgagtgaaattgcgaagaaccaattgatggataattacggcttgtctgataagcaggcacaagccattcttgatatgcggttagtccggttaactggtttggaacgtgaaaagatcgagagtgaataccaggacttattgaaagccattgctgactacaaagaaatcttagctagcaaggatcgtatcaaccaaattatttacgaagaattaatggaaattcaacgtaagtttggtgataagcgtcggaccgaattgatggtcggtgaagtcctcagtattgaagatgaagacttgatcgaagaagaagaagtggctgttaccttaactcacaatggctacatcaaacggttaccaacgactgaatttaagtcgcaacaccgtggtggtcgtgggattcaagggatggacgtccatgatgatgactttattgaacatctactgacgacgtcgacccatgatgtcctactctttttcactaatgcgggtaaagtttaccggatgaaggcttacgagattcctgaatacggtcgtacggccaaaggaatcccggtcatcaatttactgggagtcaattctggtgaaaaaattcaggcggtcgttaatgtcacgggcgatgcgagcgcttctgataactacctgttctttacaaccgttaaaggggttgtcaaacggacaccagttcaagaatttgccaatatccgtagcaatggtttgaaggccattacgcttaaggatgatgatgaattaatcggggttacaatcacggatggtcaccaaaatgtaatcatcgggacgcacgacggttatgccgtcagtttcgacgaaaccacagtgcggtccatgggccggacggcttctggggttcgcgggattcgcttacgcgatgatgactttgtgattggctttgacgttttgaagcccgacagcaacgtcttcatcatcacggaaaagggttatgggaaacaaacgccagctgccgattacccaattaaggggcgtggtggcaaaggaatcaagaccgctaacgtgactgagaagaatggtcatttagctggtttgacgacggttgatggtcaagaagatatcatggtaatgacgaaccaaggagtcatgattcgcttcaatatcgcaaccgtttctcagactggtcgggcaaccttaggtgttcgtctcatgcggttaggcgatgatggtcaagtcgcaacgatggccaaggttgatccagagccagaagttgatgagactgtcgcaacggatgcaacgactgaggcaccagttgacgatcaaaccgtcaacgccgatgccactacgacagaaccaacaactgattcaaacgattcaaacgaataaattgataaaacaagcgtggtcgacaatcttgtcgaccacgcttgtttttttatgcgagtcaagaattattttggcaacgggtcgtgtgtgatttaccggtcatcggtcctattctggcctccaaagtcttgttttgaaccggtagaaacaatcttcctgcgaagaataatttgactgctggaggctcatcacttagtcttgccatcttccagtgattggcagaaatgccgataaattgggagaggacaacatgaagtaagcaattttagatttacgcggtcaaaactggcttgtgcgattgagaggattacagcagtgcgtgttattctgacgtcgacttggtttaaattaatgctgtgtgggtgtgggaaaatgtaagcgaaggggagaatttcagaaaaaagaaatatttcccgggaaataaaatgaaatatcgctcaattgacgtaattgattggtgtaacggattcaggatctttttgtaacagtcggccgcttcaacccttgcaacaaactgatttagatgctatactttaaattcgtgagtatctagcattagctagattactttccttgctcttcaaaaagaagggcctgaagtccataaggaggtgcaaatttcatgagtgaatcaaagaaatatgaaattacttacatcgtacgtcccgacatcgacgatgctgccaagacagctttagttgatcgtttcgacaaaatcttaactgataacggtgcgcaagtaattgattcaaaagactggtcaaagcgtcgtttcgcatacgaaatcggtggctttaacgaaggtacttaccatatcgttaacttaacagcaactgacgatgctgctttaaacgaattcgaccgtctttcaaagatcaatgatgacattttacgtcacatgatcgttaaacgcgaagactaatagacaaaattaattttaagagaggagcgcttctgcatgattaaccgtacaattcttgttggccgactgacaagagatccggaattacgttacacgaatggtggtgccgccgtcgcgacgttcactattgccgtaaaccgtcaattcacgaatcaaaatggggaacgtgaagcagatttcattagttgcgtcatttggcgtaaagctgctgaaaattttgcgaactttactcataaaggttcacttgttggtatcgatggccggattcaaacccggaactacgaaaaccaacaaggggtacgtgtttacgttacagaagttgtcgttgaaaacttctcattattagaatcacgggcagagtctgaacgtcatcagtctgccaatggtggtagtggtaataacaattacaacaatggtaattcgaattacaacaacaataataatgggtatagtaatcaaggccaaaatgcggctcctcaacaatcatcagcgaataacaataacccatttggtaatggtaatactggtaatgctagcagtgcggcaccatcaagcagtgctaacaacaataatcaggctgacccattcgctaataatggcgatcaaattgatatctcggatgatgatttaccattctagtctaattgcttagacagataacgaggagggaaatatcaatggcacaacaaagaagaggtggccgtcgtcgtcgtaaagtcgacttcatcgccgcaaaccatatcgaatacatcgattataaagatactgacttattacgtcgctttatttcagaacgtgggaagattttgccacgtcgtgtaacggggactagtgctaagaaccaacgttctttaactatcgccatcaagcgtgcacggatcatgggcttattagcctttgtatctgaagactaatttttagtcattcaaaaaccacagacttcggctctgtggtttttatttacccttaacttgactagatagggtggtggccgttcaatgaagcgtttacggtgattgacacgaaacgctgaagcggacggtggtttgtgataaaatatagtcattactgagaaggcttgagggatttttaatatgaaaaagatcttttcgcgtgaaaaaattccatttttcctacaaaatcagcagttacgactcttagcgttggttatttttagcttgtcgttaattatgctcgtcactggttatttaatgaactggatttttgggaccgttgtcctcatcttgattgtgatggctgtggtgatatcttataatacgttgattgagctcagttcgagtgcaaatgaatatatctcagacttgtcgtatcgtattaagcgcggcgaacaagaggcactgattcagatgcctatcggagtaatgatttttaattccgaccagaccatcgaatggatcaatccttatcttcagcgctatttcggtgataaggacgtcttaggataccgcttggaagatattgagccaacactggcagcgacgctgaacgctcatctggacgagcccgcgacgattcgttggcaagactaccagtttgatgtacgtatccagcagagcactaatacggtctatatgatggatgtgaccaagtatgctgagctgacggatcaattcgaagatgaaaaactcgtgattggacaaatctttttggataattacgatgaaatcacccagtcgatgactgatacggatatttccaacctgaacaattacgtgaccaatgaattgtctaagtggacccagatgtttgggatgtacctgaagcgcttggatgatgatcacttcttcttgttgggctatgctagtagtttacgacgtgttgaagagaataagtttcgcattttagatcgaattcgggagtcgacttctaagcaaaatttcccactaacattgagtattgggattgcttatggtgaacggaacatgaacaatttggccgatttagcgcagagtaacatggaccttgccttggggcggggtggtgaccaagttgtggtgaagtctgaggacgaacctgctcgtttctacggtggtaaaaccaacccgatggaaaaacggacgcgggtacgggcccggatgatcagtcagacgttacaagagttaatgaatcaatctgaccagatctttgttcaggggcaccgccaaccagatatggatgccgttggggcctgtctcgggattcgccgaattgctgaaatgaatggtaaacagtgttggatcgtcttggatgagcaaaatgtgcattcagacattcagcgtttactggaccagttgaagtctgatgagaacatcgagtcagcgattatctcgccggaagaagcacttgagaaggccactgaccaaagtttattgattatggctgaccattctaagccaagtatttcaatgtcacaggccctttatgagcggctcgaaaatcgcgttatgattattgatcaccatcgacggggcgaagaatttccagaaaacccagttttggtttatattgaaccgtatgcttcgtcgacttgtgagctgattaccgagatgtttgaatatcaatcgcacgatgccgaaccaatcaataagattgaggcaaccgcaatgttgaccggaatcgttatcgatacgaagtcgttttcattacgatcaggatcgcggacgtttgatgctgctagttatctacgatcagccggtgcggactcgttactcgttcaacaatttatgaaggagaacgttgatagttatctacaacgcaatcatctgattgaaaccgttgaatttgttaaccaggatatggcattatgtgttggtgaagatgatcaggtctatgacccagtaacggcggctcaagctgctgattcactattatctatgtctggtgtcgacgcatcattcgtgattacacgtcgtgaagatggacgggtcggaatttcggcacgatcacttggcgagatcaacgtacaagtttatatggaaaaattgggtggtggcggtcatttatcgaatgctgcaacccagattgaagggcagtcagttgaagccgtcaaacaatcgttgattgatttgttaacggcaactgatgagccgaccacagaatctaattaggagtgagtctaaatgcaagttatttttttgaatgatgtccgtggtaagggcaagcggggccaaatcaagaatgtcccggatggttacgcgcagaactttttaattaaaaagggattggccaaggaagccactaaagcggcaatcaatacgttgaaggctgaacagaagtctgaagcagcacgtgccgctgaggaattagccgaagctaagcaagtcaagacagttttggaagctgatgaaacggttgttgaattgaaggccaaagctggtactgatggtcggttgtttgggtcaattcctagcaaacaaattgcaacggcgttagctgaccaataccaagttaagcttgataaacgcaagatcgaattaccagaaccaattcgggtattaggttacacaaacgtgcccgttaagttacatccagaagtaacggcgaaaattcgcgtgcacgttgtcgaaaagtaaaaggacggatcacaaatgaacaacgatgtgctggatcaaaccccaccacaaaatattgaagctgaaaaggcagtcttgggggctattttcttaaacagtgacgccctcgtggaagcgatggagtttgtcgaagcgcaagatttctatcggcgcgcacatcagatcatttttgccagcatggtgactttaaatgaccgtgacgaggctattgatgcggtgaccgttagtgatttattaacggcccaaaatcaattggatgatgttggtgggatgagctacattgctgaattagctgggtccgtaccgactgcggctaacgctggctactatgctaagattgtggcgcaaaaggcgacggtgcggcggttgatcaagacggccacggagattacgcaaaaggcctatacggaaaatgatgacgtgaccacgttattagatgacgcggaacgcgacattatgaacgtgtctgaacagcgtaatcagagtgggtttaagtcgatttcagatgtgttgaacgcgtcgattgaagaaattgaccgcttgtatcaaaatgatgatgacattaccggtttaccgactggttttgcggagctggataaaatgaccgccggcttacaaccggataatctgattattttggctgcccggccagccgttggtaagacagcctttgtcctgaatattgcccaaaatgtggcgactaaaacggatacgacagtggccattttcagtttggaaatgggtgccgaatccttagtcaaccggatgctgtgtgcagaaggtagtattgacgctgggcatttacggacggggcaactgaacgaagaagagtgggaacacttggtggttgccatggggagtttgtctaaagctagtatttttattgacgatacccccggaatcaagatgtcagaaatccgggccaaaagtcgccgcttagcgaaagagcaaggtaacctcggcttgattgtggtcgattatttgcaactgatcgaaggtagtaacacagaaagtcggcaacaggaagtttccgaaatttcgcggcaaatgaagaaactggctaaggaactaggtgttccagtcattgccttatcacagctatctcgtggtgttgaacagcgtcaagataagcggccagtgctttccgatattcgtgaatcgggttcaattgaacaagatgctgacatcgttgccttcctataccgggaagattattatgatcgcgaaggcggcgacgatgatgatggcggtaattttggtggcggtggtgactttaatggcggcgatccgcgggacgaagatgcttctgaggatgttggtgaagttgaagtgattatcgaaaagaaccgtgctggggcgcggggaacggtcaaactattatttgtgaaaccatttaataagttctcctcagtctcttatgcgcaggatccccaagcttaattgcagtcgatcaataaatttgttatcaaattcctcttaaactaattaagaggaattttttgtttatcacgtgccgaggccacttgttttccgccaattggttgggctgatgcaccaatttggccgtgataataatgagttagtgagataaatgtccctgttattttaaataaactttgctatgatgaaaagtagacagatttaataatggtggtgatggcgtggcacaaaagcaactcattaaaacgccgtggctaattgccgggcagtttatgaataacattggtatgagtttcatttggccgttaacgacgatctacatgcacaatgtgttaggtaagtcgttgacggagactggaattgtcctgatgctcaattcagttgccaacgttttggcaagtacgattggtgggcgtatatttgatcgaggtaatccttatcacctgttactgatgggaatcacgttgaatggcctcgcgaactttgctctgatcttttttcatggatggccgtggtatccgatgttgttagtcgtgaccgggtttgctagtggctggctaaatacgatgtttaatgctttggctgccagtgtcccccgcgataaagtgcggcgaacgtttacgttgatgtatctcgctgccaatctcggagttgtcttcggcacgatgctggttggtatcgtgtatagcatggggatggccttgctattctcgatgaccacgagcctcttcgtgattttcttgattattgcattatttgaatacaatgtggattcgtcgaacgtgaccggggttgatccgcgccaaggacaagatgtgcacttgccacgggccaattttcacattgtctggaccttctttattagtttatttattatctggttgctatacgaacagtgggtcagcaatttatccgtctacatgacgaatttggggatgccgctgcggaattacagttttctatggacaatcaacgcgggcttactggtccttattcagagtattttaagtttgctggggaatcggattaaaaatttatataatcaatttttcttcggcatgctattcgtgggcttatcatttctatcacttgtgattgcgcatgattacccacactttatctttgccatgattttattgacgattggtgaagcaacttggtcaccagccatgccaacactagtgagtcagttatcaccagttagtgctaaggggcgttaccaaggactagtacaagccttttgtgcgttagggcgctcgctagggccgttatttggtggtgtgattatcgataattggtcttataaggtgctgtttttgttggcatttgtggttttattgatcgtgttggcagttaatatcggtgtcgttcactttaatttacgcaaggccgttaattatatgaagacggacgttcagaccgatgtttcacgtgaaacaaaataattagagaagttggtggcagtagtgaaagtgatacgaaaactaaaggctaaacgagtcgtgattaaagtcgggacaagcacgctagtttatccagatggatcgatcaacttacgggcaatcgatcaattagcctttgtcattagcgcaatgcgacaccgtgggcgtgaagttgtcttggtttcgtcaggggctattggtgttggcttgaattatatgggactcaagcaacgtccaaaagcaattcctgaacaacaggcgattgcggcgattgggcaaactgaattgatttcgatttacaaagaacgtttcgccatttatgaacaaaaaattggccagttgttattaacacgtgatatctttgtttatcctaagagtcaccataatgtgttgaatacatttgaggcgctattaaaacaaaacgtggtcccaattgttaatgaaaatgatacggtcgcggtcgatgaattggatcatgaaacaaagttcggtgataacgatcaactatccgcaatcgtggccacgaatatcggggcggatttgttaatcatgctatccgacatcgatggcttttatgatggtaatcccaatgcggatgcccgagcccagttattagggcacattgagaaggttgatcaacatacttataagctagctggcggtagtggcagtcggtttggtactggtgggatggtcactaagctaaaagcggcagaacggatgatcgatgcgaatggtcaaatgattttagccaatggtgcggatcccacaattatttttcaaattttagcaggcgaaccagtcggaacgctattcggttaagttggggaggttatcaaaatggtagatttagaacagttgggtcagcaggctcaacaagctagctatacgctggggttactttcaacggcgcaaaaaaatcaagtgttgaccgcaatggcaacggcgttaacgagccatcaagatgagatattggcagctaatgcgcaggatttagagaacccgcaagtaccagttaagtttgttgaccggctccgactaacagcagaccgcatccaggatatggcgatcgggctcaaacaggtcgtgagtttgccagatccaattggaaatgtggaccgcgcgtggcgcaacgaggccgggttgatgattgccaaggaacgggtaccattaggtgttatcggcatgatttttgaagcgcgccccaatgtgacggtggatgcatcagcactgtgttttaaaaccggaaacgctgtaatcttacgcggtggtaaggaagcccttcactctaatcaagcacttgtccaagtcttacgtggtgcattacgggccgaagcggtcgatgagaatgcgattcaactgattacggatacgtcgcatgcgactgcggctaagttcatgcagctcactgattacgtggacgtcttaattccacgcgggagcgcccgtttgattcaaacggtgttggctaaagcaacggtacccgttattgaaacgggagccggtaattgtcacgtatacgtggacaaagacgcgcaattgcaaatggcaaccgatatcgtgatcaatgggaaagttcagcggccatcagtttgcaacgccactgaaaagcttctaattcatcgtgaggttgcggccgattatttacctagcatgattcaggcacttcgtgaacaaggcgtagaagtacgcggggatgccgcaactcaagccattgttcctgatgtggttccagcaacggatgcggactggggaacggaatataatgatttaattattgcagtgaaagttgttgattcagaagcagcggccattacgcacatcaatcgttacaatacccaacattccgaagctattgtgacggataattatcaagctgggaagctcttccagcaacgggtcaacgcatcgtgtgtttatatcaatgcttccacccggtttacggatggctttgaatttggatttggcgctgaaatcgggatctcaacgcagaagttacatgctcgcggtccgatgggattagcggaattaacatcttataaatacgtcattgatggcaatggtcagattcgccattgatgggcaagtatcgttattagtcagtatatcggctaatagcgatttttttattgccgattggggggacaagtgtttatccgatttttgacttcttgatttaataacccaccatagccggtctagttttaagctcgcgtaccatacgtttggttcaaaagcgcaagctagtttcggcctgaatagtgaaggcataataccatggtgacttagaatgctgagcgaaacttttagttgacagatgtaaacttaaaagctaatcttatcttaattagtttttaatctaaggggaggaatcatgatgatgaacgcaggattgcaaaacgttattgtagtcgtgaaaaccagtaattaccggtttaccacggataacggaggcttaccgttgatgtgttgttgtcggcgccaatcgaagtatcgttgccagtaaccgacatcatcgttaagttaggagtcatcattcatgaaaaaaagaatatggatcagcagtattgctattgtagccctaggattagtgttaactggctgcggtagccagcagagtagtcagcagaagacgttgaacgtaacggcgacccagtcgattgcgaccgctgatcctaataaggccgacgatatcgctagtcaggccgctattgctcagtttatggaaggcttgtacacaactaatcaaaaggggaaagtcgtgccggcaattgccaagaaagtcgtcaaaccgactaataatgggaagacttatacctttaatttgcggcacaatgccaagtggtcgaatggaaaaaaggtcacggccgctgactttgtttattccgtgcaacgccaggtcgatccgaataccaagtcacaggaagtcggacacgttgctgaaatcaagaatgcaacggcaatcacggctggtaagaaggcggtgaagaccttaggcgttaaagcgttgggtaagtataagttacaaattacattgcaacagcgcgtgccgtattttaattatcggctagccacagagatctatccgttaaacaaacaatttactgagaaatacgggaataagtatgggacatcggcacagcgaacgctctctaatggtccctatgtcttgaagagttggaatgggacgaatgacacgtggaaatatgtgaagaacccgtattattatgaccgtaaacaggtccgaatcaagaatattaaggtgcagacggtcaaaaataacagtacggccgagaacctcttccaaagcaatgaggtccaagtcacccagattacgggcacccaagtatcggcagctgagcaagggtcactaaaaagtcagatgaaggttacgaagttaaatcaactctacttcatgttgtggaaccagaagcgctcagcattgcagaatactgacttgcggcgtgctgtgagttacgctttgaatcgccagtcattggttaagaacgttctcaaagacggctcagtagcggcgacgtcattagttcctgctggcaataccaagaacccgacaacagggaaagattttaatacggataccggaaatttgtatccatacagtccagcaaaggctaaacagtattggcagaaggctcaggcgagcttaggaaagcaaaagttaacactgcaattattgacgaacgataatgatattaataagtcggtggcagaatatattcaagctgcaattgagaaaaatcttagtggtgtcacggtcaatgtcaagtcagtaccactgacaaatgagatttcaactttaagcaagggtgattttgactttgccacgttgtcgtggtcgagtgatttccaagatccagttgatttcttgaataaggcttcgataactaattctgtcaactttgggaagtttaacaatgcgaaatatgagcaattaatctcaacgattacggccgataagcagtcaactaaggcccgatatcagacgatgcagcaagcggctaagctagtcgctcagcaacagggggtcacaccgatttatcaaactgctgctgctcacttgatcagtaacaaggttggtggggttcacttcacattgttgcgagacgccctttatcgctatgcctactggaagtaatcagtcagataaatattattaatttgatagaaatgtaattgaataaatcaactagcccgaaaaaacgcgttttttcgggctttttttgatgttttggcaaacggcgcaataaaacggataaccacgggcttaactgtgaatagttgtcctgaatcagtttgcagtgttctgggtgaccagtcataataatcgttatcttttaggggtttgtgccctgtttgaccactaagtaaggcgaccttatcaaggataggcaaacaccctgtcaccttcttataataagattaattttataaactgctcagttaatcacatagggggtgtgatgctttggttaaacaaactacggaaatgaatgatgcaagttacttatttaataccggcgcaggatttaatagtcaggattacttaggctgtcatttggccgcatctggtcgggcggtatttcgcgtctgggcgacgcatgctaaggcggtcggggttgttggcgattttaatgactggcaaccaagcgcactaaagttattaggggcgactgggatttggcaaggacaagttccgaacgttcatgcgggtcagttatacaagtttcagatcacaacaccaactggccaagtgcaactaaagattgacccgtttgcacaacagttcgaacgaaaaccgggggatgcggccgtagttgttgagccgatgacgatgcgttggcacgatagtttgtggctagctcgccggaagaagtcgcgcgctgccaatcggccaattaacatttatgaggtgcacttaggttcgtggcgccgtcatcttgatggtagctactacacttatgcggaattagccgctgaactgattccctatgtaaaacaacggggctatacccacattgaattaatgcccgtgatggaacatttattagatgcgtcttggggttatcagcaattagggtattttgcgccaaccagtcgttttggcaagcgtgacagttttctcagctttgttgaccagtgtcaccaagcgaatatcggggtattcgttgattgggtaccgggtcactttattcgcaattatgatgcgttgtaccagtatgatggtacgccgacatttgaatacgctgatcctgagcgcgcgaataaccgtcgttggggggcgtggaattttgatctcggtaaaacacaggttcagagttttctgatttcaagcgccgaatattggctcgaccagtgtcatctagatggcttgcgagtggatgctgtctctaacatgttgtattgcgactatgatgaagggcgcgaagggcaggttaatcagtatggggataatcgtaatttagaaggcatcgcctttttacaaaagttgaacaccacggtcttaacccaccatcccgatatcttgatgattgcggaagagtcgtccgcctatccgcaggttacgggttcggtggccaatggcggattgggatttaactataagtggaacatggggtggatgcacgataccctggatttctttatgatggatccgttatatcggcacgatcactttaatctactgacatttgcattcgtgtacatgttcgatgaacggtttattctaccgttttcacatgatgaagtcgtgcacggcaagaaatcattaatgcataaaatgccgggggaccgctataatcagtttgcaaatttgcggacgatgctaacttatatggctgcctttccaggaaaacaactgaattttatgggttcagagtgggggcagtttctagagtggcgggactggagtgcgttggaatgggtcgacttaaaggatgatctcaaccatcggatgcaacagttcacaacgcaactgaacgcggtctatcggcacaatcggccgttgtgggaacaagaccatgatcctgcggggattatttatacacataccgatgatcctgacagttcgaccatggggtttatccggcaggccaaacgaaaatacagttttgtggtcgctgctttcaattttgttcctgttgaacgtcaagattaccggattggcgtaccgtatcgtggccgttatgagttgttactcaatactgaagcgcaggcttttggcggcacgtggacaaagctagaaacaacgtttacggcggtcgataagccgtatcgggggcaaccagctagttttaccgtgaccttgccggcgatgggtgcattgttgattcgaccagttaaagtgatagggggagttaagcatgcaagatgaaatgttagggattattttagcgggcggtcagggcacccggcttggtaagttgacaaaggatacggctaagcccgccgtgccattcggcggtcgttaccgaattattgattttacactcagcaactgtgctaactcgggtgtgaatactgttggggttatcacgcaatatcaacccctagaactgaatgcacatattggtagcggtgcgagctggggctttgatagcttaaatggtggggtgacggttttacaaccatactcgtctagtgaaggtgagaagttctttcaagggacggcgcacgccatttatcaaaatatcgaatatattgatcaacaagaccccaagtacctgctcgtcttatctggcgatcatatttataagatggattatgacgctatgctgaaatatcatcaggagaagaaggcttcgttgaccgttggggtgatccacgtgactaacgaagaagccaaacgctttggcatgatgaatacggatgcgacggatcgaatcattgagtttgaggaaaaaccggaacatcctaagagtgataaagcctcgatgggtatttatatcttcaattggccgactttgcgggattacttagttaagagttatgctaccgataagtcacttgaagactttggtaaaaatgtcattccatcatacttagccaataatgattccgtttacgcttatgcttttaagggttactggcgagatgttggaacgattaagagtctgtggcaagccaatatggaattcctatcgccccataaccggttaaatatcggcgatcgttactggcggatttactctaaagcagaggtgctaccaccgatgtttttgacggaaacgagccaggtcaataatgccatggtcgttgatagttgttacgttgcgggcgaaattgatcattcaatcttatcgcaacgcgtgtcagttgggatgggtagtcgcgtggttgacagtatgattatgcccggtgcattgattggcgaagatgcagtgattgaccacgcattgattggcgaagatgcagtgattggtgatgatgcccagattattggtacgactgataagattgcagttgttgggtatcacgaaacgatgggggtggaacaaccatgagacgtgaacaagtgagtgccattattaatttactggaaccaagtgacgcgttacaaccattgactgcagttcggccagttggaatgttaccctttggtggtcgttatcggttggttgattttcaattatcgagtgtcatcaatgcggggattcaaaatgtgatggtgacggtcccgcggtcagggcgttccgtggctgaccatttgcgtagcgggcgtgactggagcctgaacacaattcgcggcggcctattcttgtccccatacaatgacttgaaattagtggcgccagaaaagaaggccgcattactgcaccattactatgataattcgattcagtttctgaaatgcagccagagtgagtactcggtagtgatgagtactcgcaatgttggtaatattgatttaaaggcgctactacggtatcacgaggaacgtaacagtcccgtgacggcggtttataagcgcgttgatccagctagtttgattcccgaaaatacaatcttacaattgactgctaagggagaagcaacggcggtcgttccgatgagcaaggccaagattagcccgaagacgaaacaagttgccaagagcatggctatttacttgatgagtacggtcgatttaatcgaattattgcagtcggccaatcaacggggtgacatgatcagcctagaggaattgatgcggcaagcagtcatccaacataacgctaatgcttttgaatatacgggctttcaggcgaatattcatgatatcaacagctactttgcggccaatatggccgttttggatgaagctaatttccgagcgttattctacagttcgcgccgtatttacaccaaggtcaaaaatgaaatcccgacgttctttgcgactggttcacagtgtcgtgatagtttatgtggtactgggggctatattgaagggcaacttgaccactccgtcatctttcgggatgtactgattaatcgtgatagccaagttaaaaatgccatcattatgcagggggcccggatcggtgccggttgtaagttagaaaacgtcattatcgataaagacgccgtaatcgggcccaacctagtgcttaaaggaacttcaacgacaccgttagtcatcagcaaagggcagcacgtctttcaacaagcggaggtggctgtgcatgactagggtattattcgcggcggcagaagcggcccctttttataagactggtggcttaggcgatgttagtatggcgttaccgcgcgccttgcaagcggaaggaatcgagacgcgtgtagtgattccgtattaccctcaccagatgccgaccgaatatcagcagcagttagtgccagtgacgcattttactgttcaagtgggtgaacatgcgatgtattgcggtattaaaactctgacagtcgcgcacgttcagtattatctaattgataatttagattattttggtcgtgaaggattatatggttattgggatgatggtgcacgctttgccttctttcagatggcggtttgtgaaatgatggagcagatcgattatatccctgatattttacaactcaatgattggcatacggcgtttattcctgtcttgctagctgaaaagtactattggatcgaagcgtatcgtgatattaaaacggtgctgacgattcataacttacagtttcaaggtgtctacgatccgattattttggatagtctctttcgaatcggaactgagacttacaccgaagccggcgtggcgttttacgatcaagtgaactggctgaagggcggtattaactttgcagatgccgttaatacggtgtcaccgacctacgcacaagagattcaaacaccagcttttggggaacgtctcgacggggtactgcgggccaatcggtacaaactgagtgggattcttaatggcattgatatgcaattatacgatcccgcaaccgacctggcactaacggcgaattattcggctaagaatttgaaacctaaacgtcagaataaacgtgctttacagcgccgattagggttgcctgtcaaaaacgtgccggtattggcagtcgtttctcggttaacgaagcaaaagggtatcgacctcttgctggatgcattgaatccattcttgcagcaacaagatgtgcaactcattgttttgggaacgggtgacccagcattggaacgcgcgttacgcacctatcagtcggcgtatccgcaaaaggtggtcgccgcgattcaatttgatacgcagctagctcagcaaatctatgcggccagtgatatctttcttatgccttctgcctttgaaccgtgtggcttgtcgcagatgatggcgatgcattacgggacgttaccgatcgtgcacgcggtcggtgggttgcgggacacggtcattccgtacaatcgctataccgatcagggaaccggctttagctttgacgactaccagccagcggttctacgtaaaattatggttctagccgtgaccttatatcggcagcatccactggtttggcggcagctgcagcaccaagcaatgacttgtgattttggctgggaacattctgcacagcagtaccgtgcgacttatcagaagctaatgcgttaggtttgatgggggtgtgaatttgaaattaacgtgtgcgcaatttaaaaaggactttctaagtgaaattgagaccttgtattcaacatcgctgagtgacacctcgacgattgggcaatttattgcactgggacagctagttcggcgctataacagtcagagttggacacgaacagctaaattttaccgcgatcatcatcagaaacaagtctattatttttccatcgagttcttgccgggacgcttactcgcttctaatttgttgaatctcaacttattgacgacggtaaaaaaagggctaacggaattaggcttagactttgagacaatcagtcaggctgaacctgatccggcgcttggtaacggaggattaggtcggttggcagcctgttatatggacgcgatggctagtttgaaaattgccggcaacggtaacggcatccactatcgttacggcttgttcaaacaagttttcatggatggctatcaagtagaattacccgatgattggctccatcatggcaacgtgtgggagacccggcgcgataacaagagctgcattgtccagttcggcggcaatgtgtggttacaaccgcaagcggatggtagtttacaaccgcaatctgaaaatacggaagacgtgctagcggttccttacgacgttggtatcgtcgggtatcacaacgatattacgaacaccttgcgtttgtggtccgcggagttaccacccagtgcgacctattcttcgcaggatcagcgtgatcgaatcagtgagattaccaaggtcttgtatcctgacgattctaactcggccgggcaacaactgcgtttacgccaagaatactttttctcttctgcgggtgttcaaagtatcgtgcgtgatttttgtgcgacgcaccatggcatcaaattgttaggcaaaaaggtcgcgattcacattaacgatacgcacccgacgctggtgatccctgagatgatgcggctattaatggatgaacatcactgttcatgggaagttgcgtggacgttaacgacgcaagtcatgagttacacgaaccatacgattttacaagaggccctcgagacttggccaatcgatatgtttaaaaacctgctacctcggatttatcagattattgcggaaatcgaccggcgctaccgggaacaacaaacgccgatttttggcaaagcgctcgttgatcagacggcgcctttaggcaacggacaagtacggatggcctacctagctgtgattgggagtcacagtgtgaacggtgtcgcgccactgcatacggaattactgaaaacggatgtgttacggggcctgtatcaagtttatccggagcggtttaataataagacgaatggcattgcaacccggcggtgggttcaattggcgaaccaaccactagcgcaattgattgatcagacgattggttcggactggcggcggcaaccagatttattacagacgctactgccgtatcaacaagatgaccactttttgtaccagttaggtcaagttaaactgactaacaagcaagctttagccgcgtacgttcagcgtactatggggatcaagattcgcaccgacgcgatttacgatgttcaaatcaaacggttgcatgcttataagcggcaactcctacacgtctttgaaatcttgcgcgagtattttgccattaaggatcatccgcaacagccagtcgtgccgcgagtacacattttcggtgccaaggcggctcctagttatcactatgccaaggcgattatcaaactcattaatgtcgtcgctgacatggtgaatcaggacccggcgattggtgatcggttaaagatcgtctttattccgaactacggggtctccattgccgaactgatcattcccgccgccgacgttagcgagcagatttcaacggcctccaaagaagcgtcggggactagtaacatgaaactgatggccaacggtgcattatcattggcaacgtatgacggcgcgaatatcgacattatgcaagcggcgggtgctgaaaatgaatatccgtttgggcttaaggtcaatgaagtgtacgactattaccatcgcggcaactatcacgccgctgacttttacgatgctgatcctgaattaaaacggctcttagatagtttgattgatggcacgattccgggaattccaacggttggtcgggaaatctatgattcattactgcggtataatgatgaattctttgtcttagccgattaccgggcttatgtcacccaacaacagcagatcagtcgtgattttcaaaatcaacccacttggcaacaacgctcgttagccaatattgccgcttcgggacactttgccgcggacttagcagtggcgcggtatgctgacgatatttggcaagtgccccacgaacgactgaattaagaaaggaagggtgacggatgcaggtaacgtataactcatttttacccacgtataagacgccctttggtgccgtgacccgccagacacccgttcaattcacaatcagtgttcagacagtaacgccggttaagcagattgatttatgcgtggctcatgatggtcagtgggatgatgaacaggccttaccgttacatccaatcagtcccacaatgtatacggccacgtttataccgacccaggttggcctgtacttctactattttcggattgaaacggcgaccatgaccgcttattatggttgcgttgatggtggttatggtggcccgggcgttcaatacgtcttgcgcgagcatgttcaaatgtatcaattgacaatcttgaaagcagtagaaacattgccacaatggtatcgtgaaggggttgcttatcagatctttgttgaccgcttcaataatggcaacgcggatggccacgttaatgcgcccaagccaaatagctttatttatggtcaactaacggatcgcccactatacgtgcgtgatgaacaccgggcgattttacgctgggatttttacggtggtaatttgcgcggtattagtgctaagattccatatttacagcgactcggtgtgacaattatttatctgacgccgatctttgaggccagcagtaatcatcggtatgatacgggtgactatctgaagattgatccggtcgtcggcgatttgacggactttgataacctggtcgcggccgtacaccgggccggtatgcgactgatcttagacggtgtttttaaccatgttggtgtggattctaagtatttcaatcaggcgggccattacccgacggttggggcaactcagtcgaccacgagtccgtactacccgtggttcacattcattcattatccccacgattacgatagctggtggggcatccgtgatctgccgacagttgataaagacgatccaacataccgcgattttatctttggtaaacccgattcggtcattgattattggacgcaacgcggtgtggatggctggcgcctagatgtcgcggatgagttgccagacgatttcattgctggaattcgacggacccttgaccgttatccggataaggttttgatcggtgaagtttgggaggatgcctctcataaattagcgtatgggatgcgccggcactacttagagggcggcggcttacaggctgtcatgaattatccgctccgccgcttgattattcacgttttaaacggcacgctaacaccggccgaatggtggcgtgaactaatgaccctcaaggaaaattatcccgctacgacgtttcgctttaacttcaataacatcggtagccatgatacgcccagaatcctgactatgttagccgaagatcgccaacgcctacgtttggccgtccaactactcttgacgcttccaggtgtaccgtgcctgtattacggtgatgaggcgttgatgatggggggaaagaccctgataaccgtgcgttttatccgtggcaggacgcagatcaggcgcaagttcagtttgtcgctgactgggcgaattggcgtcaacggcacccgtggttaaacacagcccactttgtgccgttttacttggcagattatggcattggctacctttattggcaggctgatcagaccgtgatggtgattgtcaatgtgactactgagccgcgaaccatgacgagtcacgatttaaagttgagtggtgtgcccataaaattagcacaagcgattcaacgctgccttgtgacgcagacgctgggtggtgaacagttgcgccttattgaaaactttacctaaattttacaggaacttgatgattgttagtacggttcagccgtatagtataattgtactttttaatagcaccccgctattgattatgtattacgaagtactcatcgatccttaatgagacgtaggcacattagtgcgtggctttccttgattggccacgcatttttgtgcgcttataagcagaatgtctgcgttgttcagacgaggtgcttataataaaggtaaacactaaagcaccttttcggatggttttaaatagacgtcatcacgaaggtaattagtgtattggtggcgctggttattggccagtgactgattaattagggggtaattggttgtatcaagcagtagtgttttttgatttggatggaacgttaatgcaggacgataagacggttgcggccagcagtgtgcgggcaatccagcaattacgagctaaccacgtcctacccgtcattgccacgggtcgcaatgtattcgaagttcaagatgtgatgacaacgacggggatcgattcaatcgtcagtgcgaatgggagttacgtcgcgtatcaagggcagtttttgagtgcgcacgaactggataaggagcttttgaccgatattactcattttgccaatcgccaacagaatgcgctagcttattataataacgccggttttgcgttaagccatcgtgatgcattgacaaccagtaattatcgggcactcagacagacggcccgggtcgcaccgcacttttatgaacatcaacatattaatttcttactgacgtttgatccgttgaatgcggcgcaatatcggcagcgatatcgaggccgactacattttgttcgtaataatccgcgtgcgctggacactatgcaatggggcgtctccaaggcggttggaattcaggatatcttaaccaaggcgcatttaactaaggtaccgacctatgcgtttggtgatcaattaaatgatattgagatgttccgaatgatccagacaccgattgcaatgggcaatggtcatccgcaggtcaaacaactcgcgcggtacgtgaccgctgacaacatgcacggcgggattgcccaaggattgcaacattttgatttgatttgagaattgacagctagtctgataattataagcttccagtgagcagtccaactggtgagattagcgactggcttaaacaaaacaaaccggatttggtaaccatgacgtggtcgccaaatccggtttgttttgtgatgagtttaatggaaatacgttagtttagttgtgccttaatattggcgagtgtgagctgagtcgtatcggtaaaattgatatctgccgccgctaaaacggtcgggtcaccaataccgatggcagtttcgccagcgcctttgatcgattgtacgccagccgccgcgtcctcgacaccaatacagtcagctggattaaggcctaaaatctcagcaccgcgccgaaaaatctcgggatcaggtttaccgtgtttgagactagcggggtcgacggccttcgtaaagtagtcactaagaccgagtttacgtagcacaagcggagcattttttgatgctgaagcgagtgacaatgcgtagccagccgttgttaattcagtcaaaaaggcggtgatgcctggtagaatgttggctggggtcatttggttaacgagctgcaaataattggtgttcttttccgtagctagcgcttgtttttgggccggtgtgaagtcattttctcggtgcccttgagctagaatgaggttgagtgaatccatccgactgatacctttgagcgcgtcagctaattgatcattccaactgaccccgactttatcggcgatctggtgccaagcttggctatgaaaagtagatgtgtccgtgataacgccatcgaggtcaaagacaaaccccttgattgctgcaaatttaaccatgttgattgcctcctagattaatcggtataagtgacggaaagtggtttcttagcttgtaattggcaatgctgttttccaatcataatcgtgctgggttggtccgcagtgacggttacccgttgatgatcgataacgaaaacatagtgaacaccccgaaagagatgcttgaatttcaatgtttgccagtgttcaggtagccgtgggctcacctgtaagtgggcacctagtggattgaccccgccaaagttccgtgtcgtcaggtttaaggtcgcacacatgacgccgaggtgaatcccttcagcggtcgtcccaccttgaatgtcgtaatagtcggatgcgagggcctctgagaaaagcttccaggcgtcatcgtcattatcgtcaagctgattcaaaacggcgtaaacgatccgcgagagagtggaaccatgcgttgtgcgcgctaaatagtattgaatgttatgggtcagatactctttaggaagttgatatcccattttttcaataatcttctgaacagttgtgacatcgaagttataaaaggccatcaaggcgtctgcttgtttggccacttggtaagcatcgggtgtcttagactctgctttcaagatccggtccatccgggcgatgtcaccgtacttttgccggtaagcttgaaagtcaagcgtcggtaggttgaagtacccctcaaattgagcaatgattccccgacggttgatttcaagtgttaattgatgactgatcgtcgttaacgcttgctcagccgttgagtcaaattgtgcggcctgagctgccgcttgaaaagcagcttggggcatctgcgcccgaagcgtggtaatcgtgtcaaagagccacgcaaccatgatattggtataggcgttattcttcaatccagcggtcgtgctgtttggatagttttcatggaattcatctggtcccatgaccccactaatgttataacggccattagcttggtcataatctgctttactgatccaaaaggctgcgatcgatagcaacatttccataccataatgagttaagaaatcacggtcctgagtaacgtggtagtaaaaccagacgttgtaggcaatatctaacgagacgtgtcgctggagccggctattatctggatcccaggttttagtaatgggatttaagtgagtgaattgagattgttcatcacccttggatgctgattgccaggggtacatggctcccgcatagccttctgcttcggcatttttacgcgccattggtagtcgccggtaacgataagctaagagttgtttggctagttccggtcggtgcaacgtgtagaatggtaaaatgaacatttcgtcccaaaagacgtgtccccggtaagcttctccgtggagcccccgagcaccaacggaagcgtctaattggccgctttcaattgcggcagcggaaacgaaactgtggtaaatattgacgcgcagtaagcgttggcttgtaatatcgccacggatcttaatatctgtggcgcgccaagtcgcttcccaatagtccttgctagtggttaccgtattgtcaaaactggactggtcgagctcggcttggacgtgggtcaactggggatcactatggtcattactagttgcaatgacgacgttcttatcgaaggtatacgttttaccagcttctaccgccagtgaaacggtttgctgaacgccctgaggttgttgcgtgctattaaagttctcaattgcaggaacgtctgggctagttagtttggccccaatcgtgtaattgatatgtgatgatttggtctgaccagaaaggtagacggtattagcagccgtttcgatgcccatagtcttcagatgatgctgatcgaagacgttatagcggctaacgttgctattcacgacgctaccgtcgatttcggtatagatttgtagactacccgcaaagttgagtggggtgacttggtaacgaatgctgtaacggtgccaatcacgcatgttggcgactttctgcgaccggattctgagttgatgtccggaagcgagctgaatcaatttagtggtcgtcaagagtcccgttttcaaatcaaggctccgataagcatcttgtaaatcatgttcgttgagtgtaaagggagtctgatgatcaataccgaaagtcatgaactgagcgttcggtaaattgactaaatcttcattcttcacttggtggtcatgaacagtcgtggtggtttgatcatagaccccggcaacgtatgtcccaggataattgtccttgtcggcgtgactttccaaaaaggcgccccgtagaccaaaataaccgttaccaatggtcaacatggcttcttgaccattattacggacaccgtggtattggccgtagtaatccaaatgccattttaaataggcacttttagctttaactgcggctactagtccaagttgatcaacggcagcttggctaacgactgggatattaagcaaattagtcaaagctagcccgacatcaatgcgatcatagttgacaccgacgattgtgtctgagaatggataggacagtccgttttcaagaatagcagcatcgaattgaagtccggctaagcgaaccttgatgttctctagattttcaccaattgtttggtcagaattataggcaatcaggtaatgggccgttgcggcttgccccgatactggatgataagcgatatccatcgcgtcattttcaattcgcaatctaataagtttcataagtccacactccttagttcggtcattaaaaattgcaataagtaatcctaaatataaaaatattaaccataactacagcctagtctctttttacaagactcgcaaatattggtgatgaaagtaggggctgacgaggttgaaagtggcgttgttttcgaaggtgaatgaacaaagtgttctggcttgtgctgatgatacttggtctttgaagcacgtccggaatagtcggacgtgcttgcattaataactggtttgaaagtgatatcacgcttcgagccatgctagttgttgggtgaccaaagcacgaagcgccacaactagaatttgcgtagaatctagtcgtggcgcttcggttgtgtctttctgagaaggcctaatttgtaacggctaatctaagtgagcggggccgtcagtgggctgatcaacgagttcgagatggtcgatcgtcatcatctggcgaatcttgattgaacttgtctgaaacctgagaatgacggggtctttgtaatttagttgctgctgaaagtccgttagttcagcccgccaatcttgttcaaaaacgttggtaccgactaatgagagttttccccgaagcataattgacgcatagtctgacagttggtaatagaataaactcgcttgacgccagttttgaatgttctgcgttgttgaagtttgacgactagtatagaagtaaagttcttctaggctccgtttgataggtaagggactgagcgctaccatggtcggaaagccgtccgcatcaacagttgctaacgtgaagacgggggcggtttggatcatatgtagggctgcctgacgagtcgtgtgttgcatacttagtcacccctttacacctcagtatgcaggaatcatgggggaaagtcatacgttatgcacaccgttttcagcgattaaaaactagggatgtgatatacttaagccacttaacgcgtggaacgttatgattgattggcgctcccaaggttaacgatgttgttactgcagtcagttctgagaggacttatctaataatgaagaatggtacagtaaaatggttcaatgcggataaagggtttggttttattacgggtgaagacggtaccgatgtctttgttcatttttcagcgattcaaactgatggctttaaaaccttagatgaaggtcaaaaagtaacttatgatgaagaacagggcgatcgtggcccccaagcaacgaacgttcaaccacaatagtaactgttgggccgaaccattatcattaactggttcggtttttatttgaagtgacgggttgtcagctaaacaagaaagctaagtggtcggaatggattttgtagatgtttacggcattaagcatgagaattgtacgttagttgcacctgcgcgtgaatatcagcgggtcgttatttttatggacgcattgggccggcgctttgttgcaatgggaccggatccacaaccaactaaatatggaagtagtagccaacattggcatcaagcacagccgagtgcagctcctgaaggttatttccatattgatcaagaataaccctagcaattgagttacttagctacgctgatggtaaacattagatcgttagaaaaagcctcagggacgtcacacgcactttgcgttgtgcttcctgaggcttttttgtaggaataaaaaaatcagctttcacggtggattatcacggcgtgaaaactgattagtgtggttatatgatgggcagtcaggggatcgaaccctggacccacggattaagagtccgttgctctgccagctgagctaactgcccataactcaacaaaaaatataatatcatgaattttgagttctgacaacactatttcgaaagttttttcaaaaaaagtgattttttgagtaattaattggtgaaaacgattgcttgaactggcaaatgatttcccgggaaatactacggccacgcggattagcaatcaaagaaagccaactacatttgtgatatactaaaaccagtgttgaatttagtttcaaccaaccctgacacgagaaaggacctgttttctcgtaatatatcgcgaatcaccctaaaaattgaaatgtaaacctgttttcccctaaggaggaagaatcgttatgaaaaaaatcttagtagttgatgatgaaaagcccatctctgatatcatgaaatttaatctgaccaaagaaggctatgaagttcacgttgcagctgacggagaggaagccttacaaaaagtggatgaagtccaccctgatttgattttgttagatttgatgttgcctaagatggatggcttggaagttgctcgacaagtacggaagaactatgatatgccaattatcatggtaacggcaaaggactctgaattagacaaggtgttgggcttggaactgggcgcggacgactatgtgaccaaaccgttctcaaaccgggaactcgtggctcgagtcaaagcaaatctacggcggcaaggtgcaccaagtgctcaaccagctgaagttgaagaaaattcagacattgaaattggcgatctggtgattcatccagaagcttatatggtttccaaacgcggtgaaaacatcgaattaacgcaccgtgaatttgaactgttacattacttagcccaacatatcggccaagtcatgacgcgggaacacttgttgcagacggtctggggctatgattactttggtgatgtccggacagttgatgtgaccgtgcggcggttacgtgaaaaagttgaagataacccgagtcatccaaaatggctggtgacgcggcggggcgtgggttactatctccgcaatcctgaaaatgagtagaggttgctaaaccgtgttgagatttaaacggaaaaatttttttaaaacaattaatttcaaaattgcgctcgtgtttgcccttctattattgattacgttggaaatcgtgggtgcaatctttgtgaaacagttggaatcaaagaacatccaggattttaaacagtcggtgcaaattccaacttatattgataattcgttgtccgaacaattgaccgtcagcagtacgcgcaaggccaacggccaaatcaagacgattttgtcgaactacaacaatacgaatgttgatgaaatccaagttgttgacagcaaaggaacaattcgtgggacgagtgatgttaatgatcagtcagtagttggacaaaaaacgaccgatcgaaacgtcaagaatgcaatctataataatcgaacttacactaaaagtacctatgacactcagaataatggacgctactacgtttcaatcgtgccgctatatagctccaattcagcgggtaatagcagtcagttagttggggtactgtatgtacgggcaaatatgaagtctgtctacagtacgattaacaacattatgggaatctttgtgattgcgtcacttgctgcgatggtcttgggactgggaattgcaatcattattgcccgggcaataactcgtccaatcgaagaaatgaagcagcagacgcaacgaattgcccgtggtgattatgcggggcaagtccgagtttatagcgatgatgagttgggccagttggctaaagccattaataacttgtcgattcgagtggaagaatcgcaagagtcgacagaagctgagcgacgccggttggatagtgtgctctcacacatgagtgatggcgtgattgccacggatcgccggggtaatattaccatcatcaatgaaacagcctcggactttatggacgttacggccgaaaaggcaatcggtaactcgattttagatattttaaaaatccgtgatgattattcattgcgtgatttgattgaaaatcaagatgaattgatgcttgatttttcttcgaacgagcgtgacctaatcttgaatgcctacttctcgttaattcaacgggagtctgggtttattagtgggttagtctgtgtgctccacgatgtcacggaacaacaaaagattgataatgaccggaaacaatttgtttcgaacgtgtctcatgaattacggacaccactgactagtttgcggagttatattgaagcactgagtgatggtgcgtggaaggatcctgaagtggccccaggatttttgaaggtcactcaagaagaaaccgatcgtatgattcgaatgatcaatgaactcttaagtctatcacggatggactcagggaccacccgggtcgatatggaattggtcaatattaatgagatgttcaattacgtgcttgatcggtttgatatgatcttaaagaaggatgataatccagctaagtattacactattaagcgcgagtttaccaagcgtgatctgtgggttgaaattgataccgataaattcactcaagtattggataacattatgaataatgcgatcaagtattcacctgatggcggtgtcgtgacttgtcggctgttagagacgcataaccaagtgatcattagtattagtgatcagggcttgggtatcccacgggccgacttaggacacgtctttgaccgattcttccgagtcgacaaggcgcggtcacgggcccaaggtgggacgggcctcggtttggcaatttcaaaagaagttgttcagatgctcggcggtcgtatttgggttgatagtgttgaaggtaaggggtctacgttctatatctccttgccatacgaaccttatgaggaggaggacctttgggatgacgactcacaagcttagacgctttatcttacccattttattgacgattctgatcttattgagcgtggttttatccatgtatatctggttgaatccgtcacgctatgagcatgaaagcaaggttagtacgacgtcatcgaactcttcgttgacaactcggacaatcgatgatatttatttaccgacacaattaattcacactaacagtcagggtggccaatccctgctgattaataaaaatgtcagcttagtcagtcaatttagtgagcagttacgcaaatgggatgcgcggagtatctctaaagttcgcattacgtcggcaaaaagctaccgtgcgctcttaaatggaactgattcgtacgtattgaactttcctgacagtattactgtcagtatgtttaatacggtcttcaagcaacatctcagtaattttcgctcctcggaatttagtcggatcgtgattccaatcaatgatacgaatcacatctactttttgaatgatgaccatcatgagatttatagtgttcggttgaagaaaaaatctctgtcgtcgttgaaaaaagttttggcagtcgacaaggtcaaacggattgctgtcaagatgacctatgaggataatacaacgtatattgattatccaaagcaagttacgatgcaacattatagctacttgatgagtaaagcggctgcgagtgagattgccaaccgattactagatgcggatggtaattcgaccgtttcagtgcataatcgcagtggtaagcaggagtatacaacgggtagttacaagcgcatgacggtggattctaagctaggaacagtgtatttcgaagattatagtgattcaggaaccacgcggaacctatcactgactaatcagctaaagaagagcttcaatttgttaactagtctcggtgtcccaatggataatatccgctactacggttttgatgcaacgagtaatagtgtcatttaccggagctatgttgaagggttcccgatctttaatcagaccgaaaatggcgatgtccggattcagctcacttctaacgggttagaccgttactacttctcactgtacagtttgcaggtgccagtaccaactactggtcagaagcaagcggtgaccttaccgagttcgacaagtgtgttaaaacgtctgaaggccgctggttataaagacagtaaaattggcagtattgaacttggctacgaatggtcacagaacaagtcgtccaaactcgtgatcgacctgacgccgacgtattatgtctactataatggcacttggcggacatatacgtcgatgttaagtggatcttaggaggtggccgcatgaattttcggagaattgagtggattttcctactagcatttgttgttctagatatcttcttgggttttatgttcgtgcaaacgagctctaagtcgacacaaacgactggtgatacggcgaccacgataattcgtgaaatgcgcgcagataatattagctttaaaaacccggacacgagcgaagggacgggttactatattgcgggcagtaacgagagtggtctcaaacaattgttgagtcagttaactgaacagacagcccgggtgcaaagtggcggtaagctcgtgagcacactacgggcaaccaccactatcgatacccgcaatcctaaagcggacttgacgacgtttatgagtcagcggaccaatgtaatccatggaaccgagtacgtctatgatgcggatttgtcgtctaacggcgattacgtttttgttcaaaaggttgcggatggcgagatcatgactggcgctgggcaagtccacctatttgttaataaaaacaagcagctgacaagttatactcagacgtacgtcaatcacgtcaaaactttacgcgaaaaggctgttacgatcagtgaaaaaaaggccctggttgcgttgtatcaatataatcaggtggcaagtagctcccgggtcgtttgggcaaagcttgggtattctcggttattgaaattgaaggatagtagtgtttacgtcccaacgtggatctttgcggtccggggtaagaatagttctaacgttacactgcaccgtatcaatgcctttactggttcttcaatgaagaacggtagtacggctagtgatacgagtagtttagatgcgacggtcggaatgatgtggaatgcaattgattagtgaaaaccaatttaacgactaggtgtcgttgtcgaataacgggtgctgtgaagaagggtgtttttcttaacaggcccgttttttggtgactagatttttgactagttttgatacgccaatgttgaggtgccatggacgtagcgtggattgctcagcgttgatgttcgcggtttcgtgtgagtttataatggtcggtaaactagtgcgcgcatacacgacagtaaactagactaaccgcgtgatggcgatagtcgtggacgttaagtttgagcacttgcaggtggcttgcttttcaaccccgctaaaagcgtgtatcatatgaagatagtaatggatttcagagataggaagagcctaaataatggtattaaaattagcaacggatgatatgaaagtaagcattctggcatcgggtagtacgggtaacgtgacgtacatcgaaacgccagagcacaaagtattggttgatgcggggctaagtggcaaaaaaattgctaatttaatggcgtcgatcgatcgtgatattaatgaagttgatagtttatttattagccatgaacacactgatcactgccattctgcggggattttagcgcggaagtatggtatggatgtttatgctaatcaggggacctgggacgcaatggcgcataaaatcggcaacgttcctgccgaattatgtcatgtctttgacccgaacacgacgcttggactaggtgatctcgacgtggaatcatttagtgtgtcacatgatgcggccgagccacaattttatgagctacatcatgccggaaaatcgtttgtcatcattacggatacgggctacgtttcagagcacgttgaaggtgtaatcaaagacgctgacggctatttatttgaatgtaatcatgacttagaaatgttgcggatgggtcggtatccatggccattaaagcagcgaattattggtgatgagggccatttatcgaatgaagatggtgcgaacgccttgatggatgtgattggccggcataccaagcggatttacttagggcatcgtagtcaggataataacttgaagtccttggcgcatttaacggttgcttccatgatgacggaacgagattttggtgttgagcatgattttcaattgtacgatacggagccagaacaagcgactaagttaatcacgttataggttagctttaatgtttcacaacgcttcagtcataaaaaaatcacactttttcgctaaaataaacttaaaataagcattagtagggagggatcgcgtttcgacgcgcaattatggctaataaatcattaatcaaagtcgcagtaaccgcactagtagctggtttaatcggtggtggtgttgcttacggcggtattaattatttccaaaacaataacatcgcaacgtcatcgaccagtgtaccaactggttctaataaatcggggtcaacgtcaacgacgaacgttaaggtcaatgtcagttcacaggcgaccaaggtgtttgaaaataacaaggcggccgttgtatcggtcattaatctccaaaagaagagctcttcaagcagttggagtggtattttgggtggcgatgactcgtctggcagtgatagttcatccagttcagattctagctctagtaagctggaagagtacagtgaaggttctgggttgatctataagaagagcggtgacgcggcttatattgtaacgaataatcacgtggtgagtggttcaagtgccattcgagtgattatgagtgatgggactaagttgtcagctaaaattgtcggaaccgattctgtgactgacttggccgttctgaaaatcaattcttctaaagtaacgaagacggctagctttggtaactcagataatatcaaggttggtgaaacggccttagccattgggtcaccgatgggctctaattacgcaacgaccttgacgcaaggaatcatttcagcgaagaagcggaccgtggcgacgacgaatacatctggtcaaacgacggggtacgcgacggttatccaaacagatacggcaattaactctggaaactctggtggtccgttgttcaacattgctggacaagttatcgggatcaactcgatgaagttggcctcagataattctgggactagtgtcgaagggatgggctttgcaattccaagtaatgaagttgtgaagatcatcaatgaattggttcaaaagggtgaagtcgttcggccggctttaggggttgcaacctatgacctatccaatatttcttctagtgatcagaagtctgttcttaagttaccaaccagtgtgacgaagggtgtcgtcatcatgaagacgtactcaggttcaccggctaaagctgctgggttaacgaagtacgatgtgattacggagctaggtggcaagaaagtgaccagcttagccacgttacggagtgccctgtatgcccattcggttaatgataccgtgacggtgaaatactaccataacggaaaactcaagacagccaacatgaagttgacggaaactaccaaaacgttaactaaacaaagtaactaataaatgagaatttcataaacgtccctgactggataaagcagtcgggggcgtttttttaggttagtagccgaaattatgaaaaaacgaagaatcgattttcaataatcgactaaatttgcgaaagctggcaatggttgcgacaaaagccgaacaaactggttgaaatagcagaaagcatttattgtcgaatttgatggtgtgcaaaagtgtggacaactttggtgataaattttagtcgcgttagtcgaaatttatgaacagccggaaccacggggttgaagcttgtttaaaagttatccacaggcgccggactggcctgtggatttaattttaaaaagttattttaataggcctcggttcttgatataataggatttgtaaccggaatccacgaacaagtgttgctgtgcaaaactgtggataagtcggaaaggtcttgacaaaacgaggctaaataaatattgtggcgaactggtgttcaacacaatatattgattattgagttatgcacctgtggataactatgttaataacttgtgtaaaggcggtcaattatgaacatcaaaattatctgtgtcgggaaattaaaagagaaatacttcaaacaggggattgcggaatatgcgaaaagaatgagtaaatttgcaaaattccagattgttgaagtgccagatgaaaaggctccagagtcattaagtaacgcagagatggaaaatgtgaaggccaaagagggccaacggatcctagaaaagatcaaggatcgcgattacgtatacgcgctagcaattttgggcaaagaacgctcgagtgaagaatttgcggcggaaattgataaactaacgacgtatggtcacagtgatattgatttcgtaatcggtggttcgctgggattatcaccggaagtgctgaagcgcgcggatactcagatttcgtttgggcgtttcacgttacctcaccaattaatgcggttagtgctgtcggagcaggtttatcgggcgtttatgattaatgtgggaagtccgtaccataagtgatgctaaaatttgtttttcaatagttacggatttattaggtgaataggaattctaatctgtttttgatggtcgtatttataacagtttagataaggctgcaaagaattacagttaccttactaaagtgtaagcagtatatagatatgcaattaccattaaataatggcgaaataaaaaaggacggtagcaatgatttttcagatgctgatattaaggctagattgaaatagcctggttatcactatactcaattgattgataatagcaaagtaagcggcaggtgctcctcaaaaaggcttgccgtttttgagtatacccaatcctcaagatgctgattgtagattctcaggtatatatagctagtgattttttgcgtacaggtgccacatccataaaatttctaataattttaattgacatttattagggatagttttatattattaatcgaacgttcaatcgattaaaagagggtgccaaatatgcgggaaaaagatttagacaaagagaagagtattatcgatgaagtaagtcgtattattctaaaagagggaattgcggatgtttcgatgtccaaaattgccaaagcgagtggtatttcttcgtcaactatttacgtttatttttcagataaggaggatcttctaaagcaggtctaccttgctaaaaagcgacagttagcagcatttttaagtcaaaatatcaataccaaacccaataactcagttaagtttgtccaacagtttatgtatgcgttatacgatttcggcatgcaatattacgaagcattaatgattattgaacaattcaataattcgcccattcttgatagcttaaaaatcaaaaaggaggaatcctatcaaggtttcgagcaactttttgaagcagtcaaacatacacctgaatttgtcatttcttcaccggcagttattttaggttttgtttacgcaccaattgttttgtttgttaaagccttaaaaacacgtcaaattgataataagacaattatgatcgatcaagtggttgtgatgtgtatgaatgcactattgaaaaaataaaatatcagaacatgatatttttttgtctataattaaacgattgttcgattaaaaaggagagctatgatgactacaattaatgagatgcaccaaatttttaacttgcaaaagacacagtatgaccgtgcgcaaccaatgacctatgaagagcgtgtgactgttttaaatcagattgaggcattgattcgggataatatttcagaattaatcacggcacttcaagcagattttgggcagcgtgatccgctacaaattgtaagtgctgatttaaccggaccactagcgacgattgcatatattaagaagcatcttcgtaaatggatactaccagctaagcaacggtcgggtttgatggcattaactggaactaaacagtatgtttataatgaaccattaggtgtagttggtatcatgtcgccgtttaatgcaccaatcgatcttgcgctagatccagcggtagaagcgattgcagcggggaatcgagtgatggtaaagatctctgagtatacccctaagacagcggcactggtccagaaattgtcacaacagtatttaaatgaaaagaactttgcagtagtgacaggagaagctgatattgcggctcagttttcagcactggattgggacaaactagtttttacaggtggctctgaaactggtaagaaggtattatcggcggcggctcctaatttaacaccggttgttttagaactgggtggtaaaaatccagccgttgttttaccagatgctaacaagcaaatgacagctgccaagattgcgcgtagtcgttctggtaatagtggtcagatttgtttggacaccgattatgtgttacttcccactgaccagttggatgaatacgtgcgcttaatcactgcacaacttgcgcaagcatttccaacttacattaataattctgaatattctgccattatcaacgatcgttcttacgatcggattttgggaatgcttactgaagctcggcaacggggaactaggctgataacgattaatccaaataatgaattggttccggacgtgaaaagacggctaattccattaacgttggcgattaatcctgatcgagatttacagattgccagaaatgaaatttttggacctattttatcgatctttacgtatgattcacttgatgaagccatcgcttttattaactctcatgaaaagccgttagccatgtacttatttggtaggagttcaaggcatttgaatcaaattatttcgcagacatcatctggcggagtagatattaatgagttatccttgcatgcgggttcgcattcaatgggtttcggtggtgtgggttattctggaatgggacgctataaaggcggtaagacaggctttgagacgtttagtaatcaaaaatctgtgtataagcaaggtgttttggcaaaatataccacgcgcttaatggtaccgatccataataaacgtaatgaaaagctgctgaagcgaatgttgggactatgaagtcgtgtttaatctagggcaataacatggttaggacttttcttcgtgtctatgactaattgatgtaaaatactagtataagtatgaacattaatatggatttttataaattgaataagacaaagtagcactggtcattggagattatgaagtaattataaaagatgatactcagattgaatatattctgagcttaatcaaacaggcatgggaaaagtatcgtcactaaaactaaaaacgaatcgcaggtgcatctatatcacaacaatcaaagaaattactgaagctatcaaggctgatcccgataacgctgaatatacggcgaaggggtgggacccattatttcatgtgttaccgacagccactattttagtgattagtcaggcaccgggacgtattgcccaaaataccaagacgtatttcaatgatgcgagcggggaccgacttcgggattggatgggcgtgacgcgggagcaattctatcaaagtgaccgcattgcagttatgccactagatttctactatcctggtaagggcaaaagcggtgacttgccaccgcgcaagggcttcatggataaatggcatgaaccgctgctagcaatgatgcctaacgttcaactgacgttacttgtgggccaatatgcaattaaggcttatttaggacgttcacggcaaaagacgttgactgcaacggttcaaaattatcaggattacttgcctgattatttcccattagtgcatccatcgcccctaaattatggctggcaaaagaagaatccatggttccaagcgaccgtggtgccagagcttcaacgaagggtacagattgcattaaaataaggtctacgacagccttgttaaggccagtgttcatagcttgttgactgtaacttttaagggcctgatttggttaaaaacgtggtaatactgagcatgaatggctcggtattaccacgtttttagtttactggtttatgacgatgcgcttagctagccaagctttctcacttgaaaaagatagttctatcttttataatgatatttattctctttgttcatcactatttaaaatataggagctaaaaattcatggaaacaattaaagcgattcacacccggcattcagtccgggcttttaaagacgaccctattgagccacagttattaacaacgattgttacagatgctcagcaaaccccctcgtggggtaattcacaaccatggcaagtctatattgcaacggggcacgcactaactaatattaagcaacactatgctactgccgctgagcaagggattacggaagacgctgatctcgccaaagtacaccggggtgatttttcggcgtttgctagccaaaatatggggcactgggtcggaacttttcggcccgtgatcgactcagacccgaccacttattgggatagtcgtgctaatctttatcgcgcaccggcgattgcctatctcgtgctcgacgctaaccctaatagttggtcaatctatgatttaggcgctttttcgcagacgttaatgttagccgcaactgctcgcggagtacagtcagtaccatcttatgaactggttaaatatccggccattgtacgaaacgcactcgggatgcctgcagataaagtagtggcgatggggattgctttaggctatgagaaacctgaaaaaccgttaaatcaatttcgaactgaccgagttgctacgccgcaagtcttgcacatcatcaactaatttagactcacttttgcagcagaaaccagctgtttaccagcagacactattgccaactgacaccgtttcatctaagatggagggtaacttgaacctgataggggaggctgggcaatgacgactaaacaacgaacgtacaaaattaagtcctatgtcaacgctagccatgcggtgcggtgggcaactggctccggaaaaaagcacacgcacacgtgggaaattgtttgtgaattgcacacggttgatgcgatggttgctttttatgatattgaaaaaaatttgcatcaagcgttggatgaattgtcaggtaaatttttgaacgacttacctgaatttaaaaccgttaatccaactgtggaaaatgtcacggagtatttgtttaccaagattgataagacattgcgagacaacggggcgcaactgttgcgaattgaagttagtgattcgccaacacgcgcttattgtattagtgtcaccgaataagattaatgaaggggccaccaagaacgacagttgcagctgttcttggtggccctgatttttatttaattatcgttttggacggacaactgctaaaaagtcagctaaagcctgcgggtcggtcaattgtcgattacactgattactgtcacgacaaatgtaattgccgttacgcgtgtaaggtccgagaccagatgacttggttgtcgacataaagagtgcgacgttgccaattgtttggcaaatggcacagacgcccttgactgtttgtggtgctagatctccctggataccaatgagacgatcatgatccgggattactaaatactttttctggttaccaccatcattccaacctaggtaagtcaattcgtgtaatgctaattgtgaccatacaggctgcttcaactttttgaccttgcgaaacaacttgcttagttgctttgtcgtcaaggatggaaacggaataattagcggaattagcgtttctagtagttgaggggccttggcacgggttagccggtccgtttgcaaatgggacaagaaattagcggtgattggatcgtcactaggaagcagtggtgtaatccgctcgatagcttgtgcccgtacgacggctctaatttgaagatcgtttacggcgagctcggcgctaattaactgattgacttgctgagtaatataactgtattgataggtggtaattgtcggttgcataatataattcctttcagattcaaaccagacacttctctgaaaggttctgtcgaaaagtgtcgctaacgagcagcacttttgcgtacagataatgatgccatcatcattaatcatctccttatttgtggccgattatagccacagcgataaacagtataacggatgttgttgattttggcaatagatggtgtctgttttgataggcaccttgcataacttatatttggaaatcaaataccgtaagtcctaaaatgtttcacgtgaaactttcgccacgggacactaaaacatcacgcaactcgtgagttacgtgatgttctcaaatacatattcgctttgaattgtgcttaattcgtgactgaatctttgacttgtttcagcgcattttggaccgcttctttaatagctcggctagatgcagaggcacctgaaacggcgtcaacgctagtggagttggctgccacaatttcttgtggaatttgatcgatagcggttaaaccaacatcttcactttcatggtgttgaataacatcgactgcttgaattttatggtcgttgtaagtcacacgcacaataactttgccacctagcccggcattagaactgccgagatattgatcagcggccagtttaacattagatgctgtttcgccatcaacaaggtcattaattccgttggcttcgttggcggtgacagattcactatctacctttggacgagcagcgttttcaccggctaacttaccaaagatcaaacattcggctaaattaccaccaccttgatagcagtttgcaacgataccgcctaattcaccagcgccgaacaagtgtggaataggttcgtcattgacgttgagaatttgggcattttcattgcgttgtggccccccttgcgtgttgaggacgtcattggtcgtagcaatggcatagtaagggccatcgtccagttgacgcatcgtttgcggatcacgatcaaattcaaaatcacgtcccacttctgtgtagtgattaaagtcagttaccgtctgttgtagattattagcaggaactcccaatttggcggccaattgtgcaatcgttggcgcggaaacgagtttggtcatgaatttcggatacggtaactgaccagcctgactttcttcttgtttgaaggcatcgtactgggtttgatcaaaaattaagtaggggtgctgattattcattgggattagccaagagccatgtgtgtaaacgtgtccgtgacggtgcttagcgtcttcttggaagtagcgtgtcccatcatcagcgataacgaaaatactaccgttctttaataaaggccagtgttcaatttgacggccccgttcattggcgtcttctttgaaggtgattccaggtaagataccgtgagattcataattggtcatgtgccacattttggcatcaacttcttgagccattttgataccatcaccgcggttatagagcgtcccaagtggtgtcagattatcactgtgcaagtaggtttgctttaactcaggattgttttcaaaaccacccatagctaaaacgacgccattattggcatggatattaagcagtcgttcgccccgtttgatttggaccccttggatcactttagtattaggatcttggatcaaatgttgtgcccgtgagtccaaccaaacgtcaatattgtcagctcgttcaaggactttttgccggagtagtttccataatgcagcgtctttatcacgtttgtgaacgagggcaaagtcaatcgtatcacttccggctagttctgggtattccgccatggttttcttgatggcaacggcatcaccgggtttaatatcatgtttccaactaacggctttaatccccagatatttttcaaaatatgctggaattttactcataccgcttaaataggcgttgagtgtcttagtaggggtactgaatggcgcgcccagtgcttgataataagcggttagtttatctaagctttcacccgtaacgacgtgttgggcggagtagcgggtgttgccaccttcacggccaaatggtgccgcatcaactactagtacgtgggcaccattatcagcagcaaaacgagccgctgaagcaccggcaccaccaaagcctaaaacgataacgtcgtagttaccgtgccagttcacattgagcgcgggcgtgccgttgagtgccttaacgtatttttcaaagttatcgaagtaccgttccaagaacttgatagaaggggcatcggtcatttgaccattctgatcaaaggctttagcagcgtagcttaacatgtattcattgccagggagtacctgagcatcaactccgggcgcattgagaatattgcgtaagtcaccttgagcacggcacgtcccctgtacgccaagggaagtaccaactaacatgaccggtttattagcaaaggggtggagctggtaagaaagccattcaataacgttcttgagtgcggccggaatggcatgatcgtattcgggtaccccgatgatcaccccatcggcctggctaattttatcatttaaggcttgaacggtcgccgggatatgattttgagttggttcattaaaaaggggaatccctgtaatttcattaacgtcaatggtagcccgttgactaaaatgatgcttcataaattgtaataattcacggttgtaagactgttgtgccgccgtaccaatcaaggcaatatatttcataattaacattcctttattagttttttagttggataagtacacggattgtttacgctttcaatataaatagttacctagaaaaaacaaccgttaattttaacgaagccaacagaatgctattgtgacaaggataacaagctgtgattaatttgacgggttgtcgaaactttagtgagaattaagcaagtggcaaactttattttagctttttataaattctatttataaaagtgtccgataaaaggcactagtcgctatgataatttcaggtatttttaatcgcaaacaggtccctgtaggctgtatataacgggttttattgcgacacctcaagcaactacaactaaatttaaattgacagacttataaattaagttatggtgatattgaaaaacggcaaacaaccgttaatggcaagatatgtgaaaatcttaacaattatatgaagattaggaggaagtgcagatgttgagtgaaataaaatggaagggctttctgttaccgctaatttttggaattgggttatggctagttacgccactacgaccagtagcaattagtattatggcgtggcacttatttgcaatttttgtggcaacgattattgcttgtattaccaagccattaccgatgatggccgtcacgctgattgggattgttgttgcgacgttaacgggtgtttttacgatggacgaagtcgctactggttttggtaattcgacggcgtggatggttgccatgtgcatgttcatggctgctggttttattaaatcaggacttggcaagcggatcgcctatctgtttgtcagtttatttggcaagcgcacgctgagcttagcatacgccttatcctttgttgatgccgtattggcgattggtattcctagcaataatgcgcgggtcaacgggattatgtatcccattattgataatctttctcgtgaaatgggatctgatccgaaacagggcacacagcgaaaattaggctcatttctagtttttaatgaatatgaagttaataatattacatcaggcttgtttttgaccggtttagctggcaacatggtggctattggtttagctaagatgcagggaatcacggtaacttggatgcaatggtttatggctgcttgtgtcccaggtattttatcgctactaattattccatgggtactatataaagtctatccccctgaggtgaaacaaacgccagacgcgcaccgctgggcaacgacgcgtttggccgcacttggaaaaatgacagctagtgaaaaaattatgtcaattacctttattttagcgattgttttatggttgatcgggactaaaattggcatcgatgcgaccgaagtaagttttattgcagttgttattttgctgattacgggcgtgttaacgactaacgatttgctcaatgaacattttgcttggaatattttagtctggttatcgatcatcatgatgatgtctaagaagctaatgacactaggctttttcccatggttttccaaaacgttaggtcatttactgaatggtatgaactggattagcgtgctcattatcctgtttttagcttatttttacttacattacatgtttccgagtgtttcaacacagatttcggcgttatatgctggctttttatccatcgccattggtgccggtgttccccatgttttagcggcgttactattggcatttgctggttcaatcaacttgtcaacgacgccgtactcggccgggcccgcggcattattgtcaagtacaggctatgtgactagtgcggagtggtggcgattgagtgcaattattggggttatttttaacgtcatctggttaggtgggggcttgctgtggaccaagttattaggcttttggtaagactaactgagcaatatagatgcggtaagtcgtgattgatcctgaccacgatttgccgcatctttcgtgttaaaattaggtattaaatagattgaatgggggcgttgacgtgaatgaacgcgatttaaagtacttctgttcattagttgagacgggaaattacacggccacggcgaccaagtttcacgtcacacaaccggctatttctgcagctttacgacgattggaagaagaataccaagcagtattactaacgcaggccaaccatcgggcccaactagtaacgacggcagcggggcggaccttgtatattaagtctaagcaactcttaaaagacgttgcgcagatggcactggaagttcatcacgctaatgagcagcaagttcggctcggattttccaatgttgcgggtggtatttggcttccccgggtgataaaaaaatttatctcagttgatttattagaccaggtcacaacgaccgttgctgattcagaacaattgttagttgacttgcggcaaggcaagttagacgcagcggttttttcaactttggtcccagaacgtgccacggatttacgggtgagcatcttagaggaacatcagatgcaggtcttggccaatgtcaatagtccattaagtcacttaaaaacgattcgagcaactgacttacaaggagtgcctatcatcgctcgtcctaaacacgcattaccacggttagcattagaacaatattgtcagcgcggccacatacagcctaaaatcgtctacgaggcagctaccaacgcgttagtcgaaggtctagttgctcaaaacgttggtgttggggtggtcattgcagattccgtagtgctaagtgatcaggttgtagggattccactagctgcccaagagcaattacactgttacatgcaactggcggtgcggaagtcctttttgcctaacgctaatcagcagcggtgcattgacgtcctacgtcaaattagacgggctaattaggtcttcagcactaatccaaaaatagcgctcgcattgactttttcagtcaacgcgagcgccgtcaaatcattattgagctaacattttttgagcgaattccttaacgagttcaatctgctcatctttgagcttgccgccagtactgccgatgattttcattcctttgccacccatgacttggtggaagtggccgatgacgggaatgcccttttcggtggcaatctttgtcagggctttgtctgaaaccatttctggtccgccagaagttgtgaatagggcgatttgtttgatcttagtcggatcaaggttcttcataaaagcagatgcggttttgtcgggtttcataaaataagtaccgccgccaaaaaagagtgtgtcagcttgttcgacaggtgtatcgatggattgtgctggaacacctgccacgctagctatttgttcggcaaatgcttgtgtattgccattgcgagtttgataacgaattgctactgtcatggaaaagacctccgataaattagttgaaataagaccgttctcgcgatgagtaactgctcagggggactggttataagtttagaataatattgtaatatcaattctagtataaatcgttttgaaatcgattacaaaaatatagtgagcgcattcttgagggttaaggctagcttattcgattgctggaatagtcacagcaatctatcgcggttacgcgcatgacgatgttgtatcttaatggttattagcggagcaagcgggattcttgcgggcataatattggtgatgatacgcgattagtgtcgttatcgtcagtaatttaggaggacggcgaaatgccaaaaatatattttttatgtacgggcaatgcctgtcgcagtcagatggcagaaggctttgcacagcaattattgggaccaaactggcaagttgctagtgctggggtggagacacatggcctgaacccactagctgttcaagtaatgagcgaggtgggtattgatatcagtgaccaggtttctaaattaatcgacctgacctatcttaatcagtgtgcagtcgtggtgacgttgtgtggtgatgcacgggatcgctgccccgtcactccggcaacggtgaccaggctacactggccattgcctgatccggctcgcacgactggcagtgttagtgaccaattgctagtatttcgacaggtccgagatcagatcaaagcacgagtgattgatctggcacggaccttgaatgtttcggcaacgtagccgtgcacaatgaacggttgcagtattaagaaaataaatccaattataatgatgcgcatgtaagctaagaagggctggcatgcgtttttattagctaattaaagttggaaccacactttagttagttataattgtgaaccaacacacatgtataaaagctacagtttaatcgtcgtaagactagtacttttatccattactcaaacaaatttagtgggttaatatgaaagcgtagtcaagataaatgaccggtcatcaggttaatgtttactgataagttaataaaatcacaatttcatcgaggaggacgcaaaacatcatgaaagattttaaagataaagttatgtttatcacgggtgcggcccacggatttggtcaagttattgctgaaggcgccgcggatcggggtatgaagctcacgattgttgatatcgacgaaccagctttgaagaaaacgtaccaacatattctcgacaagggtgccgaggtgttgatggttaccgctgacgttacaaaggaagctagtgtcgacgatgcggttgagcaggccatggaaaagtttgggcggatcgacctactgattaataatgccgggatcgcgctacctggccgaatttgggaattgccgactcgtgattgggaatggatcatgcatatcaacttaatgagtcaagtttatgcgatgaagcgcgttatcccaattatgattcaacagaagacccatgcggatattcttaacgtggcttcgattgccggcttagttgatacgcccggaatgccttcttatcatgctagcaagttcgcttctgttgggatgactgaagcgaccgcctatgacttacaacgggctaatattgatatcgacatgcacgtgatgtgccctggctttgttcagacggatctctatcacactgaaaatcaccggccagcgcaatacagcgacccaacggacccgtattatcaaagtgaagcgtacttaaagggacaacaatttgcgaagtatgtcattaccaacgggaaaccaattgatacgattgccgataccgtctttaaagccttagaggataaccgtttctacattttgacccatccagaatataatccactgattgaagaccgagttaaacggatcgtgacggatggcgcaccagacgtgcacatcatggacggtatcatgtaagctaatcacgcaaacaaaggagtgttttaccatggcaagttttattgcaagtgatcaggatgttaagaactttttgacagcaccaagcatgaatgaccaggaaggtattgggtttgcttatgccactgacgaagcggtgcttaaggctttaattccagcaccattaaaattaatggcaccggtggtttgcggttatgtcgttcatatgggaaaaccgacttttagtgccccataccttgaagaaagcctatttgcgttagttagctacaaggataaaatgatgggcgcttacccgattaacctcttactccacggtcccggggcggagagtggtgtgattgcaggtcgggaaggtgctgggattcctaagaaattagcggatgacatcgaattgcgccggaatgacaacagtgcgacagccacggtcgaacgccatggcaagacattactgaacgtttcgtggacggccggtgaactgaatgatccgtcaattatgaaacaatttgcggggcagctcgcgttaggtaaggaagccgaaatgaatagtttcttctataaatatgacattgatcaacatgaagatgggacgaaccatttcagtaatgtccaattagttgcgactcaattacggtccttagctgatcaagttgaacctgggaacctaagtattcagttggagtcaaccgatgatgatccatttggcgaattgaaggtcttgaagccactcggtgccgcttggttccacttcgacacgtcagttatgttcaacacactgaagttggacgaagttgatgctgcgacaacaatgccaaagctcttaacgggtcggtatgaccggagtttcttcaatcccaaggcagcgacttacattatttaggccgattacgaaagcgaggaatagctgatgtcagaagcagtgaaaaatttggtgaacaatgatttagcagacgtgatgtttaaccgccattcagttcggcagtttgacccgaacgttaaaattggacgtgatgagttacaaaagatgattgcggaagcagccaccgcgccatcggcatgtaatttacagtcatggcactttgtcgtcgtggatacccccgaggcaaaggctaagttcaaacaagccgtgatgaaattcaactacccacaggtcgacagtgcatcggccatcgtctttattgccggtgacacccagtcgcattatgtttatcgcgatgtctggaacaaagtttatgaggatgggaatattacgaaggaacgcttggatcagattctgggaaccttcttaccattatatgaaaatgccacaccagatttcttgaaattcgatgcgacgattgattgttccgttgtcgggatgcagttgctgctagtggcacgggctcatgggtatgatgccaatgcgttctccggaattgactttgaaaagatgattccgacgctgggtcttgatcctaaacgatacgtgccagtaatggggatcgcaatcgggaaagcagcgcaagaaccgctccatacgactcggtacgatgccaaaacacagactgatttcttagcctaataggtttatgaaaagagcgggattcccgctcttttttgtccgaatacgggcctaagaaagctgagggcctttcgagtggggtggtgggttgtcagtaggcctctttacaaaagcgcttacattatttatgatgaaggcgacaagcgtgaataaggaggttacttgagtatgcaattaaagccgttattgcggcagttagccacaacgtttgaggtgactgtcgatccaacatttacacataatcccgaagttactcacgtccaatttgttgatccgacggaagtgttagcaagccaccggttatatttgtcccccgactcgggtcagctagttcaacttgcttatagttggcacggccatcgtcagtcggtcggactagtaaatctgggaaccggtctgactacgatcattgcggcacaaaatcagttattgaaattattaatgacgcttggtcagtgcttacaccacgatgttcaaattcaagcagccatcaatcagctcgctatccaagcaatcacggcggattttgataccacactggcccaagcagtacacttattagagaatccgctggcgattattgatctgaacggggagattctgacacggtcgcatacgacgcaactcaatgggactagtattcacgctgcagttgagacgaatcgagtcggacgctggctgttagaccacggatttgcaccggatacgccggattttttaacgcaagtctatgtggcggaagatcagttgtcggcggggcccatgctaattacgccgttagcaaatggcaccgagccgattggttatttggtgatgccagcactcaataaaccactgaatgatcgacaagcactactgatcaattcgattggtcaggttatcgctggctcgttagttaaaaatcagattatgccaacagctgaatcgcaacgggaccggttattaaacttattattgacggaacatcaagggggaacgtttgctgatcagtttgctgaacaacacgtgcaattaccgacagccatggtgttaatccgctgcgaaccactagctgatcaagcaccgatgattttacagcagcgactacagtacttgatgatgccacgattcaaacaagtgttggtttcgacttatcagcaacaatgtgtggcactgatcccaattagtctggtcgcatataatcagaatcaatttaaactaacgttgcagcaaattacgaagcaagcggattgccgcttgatcgtgtctcagcactacgttaatccggaagatacctttgccgcgtatacagtttgtgaacgaacggcgcaactgaagactggccgtggtcgggtgattttttgtgaagaccaattctataatcttgcgttggcacgagttaatcatcttgagatcttaccgttctttattaatccagccctacgtttgttgttagcctatgatcagcaaaaccatacagaactggtaccaacattagatgtctacttacgggcgacttgtaatttgacccgcacggctaagcaattatacgttcatccaaatacactgcgtaatcgactgcaccatatcacaacactgaccggatgcgatttacgggatgcggaaacgtgctttaaattggctgctagttttaaattacggcaatttttaacccagcatcagtaccagtatcgaccggatattccaattccgacccaagattaagtgggcataaaagcgtgcaaccgtttgtggaaaaatggttggatcagtcattattagtaaatccgtaaattcaggatggacggcaataatggggccgccattgcgatttgatcggcgggcaggcatgtgattagcaacagtcgtcattaaaattgttatgcaaccggttgcattgaaactgaaagcgttttataatgttaagtgaacattaacggtgtgcttcaaaacaagacgggtagccgtcactcttggcgcatctattgatgattgcgcagttgtccggtacccagcaatcaattgtgctggtaattaacgaggaggaaccattaatgagtaaatttgcagatattaaagggtttgtatttgatttagatggcgtgattgcggatacgtccgtttatcactcacaagcttggcatcaattagctgacgagttgggcgttgcctggagtgaagaacttgccgataatttaaagggtgttagtcgaatggactcgttgaacttaatcttaaaaacgggtggtaaggaaaacgactatacggaagctgaaaaagtggcttacgcagccaagaaaaatactaattatctgaacctgttgaagggaatggataaaactgcaattttacctggtatcgaagacttcttagccgatctcgccaagcatgggtatcgtttatccttggcctcagcttctaagaattcaccattggttctggaacagttaggcttggcgcattactttgaagcccgggtggatcccgcaaccttgaaacacggtaagccagatccagagatcttcgcacgtggcgcggaagtgcttggcttgaagcctgaagaatgtgcgggcgttgaagatgctaaggtcggtattcagtcaattaatggtgctggtgaaacgtcgattgggattggtgatcctgccattttgacgggtgcggatgttaacttcacttcaacgagcgaattaaccttagctaatctaaaagccgcgttagcctaagtttaaataatacgaaaagcttacttcacaaagtcaactagatttgtgatgcaagcttttttgagttactgcttttctgaaagtcttaatgggccgctggcaaggtggcaacatcgggagttagtaactggacgtgtggggtgcgactaaggacgtattctaacggaacggtctgtttttctaataaatgatccgttaagttaacttgctgaatcactcccggattttcgtacagatctagtgcgtacgtttgatgattcaagtccatgtagctacggtactcagtataggttgcttggccgttggcggctactttggcgcccttgggaatagtcacagcattcaagatgtgttgaagtaagttgactgtatctgttgttgtcgctggcactagcgcatagtgtttcaagaagacggtccgtgcaaagcgagacatcgaagtatagtcaccaggtagtcctaatgcgcccgtaccaggtccctgtgaaccaggttggtagttaatgaatttatttagtggccgctcggtgttagtcagggtgccatacttacttaagttttgtagctgctatttgaggttcggtgaattggtcaggacgccgactgggttattaatcaggcgaagctcgccactagttggttccaagacggcggtttcaccggtttggtcactaatgataaagtgaagtggtggaatttcgttaattaattctgccgtgctactaatcaattgaacgtctttgacgcgctcacgtaggtcagcaacactagtgatttttccgagtacccaggcgacgaaatcgtggggtgcgagatcgattttgtcttggttactgtgaggctggtaaattgcatgattcggaaagtagagtgctgcgatgctgacaccacattcgttaacgccgtccgtgaaaatttcatggttcagttggcgacccgcgccaataaagccataagtcgtggtgaaatcaccaaggtcacccgtcacgcggtaatgtcgaggcatgaacataatacgggtctcaaagtcaacgttaaaatccattgtacgagctaagaagtggcctccatgactatttgtataagttagactagtgcacatacaaatcgctcctttattagatgatatcggtaacttatcatatgattgcggatagcggcgaaaattgtgacgcttaaattaacgaatggtaatcaagtttacttttgagggggtagttcaattaacaagctggggaaactcatcatgaggctaatgtttcacgtgaaacattatgcttttaaaatgacaaaatcgctatcataaatgatgttagtagcctaaaataagggggaaagctactaacataatgaacgatctaagacggaggaagaaatgaataaagagcgtaagtcggtgatgccgctatcacaacgacatcatatgacaattccatggaaggactttatccgtaatgaagatgttcccgctaagcatgctagcttacaagagcgaacatcaattgttggtcgagttggcattttaatgttgtcgtgtgggacgggagcgtggcgggttcgtgatgcgatgaataagattgctcgcagcctgaatttaacgtgctcggcagatatcgggttgatttcgattcagtacacgtgttttcatcatgaacgtagttatacgcaagtattatcgataccaaatactggtgtaaatacggataaactaaatattcttgaacagtttgtcaaagactttgatgcgaaatatgcacggttaacggtggcacaagtgcatgcagcaattgatgaagttcagacgcgtcctaaacagtattcgccactggttcttgggttggcagctggcttagcctgtagtggatttatcttcttacttggtgggggtattcccgagatgatttgttcctttttgggcgcgggtcttggtaactatgttcgggcgctgatgggtaaacggtcgatgacgacggttgccgggattgcggtcagcgttgcggtagcgtgtttggcttatatggttagttttaagatttttgaatataatttccaaattcttgcccagcatgaggcggggtatattggtgccatgttattcgtgattccgggttttccgttcattacgagtatgttggatatctctaagttggatatgcgctcaggactggagcgcttagcttacgcgattatggttaccctgattgcaactctcgtcggctggctagtcgcgacactggtgagcttcaagccagctgatttcttaccgctaggactttcaccgttagcggtacttttattacgattaccagctagtttttgcggtgtttacgggttctcaataatgtttaatagctcgcaaaaaatggccattaccgcgggatttattggggccattgcgaatacattgcgccttgaactagttgacttgacagcaatgccaccggccgcggccgccttttgtggggcgctcgttgccggcttgatcgcatcggtggttaatcgttataacggctatccccggatttcattgacggtaccttcaatcgtaattatggttccgggattatatatttatcgtgcaatttatagtattggcaataatcaaattggtgtcggttcactatggctgacgaaggccgtgttaatcatcatgtttttaccgctcgggctatttgtagcgcgtgcgttgttggatcacgaatggcgacactttgattaattgagtctatcaagttagcggttaaaaagtcatttagtcaccagatcagttaggtctggtgactaaatgactttttaaatggcctttgactgaaaatttaacggtgacagtttacaattaagttatcaatctagctgggggcttggtcatggaagggattactaatttacggtcactaggtggttatcgcaataaaaatcagcaagtaatcaaagatggtttaatttaccggtcaggacaattggatcaattaacaccggcacagacgcagtatctagcaaccacgcttggcattacgcgaatcgtggacatgcgtagtgctgatgagcgtcatcaatttccagatgcgacatggccacacgtccagtatcacgtgctggatgtgctagcacaagtcatgacgaacgacgcaagtttacaatcgatgattagtagtacgggggcggtccatgaccgcatggttcagttatatgaacagctagtgttagatcctactgcccgtcaaagttattgtcaatttatacagctactactggttccagatcagccactactgttccattgttttgccggtaaggatcgcaccggcgtcggggccgccttatttctaaaaattttgggtattagtgacgagcaaatcatggctgactatctgctcacaaatcaagcacgtgcggctgctaatcaacaaatcttggcgacgatggcgtcgcaattatctgatgagcaacaacgggccgtgaaccaggcattattagtagacgctgattacctgagccattactttgaagtcatcaaagcccggtacgacacattttcaaattacttgcagacgggtctagggctgacctcagcggaatgtcaacagttacgcgaattatatttgactaaatagtcaataatataaaggcgcaaaaaatcacaccaatactcacttaaggactaacctgggtattggtgtgattacttattcatgggtgtttgcgttgtccgctgacaatagtcggtcaatcatctgattgccagcctgtaaatcggcgcgttgataatgttgggcacgaatacgcattggatcaccaccatgatagtattcgtacatcaattggcgctgaccaaagccagaacttgttaaatcgaaggctaagttcaacaagcgcgtgcgggttttagcggtggctcggtccgtcgtgagtgcctggttgaggattgtcgcattatcgccgtcaaattccgcaaaacttggcacgccaaccatggaaccggccgctaagtgttgagtcacgcgcaaggcctcgtcatagtattcgggaagggtcgagcgaaccgcttgcaaagcttggagactgggcgtatagataccgaattcgtccagatgaccgttgtcttctgaacgggtgatggtacccttgatgagttccagattagcggttaaccgaccgagtttttcttggacacctaagaaaccatctaatcctaagatatgagcaatccgaagcgctaaactggttgctaactcaagcttagtaatacctcgaacctcatcttgatgggaagtgtggctaaacatgcctgaatcgatgaagaaacgattactcatttcaacattattttcaacaaatacttttgaccacggaataaaggcgtgatcaaagacaatgtaggcgtcaatctcatcaagggcgttgctgagtgggtaatccgtaatggaagcggtgggatgatctaataatttgcgacaaatgatcttgacgcccggattattgagtggcgtagcaaaggcgacagcataactactatcgccgttttctaacaacagttccggcggattaaaaatcaggaggtcatcagcaattggggccatcgtattgaccattttggcaccagaaacgaagattccatcttgattacgttcaatggtatgaacacccgcgtatccagacggaatggcattgatggctttttgacggttgagttgtgggttttgaagcgcatggctaatgaagatatcgttagctttgacctccttagcgtaattgcgggcattagctgcaaaatcagtatattgattttgcccgaggaaggcagcgcgttctgctaagacggccatcccagtattaagaaaatccggtgtgcggcctaacatgccgctgttactttgcgcaatttcttgataagcacggtgcttttgttgtaaatcagcgacggtgcgtggcactttgaaagcaatatcgtagcggtgaccattttcctgataagtatgtacttcgggatggttgtgttgcaggtcatagtactgattattgagtgctaaagttttacgaaaaatgggcacatcggcgacattgacgcggtgaccatttagatagaccgcgcgcccgtcattgagttgttcgatagtatgcatgtgtcgttccccctaatgaaagttctattccaatataccactaatggaagcgaattcaccagtgctgattggaacgctatttttagtgaacgggataaacgacgtggaagcgttccagaaccatttgtgcagtatggggatcaaagcgctgatgctcgctttggtactcctgcttgaagaaggcatcatgaacacggcgccaataggcataagtacgatcgccttcaccttctaagtaagcgtgggttgcatcgatgtccaagtaaggcgtaatcatgacttgatcggtccgggtcacacagacaggctgattatgagcatctaagatgacgtcataagcgcccacttttggcagtggttcatcagtttcgtataggtcataagcgctggtggtagccgtttttgtgccagttagtacgagctgtgcaagtttatcaggatcgctgccaaactgataagcactttgtaatggggtactttgtgtcaatttgagcgtcgttttagcttgttcgaaaaaagattggacgtccattattatcacctctaaattatgatcggttttaagtttaacataagcgcccatggctcaagtaattagcgtggtataatgactctatcttgggtaattgcaggcgatacccagaccaaacattgccgttgtggaaaggactaatcatgcgaattaatgtgttgcaacatacccccaatgagggccctggaatgattgctgattgggcgcatgcccatggtcataccatgtatgtctatcacccgtatcaattcggtgttctcccaacggcggatgagacggagatgcttgttatcctcggcggaccgatgagtcccaacgatacgctgccatggatcaagcaggaacgagacttgattcaacaattattggaccgcgatatcccaatgtttggtgcgtgttacggcgcgcaacaaattgcgaagaccttaggatacccagtcactaaggcgccagctaaggaagtaggttgggcaccgatttaccgacagagtcccgtgattccggggattccagcaaaactgtcggtcttgcattggcacgaggagatgttcaccgttccagccgaagcaacgctgttgttctctagtgatcgtgtgaccaatcagggtttcgtatggaagcatcgggtagtggggttacaatttcactttgagccggctgcggacaatgttcgtgagatggtcgtcaatgattatcggtatattgcggggtcggtcctaaaccaaacagcagcagaaattttacaaacgccggtaccacgagagaatcaacaagttctgaatgcaattttgaattatattacggctgaataaagcagttaagaagagaataatcaggttagtaaaaatgtcggtagtccttgacggggctaccgacatttttgttcagaaaaccaaacgttaatagaaatcttgaatttgctgcagttcttgcagataggcagtttttaacgcttccggataaataattctaacgttgcggccaagtcccagtaaatagtcgaccatataggctaattcatcttgattataaccaccaatgagataatcttggtcgttctgatgtgttaagtgcatattaggataattattcttttgtacatgttcacggcctagaggtgttagtgcacatttataacgtatattgtgatgatggtgatcgtaggaccgttgccgttgcgcgagctgtttccaagtataccgagctggttgctcactggtttgaaatgctttgatcgtatcacagcgatagatgccccaagcattgttatcgagattgacgccactgaaaaaccaaatgccatgccgatataataaatcaaaaatctgaaacccagctgtcacagtagtcatcgttaactggacaacattttcatcaaggatagccgttaataaatcacttaaatgggttggggcatccaagttaggaattgagtagtagttaaccacacgttgcaatttggcgacctggcgctggttgcttaaagatagtgttgccatgagttttttgtaaattgtatggtaggacttttcaaagggggtcgccgacaataaactgagtgctttgagcgcaaaaaagagcgcattaatttcctggctgtttaataagatgggtacccatagttgttgttgcatgatttggtagccaccgtaacgtcccggttcaacgtaaatggacaaaccaagttgttctaacgagttaacgtcgcgcaaggcggtccgtttggagatattgaattcttgcatgagttctttgatgtggaattcttgtcggtaactgagaaagatcaattcttgattaagacgttcagagcggttcatataaataactcctaaaaatgattttaatggtgacatggattggcacctttcgactgtagtatataactgttgtcaaaaacaaccaataaatagattattaattaaggagatatttaaatgactaagactttgattgttaatgcacatcccgattttcgtaatgcggcgcactactcagttcaactagaacaagcttttttgcaactttttcagactcgctttcctaatgatactgtggatgtgatcaatttgtatgatacggtgattccccaagcaacggtacctgaattgctgggaatctgggaaaagcaagcgcaacatgtaaatttatcgattgaggaacaacgcctgtttgcaatcaagcagcaactcctacaacagtttaaagctcatcatcggattgtgattgcgatgccgttgcataatttcaacgtgccggcacggttaaaggactatatcgataatatcttagttgccagggagacttttcgttataccgaaaatggatcagtgggtttgatgaccgataattatcgtgtcatgttactgcaggccagtgggtcaatctatactcgtaatgaccgttatacacccatggaattttctcggctgtatcttgacaagatgtttactgaaattatggggtttgatcggtttgagattgtccgtgcacaaggactgcaaacgaacggggtggcggtatcacaggcattaaagcaagctaaaatggacctgaaggcagcttttgagcgtttttatgattaagtctgaaaatgattttaaggtatcggtagttgtaggctacggataccttttttgcgatactgcacgggaaatgggtcaccactactttaaagtgatcgcaactatggaaagtaactagcctgattttggtgattaacattggactaaaacacgccaaaattcatgcatatttaacgttagtggcagacctttactagccgttcagtgctgagaaccggtatactggaagcagtgattcactaatcgtgaagggagcccaatatgaaacggattgtagcgggaattattgcccacgtcgatgccggtaaaacgacgctgtcagaagcattactataccggtctggcgcgctacggcaattagggcgcgtcgataatggcgatgcttttttagatacggatgtgcttgaaaaacagcgtggtattacgattttttcacaccaagctaatttacaatataaagacattaatttaacactcttggataccccgggccacgtcgattttgcgacccagactgaacaagtactgtcggttttggacgtcgcaattttagtcgtttcagcgactgatggtgtgcaggggtacacgcggacgttatggcgattattagcccgttatgacgttcctaccattctgtttgtaaataagatggatgcgccggggacggatagcgaccaattgatacaacaaattcaacagacattatcgcctggttgtgtggcgtttaacacgccgggagccggggacacgttggaagatcggccagtcataccgactgcggcagttgaagatattgcgatgcaaaatgacgaagtgttaacggattacttagaaacagggacgttaagtgatgccacgattcggcagatgattcaacggcgggaagtttttccgtgttattttggcgcggcacttaagctggacggggttgatgcgctaatggctggtcttgattattggacgacgccacaattaacgcgtcctgaatttggcgcgcgggtgttcaagattacgcatgatgatcaaggtgaacggcttacttggattcggatgaccggtggcaccttacgacctaaagatatcgtgtatgatgaccaaaaagtcaatcagttacgggtttacaacgggactaagtatgcgaccacgtccgcgctgacggcaggatccgttggtgccattaccggtctaacgggaacgcggccggggcaaggattgggacaggcagcaactagtctacaacccgtcatgcagcccgtactgacttacgcacttgatcctcagcgtgaggagttacacacctgcttagcagtcttgcgtcaacttgaagatgaggatccacaattacacgtgacttggtcagaaccacttcaggaattgcgagtacaggtcatgggaacgattcaactggaagttttgcaacaaatcttgcaggatcgttttcaactgactgtaaagtttggaacggggagtatcttgtatcaagagacgattacccaagctgttgaaggtgttgggcattttgaaccgttacgacactacgcggaagtacatttgttgctgacgcccgcaccgcggggaagtgggcttcaatttacgaccgattgttcattggaagtgcttggccgaaattggcaacaccaagtcgtgtcaaacctacaagccaaaacacaagcgggtgtcctgattggcgcaccactaacggatgttaaggtaacactggttagtggtcgggctagcaatgttcattcggttggtggtgactttcgtgaagcgacgtggcgcgcgttgcgtcaaggcttgatgatgttaaaacaacgtggtgattgtcagttgttggagccgtggtatcggttccgtctagaagttggtcaggaacaagttggccgggcgatgactgatattcagcggatgaatggtcagtttgacgcaccagtcgctaatacaagcgtagccacggacgggactgacttgacgacaattacgggaacggcgccagtagcagcgatgcaggactattcacagacggttcgagcttacacgcatgggcaggggcaattggaatgtatcgtggatggctatcggccgtgtcataacgagatggctgttgtcgataaggccaaatatgtccccacagcagatttagaaaatacaccggactcggtcttttgcgcacatggtgcgggttatccggtagcttggaatcaagtgccagagatggcgcacgtcccgtacgtttattcgaatacggaattggcacattttaaggcgccatcaaaatagaaattgaggaaagtcagatgatggatgtgacgtttaattcgacgttcgcggtaaccttgcaacatgagttgcaccagccagtattgagtttgccattgtcgttacaaatcggtgatttaactcgattgacaactgatgatccagcacagcttgctatcatgtcacacagtaccgatgccacggttgtcaagcaagcgttggtaatattaaagtctcaagttgagcaggggggcgtgctacgagtatggtggtctaccatgcccgatgattcgactggttgtgtcagcagttagcagacacagacgcgcaattgagacaagtgatggtaccgctaagtcaagtgataactcggccaggtctagctttacagactttgtcggatttatcggaagtattgccagcggatattgcgcattacttacagttggcacaagacgtttctgaggacgaacagcgtgctcatagttatgaatggcaagcgctcgtggtagaaaatgagccgttacgggtcaatcttaacgggcacttagtcagtgccccagaggacttttatgacagcttgttagaacgccaaatacaaccgggacgcccaattgtgcaaattattggtgagatgctgatgcgctactcactgggcttgccagactggtggtatcgtgcccggctccaacatatcttgtcaacgagaggatgattaatgtgaagaaaattgcgcccctgttcgttggcttaggggccattagttttggaattccggcgtcactatttaaaattgcgcgtcggcagggggttgtcaatggcccattgctattctggtcctttctgagtgcggttgtgattttaggtgtgattcaaattttacgccgtgcacgtttgcgtaatcagcaaacgaattggaagcaaatcggactggtaatttcggctggaacggcttcgggatttactaacaccttttacatacaggcgttaaagcttatcccagttgctgtggccgcggtaatgttgatgcaggcggtctggttatcaacattactaggagcagtgattcatcatcggcgtccctcccgactgcaagtggttagcattattttggtattgataggcacgattttagctgctggtctgtttccaattacgcaggcgctctcgccgtggggcttgatattaagttttttagcggcatgctcgtatgcttgcacgatgcagtttacggctagcttaggcaataacttagacccgttatcgaaaacatggttactgtgtttgggcgctttcatactcattgctatcgtgtggtcaccgcaattagttacggcacccaccacgccagcaacagtcggctggggagtactgattgcactattctcaatggttttcccactggttatgtattcattgtttatgccgtacttagagcttggcattggcccaatcctttcttctttagaattaccagcctcgattgttgttgcatttgtactgcttgatgaaactattgattgggtgcaaatggttggcgtggtcattattattacggccgtaattctgccaaacgtgttaaatatgcgacgagttcggccatagttcaggtcaataccaaactcaaaatgaacatgttgtactggattcatttttgtactgtgttttttgtttcacgtgaaacattcatctaattgatgctctttatgaatagttggtgggtaccttatttatataaatgataaaatgtgcctcacttagggacaacttgaattgaaaggtggtcaggctgatggcactaacctatcggatcgtccgcgctgaagcagacagtgattttggaaaaattcgacagttatattatgagacctggcaatcagcatatcgtgatttgatgcctgcaagttatttacagcaattgacgccagcaacttggcggccggaacggcggtggcaaaatatgttgctggcaatgacggctgatggtgaagttgtgggtgtttgcacatttggtccggccagacatgcgaactatgaggggtggggcgaactgtattcgctatatgttcacccgaactatcatcatcatggcattggtcagcaattaataatccaggcccaccgtcgcttaaaggcggtctatccacagaattatctacttgttctggcaaataatgctgtggcccagcgtttttatcaacgtaatggatttcacgacactggtcagatttatgtcgatcatgcgccgtttggtgttttgcatgagcggatttttgaagattaacgcaaaaaaacgagccttgtgctcgtttttttatagtttagcaatcaattggcgtgcgaccgcgcgtgctgagaacggattttgaccagtgatcaattggccgtcagtaattgcatattcgcgataaaatcgatgctgactaaagatagcaccgtgagcagtagctcgttcacggttaaggaacgggacgatccgttttttgccggcaatcagctcttcagttgcggtaaagcccgtaatggttttgccagcaatcaagtattggcccgtttggtctttgatgtttaggaggccagcaattccgtgacaaacggaggtcacatatccaccatgttgataaatggccagtgcgatggcttgtaactcagggttgtccggaaagtcccacatcacaccgtggcccccggtatagtaaatagcagtgtaatcatcgggatcgacctgactaggcttgagcgtgttcttaagggcccgattaatgaagtcagaatcttcatacacggccattgtggcggcatcggtatatttcatactacgcgggtcaaggggcacgaagccaccattaggactaacatagtcaacggcaatttgggcttgctgcatttcatcgacgaactcagcggcttcacctaaccaaagaccagtcggctcattagttccttggtaacgagtgatattggtttcgacaattaaaacttttttcattgatcatgactccttaaaaagattgatttgaagttagctaattaggttgaatactgataatgattttaccggtagcatgaccggaatgcgagtattctaacgcgtcgttgatgtcggtgagggggataatccgatcaataactggcttaataacgtcctgttcaattagttgtcgcaggcgtacaagttgctggccactaggttgcatgaacagaaacgaataggtagcttgggcttgttgttccagttgactcagtttccgcgttgctagacccaataaccattgtttccatattggcagtccgtaatccttaccaaaacgcgcgtttggcagtccggcaatgctgacaatctgaccgcctggtttgataatctgaaaagcggcctcgagggattgcccgccacgagtatctaatacggcatcgtaatgggataatacatcagtaaagtcttgctgatgatagtcaatgattttatcagcacctagtgattgaacgaggtcaaaatgtttcgcactggtagtggttgcgacgtaagcgccgagatatttggccagttgaatggcaataatcccaataccacccgaaccgccgggaatgaaaaccttctgtcccggctggatgttcattatatcgtgtagtgcttggtaactggttaaacctactaatggaattgcagcggcttcttcaaaattgagattggctggtttcagtgcgatggcttgatgatcaatggcgataaattcagcaaaggttccaattcgatctttgggtgcgcgaccgtaaacagcatcaccaactttaaagcccggtacttggtcgccaacggcagtaattacaccggcaaagtcactgcccataattagtggcatggtgtattgtagtaacaatcttagatcgccatctttggttttcaaatcgattgggttgacactggcggcaacgattttgacgagaacatcggtgggagctattgtcggaacagggacttctgtcaccatgggggttatttgcttgtatttagtaataatggcagctttcatagtggactcctaacatattggtttaaatgtttaacatcttgaacaaaccatgctgttgattctagtcgcttacttacaaaaagtcaacgattaattcttgactttcaattttagcaagcgttaaatggtttaagaatacgaaccgtaattggaaaggtgtgattttttggcagaacgaacgatggcaatatttaagaagggtgttccgatttttacaattcttcaagacgaaaatcggcaacggattttggtgatgctgtgccggactgatcagatgacggttaaccaaattacagcgcaaatcgccttatcacggccggccgtatcgcaccatttgaagttgatgctggatgccggcattttagcggttagcaaaacaggtactgaacgttattaccgcgctaacatgacggcgactctaaaactattgaaggcactcactgcgtcattagaagccgatttagcccatactcagtctgtagacgaataaaaaaatgaatcagagtgaaaaaagctggtacttttggaatgacgcctctcattccaaaagtaccagcttttagttcacttatgcatttcagcgcactgaatcaccagtacttgaaatggatggcgccatttaatgattatcagtgagctaacgacatgatatcgttattattaatttgaggatggcacttgaatatctttgaaggtgtgccgataaagtaaccagccaagtaagcacgttaagacatcagcgaccgcttgagcccaaataataccagttagtccaaagaactgtgccagaataacgatggcgatacctagtaagattgcttgccgcgaaagagccatggctagggcactcaaacccgcaccgactgattgaaagacggtcgtgaacacgaggatgaaacccactaatggtgtcgtaatcaacatcgctcgcaacatctgtgtacccatagtgacaatggctggttgattcataaatagtttaataagttgaggcgcaaaaatcattagaataatcgcacaaatggttgcgtagccaccctcgacttttaaatcgaagcgcaacgttgcccgtagtctttgccaatttttagcaccgtacgtgtaaccaactaaaggctgggccccaaaagcaaagccgaccatgaccatcataacgaccatgtaaactttttgaacgattcccatggccgccacggcttgggcgccgtatgcggctaagtagctgtttaagatcatcatgccaaaactctgggttaggttagtcagtgaggctgggattccaactgcgacaacggctttaagggtcggtcgcgagatatgggctaactttggtgctaaggaaagcgttttggctcggcgcataaaaaagactaacagactggtgttgaccgcgtaccccaaaacgttggcaaaagcaacgcccgaagcaccccagtgaaagccaaataagaataagggatcgagaataatggtcagaaccgtcccactgatggtcgcaatcatggaaagttgtgccaggccctccgttcggataatgttaccgggaaccagtgaaacgatgataaaggttgatcctaataccaatatacgatagaagtccgcaatgtagggacgggtagctgcagtagcacctagcaagcctaaaattggttgttcgaatagtaataataaggctgtcagtactaagctaagcgcgatcgcaatgtaaaaacaaaagctactgatacgtgcactttggtgataatcatgacggccaaggactcttgaaataacggcactcccaccgaggccaaaaatatcaccaactgctaacataaacgaaaatagcggactgccgagggcaataccagcaactaaatcagcattaccagtttgagcaacaaaaaatgtatctgctaagttataaatcatgctggcaaccatgccaagaaccacaggaaaggctaaatggaaatacgctttgggaatcggggccttctcaaataaatcattcataaaaataagtcactccttctctgaacggtcggtcgaagcgtgactagacgaacagaaagataatataagttaatgatacgcttgactgtcaagctgctcaatgcaccaaactgataaggacggtcagctaaaggaacgacaaaaaaagcattgcccagtgtttcagcggcaatgctaaaaattaacgtgaatttttaagagattaacgtaagtcgatttggtgaaggttagccggcatctgaccaacatgatggccgaccgttcctgcgtgcatcgcttgtgcgccattgataaagtgcacaccagtggctgcaattaatcccattcctaatactgtaataatacttaataccatcattattcacccgtttctgattatttctgcacttctattgtagcgcttacatcaccattgtcatttgagttgtattagaatggaattaagtttttcactttttcaggtggacattagtattggaatggaataagtacgcattgtgcgagttaatttgtcatcgattatgattaaaacgtgccattttttaaattcaaaagcagccagcttaggttcgctgggaacagttcgagttagcgtaaacttgcttagagtgcgcgtcctacaccgacctccaggcatttctgccaattgccggaacgtggtgggcacagatttgagccgaaaacccacgtctcaaatactggcctttcactaaccaagcacaggacgcttgctaagtgaaatttcaccactgggcattgtcagaaacgccttccagtcgggacagtattcgaatggcagacagtaagggacctaacttttgttggactcatcattgttcttcataaacagcaattttgtcgagcagctgtcaggtagaaaatgacattgtgatagctcactatttcggaatcgccatagtaataatcgaacgtctcaacaaagtggttaatgtaaccctaacgtttcttttaaggttccatcatcaaaatagtcagcgaccaattgtaccaagttaagtggctgttcatcagccattcgagcggcttaccgactggaggagctgggtgacaatgctcagtagccaaattattcttagtcggaagtgggttgcttccggcttagaataagactcgtatttgagactgggcgggttgtgcacgggctctaatcgacgtcggcttacgttccagcaattgtcacccagccccggaggtcggaatcggacgcgcattgctgacgaacaggaatccatctgtttggcacgttttaatcaaggctaatgctaaatagcggctagcataacgcataacgcataacgcgtaacaagtaaaaaattagtaacgaaagtgagtgatattttggacgtgcaagaaggatacatgccatttaatggttatcagacgtattatcgaatcgtaggggatcggcaatcaaataagacaccgttagttttgctacatggtggtccaggatcaacgcataattactttgaaggatttgatgacctggccgttcaaacgggacgaccaatcgtcatgtatgatcaattaggctgtgggcgttcatcgatacctgatgacgatcaattatggcaagccgcaacgtgggtggcagagttacaggcgttacgtacgtatttagacttacccgagattcacttactagggcagtcctggggtggtatgctagctattatttatggttgtgactatcgaccacaggggattaaaagtttgattttagccagtaccttgtcttcagcccgactgtgggctcaggaacagcatcggatgattcggttaatgtccccagcggatcagtcggctattgcgacagcagaacggttacaggatttcacaggtgctgcctacctgactgctaatcaacattttatgacgcaacatgcgtcgggcccgattactgctgatgatcctgaattcctacggcgatcaaaacgggtggggaccacggcttataatgtagcgtggggtcccaatgaatataatccgactggtacgttggcggattatgagtataccgaccgattacagtatttgcagatgacaactttagtcaccagtggaacggatgatttgtgtacgccattagtcgctaagaccatggtcgaccagttacctcatgcgacttggacgttatttccccgtagccgtcacatggcgtttatcgatgaaaacacgacctatatgacgcgattgcgtcactggctagcagcccatgattagagaaatgagcgtaatcatttcccgggaaataatttgctgaatagctagattgagaagtttatcggcgtgatctgattttgtttggctgtcactataatgattattaaaaggtttaaagtagaccaaagcgcctgtggaagttagccttctgcgggcgctttggtgattgctgtgatgatgtttaatgttgatagataaagacgaatcgattggccgtcgagcgcttctcgtcaaattgataatcgggatggtcaaatgtgcgaatggccgtcacatcatcgatttgatgttcagccaaaaaacggaccatggccccacgtgccatcttagctaatgtggctttagtcttgagtttgccgtcgataaggcttgcaaagacaatatcaatcattgattgatgcggagccagataaggtgcaatggtcttagcatattcttgagaagcaagattgataattggttctggccgcggagtcagtgcctgatagaggcggtcgccccaaaacgcatagaggttcttggcttgaccaacagccaaccgtgcttgcatttctaaccgataaggaacgataccatcaaacggtcggagaatgccataaaaacctgacaagattcgtaagtttgcctgaatatagtcaagggctggttgggtaaagacgtccggggccatgtaacggtactgaataccgctgtaactgagaatagcgggagtcagattgcgggtcaggtcaattttttgaagccaatcataattaggttgggctagtttgtcactgcaatgccataaggtcttggcctcaggataggtgaggtgttgcagttgagccagtaattgttgcgtctgatcaagatagattggttcagttagggctggaaaggcatcttggtcgataatcatttttttcgcaggtgcaatgatgattttcataaggtcactactttcgaagcgttcagtttataaataatgttgatagcatttaaagcaaaaactaagctatagaaatatgatagcacattagacaaacgtacgttcctaaaactatcaattgcggtataatgaaattatgatactaattgagtaaaaggagtttgtcggtatggatatttcactattaaaacaagtggttcaatcaactaataagattgccctcagcacggccgtcaataatgaagcagatgttaaaattgttaactttgtctggtacgaagcacaaccagatacgctatacttctcatcagttaagacaagtcccgctttgaaggtttatgaccagaatccggatattgcattcattacgattcctaatgatggaacagcgggcaatccatatctacgagcccaacacgttaagttacaacggtcaactaagacgatgactgacttgctaccccaatatttagaaacagttccgaattatcaacaagtctgggatgctattggatcgacactcgttgtttttgaattaaaactaactgatctttttgttgacgcgggtgttggtggcgagaagcaaacactgacttttaattaacactggattcctatactaaaagcgtttcaaggccggcttaggttaagctacggtcttgaaacgctttttggtcgggtaattttaggagcaacatatgaggtgttacttcacatatgcggtccgataattggcggcaccgctgaaattattatagatgacgccctttaagtgcgacttaacgagcagatgggaacggccttcatagagtggggtcacggcctgatcagttagcgccgttttagcggcttgaactaagtcttgatagcgcttggtcgcgttcaaagcatctggaccatcagcggcttgcattgcctggtcgtaagccttgctttgatagtggcccatgttggagttgctgtcgccagtcaaaattgttaatgattgtgaagggtcggcaaaatccatactccagctagttaaattaagctggaaggctcccttggacactttacctagcattgcggtaaatggcattgccttgattgttacctttagtccggggaggtgactggtcaattgtccctggatgaattcagcgacctgatgtgagttgtcatcatcaccacaagtaatcgttaacgttagcgattttttgcccaattgttgttgtgctttatgataagcggctcgagcctggttgagattataattaacagtaccatcaacggtcgcatcattgacaaaatcggtaccagttttaggattcttagccatattgcgcacaccaaagcttttggctggaagcgaaccattttctagaactttgttggtcagttgcgaccggttgattgctaaggataaagcggtgcggagttcacggttggctgctacatggtcatggtgattgtattgaataaagctgatttgaccacctgcaagtgttttgagtttttgattatttttattctggacactctgctcgccattaagtgtcacactatctaacttattagattgatataaattataggcagtcgtattggacttaataacctgataattgatttggtgcagtttcaccagtttgtgatcgtaataagctgaatttttctttaaggtccacgtattattagtcccggtccagccagtaagcgtaaatggcccgttgtagacggtcgtcgcggctgaagtcccgtacttcttcccgtatttgttaacagcaggttgattgaccggataaaaggtcgaaacagctaaaatctttttaaagtaggcgacgggtttgcttaacgtgattgttaattgatagtcaccattagctttgacaccaagggttgatggctttttcttgccggctgcaatggcgtcagcatttttaatgttcgtgaagacataggtgaattcagatttactttttggatcaagagttcgtctccatgaatagacaaaatcgtgagcggtcaccctgttaccgttactccagcgcgcatcgtggcgtaattgaatgatataggtatgaccaccattggtaacagttgtcttagtagccaaagcgttgacgggttggctctgactgttcagccgatagagcccctcgtcaacttgggtgacttggctattagaaacgctgtccgtcattttagcgggatctaagctcataatttctgagccagctgataggttgataacttgtgattgtttagtcgtagctgggtgtgagtgggcgttgacggtaaagccgatgccgccaataatgaccacgctgccgattgttaaaattaatttgtgtgttccggataaactcataattaaatcctccaaaagtataattgtatttggttagtttgatccatgagttttgccatcgtttcgtgaccatttatttcaccccgtttttatcgtcaaaaaaaccgtccttatccagccaatgctgtgttaaggacggtttgataaccgcggtgccaccttaattgagtgttcgccaatttagtgattaaatcacgcgtacactcctactccataggaaactaacatttccctgacaactgacgtatgtcgcacgtctttccgtactctcaactgacgttaatttcggcaaagccctcggtggtccatttaattacctgcgttcggccatactctcagcaacgatgactctctgtgcgggcacgataatcttgatctccacctcattggtttataaggacgatattttgttgaagtgagtataccgcttttgaaaattagttgtcaagagctggaaaaatattgttcaactataaatttagtcaaacagaaaacgatgttcgtaaataaaccgaggattaatatagtgtcgagtggcattgattgcgtggtttttaataacggctgcaagcattaattactttcattatgcgcgaataaaaattataatgacatcaataatgtaaacggattcaatattgcggtgacaagattaaggagggctaaacatgagctttagagttgtagccggttatttcggtgaatttagtgatgaagcgaagcgggccaatcaagacttaggtgtaatcggcatgtcgtttcagtatcaatgtaatctcgtttatccagaaggggcggggccaaactttggttttcgaaccgacgcgcaagcgattgatgtgttcgatgcgttaaaagttagttacgatggtttcaaagtgcaagctggcctgattaaggcgatgggactagttgattatcaattggttggtggtcgttacgaactagtcggccatgatttccgagaattacctttagctgagatcaatgcgaacttggaaacgatgcccggactcttggctcagggaccgatgccagttcgatatgtgacttatcgtcggacggatgaccctattgacgcggttggctttagtggcaactgggcactaggagatagcggtggctttcgacagttaagtgagacgttggcagaaccaatgcaagcaccagtggcggcgctaattaaggcaattgatcaacttggtttaacgttacaacaaattaatctacccacaccgcaaagttcaacggctttgccgacacatttgagtgatgatgttcatcaagcgaacgttgacgtgtgggtggtgttaacacagccacaaggtgacgagcagcaagttttgcagaccattcataacgctcaagagtgtaatgaaaaattgtgcgaagcgctgactcgtgtttatttgaagtaggatgtttcacgtgaaacaactggcacttggcagtccgttattttctttagtgcgttgcatgatatgatacgcacgaaccgtaacacatcttcacgggagaaaatatgttattagaaacttatcagcatcgctcatttatcaaacaaactggcaatatttctatcgaacgtgattgggaaaagcttttcgatgaagcgtggttgattaagcatcttcgtggctatcgctaagctcaagacttagaggggagtggtttgatgatgacatcgacaccacggttattacaagccattcaacaaacgaccaccgcaattttaaaaacaaaccttgttggtatttacctgcatggatcctatgttttaggctcatataacgaacaggtgagcgatttagactatctgatcgttgttcggcgttcgttaacattagctgaaaaacggcagttaatgacagctaccataacgcaattgtggccattagcgccacacaagggattggagtttcacgtgctgttacttagtgcaactcagcattttgcgcatccttgcccattcgattttcatttttcaaaataccattatgagcattatcaacaggcaccgctggcctacctaaagacgatgcacggtactgatcctgatcttgctgcccacttaacaattctccaagcagcgggacaagtcttgcttggaccagccattacaacggtctttggccccattcctgcggtggcctactgggacagtatcaagtctgatatcgcgaatgctgaaacggcgatcgttcagttaccaatgtatacggtattaaacctttgtcgagttcgcgcttaccagcaagatcagttaattatttctaagcaggccgggggtgaatgggggacagctgccaacacagtggcatccgttgatcaggcaggcgtcagcagcctatgctggtcaacaggacgaacaggttatacgatggtcacgtccaaacttagtggcgtttgcacgaatcatgttagccgagttgggcttaaaatcagaatagtttgtgagtttaacaaaaaatgcttactggcgatcatccaccaataagcatttttgtcaccaccaacttaaagtcggctgttataaatcaagaaactaatgtagcagttatcgccatcaggtaaatcatagccagtgttttcgttgctaccgtcattttcgtgtaaaacaacgaattcaccagaaccataatcttggtcgtttaaatactttactaaacgttcatcacattcagctaaagtcttaccggtcacaacgcgccggttccaaccacgatggatctcagtatttggattaagcatctcttctcaactcctcttaattataaagtcatcaattgcgcttgccaagcgggttgctgatcaagatcagcgcgcgttaggtcagcgtcgacttggtgggtactgttaaaaataatgaaacgttcaccaacggcttggacttgctggtagctatggcttgccatgatgatagttttgccggcagcttgtagccgttgcagtagggttagcatttgctgctgagcggcaattgttaagccgttcagcggttcatctaacaataaaatttcagggttcaaggcgagaacgctggctagtgccacgcgcttcttttcaccacctgaaagttggtaagggacccggtctgctaagttagcacagtccgttaattgtaagcagtcggcgacgcgttgcgcaaccatggctgctgataaaccgagttgtcggggaccgaaagcgacttcctcagtgaccgacgtgttgaatagttgaacatcagtattttgaaagaccatgccgatccgctgatgaagttgttgtcgattttgggcatcagcgagataagtggtcgtaatcggctgatcgtgaaactgataagtgccactagttggactagctaatccactcaatagtcgtaaaagggtcgatttaccagatccattgggccccattagacagacaaagtcgcctgagttgaccgttaagctgaggtccttcaagccacacgtatcaggataatcatagcaaatattcaccaatttaatcaataccacgttaatgcctccaaaaaataaataatatccagacaataatcgctgggctcagggcaagataatcgcgccaatgggtacgacgcccggttgagcgcgcgtaatgaccattgaacccgcgtgcttccatggcagcgtatagttctagcgcataagtgtaacttttaagatataaattaccaaataatgcgccgattaaacggtatggatgagccgttggggcgaccgtccgcaattctagtgcttccatcgtcagcaatagatgttggccgagcattcgtaagtacgtgatggcaatggccaaagtcataattaatagatcagggcaatggagtgccttcaagccagccaataaatcttgaaacggcgtggttagacggtaatattgagcgtttgccagcattagactggttttaaggccaaagaataatagcgtggtgggaccggctaaccagtagctcggtaatacgaacagcatggccatcccaacactgattagccagcttcccataaaacggcgcagttggcgtggaggtaaccataataattggcacccaactaatagtgctaggccccataacagaatgagattattacttaaagcaattaaaatgacgagcaacaggagctgaattaatttgaattgcggtgcaacgcgccaatgagacgttgccgtgactggcgctggctgtgctagtcgactgagtaattggcgtaggtgacgctgattacgttgccaaaatttcgctttaatagcaggtgttggcgtggtggtcgtagtttgcagccaagctggaatatcagtgttgggacgtgtcggtttcatgttgaagacctcgaatcaaaagtaagaaaatcaaaacagcggtaatggccgataaaatataacccacactgaccggtaagcccgcgatggcgtaatcactgaacagggcctgaaaatggaacccgtggaccattccttgaggcgcgtgagtactgatatgttgttgcgctagccgttgctgtaattcttgggggctccattcgccccaagccgtattgctagccaacaagcctaatggtgataacaccgctaatccgagtagcagtgcgatccacggccgctgattgcgccgagtgggtgtctgatagaggttagtcggtgcgactcgttttacaaattgaaagacaagcagtgtgaagacgacttcgacccagccggcgactaataagtgagccgtcaacattgcgggtatcgtaatgttgaggccgtatgggcagtagagcggcgcaccacttgccgtatgagccagtatgggttgtaacccgagctcgataccagcaactagcgccgccatattaatgcccaagtaagcaccaattgcgagccccaacttttcatggtgccatttttgacctaggcgatagcaggcgtagccgacaaacggcataatgaccgccatattcaacgcgttagcgccaaaggctaggataccgccatcaccgaataataaggcttgtagtagtaacgtcacggtcagcgcaagacacgccgcccatgggccaatcaagacagctaacagggttcccccgacagcgtgagccgtggtcccacctggaatcggcaagttgaacatcataattaaaaaagccaatgaagcggcgatgccgagcattggcagggtttcatgatgttttttgatttgaactttaacttttaaaacggcgacggtccagacgggagccatcgcggtgaccaacgttccgcaagttgcgggacttaaataattatccggaatatgcacggatgagcacctcactaatttgcaatttgatctaagaggtaactaacatcttgaataataaatttgtgatttttgaccgtaatgacgccgtctgttcgtaattccttgagcatccggttgacactgctccgggagctgataccacagaaaccggcaatgtcgtcattggtgaccacaaagtcaatcagaatcccttcgttaacttttcgtccgaacaaatcaacaagactatagataaaggcacaaatggccccttttttaccgttcatgaccatccgttgcagtcgaagaatgttttcggacaactttttacggtaataatttttaacgtagttttgcagttcaggcgtgctgttgacgtacttccaaaaagcgacccggttgacctgataaaaagtggcgtattcggactcaatacggacgttaaacggttgatccgtagaacgagaaacttcatcacgcagcagggagatcacgtcgggcttggcaatataagataaattatattcgcgaccgtcttgtaaaataatgctgtttttgatgatgccgtcctttaagacgtacgtatagtgttcggctaaaccatgataggtcaggtaagtatgccgcttttttttgattgtcggcacgtgatgggcttccaaataacttagtaaatattcaatatcagttaataccatcttagtttttcagttctttcgtgaataatttttaaggttgaggtcagtaaaaatagcgattctcaacagtaatcacgacgataacgctacttaagcatagcggttttcatgattgtgacaatcgcatttaaagtatacatttgttaactatttttgaaaacttaaaatgtaacggacaagttatccgtcttctagtataacaaaacgtgcatgtaaaaattagtttttagagaaagaggatggctaaaagtcatggttgcaattgatttaccatatgacaagcgcacaattacggctcagattgatgatgaaaattacgccggtaagttagtgtcgcaagctgcaacatatcataacaaattatcagaacaggaaacggtcgagaagtcgctggataatccaatcggctccgataagctggaggaacttgctcgtgggaagcataatattgtgattattagttccgatcacacgcgcccagttccttcacatattatcaccccgatcctattgcggcggttacggtcagtggcgcccgatgcacggattcggatcctcgtagctactggtttccatcggccatcaacccacgaagaattggtgaataagtatggtgaagacatcgtcaataacgaagaaatcgtgatgcatgtctcaaccgatgacagtagtatggtcaagattggccaattaccatctggcggcgattgcattattaataaggtcgctgctgaagcagatttgctaatctccgaaggctttatcgaatcacatttctttgctggtttttcaggtggtcggaagtccgttttacctgggattgcttcatacaagacgattatggcgaaccattccggcgaatttattaactcaccgaaggcccggaccggtaatttaatgcataatccgattcataaggatatggtgtacgctgctcggaccgctaaacttgcctttattatcaatgttgttttagacgaagataaaaaaatcattgggtcatttgccggtgacatggaagccgcccataaagtgggctgtgactttgtcaaagaactttctagtgtaccagccattgattgtgacattgcgatttcgacgaatggtggttatccgcttgatcaaaatatttatcaggccgttaaaggaatgaccgctgctgaagcaacaaacaaagaaggcggcacgattattatggttgccggtgctcgtgatggtcacggtggtgaagggttttatcacaacttagctgacgttgatgatcctaaggaattcctggaccaagcaatcaacacgccacggcttaaaactattcctgaccaatggacggcccaaatctttgctcgaatcttagttcatcatcacgtgatttttgtgtcagacctcgttgatcctgatttgattacgaatatgcatatggaactggccaagacgttagatgaagccatggaaaaggcctatgcgcgcgagggtcaagccgctaaagtgacggttattcctgatggtttaggcgttattgtgaagtagtatggcaaccacagcagaaatattacaacaagtggcggcagggcaattaagtccgacggcggctgcccaacagttagaagcgggcaaaacagcggcattaggttttgccaatgtcgatttagatcgtcaacgccgcaatggctttcctgaggtcatctacggtgctggtaagacggcaacccaaattgtgggtatcgtgcaagccttgtcccaacagacgttgccgattttaacgacccggttatccgcagaaaaattcgcggcactccaaccagcgttaccaacggctgtctatcatgccactgcgcagtgtatgacggtcggggaacaacccgcaccgaaaacaccagggtacattgctgtggtgacggcggggacctccgatcaaccggttgctgaagaagcagcagtaaccgcggaaacttttggcaatcgtgttgaacgagtctatgacgtgggtgttgcgggaatccaccgactgtttgccaagttggatgtgattcgtggtgcccgggtggtcattgtgattgcgggcatggaaggtgcgctggccagtgtcgttggtggactagttgataagcccgtgattgcagtgccgaccagcgttggttatggtactagttttcaaggtatgaccgcgctattgaccatgctcaatagctgtgcgtcggggattaccgttgtcaacattgataacggctttggtgccgcctactcagctagtatgatcaatcaaatgtaagattcagttaactgaacaaggagaagataaatgcaaacactttatttagacgctttttcggggattagcggtgatatgtttctgggcgcgttactcgatttaggacttgattttgagcaattaaaaaccgaattggctaagttacacgtgcacggttatgaattaacgcagcaacgggaagcccagagtagcatctatggcacgagctttgatgttcaggttgcgggtggtaaggaccatggttttgtggaacatcaccatcatcagcatgaagctgggcatcatcatgatcatgaagcgcgtcatttagctgatattgaggcgttaattgacggcagtgacttatcagataccgtgaaacaccacgcgaaagcgatctttatggaaattgcgcaagcggaagcagcggttcatcacatgccactagctgaagttcatttccatgaagtgggcgcgttggattcgattgttgatattgtgggctgctgtattgggttggaattgatgcagattgataccatcatggcttcaccgttaagtgatggtagtggttttattaacgttgcccatggtcagatgccagttcccgtaccagccgtgatgcagatgcgagttggtagtgccattccgattcaacaacggttggatgtgcatactgaattgattacccccactgggatgggcttggtcaagacgctcgtacgtgaattcggaccgttaccggaaaatgccgtgccaactagagttggttatgggtttggtaaacgggacacgggtggtttcaatgcactgcgagccgtattattcgaaaaaaaaaactaagtcagcaaatcgttaaccggacggctgatgctgtcttaatgattgaagctaatctggatgatcagacgggtgaaggactggggtacgtgatgaaccagttattaacggcgggcgcatacgatgtgtttttcacgcccattcagatgaagaaagatcggccggcgacaaagttaacggttttgggaaacgttaacgataaggacttactgactaagttgattttacaagaaacgacgacgattggtgtacgttaccagacgtggcaacgtactattatgcaacggcacttcctgacggtcgcaacgccgtacggtgacgttcaagttaaagtggcgacatatcaagatattgagaagaagatgccggaatatgcggattgtgcccagctggcgcagcaatttcatattccgtttagaacggtctaccaggcagccttagtggcggtagatcaattagatgaggaggcgtaattttttggtacatcagttgattgctgaatttatgggcacagccctaatgattatttttggggtgggtgttcattgtagttccgtattaaagggaaccaagtatcggggttccggtcatatttttgccattacaacttggggttttgggattagcgttgccttattcatttttggcaatgtttgcattaacccggcaatggttttggcgcagtgtctattaggaaatatcgcatggtctttatttattccgtattccgttgcggaagtgcttggtggggtcgtgggctcagtgatcgtttggatcatgtatgctgatcattttaaagcctcaacagatgagatttcacccattacaattcggaacttattctgtacggcaccagccgttcgtaacttaccgcggaatttctttgtggaattatttgatacatttatttttatttcgggtattttagcgatttctgagattaaaacgccgggaatcgtgccaattggcgttggcctacttgtatgggccattgggatgggacttggtggtccaactgggttcgcaatgaacttagctcgagatatggggccccggattgcccacgccatcttaccaattgccaataaagccgatagtgattggcaatacggtatcattgtgccaggaattgcgccctttgtcggggcagcaattgccgcttggtttatgcatggcttttttggaattaattaaattaaatagaagaagggttttattatggcaacattagcaacaaaaaaagcaacgttagtagcagcattaaaggatttacaacgggtcaccgtggccttttctggtgggatcgacagtaccttagttttgaagatggccctcgatgttttaggccgtgacaatgtgaccgctgtggttgcgaactctgaattatttacggatgaagaattcgataaagcgatgagcttagccgaagaactaggtgctaacgttcaaggaactacgctagactacttgagcgatgaccacatcaagaacaacacgcctgatagctggtactatgcgaagaagatgttctacagccggttgaatgacattgcggctaataacggtagtgccgctgtcttagacggtatgatcaagaatgatgaaaatgattatcgtcctggtttgaaggcccgtagtgaagcgggggcccggagcttgttacaagaagctgatttcttcaagactgacgttcgggccttggcacaagaactcggtttgacgaactggaataaagtggcgtcatgctcggtatcttcacggttcccatacgggacgacgttgacacatgacaatattgctcaagtaatggccgccgaaaaatatttgcgtagtttaggttttccaacggtccgggttcgtttccacaatgatattgcgcggatcgaattaccagaagcacgaattggtgatttcttagtctttaacgaccgcgttaaccgtcaattacaatcacttggattccgctacgttacccttgatttaggtggcttccgtagtggtcggatgaatgatacgttgaccaaggcacaattggccactttcgcctaggcctaatcaaattaatgatagtggtgtcgggattaatcggagatgggcggctgaacggcggtgatcatggttcattcgcccacccgatgataatcgtaaccccagccgatacgcacatgttgcgattatcgcctgacaccccaaaaagcgcagttcaaggccgcccttgagctgcgtttttcgtatcttcatttttagatcaacaggcgtcaaaagtcacgacgagtttaccaacgacttgaccagcttggagttgttgtaaaccacttacaagttggtcacggtgcaagacctgagtaattagtgggtcgaccttgccagtttggaccaaagctaataaggcggcggtcatttgcccaagatcggcaacttgcgctgggttaccgctacggtgggcaccaccgaggtccaatttactgatagttacaacttgattacttggaaagtggtccggagttgctaatacacagacaagctggccattgtaagctaagcgcggtaagtccgcatcagcatgaccaatggtattaatgatcagatcaacaccgtgctgctgcgttaggtcttgaatgcatgtggtcacatcttcatgatggtaatcgatttgggcatcgggatgcagcggtgccacgaaggcttgcttggcctgtgaaacggtcgtgaagacggtcttgccagcagccttagcgagttgaatagccatactgcctacaccgcccgcacctgcatggatcagcacagtttgcgcggcatttaaattggctttgcgcaggagggcctgataagccgtcaatccagcgcagagactagcggcggctgcttcaaagctcacagtcgttggaatcttagctagcacggctgctggtaaactcacgtattcggcaaacgtcccattattggcgagattagcgtgcccacaaactcgttcgccaggccgaaaattagtgacctcagcgccaaccgcttccacgattccagctgtgtctagtcctagtgtgtgtggatattgccaggcggcgttacccgccgtaactaatttaaaatctaccggattgagcccgactgcttgggtcttgatcaacacctcagttggcccgaggttgggcatgggccgttcttgccattgaagctgtttcatagtttgagcggatggatctggcacaacaagtgcttgcatcttcaatcactcttttcttaaaggcatatttgctttttattataaccggtcgcggcggtgaatttaaactttaatgcctaattaattaagtagcaatgagggtgattcggctaacggaaagattgacgttagcggttacaatcgttagactaaggttagtaattgaatatttttaaacactaggggtgtccaaaaatgggctgagatggtgctgtaagtgccgatccctctgaacctgtaagctcaaacttgcgtaggaaagtgtcacagctaatgttagcggccactggatcaatgcatgttgattggtggtcgtttttgattggtgtgtcggtcaatgaggaggagaattgctatggaattacaattattgaatactttacgggatcacaatccgattgtttttaacattgccaattttgttacggttcaagacgttgccaatgggctaaacgcgttaggggcctcgccaattatgtcagctgaagtccaagaagcagagacgatggtccaaattgccggggcagtttgcattaatttaggaaccttgaccaccacccagattgatcaaatgcgagtggttggtaagcttgctaatcagtatcataagccagtcgttcttgatccggtggccgtcggggcggtcccttatcgaaaagaagtcgcgctagcattactatctgattttcaagtcgatgttattcggggcaatgctggtgaaattgcggcattggctggcatggattggcaagcgaaaggcattgatgcggggagcggtcagggcgacctggttgaaattgctcaagcttgtgcacagcaatttcaatgctgtgtcatattgtcgggacctactgatgttattacggatggtcggcgcgttgttaaagtcgctaatggtaccccgcttttccaacgtcacgtgggctcgggcgatttactttctagtatcgtcgcggcttttacagccgttagtccaaccgatatttaccaggcggcgcaaatggcttgcttagtcttagcgggagcgggggaacttgtcgccagtcagctgacggccgatcgtcccgccacatttgccattgatttgattgaccggctgagcttagtgacagtgtcagaaattcaaacaattgctaaagttgattaaatataatgaagggtcgcgagatttaatgaatgaatttccacaagtggcaacgattgctggtacggacagtggtggcggtgccggtgtcatggccgatttaaaaacgatgcaggcacgtcacgtttttggtaccgcggtagtcgttgccgtgacagctcaaaatacattgggggtccaagattttatggcaatgccgacgaagctcattgacgaacaatttgcttcgttagcagctgacttagacattcgcgcttgtaaaacggggatgcttgcagatgctgaacatgtccatgccgtcgttgagaacttgaaacgagttgattttgggccgctgacagttgatccagtcatgattgcgaaaggcggggcggcgttattagccgcggatgcgattaaaacggttcgcgacgaactgatcccgttagcgactgttgtgacaccgaatttaccggaagcagaacgattaaccggtcaggcaatcactagtaatcaagcgatggttacagctggacatgcgctacaggggttaggtgctgacaatgtcattattaaaggtgggcatggtgataatcctgatttagctaatgacttcgtattgttggctgacgggaccgccttttggctttcggctccacggattgatacggtgcggacccacggcacgggagatactctatcggcatgtattaccgccgaattagcaaaaggacggtcaatggctgcggccattaaaacggctaaggcgtacgttgctgggacgattcaggatggtatccaggtcgggcatggtcatggcccgttgaatcattgggcaaccccaagtgagcaggtgatcgttcatgacgcttaaatttgaacccacacaattacgtgcttattttgtgtgcgggacacaagacgtgccgggacaggatctgaatgtggtcgtccaaacggccttggatgcaggcatcacggcatttcaataccgagataaaggcaatagccagttgactacggctgagcgttttgcattggggcagcagctgcgggaacgctgtgcgcaagcgcatgttccctttatcgtcgatgatgatgtcgagctggcactcgcactgcaagcagatgggattcacgttggtcaaaaggacgaccgggtgacacaagttattcaacgggtcgctaatcaaatgtttgtcggtttgtcttgttcaaccttagctgaagtgcagattgctaaccaattggaaggcattgcctatcttggtagtggtcccatctttccaacgacatctaaggccgatgcggatccagtagtcggtctgacgggcttgcgacaattagtcgtgactgcaacctgtcccgttgtcgccattggcggaattactgtcgcgcaattgccagctattgcggctactggtgcggctggcgctgcggtgatctcaatgttaacgcgtagtcccgatatggctgccacggtcaaggcgatgctaacggctacggagggtcactgatgaaacatgacgggatttttcggagccaatttttactgtggctcggtgcggctatctcaattgccgaaatcttaacaggtacgctgatggcaccactggggctgacacgcggattggctgcgattgtattggggcacttgatcggctgtggcctgttcttggttccagccggctatttgggggctaaattacaccagtccgcgttagcgtcagcccaactggcttttggtcgcggcggggtgttactagcgtcaggactcaacgccttgcaactcgttggctggacggcggtgatgatcgtcaatgctcagttagccatgaacagtattagtggaaagctatttggctttcgaagtccgctattaatggcaaccatcgtggcgattttgattattgcgtggttgctcatgggtagtcagttactgttcaaaatcaacaatgccgttgtgggcttgttggtgctcgggacggtgttaatgctcgtaatggtatttatggcaccgacaactagtcagtcggtatcaacgactagtatgacgtttgggcaagcagtggaattgaacgttacgatggcactctcatggttgccactaattggtgattatacccagcgtgttgatcgtcctttaccagtcgcactagtcagcgcgggtggctatatgttaggcagtttagtgatgtttgtgacggggctattagttgtgttacggacagggcaaactgatatcacggcattgctgacgcggtccggtttaggattggttgcattgctgattattgttttctcaacggtgacgacgacatttttagatacttattcggccgccacgagtttggctaatctgaccgatagccgctatgttaatcgattagccgttggtgtgacggtagttgggctattgattgcgctgacggttgccatgacgtattatcagaacttcctgtatttgattggttcggtcttcacaccgctatatgctattatcttcgtcacgtactttgtgcggcacgctacgttaccatactggttgaacttttgctggtgggttgtggggattgtcgcctattatcagttacaggccattgatttcattggtggcacgacgctattagtattggttgggctgagcatcgccgtctggttgacgggaattatcgtcaaaccaaccgagctcgaatatcgcgagcttagtcattgacaattagatgtaaaaagtaaatgataatcccattggtaatacgcatgttaccgtgggatttttttgagagagggcgacagaatggttaaaccgataattggaatcgcaccaggcgttgtgacagtgaacagccagatgttcccggggcgggtccgtgattatgtgaatcgtgattatttgaaatcagtaacggataatggcggtgtgccattggtattaccggtaacgaccgacgcaacgacgattgaacgatacgttggaatgatcgatggtctactactttgtggtggtgcagatgtggccccattgacgtatggggaggaaccccagcctaaattgggtggggtagatccggaacgggatcagtatgaaattgcgctgattcgtgccacccacgccgttggtaaaccggtgctcggtatctgtcggggcttacaaatcttaaacgtgtgctatggtggcaatctttatcaggatatgagtgaactaccagctggtcagggtaccttaaaacatatgcaaggacaattggccgcttacggcatgcatcacgtgaaggtcgtaccaggtacgaccttggctgaatatttaggcaccactagtgacgcaatcacggtcaattcatttcatcatcaggccgtgaaacaagtggcaacgggctttcaggtggtggcccaaagtgcggatcaggttgttgaagcaattgaggcgacagctggtggtctacagttgggtgtccagtggcatccagaaatgatgcaacaagtaaactccgtgcaggcgcggttgtttgcggcgtttatgcgggcttgtgtggcgtagatagcattgactagcaaattgataaaattgggcgtggttattctgaattgtaggataaccacgtttttaatgtgcagccgcaaaactaatgaatgtttcgcgtgaaacatctgaaatggtgttggcaactagataactaatccaagatattgtaagctgacgtgtaaaacaattcgtaaagctgttaatactggcaacgctttcgtataatggaataaagttattgttaagggggtgaccgctatggaacgaattgaagctggcatgagcgtaatgacgttgaagaagcagacctatcgggttatcgctgtgattaatcaggggcaagaactgttagttcgcgcccacgaaccagaaacagctgacattgaaataattccagtgaccacagttgttcaagtaactgaacaaaattcaacaggcgatgcagccgtctcattggatacagtcacggtcgttggcgaacggtatgtcgatgatattgtggcaacgttaacgacgctcagagtgggtatggcggtgttgctccagcgagaaagtggcaatcaatacgatgataatgccatctcagtgtggacgttgcaacatgctaagttaggctacattgcccggtatcagaatcagccgtacgcggcactgatggatcagggacaacgattgtacggcatcgtgacggtattagatcaacaaaaacagcatcttgaattgatgctatggcggactactgcagtcccaagtccgattgaggcgttgcaaatccgccaacgattggctaagccgaggacaaatttaggggcggtgccaacgcattcgttacagacaccgttaggaacaattgtcatgatgtgcaatggtcacccgattaagtatcagcaggttccgttatcgccatggttgacgcccgctgatgaattacacgtcaccaaacgttatctattaacgcctgattggtcacaagtgccgccggacagcctcattacttgtcaagtgacggcgaaggccgacgtggttcagcggtggcaaaatgaacacatttcagcagcggtcttaacgaacgctagtagcttttatgtggttggtatcagtgctcaaaccaagacggggctgaatgataacttggtcgatgatgctgcgcaacccgcggttatttaccgagttggccaggttagtgcacatatgcaggccggcttcatggtcagctgggcgccgtttggtgatccgcgcgtacaaccagcactgaaattagcattgcacttctcctcacaaccgctagttccttaccatccagtaacacctagtcgcaccaacgcgacgtttacgcagcaagagttggcagccttgttagtctccgcattaccaaattatcagggtggtcaacgcttagaaccaagtgtgacagcgataacggtagaaaaattgcggcagacgttaggtgatcagacgtatcatgcgctggcgaattatcagcgtcatgttcagctagttgcgggtagtacggaaggtgtcaacgagaccttgttacaggcgttgattcatgcagtcacgtatcatgagttgacgaccatgcactactaccagccgactgtagggatggtcgaccaggttatttatccgattcaattatttagcaccacgactaaggatgaggatgatgcgcaattagtgggttgcttagcgctttacaattacgaaacatttgaaatccaacaggtgccgctgacggcaattgctcgtatcgcgattattgccgatccggagcatcccaagacaacaccggagacggaaagtccggattggttacgcatatttttacatgggtggaatgacgatttttgaacgaacagtcaaaaattaatttgcttacgacttataagtattcgtgatacaagccagattgaattcgataaaaaatcccgctgaggctttaaactcagtgggatttttggttaggttatttggttgccgaatgggtctgtaaatattcctgggcggcgtgaatcatatctgcattttgttgatttaacaatggcggcaagttgtcgaagtcaaagtagtcgagtttgagtgtttcatcagtggcttgggtcagaacgtggccgccaatgggttttacaagaaagagtgcactgattgtttgagctacatcgccgttaggataggccgtctcgcctttatcaaagatgccgatgcgatcaacaacttcgacatcaatgccactatcttccttatattcccgcacgcaggccgtggcatacgtctcaccgtattctagatagccaccgggtaaactccagttatgcgtatcggtacgaaggttcagcaagacttgttgctgatcgttgactaaaataccagcagccgtattcaaaatgattggtttgtgaccaaccaaagcccgaatttctttaatgtaatttgccatgatgaaacctcgtttctagtttaattacccttattataccgataattctgactgaaagctgtttgttgataaatttatacgaagcatgctcgaaccgcgttagagcaagtacatactgactatgtgtcactaaatccgtttgcgtcggtgcacttttttagctaagataaaagctatatactgtcagccgtgatagtgtgagttctttgattttatgaaaagagagtaatttatgcagagaaaattaagtacgggccagatgcaaatgattgcactgggcggcacgatcggagtgggcctatttatgggatccagctcaacgatcaagtggaccgggccgtcagtgctaattgcgtacatcgtatcaggggcctttctatacctgattatgcgggcactaggtgagatgctgtatgtcgatccgaataccggttcgtttgccaagtttgcttctgaatatattcaccccgtttttggatacttgacggcttggagcaacatttttcagttcgtcgttgttgggatgagtgagatgattgcactaggcggctactgccggtattggtggccgaacttgccagattggattccgggcctaattgccattgtattcttatgcgcggccaaccttatctcggttaaaatgtttgggacgctggaaacctggttctcacttattaaagtggtgacgattattctgatgattattgccggtttaggtctgattatttttggtattggtaacggcggtcatccaattggaatcagtaacctgtggacccatggtggtttcttcactggtggggtgaagggctttgtcttcgcactagcaattgtgttggcgtcgtatcaagggattgaattgattggagtcacagctggtgaagctgaaaatccacaaagcacgatcgttaaagcgattcgttcaacggttgcccggattttaatcttttacgtgggggccatcttcgtaattgtcagcatttacccctgggataagttaagccagattggttcaccgtttgtacagacatttgccaaaattgggattaccgctgcggcttcgattatcaacttcgtggttattacggcttccttatcgggaacaaattctggaatttatagtgcgagtcgaatgacttacacgttggcggaaagtcaccagttaccaaggaagatgactttattaaatcgtcatggagtaccattttattccgttattgcgattgcgaccgggattctaattggagtcgtcttgaatgttgtattaccaatgtttttcaaggacgctagcgagattttcgtgatggtttacagttcgagtgtcttgcccggtatggtaccgtggtttgttattctagtgagtcaaattgcgttccgtaagcaaaacgcggccaagatggcgaaccatccttttaaaatgccattatcaccctattcaaattatttaacgttggccttcctcgcgttaacactggtcttcatgtttattaatccggaaacgcgctactcaattttagtcggtgttgtatttctggtcatcatgacattgatttatttccgtaaatacgccggtaacaaggaagaaacgttgtaatcaagagtacttgccagtaaatggtaagtgcttttattttgggcttttattgcgttaaaattaggtgtcaatataattatcaggaaaagtggtggcacgatggtcaagcaaggacattatgcaaaagtcagtaaacagaaacggttacgacaattaaagcaacgacgtcaggcccaggagaagcgggcgattatgccagaaatggttagcgaatttttgcaagtgcgttaccacctgacgcaagcggcaaaacagcggccggcgatgcgacagatgatgcaacgttttatggcacagtggttagccgcagggcaagcagaattgagcgacaatggtcagacaacgtggtcagtagtggcattgacgaagcaaacgttacagacctttaatcggcagttaccgtggcaggggtatgccttagttgaccaggaaatggcacgctggacggcttttctgaacaaggaagtgccggctgtgccgttaagtgagcggattacgttaactgaggcactgtccccagcgacgtggcaggcctgcctatcagagcaattagcaatcaatgccctattagcattaactggtgattcacgacaattgggccaaataacgactgagcaagtacgacagctacaaaacagtattcaaacagcaacggggattgattgggaaaaggttgctcagttgcttgattcgacagtaattgcccagaatacactttccgaagctgggttggatgacaaaacgcgccaatggctagaaaaattacagaagctaacgccacaagattttaacagccatgttgaatgaacagtcaaaaaggaggatggtgaaatgcattttatcacgtcagatcacgttcagttagattatacggatgaaggccaggggcagccaatcgttattttgacgggatttggtggcgctaaggatatttggcgcgctcaaatcccggtactgattcaggcgggctaccgggtcattaatttagatgggcggtgccaaggtttatccgagcacacggcgaaaggcttacgtatgagtcgtcgcgcggtggatgcgcatgaattgattgaaaaattacaactcgaacaaccaattttactcggtaattcgatgggggccgcgacttggtttgcgtacgtgtcattgtatggtgatacaggaattaaggccctgatcgacgtggatcaaacgccgcggatgatcaatacaccgcactggcaatatgggttcaaacaggttcaatggcaggatattccggactattttagaatgccgctgggacactcgacgtttaagcacatcgatgatgcgacgtatgcgcgcgtcaaggcagtagaagcgcaggcaccgttcgatgcgaaattaatgtttccattgttggttaaccacgcggttcaggattggcgggatgtgatccgccaattgaccgtaccgttcttgatcattgcgggcgccaagtcaccgttcttcaatcccgactttgcggcagtgactgctcaaatggcactacgaggacagagtgtggtcattccggaagctggtcatatcgtgatggcggaacagtcggcagcatttaataaggcgttgttggaatttttggcgacgtgctaaacgcaaaacacttttaacacctgtattaaaggtgatattacagtcttgaatagtagtcatatcaagcaggtttagaataacataatgtattatgttgtcttgaataacggccacatcaaaaacagtttcacaatactaaaaaaggctcaccaactaaaacaggttggtgagccttttcgatttattgactaattactaatcaatcacgccatcttttcccatccatcggaaccgaataaacttcccgacctcggtcacaatcaagacgacgatcccacagataatcgggatgccccaaccataccagaagttgatgctagtcgtatggaagacggattgcatgaatggtaggtaaatgattcccagttgtaagagaatcagaataccaatgatgtagaacgccatcttattttggaagaagtacttggaaatgacggggtggtcattccgcaagttgaagaggtagaaaatcttaccaaagatgatgatgttcagtgacatggtactaccgacgacatttggtaatccaagtgcggtcaagtagttgtaggcgaagatccccaagccagaaattaggaaggagacatagccgatttcaaagtaatctaattttgacaacaacccagacttaacattccggggaccccgggccatgatgccggcctcgggtggctcaaagatgaacgcaaactggatggtcagcgcggacaccatattgatccacagtaattgcgtcgggtacagcggaagttcgtggcccattaaaatactaatgatgacaacgaggccttccgcgaaactagttgggagtaagaagcgaatcgtcttacgaatgttatcgaagacgtggcgcccttcacgaacggcggcgacgatatcagcaaagtcatcatcggccaggaccatatcggcggattccttagcaacttcggtccccttgattcccatagcaaccccaatatcggcttgcttgagggccggggcgtcgttgaccccatcgccagtcatcgaaacgacgtgattattggcctgttgggcacgaacaatccgtaatttgttattcggtgttgcccgtgcgaagacgttataatcatcgatgtgtgcttgtaactgctgatcgtccatcgcgtcgatttcgggaccagtaatcgctttgacattggcggccaagttcaacttgttggcaattgccatcgccgtatcagggtggtcccccgtaatcattttaacttgcacgcccgcttgccgtaattcggcgatcgcggtagccgcttcttcacgaggcgggtcaatgattccgactaagccagctaaatgcagcccaccaatggcttgtgcatcaatggtagtcacgtcatcatcgacttcttggtaagccagcgccaccacgcgcaaaccatcggcggttaagtcgtccatggcgtcatcccagtatgccgtttgggtagcttggtcagttaaacgcaggacagtcgcgggtgagcccttgaccattagtaagcgttgaccatctaagtcggccaggcgagcagaaaaacggaaggcggaatcgaatggtagcgagtcgacttcttcaacctcaggatcatgaccagtcattttacgatacagcgtcgtcaaggcaccatcggttggttcaccagtcagttcccagcgattattttcgaagtgtagctcggcgtcggtcgtttggccggcaatcttaacgagccattccatcgcgttatcttggtgccagtcgactttgttgccattgagcttgagatggccatcgaagttaacgccaccattatcatcataaccgacccccgtcacatcaaacgtatgctcaggcgtcacgaccttagtgaccgtcatttcatttttcgtcaacgtcccagtcttatcggtgttaacgatatctacggcacctaaagtttccacggcgggtagtgacttgacaatgacgtttttcttcgtcatctgccgggttcccatggctaagaccaccgaggtactagcgggcagtccttctggcatagaaccaactaccatcgtaataaccgcaattagtaaagttggcaaactataggtatccatgaccattcctaataggaataataggacggctgccaccacgatggcgatggataagccaacccccagtgagttcagattacgcatcagtggggtagtggtttgtttgacgtcgctaacagactgctggatatgaccgatttcggtatcttcggcggtagccgttacgattccgacggccgaaccgctagtcaccgcggttgacgcgtaaaccatattcttacggtcagccaaagctggcgtggtctcagtcatcggttcttcttgtttctccacgggattagtctcccctgtcagcacggattcttggacgttaaagttatccgctgaaatcaagcgcatatcggcaggaaccgcgtcaccggcttctaagttgactaagtcaccaacgactaattcgcgggcgtcaatttccagtttttttccatcacggatgacgaaattcttggaaatcagcatttcacgaatccgttctagcgcgttgccagcttggcgttcttggacataaccaatgatggcattggcaataataaccagtccaataacgatagaatcggaatagtggtgcatgaagaacgttaagaccgctgctgcggctaaaatgtagataatactgttattaaactgcttgatgaattgaacgaaccgagacgtacgcttggtctccagttcgttgcgaccgttatgttgtaaacgttcggcagcttcagcagtgctcaatccattctcaggatcggtggcgtactttgcggctaaggctgattcatcaagctgccataagttatccgcatcgggagggttctgggtgtcgttttgctcttcattagaggttaacgactgattgtcatcttttatcattcaattcgctccttaaaaataaagttattaccggtgaggttctgtaaaatcacgacgtttattgcgtgttaaataggccaatttcgccacatcctttcttaattagcgttattataaataatattatatacgaacaatctaggtgaacgccattaaaatatttgacaaattcatgacaaattattgcgttagttgcaataatatatcagattttggctagtttgtcgctgaaaatgactggttttcctcgaattgttgggtaaattgaactagagcactatgatccgcaacattggggtgcgggcggtgttcttgctgccattggactagctgtggaaagtttggccgcatattagcgaataaaaagaggctgtgacataactagcctctgtataagcaaatgggacgagaaaccgaattttggtttctcgtcccatttgcttacgcctttgatttttaaagttggtccctaccgtgaccagtttca

SEQ ID NO: 725 - DNA, 370879 bp, Unknown
  Metagenome-assembled genome
acgtggtgggcacagatttaagccgaagcccacgtcttaaatactggcctttcactaaccaagcacaagacgcttgctaagtgaaatttcaccactgggcattgtcagaaacgccttccagtcgggacagtgttcgaatggcagacggagatgtacccaacttttattggactcatcattgttcttcataaacagtaattttgtcgagcaactgtcaggcagaaaatgacattgtgatagcttactatttcggaatcaccatagtagtaatcgaacgtttcaacaaagtggttagggtaaccctaacgtctcgtttaaagttcctgtatcaaaatagtcaacgataaattgtgctaagttaagtggccgttcatcagccattcgagcggcttcccgaaacgtgttcggtgccactaaagcctgtgcttgctacgccaacggactaatgccaaaaccgcattaatccgttggctaggcaatgctcggcttcaactcgtggccccgcacactcttgagactggagggactgggtgacaatgctcagtagccaaattattcttagtcggaagtgatttccttccggcttagaataagactcgtatttgagatgacgcgggttgggcgttagctcaaatcgatgtcggcttacgttacagcaattgtcacccagccccggaggtcggaataggacgatcattgctgacgaacagaaatccacctaatcggcacgttttaatcatgaaaagcaacaaacacagtgcggattatcggatagataagaatggcagtgatggattcaaggaaaatagtgctgaactaaaaacgtcgtgactgacttcagtcgcggcgtttttgactagaaatttagtttagttggtacttgattgggcgtcgattggggtgtgcttgaatagttgggctgctttgacggcggcttgccagccttggtaaaggttcgcacgttggggcgcggccattcggggttggaagacattgccggtttggtggattgatttgagttcgtccaaatcttgccagtatcccacggctaggccggctaagaatgcagcaccgagtgcggtcgtttcgaggtcagcggcccggatgatcttgacgtttgagatgtcggcttgaaattgcatcagccagttgttgcgggctgccccgccgtcgaccatgagtgtgggcatggtgatgttggcgtcgtttttcatcgtatcaatgacgtcgcgggactggtaggccagtgactgtagtgtggctttaacaaaatcagcccgggtggtcccgcgggttaagccaaagacggctccacgggtctcggaatcccagtaaggtgcgcccaatccggtaaaggcgggaactacgtaaacttcgttgtgattatgggactgttgagcaagactttcggattctggtgctgattcgatcagttgcatgccatcgcgtaaccattgcagggccgaacccgctacgaagatggagccttcaagcgcgtaattgatgttgccatcaagcccgtaagcgatggtcgttaaaaggttgtggtcggataattgcggttgctcgcccagattcatgacggtaaaggcaccggttccataagtatttttgaccatgccaggttcaaaggccatctgaccaaatagtgcggcttgttggtcgccggccatcccgctgattggaatttggctaccataaagcaagtagtccttagtcgtgccatagatctcagagttggaccgtacttctgggagcatcgcagcaggaatgttcagtaggttcagaatcgtttggtcccattgtaagtcgtgaatgttgaataacatggtgcgactggcgttggtgtagtcggtgacgtgggtctcgccaccagtcaatttccagacgagccaagtatcaatagtcccgaaaagaagttcgccgcgttccgcgcgcttttgggcaccatcaacgtggtctaagatccagcgaattttcgttgctgagaagtaggcgtcggtcactaggccggtgtgccggtgaatcagatcgcccataccatcagcgatgagttgctcagctaacggtgcagtttgccgggactgccaaacaatggcgttataaatgggtagaccggtttgcttgtcccagacaacggtagtctcacgttgattggtgatcccgatggcttcgatttgattaggtttaatattagcgtcaattaagacgttagcgatcgttgaggaaaccgcgttccagatttcagtagcgtcgtgttcgacccaccccggttgcggaaagtattgtggaaactccttttgggcgtcggcaactttttgaccggcgtgattaaaaataatggtgcgggtactcgtggtcccctcgtcaatggccatgatatatttggctgacataacttgttcctccgaagattgtaatcaataacatcatctttgatgctagcatggatagttggacttgtgaataaatataaaaaacttaatatataaactggcatcccatgaagtatcgagaattaatcatcgtacccataccaattcgctgaaataaggaaagggttaccatgcttgttttgataatattacttttgtacaacggttagtaacggcgttgaactaagattaatgaatatttgaaatgtagaccaatcggcatataatggggactcaaatcggtgtgaaatggaggattcctagtatgcaaaaacgacgcttttttcttaaaggctctgctgccgaggttgcttggctcaatcggcaggcggcgtggggctatcaattgacggcgattcacggtctgagttatcagtttaaagaagtcccacaagcacgccagctgattgccgaatacatgccacagacgacgttacaagttatgacgacggtcttccaaccacttactagttatacgtttcatgatgatatggcggtggtttattcaactgtggcccctaaacaacgagtggtcaacaatgatcaacaataccgcttagcagtgtatcgacatgctcgcgatgtcgccttgaactggctcaatggctgggtattggtagtctggctcatgatgagtgcgacgattgtgattagctcgcaattgcaagcaacgccactattaacccggttgttattacttgggttggcacttggtgcgggggtgatggtggcaggtattatcgttggtgttcggacagcgattcgttgtcaccgggaagtgtgtcgcttgatccgtatcacaggagacgatcacgagacgtggaagccgacttttcacgtgttgtttaagcatcaacacgccgctcccgatacgacttgctgggatgatttaggtagctggcaactggcactgcataatcagcgtggggattactactttgagttaaaaacgacattgagtgaattagaaatcactaatacactggcacaacgcttttcaaaacaggacttttccgtggtatcgtggttaggtttgtacgttgtttgaggtggatatcatattaattatgtgaatttagtgtgacttttttttaaaaggacttgttttttatcataaaagcgtgtataaatacagacataatcattgcccggtagttcagcggtagaataattgactgttaatcaagaggtcgctggttcgatcccagcccgggcagttggtcatgtttagttaagtagcggtatctcgtgaggtaccgcttttgtcggcacaagtacagaatagcgctggcatttgatgggtaattggctggcagaactttagaaataattaactaaaaaagttctgacaaaccttgactattcttgactaaaaccgtatacttactatattaaagtaagtggtgtaaagtcacttgctgaaacttaggaggaattcatcgtgacagtaaacttatattattcaacgtccagcaagtctagtcgtagtgcacgagcatggttagttgagaataacattccatttaatgaacgcgacattattgctaatcctctggatcgcgatgaattgaaacaaatcctccggctcactgaaaatggcttcgaggacatcgtttcaacgcgttctaaggctttcaaagcattacacattgatttgtcggacttaggcttcaatcagttattggacctattagttgaaaaaccacaattactcaagcggccaatcatttatgatggtcggcggttacaaatcggttataacgaagaggacattcgggcatttttgccacgttcggtacgtaagtctgaattacgtgaaattcaacaaaaactttatgacgatgatcaacaagcagttggttaatcggatttagcgtttgagacgaaagcggcccatcaagaattgtgttgatattcttgatggggcgtttttttgtcgaaagaacaatatcagccagccaccagggcgcgttaggttgcgtgtcttcttaacagcgtatcgcagtgtagggcgttattttacttgccgattaccgcccgttacctttgctgagtaagcagattccttggtataatcagttggtttgtgtacaatgtaaaaaggcttaaaggaaacggagattttaacataatgagtgaacaagaccaggctgcctgggcgatccaggcactcgccgctttgaagacggctgataatcaagttgttgtggagagtatcattaaggtcatcgatgaccaacaggctgagattgagagtctacggggttcaatggaaggccaattatggagtccaactagctggcatcaagatcagcaagcgcaacgtgccgcgcatgaggacaagtccacaactaaccattaaaattgagaagacgccacaaaagacggttgttagactattattggtctaacaaccgtctttttgtcactgcgtttgtgaatttaagttgagcgccatgccgtgatttacggcgcagtcgagcattaagcagccagcaagggggtgcaagcttcaggatacagttgtgatcagtaatccgtgacgcttgtcttgcggtgctgggccacaaattggaaggtagctgccacgagtccgccaatcaggatacccgttgcgttggcaatgacgtcgttgatatcgctactgcgattgatcagccaatgttgtgacatgaaatattgcagactttcaatgctggcacccactaacaagcccgttaatccgaggcccaatagtgggtagtgatgaaagtggcgtttaattccccagcctaagggaatcgtcagaatgatattttcgataaagcccagcccgtgaagatacaaccgtgataggttcacttggccgacaccagctggcatcacgtagatggcagttccgtcgaatgacagcggggtaaacaaaatcacactaaggccaaataagtaacctaagccgagtagctgccgcgtccgggcttgtggctggcgaacgtggacaagaatcaccaaacaacttagtgttgcaactattaaaataattctgaacggttcccaacgcatgcacaccactcctcggtttggattaactgtatcttaccgtaaactcagtggtcagaagtaaagaagacgtgaagcttaatgaagcctttaacggcttaaccaaatcccaagtaaatcagtggttagatgaccgtgattgatgttggtcgtcagccatattcgcaattggtttcgtagtcagcgctaaagcagctacaatcataatgataattagactgaaccagagtgcgatctgggtgccgagggtggtttgcatcgtactcgaagcactcggtgccatgcgggtgcccaatgtaatcaagacggccataatggcggtaccgagcgaaccagaatactgttgtagggtgttgaaaagcgcgttgccatcgcccattagttggggcggcaattgttgtaaaccatacgtcagggcattgttaaataagcaactgaacccaatttgaaagccaacaaataagccaatgatcaagccgaccgagagatgctgggctaaccctgcgagacttagtgttgccaacagtaaaaagccactaccaatttggaatggtcgccgaatgccgcgacggtccatcaatttaccagccaaaggtgatagtattgctgaacataagcttcctgctaatagcattaagcccgacactaacgcatttttacccaaagcgagttgtgcaaaattagggagcagaaaggtcagtccaatctgaatgaattgaatgaagaagtaaatgagaagcgcccgggtaaagtcaccctgttggaagacggccaggttgattagtgggtgcgtggttcgggttgccgaacgggtaaaagtcagtacggcgagtaccgctaataacagtggtaaccagacgaatactaagcttaagccatgtgtactaaggttattgacgctaaaaatcagcaggatgagtgccgcgacgactagcccgaattggcataaggggaacggacgtgaccgtggtgcctgcgtttggcgaatagttttggccgttatcagccaagcaatcagaccaaacggtagggtaatgccgaaaattaagcgccaggataatagttgtgtcactaagccgccatatgttggtccgagtgaaggggccaatgcgatcaacattccagcggtccccgtaaaacgaccctgagcagtgaaagggaccagggtcatgatttgcgcaaatactaatggtaatgccaatccagttccgatggcttgaatgattcgaccgaatagtagtaaccagagctgtggcgcgactgtacataataaaccgccaagaacgaaaccagccccgccaacgttaataattgtccgccaacggaagcgttgttgaataaacgccgtaataaccatggtagcggctacggcgagtaaataggcagtggtgacccattgaaccgttgctagagtggtgtggaattggtgcatcaaggtcggaaaggtaacgttcattgatgtttcaactaaaataccgcaaaaagccagactggcggtgccaaaaattgcaaccttcgtttgggttgggatgacaggtgttgttgtagacaaaataaaacctccattgatcaaggccagctcgtttcgtatgtgaaacgacgcttttcttgaccaacggagattccgttgtaaagatatacaagcatcaaagacgaccttgatgaatttattaatgttttaatcctagcatactactgataaaaatgtcagtccgatttttttattcgctgactttagcgctttgttcagctaaagcagtcaggtgctcgaataggatgccttcacgcagtccattttgagagaaaatcatccggtcagaatctaaaaagcgcatcagactaatggcaggaatcatcccaccaacaataatatcagcccggtcctttgctaatccaggaatagccgcgcgaccagctgcatcctggctaatgacagtattgaatgtgtcatagatggcgttgtcacgtagccgataaccgtgaatatcttcaaagttgaggatattgcatttgcgccggttaattttggctaacgttcggttgctaccacccaaacagacgagtggtaagttgagaccgtttcgcaaccaccagacgctattaaaaattttatcaacgaaagtcatcgttttaaataattgactagcggtaacttggtcgttgaggccgaacttttcggataaactgaccgcgccgattggcagactgattaggtccttggcttggccgtttacgataaggacgagttcgcagctaccgccaccagtatcgaccatgacgcagttagtcgttggaagcgtattgactacccctaagtaatcgtaataggcctcggttgttccaggaatcacttcgatatctaggccaacatcatttttaacgcgtttgagaaatttcttttggttgctggcctttcgcgttgcggcggtcgccacggccttgatagttaagttaggtaagtctttgtagacggcagcaaatgactttagcgctgcaatcgtgcggtcaatggcctcggcttgaagggtcggcgtatccgtggcgttttcattctcggataaacgcaccatttccttgagtcggtgagtgaccgcataactaccgtcttcctgaatctgtgtaattgtcattcgacatgaattggaacctaagtcaatgaccgcaaagttttccatcgctaatcatcctctctatcaagatctgaagcatccggctcattcttgggactcatcatcggaatgaactggtgcgcgttgctagtgggcgtagtatcgccgtgatcagccttgactgcttgctcggcttcgcgaatgaattcggcctgggagtccaaaacctctaagccgcgcccatccacacgggcgtacgtattatctggttgcaaaatgcgcgttttgaccgtgtcagcccacattgtttcaaaaattgtcatcgcacggtgactgatttcaggttggagtagtgggaacaataattcgacccggcgatttaggttacgggtcatcatatccgcactggataagtaaatttgtggttcaccgtcgttgctaaagtagtatatacgactgtgctccagaaggcgaccaatgatcgagtggacctcgatgttatccgagatacctttgatgcctgttcgtaaacaacaaattccccgaatgatcagttggatcttaacaccggcgtgagaagcttcgtagagtttactaataatctgcggatcggataatgagttcatcttcattttgacaactgcgggctgaccagctttggcaatggcaatctcatcgtctagcttttcgttgataaagtcgcggatgccatctggtgagatgtgcaatttgtggaaatacggtggttcagaatagccagataacatgttaaagatgttggaagcatcgattcccatgtctgtatcagcggtgaagagccccatgtccgtgtagaaatgggcggtgacatcgttataattcccagttcccatgtgcatgtagcgcttgataccttcgttttctcgccgaacaacgagggcaagcttacagtgtgtcttaagcccgatcagaccgtagatcacgtgacaacccatttcttcaagctttttcgcccagtgaacgttattttcttcatcaaaacgggccttaacttcaacgagaacggttacttgtttgccgttttgggcagcctgcccgagatacttgataatcggtgaatcagctgatacgcgatacagcgtcatcttaatggctaacacgtcctcatcttctgcagcttcatggataaagtccacaacgggtttgaaatcatcgtacggatattgcattaaaatgtcgtgatccttgataagatcaaagatggatcgttcgcggtacttcgcgggatagtaggcgtggtattttggataattcaagtcttcgtggccctgcacagctttcaccagcttggataagaaggtcaagttgaggggaccgttgatgacgtataacgcactttcgttaatcccaagggctttagcgagtcgcgtacgttgatgtttgctcatactcttttcgacttctaagcgcatgaccttaccgcgttcacgcatctttaattgtttttgaacttcctttaataagtccgaggtatcctcttcggcgacatctaagtccaaatcccgcatgacgcggtaacagctcgtttccttgaccgtgtagttgataaatagtgagccgacaaaggctttgataatttcctcaatcagaataaactggttcggtgcgcctggcaaaacgaccacgcgaggaaagacgtccggcacttgaacggtggcaaacttgcggtccttcttatccccatttttataaatccgtaaggcgatgttgagtgtattattcccaatgaacgggaatgggcgtgaagagtcgtctgccatcggtgttaaagccgggtacagctcatcatcaaagtagttcttaacaaaggcgtgttgttcctcgtttagatcagccatcgacaagagatgaatcgcgtgctgttccagcaatggcaaaagcgagcggtttaatgtattgtattgacgcttgaccatctcgtgggctttatcactgattgcactgacttgatcagcagcggtcagtcccgcgggatccggtttagtgtaattgactgacatcaatttacgtaatgatgcgacccggaccgtgaagaattcgtcaagattactctgtgtgatcccgagaaaacggacacgttctagcaaggggttatccttatcacgtgcttcatcaaggacacgatagttaaaatcaagccagctgagttcacggtttgtataataactttctttataataattcatttaacgtaccccccgtagtttaatcactggtgttaaaccaaagacttctttaaagaattccgctttttgtgcgaatacccaattttctaagaagaggtcatcatgagcaaagcaagtaatgatgacccgtggattgcgaattgaaacggaaattttatcaattttttgtttgcgaccgtcatccaaagcgtccgcaattctcaagatggcggatagtttggagactaataagcgttgttcgacttgtaagtgtccaaaatggcgaatgtcttttgatggtgtttgcgcgctatggtagcgtgaaatcagggcgaccattcgtttttcggtatcggttaatcccatgagttcagtggcctgcaagatatagtccgaatgtaagtaatgttggtgtggatcgatataactcccaacgtcgtgcacgatagccgctacttgtaagagtagccgctcccgtttacctaagtggtgtagcggtttgagctggtcgaataggtgcaatgagaatttggtaaccaaatcgcgatgtttgggttcaacgttgtaccggtccgcaatgttcttagctgctgttacgatttgatcattaaagttatatttcttatagcccaacttaatggcttcttgaataattaacccatccagcacggtcacgttgccaagccagattttctcagcattagtgagttgtagtaactcgttaataagtagtaattcgggcacgattaggcgcacgtcttcttcatcaacttcgtatttatccattaaatactggtcagaagcgttcaacacgtcctcatataaagcttgaaaatctgctttgctgagttcctccacgccagcttttgattgttgttggcgaaagagggtggcaaacggcgcgacgccgagcatgacgacgttactaggttgatctcttcgcccgggcaagaagcggccaaagtcaacgatttgactcgaaatataatcatccaaaacttcgacatagttaggcacgctcgattgcaagtcttcaagaacttccgcgattcgaactggtcctaaacggagactacgggagaagacaaagttactctgatcgtagtgcgaaataccgacactaccagagttgattcctaataagtaggtcggcttcgtgatcatttgcttgaatcgtggaaagtgtaccgcaactgcgactgaacgcaggtaggtttcctgactactagataaccagtcgatcttgagcccagtccggacaagtaattggtcttgaatatagtcggcattgttagcggatgacaaggaccacgacccccataaatggtagtccttaacgccgtaatcgttcatgatctgaacaaaaccactcagtgcctgtgcggcttgttccactgaatcataatcgatcgtatgctgatcataaatatcctcaccaagtgaaacgtcggaacgaactcgttctacttggcgtaatgtgcgtaaattgacaatcgacaattcaatactctgaacgttaatcatcataattccaaataattttgctgccatggcgatcccccatttttatgatttcctgacccccaataaggttaaagtcatgtatttaatttaagtttaacacaggttggggttagttaaattagtattttagtagtgaaacagttagcgattacttttagtttttatacgaaagttaagcgtaattaaggccatcattaactttgtatgaatcttactagttaggtggttgatgtgatgattaccccggtttcagcggtagcgaacgctaacctaacttggcacgtttgatccaagataccaaaaaggcgtggctcagccgtaacgagtatgcctgaaccacgctagttgatattataagatttcgtgattatcgataattagtttgttcagatgtttttcaactcgtttatcagctggtggcagctgcatgtaatcaccatacatccgggtcaaaatggtgtcatacgcactgggaatcttcacttggatatcttcgaatggaacggtcgttagctcggtcaattcctgataggtcataatttccttttcgtaatcgtattgagacgccagatttttgtaagttcgggagtctgactgctcgtacaggcgcatgtattcctcacgttccagcttatagcgattgacttcagctaattgctgaggtgtgtgtttcgtaatcaagttacgcagtggtgttttgacaaagcggtaattcaatttgagcaggatcgcagcgtctgctaatttgtaatgtaacatctgtgaacgacgtaaggcttcgtcatctggaatcttatcaaacggaaagatgtcaacgaacacgcctttaaacgcattattgacgttgttgcgttcttcaatgtaagtatttacgtctaatagcttcatataactgagtgcatagtccggatctgaggcaccggtttgtaggaaaaatttgtttggatcaagatggtggttggcgacggcgataaagcgctggtagtcatgacggcgcattccaatgtcgatgtcatcgtcccacggaataaatccgtgatgacgaatagcaccgagtaaagaaccaccgatcaaaaagtaatcgatattttcagcctcacagattgcgatgacggtacgcatcaagcgcaattcaacttgatgtaagggtgtcaggggcatggtctcgtctcctttttacgtaagcgtttcaactactttcatcatacactttgttgcacaaaattgttagggaggatgcttaacgttggaatttacgggtaatttcatgcaaaacagttaaaggcgtgttatatttggtcaaaagttaatgaagtgatggtgatcgcgatgaacagtgacgaattaagcaaacttctcaatgattattttgaagcatatcaaaatacaaccaaaattatgatggacttagtggcttggcctttaagtcaaaataaactgtcatttgaacaatttttaatattgcggcgcattgccacgactgatgaagtgacactcaatgatattgcaattcagcgacaagtaacgcgaagcgcgatttcacggcaagtcaaatcattgttaatgcaacactatgtttttcaggtgccagatccgcgtgatcggcggcggctctacttacatttaacagaacggggacaacaagtcgaacggattgtcgaccaagccattacccagcactttgatcactgggtcaaccagttgggcgcaccacagattgatcaagtgctcaagatgatggggacctttagccagcaggtcacggacctcggtgagccacagtcacaccccgttctacactaggatgtacatgggactaaccactaaattagtattgatgagcaactattttggtcgctagtcaaaaacagacttcttaggaattgtcacaattcttaagaagtctgttttgttacgaatacccattgaataaaaacacttgtactaaagtagggtcgtttcatagaaagtaagcactcaaatgggcgtacttgcttcactgtgatacgtgtagcgctcaatgcttgaagaagttatggtaaaccccttcgcaagcttcaagaaacatcccaatagccattaagtacatggctaacatgttctgcattgtgaagaccaagtagagtaggacggcgtagaggattaaaaagaagattgccgtaattttggaaccagccatttaaatcacacctttgtatggagaatcgtgacgcgttgtttgcctgagggtcgtgaggaccaagagcggttttaaggcaatgaacacgctttatcaatttcattctaccgcaggctcattaaaattgaaaatcgcaattaaatagattcaaaattatttagcgttcggttattgcttttaaataaacaaaatgatacgattaaatacgttaaaagaacgctaaaacacgaacgtttacaattgtgcaattgtaatttaggcgaatatttggagggaatcatgaataaaattgcggcatattttaatttttcagaattgaaaacgtcaatgcgaaccgaagtgctggctggcttgaccacgtttgtttcgatggcatacatcctatttgttaatccgagcgtcctcggggcttcggggatggataagggcgccgtcttcaccgcgacggccttagcgtcagcgttaggctgtttattgatggggttagttgctaagtacccgatagcaattgcaccaggattaggcgttaacgcgttctttacttattccgtagttatcggaatgggcattaaatggcaaactgctctggctggggtgttcgttgcagccgtgatttttatcttgattacgatttttaagctccgggaaatgattattgatgcgattccgcgggatatgaagttagcaatttcggcggggatcgggttcttcattgcttttattggtcttcatggtggtggcttaattgttgccaacaaatcaacggttgttggtctgggatcattgacagttggaacgacctggttaactatttttggattgatcgtcacgttgattttgatgagtcgcaaagttcccggtgggatttttatcgggatggttttaacctccattttagggctagcaactggcttgattaagatgccatccacaattgtttcggcagcaccttcgttgaaaccaacgtttggtgtagcgcttggtcatattggtgatattaattcgttacaattgattattgttgttttgacgttcttattagtgacattcttcgatacggccggaacgctagttggattggcagaacaggctggattcatgaaaaataataaaatgccgcgggttggtaaagcgttgatggccgattcaacttcgatgttagttgggtcagtgttgggaacctcaccaacttcagcttatgttgaatcttcggccggaattgcggtcggtggtcgctctgggatgagtgcagttgttacaggtgcgctattcattcttggattatttttctcaccgttattaaacgtcgtgacggatcaagttactgcacctgcattgattattgtgggtgtgttgatggcagaatctttaaaacagatcagttgggaacggtttgaaattgccgtacccgcatttctaactgttatcgggatgccgttgacttatagtatttctgatgggattgctttaggcttcattgcatacgtcattacgatggtcgcaactaagcatgccaaggaagttcatccattaatgtacgtgctgttcttcatcttcattatcttcttgtggatattaaatgtctgacagttaaaggtggtcagctcgacgttattggctagttacagataatttaaatgacttaattctaaacggactactgacgcacatgacgttggtagtcttttttttgacgcgaaataggctaaaacttgatgagcgtcaagttggtttgctttggaggtgactatactagagtcattcaagtgatagaagggggaggtgaagcaatcagaaagttaggataaacattgaaatgtaagcgccgtcatcaaaaactatcttgaaactagctcatgagcagtcaatcggccgagatttgctaagcggggcaagcgtaacgagtggggatgtacccgtaccaattcgatttaataagacaaatacacaattagtacggtggttaaggtggtataccggtgtcgaaaataatacaaaatataaaaatacaaaaaaatacgtttttttttaaaaaattaaaaacgctccatagcccgtcgttaacgcttgtaaaccatagaaagtttcgcaaaatttctaatgatagataaaatctatcgataaaagcgtttacattttaaaaaatcgtgattacaataaagtcgtaaagttgataattaaaatatatcagaggaggacattactaatggctaaaattagtggttcagatgccgtattaaaagtaattcagaagtggggcgtaaaacatatttatggtttgcccggtgggtcgttcgattcaacgatgaacgccatctataatcaacgggaaacgttgaagtacatccaagtacgtcacgaagaagctggtgcgattgccgcttccgctgattataagctaactggaaagatcggcgtctgctttggttccgctggccctggtgctgtccacttactgaacggattgtacgatgctaaggaagatggtattccaatgttagcaatcgttgcacaagttcctactaagcggatgaacatggacttcttccaagcaatgaatgaagaaccgatttttgacgatgtggctgtttggaatcggactgcgatgactgctgagagtttaccgatgatgactgatgaagccattcgtcaagcgtatgcccacaatggtgtagctgtcttaacgatccctaaggactttggttgggctgaaattgaagacaactttgaaacgaacgctagcgtgcacactgttaactatcctgcaccaaccgctgaatcagttgctgatgcggttaaattaatcaaagctgctaagtcaccaatgatttactttggcgttggcgctaaggacgcggctgaagaattaaaagctgcttctgaaaagtttaagatgccacttgtctcttcagtattagcgaaggggatcattgaagacgattatcccgcttacttaggttccacgggacgagtcgcacctaagccgggtgccgagattggctttagtacggatctaatcctctgggtcggtaacaatgtcccatttagtatcttcttatttaataagaaggctaaggtcattcaaatcgatattgatagtgaaaaatttggtaagcgccaccatacgaacgttgctattcaggcggatgcgaaaaaagctttagcggcgatcaatgcagctggtgaagcgcgcgatgattcagccttttatgacgctgcggttgctgataaaaagaactgggacaaatggcaagccagcttcaacgatagcactgaatcaccagttcgccccgaaccaatctttgatgtcttgaaccaagaagctagtgacaaagctgtttgggctatcgatgtcggcaatgttaatattaactttgaacgcttgatccgaatgcacgatgaccagaaatgggcaacttctgggatttatgcaacaatgggctttggggttcctgctgcactggctgctaaagtcaactacccagatcgggacgtctacagtttgagcggtgacggcgctttcgcaatgctgtcagaagaaatcttggcacaagttaagtataacttgcacattatcaacattgtcttcagtaatgagaccttaggctttattgaagctgaacagactgatgatagccatcaaccactctctggtgtcgatttgccagatactgattgggccaaggttggcgaaggctatggtgccgttggttataccgttcggaccaaggctgaattcaagcaagcccttgaagacgctaagaagacggataagccagttgtcattgatgtgaagttaacgcatgcaatgccatttacaacggaacatatgtatctcgatgacgcatggcaagataaagacaagattgctgaatttgtcaagaagtatgatgctcaagcgttgaagccgttcagctacttcttaaaacaagctcaaacaaactaatttggatagataattaacgaaagaggacgcgattatcgcggctcttttggtacatagtattaagtgtcgcttgccattgtggcggtgacaacataccaagctgtagagaacactacgtgaacgttcgggaggtcgcacagatgcaagtaatcaatttagatgcccatcgattaaagatgctggcaccacaaccgccactggtattagctttaggtttctttgatggtgtgcatcagggccaccaacgcgtgattcaaacagcgaaacgaattgcgaagcagcgtgatttaccactcgctgtgatgacgttcaatcgacacgcgtcacaactgtttaagtcccagaccacttttcggtatctgaataccgtcgcgcaaaaaagccaacatatggcggcgctacaggtggaccgactatatattacggattttaaccaccaatttgctggcttgacaccgactgcgtttattaaggattaccttgtcgggttgaatgcgcaagtcgttgtggcggggtttgactatacgttcgggcagggtggcgcaaatgggatgcgcgaactcgcggaattgggcgccccgtactttgaaacggtcacggtggatcgcttggctaatcagcagcttaaagtcagttctactcggatccgggggctgattgctcgggggcagattgaacaagctaatgatttattggggtacacttacgcgacacaggcgacattcgatccgttgactagaacgatccaacttgcaaatcggcaacagcagttaccagcggccggtgattatcgttgttggttagttagcgctaattatcgacaggcagtcattctgcgagtcaccacgacattaaaaattatttcgccataccagttgccaccggaaaccacggtattagatgtggacgttcagtggcagcagcgtgctttgcaagtggtcagttctgtctcagcccagcatcaacaatcacaatatagtaaagcttaatgtagaccaccctgatctgtttgatggggtggtttttgattgtcgttaagtcggtaagttattcgtgctagaccgttagcgatatttgataaaactgagtatcgggtgtgtgcttgatcctatttttctagtccatagatagtttcacatgaaataatcggataaacacaaaattggcgctgaatggtgccccgttttgtgtacttgtaatttcacttacgaaaagtaagcatattaattgcatttataattgaaagcgatttataatacgttttttaaatgaattgaaccaagcagacaaattggttctaagtcgaagggatgaatagtgatgacaaagatgattgcaggacaagctttagttaaggttttagaggcgtggggtgtggaccacatctacgggattcccggcggttcaatcaatcataccgttgaaggtttgtaccttgaaaaggccgatattgattatattcaagtacggcatgaagaagtgggggccttagcagcctcggcagatgccaagtttacgggcaaaatcggcgtttcatttggttctgcgggtcctggtgcaacgcacttattcaacggtttatatgatgccaagatggatcacgttcctgtattagcacttgtcggacaggtaccacaagcgacgatgaacacgaattacttccaagaaatggatgagaccccaatgtttagtgacgtggcggtatataaccgcactgtcacgacggccggacaattaccatatgtcattaaccaagcgattcgtgaagcataccggcaaaagggaccggcagtcgttatcattcctgaaaatctctcagcggaagaaatcgattatcagccggtatcgacgcctaacaccgtttcagatacgtttgaacaacgggtcgatcctcaggccattacggcaacgttaaagatgctaaaagcagctaagcatccattagtttacgctggtcggggtcttcttggtgctaaggcagacctggtcaagtttagtgaacaattcaatattccagtcatgaatacggtcccggcgacgggggttattccaacgagccacccgaatgcaattggcacgtttggccggttgggttccaaatcggggttcgaagcactccaacacgctgatttgattttgttcctgggatctgaatttccatttgctagtttttggcctaaggggattaagattattcaggtcaacaataacagttttgatatcggcaagatggtcccaatcgattacgccgtcatcagtgacgcccaagcttatttgcaagcgatgattgcaactggcgaaacgttacctgaaacagcgtggttaacgactaaccggcaaaataaacgtaattgggataagtggctccaacaattggctgctgacgaccatgatggactagcgccggaagcggtcatgcacaaagttgctagtatggtcggccctcgtgatacctacggggtcgacaccggtaacgtctccgaatgggctgtccgggggctcccaatggatcaggagcaacgctttgccttatctggcctcttcgcaaccatgggatttggactacctgctgggatggctggtgccttaagtgttccagacagccaagcgtggagtttctcaggcgatggtggctttgcgatggtagcgccagatattatcacggaagcacgttacggcttgcccgttattaacgtgattttcagtaatcaacggtttggtttcatctatcgtgagcaagttgatacgaagcaacacttgtatggtgttgatctaacggatgccgactgggccaaagttgcagatggccttggtgggattggttttactgttcaaaataatcaagaggtcgaaaccgtctttgaccaaatcaaggcgctccaagcgaagggcaacaagcggccaatcgttgtgaacgcggtcatcaagaatgatgatccaattggcacagcttacatgccactagatcctgaattatatggtcaagcagaagttgacgcttatgccaaagccaaccacattgatattaaggaacagccatcattaggcgccttactacgagcacagggtgatcagctatagttaaagcctgaagggctagttagaccactgggcaaagcttcagttaacctaatattattaaaaagccgccagtatcgggtatgacctgatactggcggcttcttaattgttcagttaggatttatttttgattaaagctgccatcttccacgtcacgaatgaattgtttcaaatggtcaaagtagacgggggcgttgtcgatcatgtggtgatgaccaccatttggcgtcgttactaagcgtgagttaggaatatcacgagccatgcggcgggccgaagctaatggcattgtttcgtgttcaccgaaagttaacagggtcggcactttaatgttgtgaatctgatcgcgaatatcccattcctttaacttcccagtgataacgaattcattatcaccttgaaaggcgttgtatacaggagtggcagtggtgttgatcaaatggcgaattgaagtgggttgtttgcggtcaacatagccagcgttcagaacgtccacgtacttctgatattggggatcattccagttgccttccgcttccttttgcttcatgtaagcaacagcgtcagccggtagggcttcttcacgacacttgttaacgttgacaacgtattcctcaatgttatcgaccatacttgaaataatggcgccttttaagtgttgaccatacttgagcgcgtacatcattgtgagggcaccgccccaagactgaccaatcaagtagaagttatcgagtcctagtttttgtcggacttcttcaacttcatctaagaagtagtcgtaggtgagatatttcttagcaatttcaggatctgagtagtcgggttgatccgaataccaggatcctaattggtcgtacattgaaacttggacgcctaaatctgccagttcctcaccaaagttttcccaatattcgtgattgccaccagggccaccgtgtagacataataattgaatgtcgcctttgccctgagtattcgtccataaatggtagccattatccagcgtgatgattgtcgttccttgtttcaaatgatcacctaatttcttcatattttaattgttatcttaccactgttaactaagcagggtcaaagagactaggcaatcataaagaattgcattaagtagataattggtaaggtcgtgttcactaattaactgaatcagtacgttaacgtcatagtagctgagtatgggaggggacttcggtcgaaacgatataaaaataataattagaacgggccgtttagtttgaatttggtttatactagttattatgctggtcggtacgactgatagaccaagtttcagtcgtattgtgaccgattgtacacaattgatttgacaagcggttacattttcagcgataataagtaaactgctcagcacagaaagatgtaatattacattctttaaattcaattgcggttagttaaccaatatgaaataatgggttaactaattagagatgggtgagattgatatggcaaatcaagtcgcagttttacgcttgttaatccaagcggcgcccgcgtactgttcgggtgactggttggcacaacgacttgcaatcagtcgaacggctatttggaaattagtgcaaggattgcaagcggcgggccatactattgagagccggcatgggcgaggttatcggtatgtggccaataatcaattgagtgcgccggtgattgaatacgcgcttacagcgttaccaccgtttgatttgaccgtgctaccaacggttgattcaacgaatgcctatttacggcggttagtcacgcagacgcctttagcacttccgaaaatcgtggttgcggatacgcaaactgctggttacggtcggtcggggcgggcattttattcgccagcacagactggaatttacatgagcattgggttaccactcagtgaccagaaggcgttagacgctggtttgttgacaacgagtactgcggtagtcgttgctcagacgctgcaacagctgtttgcggttgacgtttcattaaagtgggtcaatgatgtgttagtcaatcatcacaaggtggttggtatcttatcagaaggcatcactagtctcgaaacggggcaaatttcagcagtcattattggaattggcattaacttaacaacgacagcttttccagcgctactagcgcacaaagcgggcgcagtcgttgccaatccaaatggtgtgacgcgcaatcaagtgatttgtgagctactgcggcgctttttcaatagctatgggacttatcgtagtgggactttcatggacgcttatcggaaactctccatggtgatcgatcaacaggtcgagttgaagagcggaacgcaaaagtatcgtggagttgtcacggatattgatgcacacggggcgttagtcgtcaaattagagactggtcagagtcgtcattttagttctggtgagattactaaggtgaacctcttgtccggtggttatcatggctagcaagtttgtaaaatcaatttatcaagttaccgaacgaatcgcgtcaatcttttaaaatgatttctgattcaatgttttactggttcatactgttgtatagtagaagttagtcacaagtagtgctaatcaatttcaatttgattaattgagctgtttggtacgtcgaatcaaccttaaattgttgataacataggaatgataacggatggattaatagactcacgtttgatttatttatattgtaattaagttcggggttatatgtgtttaatcagcataatgaataaagtggttaataaaaataattaatgaagtttaaataatgctggtcaatgcggtcatttacatattatagtaaaggtaccgaagcactggtgggttagttaatatttgtagagacaattcaaggggtaataggaatatgaatgaaaatttgcggagcgtaaatatgagccgaacaatgagtcggatgaatcgacaccggatgaatccaagacgttatatcaccggatttgatggtatccggacattggcggtgctgggtgtcatcatctatcacttgatgccggcctcactacaaggaggttacttgggagttccgatcttcttcgtcgtttcaggttatttgattacggatattttattacaagatattttgagtcgggggcatgtccggatatggcggtttctcggacaccggatgcggcggctatatccagcattcgtgacgatgttgttagggacaacagcctacattacgctgtttcaacggtcattattgacgaacattcgggctactgtattaacgaatttagtctacgtctataattggtttgaaatcaatcacggtcaaagttattttgaccgtttcaatggtgaatcaccgttcactcatttatggtcgctctcaattgaaggacaatattacttattctggccattagtgattggtatcttgatggtcatcttcaagaagcgttcacgggtcttctggtttatgatgattgctgcgggtatttcagcgataaccatggcaatgttgtatgatccagcgaatacgaatcgggtgtactacggaactgatacgcggatgtttgcaatcttgttaggttctggccttgcgtttatctggccatcacgggaattatcggcggacattgctaatgttaatcgagtgacactggatatcttaggcggtgcttcgctaattgcaattatttggatgtttttccagatgtccggtcaatctgatttcacttatcgtggcggtatgttactattcacagtcctatcaacagtgttagttgcaacggtggcccacccggctagtcatctcaatcgcgtcttgacgaatccggtgtttaagtacgttgggcaacgtagttatgggatctatctctaccagttcccagtgatgattttctacgaaactaaagttaaaaacattggtgatcatttactcctcaatagtttgattgaagttgccttaattttgatcgtgacggaattgagttatcggtttattgaaaatccaatgcggcactatgattacagtcggttattggtcgacttcaaagatttcctccgcaaaccgaagtttaaccgcgtgaccactgcgattgtcgctttgaccacggtcttattcgttattacggcggttggtttcgttcaacagccaagtaaagcggaagctaacaagaagactgaattacaaaagacgattgcagctaactctaaagcggctgataagaagaatgcggcggcgctcaaacggcaaaaagctgcccaggcagcggctgcttcaagcaagaaggttgcgactgaaaagatgcagaccaagcaggctgaagcgaagttgaactcgaagcagaagcaggtggaaaaggaatacgatttgaagccacaagttgttctagcgatggccaatacggatctgacagccattggggattcggtgttactggatgtttcttccgatcttcaagatgttatcccgggtacggtggttcaaggtcgcgttggtcgtcaagtgacggaagttcctggaatcattaattcgctgaagtcgcaagggcaattagcccataacgtcctattgaacattgggactaacgggacaattacggatgatcaagctgaacaagtcgttaaactgattggtaaggatcgtcagattttctgggtaacggcccacgtcccaacacagagttggcaaaatcaggtcaatgctcaaattgccaagactgctaagaagcatgcgaacgtgcatgttatcgattggcatggtcgtgcgcagaatcaaagtggttggtttgcagatgacaatgttcatccaaatacgactggtaatcgccagttaacgaatttgattgcgaaccgcattgccgaagttaataacaattaaagatgagttccagcttacgttgatggtaagctggaactttttttggctagttccggacaggtggtggtgtccgacctggtcatgataagtggctgtttaagttgaaggtacacaaaaggcccaccagttaacggttgtgtggttagttggtaggccataattagttagtctgttatttttttcattgggacgtgtaagcgaatatcgttcaagttaagtgagtactgtaggtcttgattgccacgaatcgtcatcttcatatcagttgcgtaaatgactagtccgagttgatgccccttcagcaagtggtggaacagcggttggagatccacagaaaagtcataaaagacatttggctgaatcgcttctgcgtgccatgggtggtggcggttctgtaagttaagatgccccttagtaatcatcttgaacggcgtctcacccgctaacttgaagtccttcaaatcatcttcgcgccagtggtaacctagatcaagcgcttttgcagccagcatttgtgggctgacagtcaaacggcgcgcggccccgaagtcaatcagcataaagctcaacatgccgaaattcttattaacggcgacagagcccgcaacgtgcggaatacccactaataattgatcctcaggtgcctgccaagacttgaacaagaggcggtaatcatagagcggatttaacttatcctcttgcaagaggtcgcgctgccaactatccaaatgatgcttatagtggtcgaataatttgtcaggcaatttatcagtaaaatgagcggcgcgttggtcaactgtatggtcagcaggaactaattctttgtactgaaccttaaaatctaaagcgtcggttgtgtcttgccaccaattgtcatagccgtgccaagtttgggcttgcgtgttgtcttgtaccaagacgttaggcaagagtgtctccgcatgattatctaaaccatataatttatggcttagccacaagttcatcatgtcggtgaaatcgagcgattgtaagttattgatataaatatgttgtccctggtgcaaaatgagctttttagtaacgggaactgcctgtaatttatcccataaattagctacgttgcggggcttaacgttccagtcgttgagcccgtgaaccatgatgatgtccgccttaattttgtcaacgttcttgagataattgcgttcatcccagaaacggttatagttaccgcttgctcggtcttggtcggcagtcagttctgccagtttctgatcaaacgcgggttggatctggtgagcgtcaccggcttttaagcttcgtgagaagacctcagcggcgagaacatcggtgtcttcgccctggaacgtatcgggagcgacaaccaggccattatctcgataatagtcgtaccagcttgagatggcggcctcggaaataatcgtcttaaggccagccacgcccgtcgtagcagcggcagttgcgagggtaccgaggtaagaccggccagtcatagcaacggcgccgttgcaccaccaagctttgatagcgatattgccatcacgattggtgaaggcttggcgtttgccagtcaaccattcaataattgcaactgttgaggtcgtttcatcaacgtcaccggtaggggctagcccatccgagtcgatcgaaccgattccagctgcatagacgacagcaaaaccgcgcgctagaaagtaatcattgagcgtgtaggacttttctcggctgaaagtctcctctgctgtatcggtcgtcgtggtcgcggttcgagcggctggtagttgcgccgttgttggctggaactcaacatccgcataggtattttcgtccggttcctttgcagtcaggggaacgtctacgttgtgcatttgagcatcgccagcttggtcgttgatgccctgattataaggactagcggtatagagaacgggaacttttaagccggtttcggtctcagctggccgaaggatttcaactttgagcaggtcccgttggccgtcgtggtcagtatctaaaggcgcttcaacgtagatgacgtcacgaatgagcgcgttggtatcaaagacggcttgggccttaccattgaagaagagtggcttttgatcgttaggtaattggtaaaatggtacaaagtaaccccgggtcgtgagtgattcaatcaaggtttgtccattattcccacgtgtatttaataataggtaccaagcataatagagggcttcacgatcaaaggcgctatcaccgaccattggcaagtgaatatcgcgcatcgccagcaatggatcggccaattcaaaatcttgaccaggtagaaaacccagtagctgaagtcccacgttataaaagacttgattgtttacgatagttgcatcggcgagccattctgataaagtgtgctggctggttgccatgatgttattaaacttgtgggtcaagccgcttgccgtgtgaacttctggtaagcttttagccagcaatgcctggtagacggctggaacagtcgtcagggcgtccatatcaggcgtaataaaatgaatttttgtaagttcggcaatcgcggtttccgaatcagtcgggacgattgcaaattgattatttttcataagtaaattccccattaagtattattagaaatattataccgctaattagtcgagaaccaatgcttcttactgacaagtttataatgttgtggtaggttaattgcaaagtgaactatcgaatggaggaactaagattgagtgattttccaattttatatacgacccaagcagttaatgaagacggcatcgaaggacacgcctatattcccaatggtcttgaggtggccgtatctagtccacttaaggcggtgccgggctcgaatccggaacaattaatcggattggcgctcagtacatgccttaacgcgacgctggaggcaatcgaaaaggagcacggccagacacatcagagcaaagtcgtgactacggtgaagatgtcgcgtgaccgttttgggtaccaatttttcctagatgctcgggtcacgattccggaagtggatgctgaaacggcagcacggtggctcgcgattgcggaaacgcgttgtcccgttgccaagctcgttgggccatcagccaacgtgacgattcaattggcttaaccgttgtgatatggccgcagtaatcattaatcgtagtttgtaaaaatgtcaggggattgattaaaacgtggttcgagttggcagcgattaaaactgccaattcgaaccacgttggtgttaatgatgactgcgaatttgcttgaaaagttggcgtaagcttgggtgctgacagtgatgattagtaaccgctgactgaactttatcgacctgttgtagggcaagttgcttcgttttttcgcgttcgattttgagctgcttgcttagtgctcgcgatttccaaaagccgttgatgccgacgacaactggaataatgtgtaataaggttgtggcgggaatgagccagggatgcttactgaatagttgaacgacctgggtatgatgctcatgaaggtcgtcatggatcgttttaggtgttaacatgattaaaccacgctccttaattaagtatcattatcataccttaaaatgtaatcgttgtcatcgttagctggctgacaatagttaaagcgcccatctcaagttgattgatcacttgagatgggcgcttttagttagtacaaatctagattgttactcatcagctttattcatgcgactatgccgaatgccatagccaaagtaaatgatgagaccaaggaggaaccagactagggatgccagccaagtttccatggatagctgggtcatcatgaacaggcacagcaagccagaaataattgggagaaccgggtaaagtggcacgcggaagcccttgatcgcgttgagcttgggattacgccgtagtagcaaaattccaaaagaaacgaaggcgaaggcaattaatgtcccgatattaaccaagtttgccaattggtctaacggaatgagaccagcaagaattgaaatcacgattgtaaccgtcaacatggcgtttttaggggcgtggtgcttatcgattttacctaagaaacgtgggagtaagccgtcacggccgattgaatataatagccgtgagctactgtagatcatcgtaaccatcattgtgaacatgccggcgagggcaccaatcgagataataccggcaacgaagttttgatggacgagttgtaaagcgaacgccactgcatcgtcaacgttcaactgtttgtacgaaaccatcccggtcagcactcctgaaacgagaatgtagaagatggtacagatgactagggtcccaatgattccaattggcatgttgcgcttggcatttttaacttcggctgccgacgaagacacagcatcaaaccctaagtaagcgaagaagacgaccgcggcgcccttgagaattcccgtcccaccaaatggggcaaagggtgtccagttacttggtttaacataaaatgaaccgactaataagaacaatacaatgattgctaattttacgaccacaataatattgtttaatcgaatcgacgtttttaggccggtatcgataatccaagcaatcagacagacaatcagaattgcgatcacgttgatataggtcccgtgggcggggtcaaacgaaccggtgatggctttcggtaacttgaggccaaaaccagcaatgaatgaattaaagtacgcggcccacccaacggcaacggtcgcaacggctaggacgtattcgagtaccagagcccaaccaatgatccaaccaatcatttcgccatagacaatgtttccgtatgaatacgcggaaccggcgattgggagcaccgaagcaaactcggcgtaacacattgcggcgacggcacacacaatggcagccaaaacgaaagataaaataatcccgggtcccgcttttgttgcggcaaccgttccgggtaggatgaaaatcccggtcccaatgacggcaccaatcccaagtgcaatcagatcgactgcggagagggttcgttcaaaatgactatctttttgtaaatagcgctccaaatcttctttttggaaaatgcgctggaaaatccccataacatggaccacctttttggttatttgtaacagttagttgtcattatcgacaaatcgtcatgtcaatatgataccgtggttgattattaaaagtcaattagaatcagccttttattattaataactcaatgggatacggagcaagatagctggttaatcatcatagaagctggtgacattgcgactgtcgaggcaatgttcgtgctgacaatagatttgatgacgataacgcgtaaccagtcatggtggggatttaaaaagcgttgtgatggccgaattactagtcatcacttaagccggcggtaacggtgctaagctgaagagaaacgggtctgaatatgcggttgggtagctgttactattgttatttataagttgatactttgttataacgaacggtagtcaaagaatacacacggataatacattaaactgttaattggattcgccaaagcttataatattgttatcaatagaaatttaattttagaatggtgggattaggatgggagcggcgattgatattaccggtcagcacttcggacgcttaatagctgttcaccgagcgggccgggccaagaatggtaatgcgctctggttttgtcagtgtcagtgtggccggacgtgcgtggtggattcctacgttttgcggcacggcaagacgcgtagttgtggctgtctagccgtggaacagagtcggcaaaatatttttaataatccgcaagcagtttcgcatatgggggacccgcgcaatttgaagattcgtgatcaccatacagatgtgagttcaatcaagaagtcgaagcgtaacacgagtggggtcgtgggcgtgagctatgacaaacagtcaggttcctgggttgcgcacttctactacaaaggaacgtacatattaaacaaacattttgcgcattttgaagatgcggttcgggcccggcacgctatggaacagcaatatttaacgtcatctgataactgaaactgtcggatgcccacgttaggattcactagcaaattgtaggctagctaatattgtggataatatttgaaggaactgaagtcggttaagtgtcgaagggcttcgacgtaatgtgtgcttagtctgatgaggatggatgataaattttaatgagttgaacaacgggactggcaatccgctgctcaactttttgagtcggcactaatcaagcttaatgctgacaataccgttgcggtttgcagtgaggagtaatcaatgcttatttgagtggttgatttaacctttcttttgaagcgaagaggttacagtcagtcggagttctgatagaataagcattacacgagataagagggggtagcaagattgtcaacaatgttagtggcggaagatttatccgcagtcggtggaatctcacttagttcagcgttgcccgtattaacggcgatgcagtatgacgtggcagcactgccgaccagcttattatcgacacatactagcgggtacgggacaccagccgttgtcgacttatcgacgtggctgccgcaggtctttgcgcattggacccgtgcacaactgcattttgatcaagccctgatcggctacgttggttcggtcgcactgtgccaacaaataactacttacttagaacaacaaacgctgtcgctattagttgttgacccagtactcggcgatctcggtcaactctatcagggctttgatcaggactatgtcgcggcaatgcgtcagcttattcaacaggcggatgtgattttgccaaacacgacggaggccgcattgctaacgggagcgccctatcaagtgacgccagatttagaagttattttgccagcactgcaagcacagttgaaaactggtgcccacgcagtcattacggatgtccaacgtgctgatcagattggctgtgcctggttggatgaagctgggcacgtgcaatactgtggtgcgcgacgtttgccggggcattataatggtaccggtgatactttagctgctgtaatcgcgggactgttgggccggggttacccgttagcaccaacgctggcgcgcgctaatcagtggttgaatatggcggtagcagaaacgattgcacaaaatcgaacggatgaccggcaaggggtcgcactgggggacttgctccaggcaattttagccctcaattgatgatggaacatgttatactagagcataattcataattaggaaggtgcgacttcatgagtacagaagtagctagtggtgcggtcgtctatcaacaaaaagatggtcatcccgcttatttattattacagagtgcgaccagtgatttttggggctttccgaaggggcacgttgaaggcaatgaaacgttagctgaggcggcgcgacgtgaaatccgtgaggaaactcaaattgaagcgacactcgataccaattttaaggcgtataccgaatatgacttaccgaatggtaatttgaagcaagtcacactgtttgtcagtgaagtcccaagtggtgtcgtagtgacgcggcagcaagttgaaatcagtgcaattggctggtttgattatgctgctgcccgtgaacgattgacttacgataatttaaagcaaatgttagatcaggctaacacctacattgagcagcatctacaataatactgactgtaaaaaaattactggtgccgtcgcataaacggtaccagtaatttttaaacaatatttttagattggcttaggcctgggtttgtaagtttgcaactgcatcttcgattgttacgccttcagcgaacaattctggatgaagtttgtcagttgcgacaaacatttggcgttgcgtatctaagacaatgctgaaccagctatttgttttttgaaattgcatatgacaaaactcccttctgaaaattgttggtttgctacgagatgcgtgaatcatctatttgaaccttataggtacgttactatactcggtttaccgagctaacgcaaatgaaaagctttacatgaattaaaaaatggaggtttatcaactttgacaacgaaacggatctttgtgatcacgggaccaacggggagtggtaagaccactgtcagtcattacttgcggtcacaataccaaattcctcaggtgattactcatacgacccgggctccccgggaaggtgaagtcagtgggcgcgactattattttgaaactccggcgagttttgtcacgaaacattatttagaacacgtgacctatagtggtaatcaatacggttcttcacgagaaggactagcggcagcctgggaacggtcaccactgattagtatcgtcttagatacggcgggggctattacctatgcgcgggagttgggcgaacaagcggtggtgatttatctcgaggttgctgatcaagaggcgctaattcagcgtttgaccaagcgaggagatcttcctagccggataaaaaagcgagttgctagtgatgagtatttgcgggaccaggctttgccagtaggattagtggggcatgcacatgttatcgtgaatgatgattggcaggcgacgcggcgccaactagatgagctggtcactgaatattgtcagcatgatgttgtgacgaaagattagcgctgacgtatagacggtcaacgtaattcacttttacacttgagtatgctaaactaaatagtaatgattatgatttagtgaagtcctggtcagtaggaggcagcaacattatggaaacaccaattgaacaagccgtcgcaattttacgtcgcaatcagtttaaaattacgaagcaacggcaggcattattagattatctggtgacctatcaggaccactatgtggcaatttcggccgttgatgagcacatgcggaccttatttgcaggaatgagtcacaataccatttatcgcaatattaaagagtttgaaacgttaggattattggaattgaaggcccaggctaatcaaaccctggttaaatatcaatgtgatttcaagcatcaacaccatcaccattttgtttgttcaaactgtggtaaggtgacggaactgcaagcgtgtccgttagacgagtatgaagcacaattaccgggttgtacgattacgggtcaccgcatcgagatttacggtctatgtgccaattgcacgaaaaagcaggcaattaatagctgacggggagtcggcttttttgttggccttgtttgagtaaagagtttcttaatttgtgatagaattagtgcattccgaacacgagcatggtttaattatagattagaaagaataacggcaaagcctcagaagggaatgacatcgatggcttatcgaacaccaccatttatttcaccatttgcaattgtttcaattgtccttgcactgggggcaactaacgtggtcgttaataagacaacccatactgtcaatggcgccaaggccactagcagtgtggtcaaaagttcatcagctagttccgcaagtctgaaaaagaaagcggctgatgatagtagcgatgagaataaatccaaagacaaatccagttcagatacatctaatgatgaacagaatagtagttccagtagtagtactgacgagaatgatacggacagcagcagtgctaataagaccagtagttcatcaagttcagctgatgatacgagttctagtgccactaatagtagtacgactgataacaatagttcaacgactgatacgagtgacgatgatgaaagctctgctgctgagtcatcaagtacgaccgcgtcaagctcgacaacgacaacgtcacagtcgacaacggataccactactagcgacgggggcgaataacgaatgtttagtattttagatatgatcaaccacgccttgggttacgttaatgtcaatgtgaagattaagaaccaaatctatatcggcattggaattgcgggtaatttatacctcggttatgtggcaattcgcttgatgcagaatggcgcgtggttacggggcatcttatatatgctcgttttcttggcgctgatttatttcattacgttaaacgtcatttattattttactaataaaactgcgaagtatgacttatcaccacgtattgaaaaattgttgggtggtaagcctaaagaagcgttagcagctgaaaaacaagcacaacaaagtcagcaacaaccatacattcctgcgaacggtatttttgatgggcaggaattgttgcccgccacggtgaagacttcacgtgctgaacaggagaatgtgcatcaaatcgttgatcaactacaagcggcgaacgttgtccgattagattacggtggcttaactgatgatgccatcattcagcaggcgcaggcaacgggtgaacccgtttatgcgattgggcaaggcattcaaattcctttttcgcagttaaagttggagaatcaccggctagttatttacgccggaatcaatcagatggaccaatccccggttgggcatattactaaggtcggtttgaccgatgttcatgatgcgcatgaggattataagttgtacttggcctccacggtaatcacaggtggtatgagcaagattgcgggccgaacgtcggctatcgagcaaccgggcgattaccaggtaaccgcgcaggttgcgtatgagggaagagaagattaagagtgcttccaaaggcggttagtttgtgagcattaacggtaaaacggtgatcatcctggttttggatgatgaccgttttattgttaagcggagcaaactgcctttggaagcacgtttcggtagccaaattgaatctaaacacaaaacaaccgttttgagcagtggctcgaaacggttgttttgtcggtatggctatttaaaaagcgctaaaatgtctaatggtttttggaagcggtgggccactttttgatggtcggcgttagggtccattccccagactgccagtccaaaatcaacgttagcggcctgggcagtttgttcgtcactgacggaatccccgatgaagagtgcgttttgtggcgcaacgttgactttttcgagggctgtgagtagggggaggggatctggtttgcgcttaggcgtatcgtccgcactgaattgtgacagctatccgcatcatgaatggatacgagcgcatcccactttctaattcgtttcgtcgttgggaagtcacgattccaagtcttagttcagacggcaactgttcaaagaggctggtaatgcctggataaagttcaatctgatcataatggctggccatgacatcttcgtattgggcctgaaagtggtcaaactcactggctgcaatccccaattcagtcattgcttgttcagcggccatgggaaaagtcttctgcgcttgggcaggactaaatggtttgccataagtagcaagtacctcacgcataaccgtcgtgtaagctggttggctattagtcagcgtgccgtcaatatcaaacattaatgcttggtaagtcatataatcgttccttccaaagtagatttaactccagtatagcaaattcgtccttgacagtggttaggacaaccattatagttagattaacaattgatgaggagctaatgatatgtcattaccgttaaattcattaaaatctagaactagcttttacttttggtattttcgctagtgtttgtgccggctgcagaggtgcaaacacgaatccgatgtttgcatcgatgcggttgccaagagtattttgtgatttgacggcgcccatggatgtttgaaaattccaagggtggctaataagtttgtttctgcgtggtggcgcaccctttggaatttcaaggggtgcgcttttttgaccctagtccagtccgcttccaccaacaagatcagccaaacttgggaggaatctttatgtcaattaattcagaaacacttgttaaccatatgaatcatgaaattgcggcgattcagccgtctgatattttggcgttcaacgctgaaatcgcaaatattccgggtatcgtgtgtttgaccctcggtgaaccggattttaatacacctgagcacgtgaaacaagctgcaatcgaaagcattgaagcggatgaaagccactatgcaccctcgaacggaacgttggccttgcggacggctgccgctgaattcttggccgctaagtatgatgtccattatgatcctgctagcgaagtgattatcacagctggtgcgaccgggggcatttatacagcgttgacttcaatccttaatcctggggatgaggtcctgattccaaccccaatttttccattgtacatcgcaatcgttaaattatctggggcaacaccagtcttcatggatacctcggacaatggcttcgtgttatcgcctgaccagttacaaacgacgttagcagcccaccccaagacgaaagcggtggtccttaactttccttcaaatccaaccggtgtgacttaccggcatgatgatctgaaagccctggccgcagtgttagctaatcaaccaatttttgttttgtctgatgaaatttatagcgaattgacgtatggtgagcctcatgaatcgattgcaaattacttaccaacacaaactattttgcttaacggcgtctcaaagtcgcacgcgatgacgggctggcgaatcggcatcatgtgtgcgccgaaagctatcacagcacaactgggtaagattcaccaattcacagtgacttcaacgacgaccaatgctcaagcagctgcgacggaagcattgaaaaatgggttagatgatgcccaagtaatgaaacgtgagtaccaagaacggcgcgattatttgtatgatgcacttaatgaccttgggttccaatcagctaagccagaaggggccttctatctcttcagtaagattccagccgggttgccacaaaatagtatggctttttgccgtgaactagcccatgaagcacgtgtcgctctgattccaggtagctcattcggcccgggtggtgaaggctatgttcgaattagttatgccgcttcgatggccgatcttaagacggcggtcacgcggctcaggacgtacgttgccagcaagaagcagggggcttaaagatgaaaattttaatgtatagtgttcgcgatgatgaacaggatgcgattcaagcgtgggctgcggctcatcaaattcaagtagatacgaatgatctggaattccatccagaaactgccgacctggtcaagggttatgacggcttggtcattcagcaacgcagtccaattggtggtgatgctagcttataccaatcattagctgcggccgggttaaaacaactaacgagccgtacggctggtgtggatacaatcgatattccggcagccaaggcggctggtcttgtggtcacgaacgtcccagcctattcgcctaattcagttgctgagatgtcggtggcacaaaccatgcgcttgattcgcaacttggaaatgtttgatcaacgaatcagccaacagaattttcagtgggcgggactgcaagcacgagaaattcgatcattaaccgttggtattattggtgcgggtcgtattggtggcacggccgctcgacttttccacgggttaggtgccaaggtgattgcctatgacgtggtacgccatcctgaactcgaagacgttttaacctacgttgacactaaggaagacctattgcggcaggcggatgtcgttgatttacacgtggatttgaatgagacctctgcggggttgatcgatgcggcggccctgaagttaatgaagacggatgcctacattatcaacgcctcacgcggaccagtgattgtcaccgatgatcttgtggcagcgttaaaggccggtgaaatcgccggttgtgcacttgatacggttgagggtgaaaatgcgttatttaatcaaaatcatcagggtgaggtgcttcaagataccaacgtggcacaattaatgcagatgcccaacgtcatcatcacgccacacgtgggtttctatacgaatctagcggtcaaaaatatggtcgatattagcctagatgacgtcttagcaattctgaatggtgaaacgacggcccacgccttttaatgatggcgtcagtcgctactaccagtatggctgtaggagacggtggctggtcaaagtgccccaccggttaacttgttcggcgactcgctgttcgataactagcttatagcgggactaatttggtggtgcgtccgcgactgggcttcaggtgtactggcaatgaaataagccttccaagcatattgcttggagggcttatttgtctcttgagtcggctgactggtcgtgactaactagctagtagattcggctaaccagccattatctaataactggtgatagtgcttaccgattggcacccacagtttagcttgcagaatgctacggagctcatcccagaagagtggatcgcgttgttcattggtggataaattcaattttaagtaggcccccgtctcagtcttggcaatcacaaagggataaaagactttgataatctgggccgctataatgttagtcatgttagctgcttggtcaagtaacatattatcgtctcccgttacaatgcagatgattaatttcttaatagttctaggttagcagtgattattaaagaaatgattgcggaagcgttaacaatttttaaagttcagttagttttaaaccactaattgtgaaaattatgcgccggacgcttcggtggctttcagtagtggtatgattaaaagcgggttaagtttagttgttagaataatataaattttattgaaatcattgtctaaaaattattcggccgtggcagttccaaaaagaaaggcgaattattattggcttttcacgaataatgttcaatattggagctgttattcagctattttaactgaaaacagtgtagctgtttctcactattttatggatatcgaacaatatttagctactttttgacaaaattactaattatgtattaaactatttaaatagcattaacgaagaataaggatttcttaactctaattattaatgcaataattctagaccgtcagtcaacaggctgatagagaaagcgaaggtgactgcaatgtcaatgatcgaatttcacgacgtcgaaaagtattatggtgattttcacgccctcaaaaatattaatttaacgattaatgaaggtgaaaaagttgttttgatcggaccatctggctcaggtaagagtaccttgattcgaaccgttaacggtttggaacgtgtccagtcaggtcaattgttagtcaatgggtttgatttagccgaccgcaaaacggatatgaataaaattcgcaaaaacgttgggatggtgttccaacactttaatttgtacgctaacaagacggtgcttgaaaatatcatgattgctccccggttagtcttgaaacggccggaagatgagaataaaaaattagcgatggacttattagatagtgtcggtctggctgacaaggccaatagcttaccgagccaattatctggtgggcaatcacaacgaatcgcgattgcacgttctttagctatgaagccgaagtgtctcttgtttgatgaacccacctcagcactagatcccgaaatgatcgatgatgtgttgaacgtgatgaagagtgttgccgaagactccagtatgaccatgttagttgtgacccacgaaatgggctttgctcgtgaagtggccgatcgggttattttcatggctgatggggaaatcttagaagatgatgctaaagaaaagttctttgatggtcagccgtctaatgaacgggcccgtcaattcttgagtaaaattattacacactaatttgtaggggaggaccacgaatgaagaagctgaaacgactaattggcgcactcggcatgcttgccatgctagtggtggtcttaaccgcttgcggttcacggcaatcattagcaaaacaggatgttttgaccaatgataaagctagtaagacgattacgtggggtgttaaagctgatacgaaattatttgggttgatggacgttaaagataatcaaatcaaggggtttgacgccgacattgcgacggcattaacaaagcgggtgctcggtaagaatgctaccgccaagtttgtccaagtaacgagtcaaacgcggattccattgttgaagaatgggaacattgatgccattatcgccacgatgactatcacgccggaacgtgaaaaacaggttgattttacgaattcatactttgatgcggggcaatcactgttggttaaaaagggcagtgccattaaatcagttaaggatttgaataagtcgggcaccaaggtccttggtgtgaccggtgcaaactccgttgagaacattaagaaagcagcgcctaaggctaaggtgttggaattatccgactatgctcaggcaatgacggcgttgaaatctggtcagggggtcgcgttgactactgataacgggattctttacgggatggcgtcgcaaaacccagggtacgaagtggttgggggtaccttcacgaaagaaccatacgggatcgctgttaataagggtcaggaaccgttaaaaaaggctctgaataaagcgctcaaagaaattgaagcggacgggacgtacaaccgcatcttgaagaagtggtttggtaacgtggccggcttcgactataaggaggcgtcacgctaatggaatacattctaacgcactattggtcagagctgattcaaggactcggatatacgttgttatccagtgtgattgctttggtattcagtacgatcatcggaacaatgtttgctatctttgaagttttgccaagtcgtacgatgcgcatcattggtcgagtttatattgaaattttccggaacattccattgttagttattgcgatgttcttctacgtgatcattccaatgtatgttgccaagattgatggttttaccgcggggacaattgggctaacaatctatacctcgtcattcattgcggaaacggttcgggccggaattcaatctgttgatcctggacaaatggaaggcgcccgtgctaatgggatgacgtactggcaggcaatgagtaaaattgtcttaccacaggcatttaaaatcatcattccaccgttaggcaaccagtttattaatctggtgaagaactcttctgtcctagctttcgtggctgggttcgacttgatgtaccaagcaaattcaattgcgtcactatcgcttgatacgatcaatagctacgtggtcgtaggggtcttttacttaatcattacgttgccactgagttattacatgcggcacttagagaaaaaattagcaaactagaagggggcgacgattcatgcaaaactttattcaagcgtattcgtggataaatatccggttcttgctcgaaggactctgggtaacggtggaagtgtccgtcgtttccatcattgccagttttattatcggttcagtcctaggggtgcttcggtacgtcaagattaaatatttatcggcagtggttgggtttgttgttgacattattcgaaacttgccattgatcttaattatcttctttacttactttggcttgccacacttgggattcaagcctggtatcattttcgcagccatcctcgctatgacgatttttgaatcggccatgttagccgaaatcattcgttcagggattttggcggttgattacggtcagatggaaggcgcccgggctaacgggatgagctatgtacaagcgttatggcacattgtctttccacaagcaatcaagaagacgatcccaacgattgtgagtcaatttatctcactgattaaggatacgtcgctggcaaccattattgtcttacctgaattattaaaccatgcgcaaattatttatggtcagaactcagcgtatattttaccgatgttcttaatgatcgcagtcatgtacttcattatttgttacgccttgtcaattctgtcacgtgtgttggataagaagttagcgtaattaaactggtgggatgatggctgaaattccttaatgaaaagaccaaacaagcaataatgctttgtttggccttttttataaaaaatatttaaatgtcttgcaaaaaatagaaggcgtgataatatagttaatgaaaacgttttctataaaactgaaattaaggattgtaactcatactctttgaggcattaccttttacttgttgaaatatacgggtgaagtgggtgcctcaaggagtttttttgtattgaaggaggttcagtgatgtttggaattaaaagaaagaaagttgatgtcttcgaggtggttacaccaattgaaggtatttatataccgatcacggccgttatggatgaagtgtttgcaaagaaaatgatgggtgatggatttgctattaggccgagtgaggacactaatcaagttgtggcaccgattagtgggaaaatcgttgcattacctgaaagtaaacacgctattggcatcatggatgagactaggggcgtgtctgtattggttcacattggcctagatacagttggcttaaatggtagaggctttacggcacacgtcaaattaaatcaagaagttaaagcagggaccctattagtgacgctcgatcgccaaacgatggcgaccgcgggattagatatgaccaccatagttgtctttacagaaggttatacgggcgaagtgccacttggcagtaagcttcatcaacaattagcagccggcacaccagttttaaagcaagcataaactatgtaaaggagtgcgaattaaaatgcgggtggtgaagaaaattaataacaacgtggtcgtttgtcttgatcaacatggtgaagaattggtcgcctttggtaagggactaggatttcaaaaagtcccgtatgagcttactgatatgactaaagtgacgatgacattttataaattaaactatcaatattatcaattactaaaagaaatacccactgaaatctttgatttgagtgcggcaattgttgagcgagcgcaggcactaattccaagaattttgaatccaaatatgatttttagcttagctgatcatattaactttgcaataacgcgactaacccattataaaagcgcccagttaccattttcatatgatgtggagcaattatacccacaagaaacggatgttgggtattacgccgtcaggttaattaatcgacggctaaatattcaattaccagtttccgaggtcacagcaattgccatgcattttgtcaattctcagactaatgatttagcgaccaattcaagtgtaaatagcgacgatgaaatgataaaaatcatcacaaaaattattgaacaagaatatgagcttagaatcaatcaaaccgaattcacatacaaccggtttgtcatgcatttacggtattacattaaacggatgaagaaacatgagcaaatttctgaaaatgataattctaaattatttaatacgatgaggtatgatgagcctgaaatttacttggtagcaaagcgaattgcagactacgttgatagtcaacttgatactaatagtaatgatgatgaacttttctacctaatgatatatgttaaaaggatcgttaataaaatgaatactcaagcgtaaccgttaattaatggaggtgtatgcgacatgaaaaataaggataaacagtatgaaaaagtggcgaatggtgtactggaagcagttggtggtagtgcgaatatttcttcggtgacacattgtatgacccgattacgttttaatttgaaggatgaaagtattcctaatgatggtgaggtacagaatattccaggtgtgattggtgtcaatcgcgctggtggccagtatcaaatcattattggacaagcagttagcaaagtttatgatgcgttacttacggtgggaaatttaactagaaacgcgccaattaatgaagatttagataatcgacctaaagaaaagttaacgtttaagtctgcgggaaatatgattctaaataaattggctggatgtttaacaccattgattccgatgttgattgctgcatcaatgtttaaaatgtttgcggccattttaggaccaagtatgttcaatattcttggtactaaaacatcgttgtatcagttatttacgttggttggtgatgctggattctacttttttccaatcatcttaggatatacagctgctaagcaatttaatacgtcacggattatttcaatgtttttaggtgcaattttgattgatcctaatttaattaaaattgtgactgctggaaaggcatttaatatcttcggtatcgcaatgccattagttaattattcaagtacggtcattccaattattttgtcggtttgggtaatgtcgtatattgaacggttctttaagcgttatgtaccagagtcaattagtacgattgttatcccaacgttgacgattgcaatcatgttgccgatttcgttatgtattttaggcccagcgggaaactttatcggcaattacatttgtacaggaatattagcttttgggaaattaggtggcttgccaacgattatcgcggttggagtggttggtgccttatgggaaatcttggttatgaccgggatgcatctcttaatgcttacgacgatgatgatgatttttgcgcaatcgggtcatgaaaactttgtcacacttggcgcagttgccgctagtatgtcggtcgcgggcatgtgtttgggtgcggccttacgaattaaggaccaagatcaaaagacacttgcttggggttatttaatcgctagtattatcggaggtgtgactgaaccaggattatatggactagcaattcgttataaacgaccgtttattggcatgatgattggtggattttgcggtggcttatatgctggcctgacaacagttacagcttatgtcatggtacctgttgcaaactttttatctttaactgcgtatgttggcgggcaaacatctaatgtgattaacggtgtggttagtggcgtgattgcgtttgtagcagctgctattgcaacttatgcgattggtgttgaagccaatacaaacaaacaggggactaaagaatttaaactagtggaggcttaaaagctaatggaaagaaaagtaatcgttcgagctgatgatttaggttattccgatgcagttaatgttgggattgcacgaacagttcacaacgggttaattaataatgtgggtgttatggtcaatatgccaacgacgatgtcaggattagccatgattaaagatgcaggggtttgcttagggttgcatactgttatatctgctggccggccattaacaaatccaaaattgattccgagcatcactaatccagatggtacctttcgtcattcctcggattatcgggcggctattcatgattttgtcgatcttaatgaagttgttttggaaatcgaagcgcaatatcaaaaatttgtagcgttagttggtcgccagcctgattattttgagggtcatgcggtagttagtgataactttgttaagggattggaaattgtgggtgaacgtcatcgcttaaatcttttacgctttgcagcaggcccagatagtccgagtgtgctatttaagggaaaagtattacatgtttttatggaaagtatgggcaaaaactataacccttatgaaacgttgaaacgtgcggcactagcccaatataatgacggctatgctatgatggtttgtcatcctggctatttggatgactacttattacaacattcaagcctgacagttccccggacgcaagaagtcgcaatgttaacagattctcaaatgcaggaatggttagaacgacagcagatcaaattaatcaaatatagtgaggtttagttactaagcgttaaggtaatcggtaagcaaattaaatcacttatttcaatgcgcgttgaaaagcataaaaagagcgttgctactgaaaatatcttcagtaacaacgctcttttacaagttatcaagaatttaaattaagcattttgattttgctgctgcttccaataatagattgggaacccaacggccacgataaccaaggaaatcagtacacccgataagtctgagccaatttcactgataatcacgaacagcgcgcccagaatcgcaatcagcggtgtgatcggaaatccaggtgtcgagaatggtcgctcagaagctggacgtcgttttcttaaaataaagacaccaacgaaggttgccacgtagaagcagtagaccgtgaagatacagaggtccgataagcgatctggattgaagaacaggatcataatactagcataaacgagaatggcaatggttgcggcgatcggctcgtgtgattttttgtgcaagtaactgagttgtttagcgaatggcaactgattctgagcagccatggcgtacacgatgcgggggaaggtcataatcttgccgtttaaacagcccaccatcgagatgataatcccaatgttcagtaggcgcccgccaattgtgccaaacgccgcttgggcaaagtacagcgtcgtttgttgcccgagtttgtggatcgttgccgcgggtacgaagtggagaatcccatagctgactaaggtatacgcaatcaagaccattgaaatccctaaaataatggcttgtggtaataacttctgcgggttcttgatttcgccacccaagttagcgactaagatccagccatcataggcaaaaagtgttgcgaggacggcaaccccgaaactacccgttgattgggtaattgtatgtaaagactgtcccagcgcattctgattaccatagaagagtccaaaaataataatagccgcaatcggtaataatttgcccaacgtggtcgcaatttgaaatgcggcgccccaacggttttcgaacatgttgaggattccaatcaggacgatgacgccaatcgagagtggcgcctgccaacccgcccgcaggttgaagaaaccaactagtaatataccaaggtaagcgctaattgaagcgatgatagcgggaccgtagacggcgatttgcatccaaccagagagaaagccccacaatttaccatagatttgttccatgtagacatagagcccgcccgtatgcggcatttgggcaccgacctcggcgattgttaagcccgcggtcaacgtaatcagtccacctagtaaccaggcgagtaacgcagcgctcggtgagcccgcactatcaaggactgatgattgcttgaagaagattcctgacccaataaccgtaccaacgacgagtgaaagtgctgaccaaaaaccgagtgaacggttcagggtcgttgcttgctttgtttcctgcattaacctgaaatcctcccttgaaacaaccaaattctaaatgattgcacttagcataccagagattaatggtgatgacaatcaaatatcgttggttgtggccggctttttgcccaaaatccgaactaataacgatattttaataataaagttcgacaaggctcaaaatgatcagtgttattcggttggtgattcgagtttcgacaaaataggattgggcggcgtggtggctttaaattaatttatttatcttcctaatattagcagggttatttaacgggtcaggttagtcattaacttagtcattaattgagttagttgtgcccactcggattgattgagaccacccttagcagtcaataaatccggcaaatcatttaaagcaagtcgtgttgcggttccttgaggtgtcagagtgagcaagatgctccgttcatcttggggattccgatgacgtgtaattaaaccagcttgggtcattcgctgtagcacgggcgtcagcgttcccgtacttaaatttagctgggtgctcaacgttttgaccgtgacagcgcgcggcggtgtcgcatagagtgcgactagaaccaagtattgtggataagtgagtcggtgtgctgtcaaagttggttggtagaggcgttgaatagcatggactgttgtgtaggttgaaaaacagacgtggtcttcaagggggcgaattgtggttgtcttcatgataattaccgcctttcatgcgatgagtattaagtattaagtgcggagacgttctaataatgattgtgcacaatcgattgactggattatagcacattctgacaatctgtgggcatagttgccctagtgccggtgggatcttatggtctggtggtaacgttcagtatgcaaactgatgattgtgggtaccacttgcagtgacgtcatggtaataatttttggttccttcctaaaaatacagtataatgctacgagtaggtaagagagtggggttagattgatggtaattgcaattgtggtgttgttgatgctgctcagcatcggcttatttgggttactgttagccggtgccagacggcaagcagcgccattttttgaccacagttttggtttcggcatggttatcggggccgtgacggattttcttgacacacttggtatcggaagtttcgtcgtgtccacggcaatttttcaagcgagccattatttaaaggatgaacgtaagctacctggaactttgaacacgatgcatgcgattccgaccgcgtttgaggcgtttttctttgttacagcagttgcggtcgagccagtgacactgattagtttagttttagcagcaacgctcggcgcattactgggtagtgaagtcatgacgaagcttaatcagcggtggattcagttaatcatggccggtgcgttagtcatcactgctttactgatggcagcgaagttattaggttggatcagtttgctgggagttgctaatcaggcgacggggctatccggttggaaattattggtcggcattggtggcaactttatcctagggttactgatgtcagccggagtcggactgtacgcaccgtgtatggtaatggtgtattttctgggattgaccccgattgccgccttcccaattatgatgctgtcgtgcgcattgttgatgccgatttcggcagtgaattttattcgccatgaccgcgtcgattatcgcggcttattcggcattattttaggcggtattattggcgtggtggtggcagcgaccttagttaagtcactgtccttaacagccctgagttggttgatcgtcttagtgagctgttggacggccttttcgttatggcgtgccgcgcaacgccggaaaaatgtgttatagtcaacggtatgagtggttaggctaaccaagcctagccactttttgtcgttgtttaaaatgatcttcaggctgctagaaaaaatagcggtcgctggttgacaatttatacagctggctgtataaatgaaagggcaggtgattaagatgaaccatgatgaaatggtggcgcggcaagttctgattttagctcgtcaaatcaagcggcgtcgcaaccaacatttgcggacggtggggttaacgactgagcaagcggatgcactgaccttttttacggatcagccaggtcgcacggtaaccgcgtttaagacgtaccaggaaatcacccatcagacggccaggatgatcgtgcaacgcttgcagacgcgcggatatgtccaattagtggtcagtccaacggatgcgcgtgccaagcaagtggtagtgaccccgagtgggcgtgctaaacgcgagcagctccgtcaacatggctggcagacgagtgcgcaaatgtttgcccatttggatgccgaacaacaacaggtatttttagatttgttacggcaagttaatcagaatttagaaagtgatgagaattgatgaagacgcgtttatatacgccggatgtaaagttagtgttaatggctagtttcttctttttaatgagtccaatgttaatcaatcccgtgattgcaggatttgcgcacggtattggcgctagtagtgtgcttgccggtacgattgccgggttaacgaatttgacatcgctagtgctccggccacttgctgggaatttaaccgaccgggtctctaagtaccgtttgaccttcgtggggggctgtttgttgctactagctagtttaggttatagtttgacaaccaacgtgacgttaatcatgttattgcgaattttgaatgggttgggatataccttgtgttcagtttgcatggcaacctggatggctagtttattgccacccgatcgaattggctctggaatgggcatttatgggctagcgaatgcgcttggaatggcgtgcgggccggcaatcagtgtcttcttgtatcaacattacagttaccagagtgttttttggttagcagcgggctgtagtttactgctcatcatcatgattcaattcgtcggtgatcatggtgaaccaattgtgacgcctcaaacggctacgactaagcaccatattcgcatcgtacaaccacgagtaatccccgtggccttgattttgcttttattttcattaccatatttttccacccaaacctatattgtcagctacgtcgctgcacggcattttcatgtggcagcgggggtatttttcccggtgtacgcgggtattttattagtattgcgaattattctccgcgattggttcgaccgggtgccatttaaacggttcatctggttatgcttaatttttaatctattaggattgattggcttaactgacatgaacaattgggcgatgctactgctgggtgcagcaggactggctgccggatacggtttgatgttttcaatttgccaagctaaagcattgatgctcgtgccgaaagctgatcatgggctagccaatagtacgttttatattggtgttgatctcggaatgtcacttggccccatcattggcgggctgattagcagtcaattaccaatggcgtggttttatcccgtgatgatggtgacgctgccattgattatcgttgtttacctagtcagtcgtcggcagttagcttagccaccaacatgctggagaaggttgttcttggtatacacatgattatgaattttttcagtaggggatatcaaaaagtcacttcaagtttacgactgcctgaagtgactttttatctgcctttatataaacattttgatgccaaaataaataataataagaccaagaaatggcgttaatacgcggttgaccttatctaaatttaaatggcgaatcacgagtggtgtaatgattgcgccgataattgcgccaatcatgaggaccaatcctgattgccaagcaaaagtactagtaaagagatggccgattaaactgattgtggacataacagttaacacataggtggcagtaccagcggcttcaacggccgttagcccaagaattgctaacccggcagccgtggtcgcaccaccgcttaagccgccaatgccgaccatcaatccacttaaaaggccaaagaaggcagcttgccaaggttggtgaccggctgtagtttgtttagaatggtgcacatacttgattagtaccatcgcacccataatcaaaaaaattgtcccgacaatccagttatacagttgttggggaataaattgtgcgctgaatgtcccgacgatgataccgggaacggccgcaatgatcatttgattgccaatcttgaaattgacatttttgattttcaactgtgttataaaaccaaagaataaggctggtaaggcgacgattagggaggttggtacggctaccgcggttgcaaggcctacttgactggttaagacacctaggtatagggcagcacctccgccaccaatcagactaacgaagatgccgattagtaatccgaataaaaagacaaacgtagtgaattcccccttagattgtataattataccttaaacggagtacactccgtttgtcaagtgatgcgtaaaagtgtatggtgaacttaagtaaataggagggtgtgtcgaatgcgaaaggatgcacaaattaaccaacagaaaattttgactgctgcgcgacaactctttgccgcgcgttcaatcgaaaccgttagtatgaaagatattgcgacggccgctggtatcggtcccggaacgttgtatcgtcactatgcccataaaagtacactatgtttggcattggtaacggaccgagtcgcaacttttattaaaaccaatcaagtctacttgaccacgacctcggtaggtgcagcggcacgttttgatcatgttattggggaatatttagcgattcgtgagcacaacatggcgttattaatgaatgtcgaggccggtgaacctggtcgccgtcaattttatcagagcgaactttatcaacaattatgtgacctattaacgcaactggttcgtgatttgaagccaacgctttcgaaaccggcatgtgagtttcaagctgatatgttaattgccatgctgaaggggactagttatgcttttcaacgtcaatggcgaggacggtcgcagtccgaactattggcgcaattgcacgcgttaatggtgactgaatgatgttcactattggcactagtggtttggcgattaacagagtgggttgattgttaaatcaaaaaagatggttctaggcggttaatcctagagccatctttttgaatgagtcgtttaagcaggtgtcaccacgtatttttcataacgttgggcatcgacagtgttgagttcgactgttaattgggtgccatcagctaagtaatccgttttgagaatgttggcgtggtcattcaagtaagccactacttcaccatcattgaacgggattaataacgttgttgtcacgtaattcttaaagactttggctttgatcatactggtcaaagcttgtagtgaggcctcatcacgcgccgtatagatgagttgatcatcttgctggttcgggtagtcggcttcggttaaatcagctttattgaaggcataaatcataggaacatcgtgcacaccgatttctttgagcgtcttttcagtggtcgccatcatttccttgtaatggggatcggcgtagtcgatgacttgaatgagtaagtcagcattggcagcttcggctagcgttgaacggaaggcgttgatcaagttatgcggcaagtcgctgacaaacccgactgtatcactgagcagtaactgcttattgtcagggaaggttaactgacgaatacttgtatctaacgttgcgaaaagcatgtctttttcgaagacttgcttatcttcacccttaccgaacagtttcactaaaccattcatagtcgttgatttaccagcgttggtataaccgactaaagcgacgttggggagcccagctttatcgcgttgtgaacgtcgcactacttcgtctttattgagttccttaagttcgtgcttcgcgtgactgatccggtcttgaattgtccggcgatttaattccagttgcgtttcaccagcaccacggttggtaaagcccccgccaccaccagcagcggccccagcctgttggtcaaggcgattggagatactcgttcgtaatcggggaagttggtattgtaattgggcaatcttaacttgcaatttggcttccttgctccgcgcacggttaccaaaaatttctaagatcagaccagtacggtcgatgatctgaatgtccgtttgttcctctaagttacgcacctgactaggggtcagatccgcgttgatgaccataatgtgcaaatcgttggcggctgcgacttctttgatttcgacaactttacctttgccgaagaaggtggccgggttgggtttttccaatccttggtcaattcgcagggccgcgtgcatattattggctgcaacgagcgcttctagctcggacatggcgtagtcgtaattggcgaccgttttagacatgccggcaatgatgacttcttgtactttttgagcgttggtttcagacatacactcactcctaacgtgttatgattgcattaagtataacatgtctaatcaaaatattacgacttcgggtattagggaggaatcaaaaatgggttacgtgcttgatttgcggcggcaagttggttaccaaccgctagtagtggccggtgcggctttaatggcccaaaattcgattggcaaaattgtcttgatttatcgaaccgataaccactgttggggcttgccagctggatcgactgaaccgggagagacggtccagcaaacggcgcgacgggaattgaaagaagagactgggctgacggtgggtgagttaacgctgatcgatgtctatagtgggcccaagatgcactatcagtatcctaacggggacattattgacagtgtcaccacgttatatcgtgccaatacaacgggtggtgaattgattcaagccaccgatgagacgagtactgcggctttctttgctttagatgctttgccgacaccgttgaccccactgacaaagtggatgctttgcggtgagtaagcttgaccatgcagatgaggtttgctatagtggactgaaatattaagatgaattgtcaccggacaacgttaacccaacttccttaggtcattgtggaagttgggtggacgttgtcctttttattttgaggaggaattgataatgacgtggatttatttaattattgctggattatttgaagtggtatgggctacgatgatgaaattaagtaatgggttcagtcactttggctatgctgcggccacagtagttggcatggtcttgagttttggcttcttagcattagcaaccaaacacttaccgttgagtattgcatatccaatttggaccggtatcggtgcggtcggtgcgataattgttggcctggttttcttcaaagatacaattgcacccatcacgtggatcttcattgcaatgctggtcattggcattattggtatcaaagtcacgagttaggattggggggggttagtgggtttgtgattcatcagtgaagccccaacagcttttcaatatttttataaaagaatgaccacaagcatgaaagcggtgttataataactttagaagttaaatgaatatttgggttattcttagacttcttccgacctgagatagacgcactgttgccaagactttacaaaattttcttgttacacccggtcaacgcactacctctcggaggggtttcttaatttcgtcagtaattctgtgtatagtcttggttgagtacaacaaatagtgaaagaagtgacgtctgatgatgatgtatccgtatctgaatttaggccccagagatggcgtcttgataattgcagctgctattatgttagctttaacggtagtttttaattggtcagtctgggaacttttgtttgctgttgtggcagtcgtaattgcgttcttagcaggaagcatgaaaccgtctaagaagaacgtgcttgcttttttgaaaaaatagtttgaattggggtagcatacctgaattcttcaaacacgtctttaaccagcaaagtttaaggacatcattgataagatagccgagttggttctctgtcaattgatgttgcgaatagtgctacgggtgcttagtcaaacaatggcaagcacctttttcaattcgaattgttcaatagcccatgattaaaatacaaataaagatatctgtcgccagtaatcacgtatttagttaattaccaacaacagttatttcagagccaatataaaaacgctcgcgaccagtcagtggttgcgagcgttttgtttgatgagcaaaattataagtgttgattgactttcacgtcagctaagtcttgcgcataatcgacgacgcgaatttgatcgccattgatgtcgatgcgagtgacgctcccgtttttggggccgttcgtgatgtcgatttcaggagcaaaatgtgcgaccatactgcggattgtcgtgccgtgggtaaccacgaggactttttgatggtgatcgtggtgagctttcaagtagtcaaagccctggttgatccgttcccagtacatcgagttgtcttcagcttcatgccaagggtcgatttcacgcatcaggtcgcgagtctgatcgataggcacgtgttcaagaagttcgtgcatgctggtgaccccgtattggcggccaactagtgaccaggtccgacttgaatcgtcaccttcgaaataaccatagaaaacttcacgaaagttcatcagtgttttaaagggctgggcggtagcacccgccgcttgtcgaatgagctgagcggtgtcgattgcccgcttagaatcactgctgtagtagtagtcaaaagccgtgttcgctagtgcttgaccgaccttggttgcggtggcttgtccgtattcagttaacggcgagtcagaccagccttgcatgcgattatataagttgaaaaaagtctgtccgtgtcgaacaaagtaaattgaaaattgagccatgtgtttctccttatttagtcgagatggtctttgcggccaaagtagtctaacgtcacatcgttgtcgctaattgtgaatttcgtgacgctcccattttggggccgtgctggtgaggtcagtgcggcaaaacgagcagcaatactgtaaatcgtattgccgtggctgacgaccaaaactttgtccccgtcgtgatggtgagcacgtaacgtatcgagaccgccattgacccgttgccagaattcggcgttattttcggcgcgatggaacgggtcagcttctttacagaaatctttggctttttcgatgccgtattgttcaataattgcggacaaactaggtgcttgatggggcgcaccaaccatgaaccaggtctgcgacgtgtcatcaccttcaaaatagccataaaaggcttcacggaaggcggccattggttgaaccgtcaaatcggtattgccactggcaggaagaattaattctgcggtgcgcattgcccgcgtcatgtcactggcgtaaacggcatcgaaatcaataccgttgagcattttacctgcattgcgagcgtcctgttcgccgacagctgtgaggggggaatcacaccagccctgcattcggcggtacttgttaaagtaagtttgaccatgacgaatcatgtaaacggaaaaagttgccattatttactcctctacttggtgttcaaaactaagccataatgtgtttagtttaccataaaatgcactgcgattaattagcagttgctaaggcttgtcgaatctgagcggccgtttgcttattcccggtaaagattaagcggtcaccgtacataatcgtcgtatttccattgggcgcgatcagtttccgattacggatgacttgactaatggtaatatcctgagcaaactgtaagttcttaatttgaacatcagtatagagatggttgaggacccggacttcgtagatgctgttttcagtatcattgagcaatagcaaggttgacggtgattcaattaaggcgcgcagtaaagtaatgttggcctctggtgtattgtagacttcgacgcctagctctcggagttcatcttcatgttcgttgagcacattgcggtcttcaaaccgaacgatgatccgccgtacaccgtatgctttggcggctttagcaagctcgtagttacgttcggcatcaatatggccgagtaccaaaatatccgtgtcaaagacgccgtgatcctgtaagtcctgggctgtgaagttttccattaaggtcactggcacttgcgcgtggtaggtttgataattctcaggatgattcgtgtacattgacacgtcgtaccagccttttcgtagctgttgtgcaacgggtacggtgcttaagttagcgccgataaagtggaccgctgttttgaccaggtcttctttttcagctgaataaaacttgttaaaaatcaggggtgagatgacacaagtgagtagcgctgcgagtaagaaagcgccggactggtcactagtaattgtcttcattgacttggcaactcgaagaacggctaataccattgtcattgtcgttgcagtcagcgcggtaccggctaaagcattggcttgcttgaaccgtaactttaggacccagtagccgccaatcttggcaaccatgtatgctaagaaaaatagtggaattaatagtaaggttttgccacttgttaataaggtccgtaagttcaaatcgacgccagtcgtaatgaagaaaatcgggatgaagaagccgtaaccaatagcatccaagcgttcgcgggtcgtttcactagggttcaagagtttcaagacgattccggccacaaaagcgcccaggatgttttcagcaccgacggattcggccaccgtgaccatcgttacaatcaagaagaaggctaaccgaatatctagttgtgtcgtcgatttgttaatattttgatagaagcggaagaatggtttgaaccgtaagagtaatagtgcggcaacggctaaaatgagtaatagtaaccagagactttgtgagttactgccgtagacggatgcatagagcgtcagtcccatcatcggtacaagttcaccaaagaccgagatgagcagaatcgtttgtccgaaagccttactaagcaattcctgttcttttaaagctgcaattacaataccaagtgaaatcgtgccaaataaaatcgcggcaagccagaaatcactgaagaggccgctgactttaaaagcagcggcgagtaacagcgatagaacaataattgtgctgtaggcgtacaccgaaagtcgaactggcgaatatttcggtgtgttgaccgcgtttttttgttctaaaggtgttaatgccgtgcgccgcttcttaaataggctaaagtcaatttcaagtccacttaagaacagcaggacgatgacgccaatcgttgagagttgtgagataaggtcagaggtgttcacaaagttaaacacgctggggccaattacgataccgacaatgatttccatgacggccgttggcaaactgttgattttgaatttagccatgataagcggaattaataatgcggctaataaaataatgactaaggaaacttgatccatgaataaatacctcgattcgttttagtacacacggagctgatcatcatcaaagccccagaaagcttcgctagcatgtgcatcggtgaaaactttcaggatttggtcgacaccaggggctaatttgtcaggcgtcagttggctcaatggttgccaactaatggccccctcgtatgagccggctagcaaatcaccgtgatagtgactagtggtgtataaggtgccaagtgacacgtcgccgtccgcattttcgacccacgttacggtgccgactaatttcaattgatcgacgtgcaagccggtttcttctaatacttcacgcttcatcgcggttacttgtgattcaccgcgatcaacatggccgccgggaaaagttaaccccgaccactgcgcgtcaatcttattttcaaccaggacatcgccggtcgctggattggtgatgaggcacatgttgacgagttctgcacggacggtccggtcgtggtgttcatgctgatccttagtggctaaccagtcttgggccttgtcattgatgcttgccatgaatgctgctttcgtttgtaggtaggctgcgagatcggcttgcccattgcgcacacctttttcgcgaatggcagtatacttgcggccgtctgtccggtgtgcattgagataatcccggaaagtgagcaattgctgataatgctgttcatcagttgtaatgatcacgtggatgtcgttagcagctaattgcgttgcgtaagtatgcgttgttccagcgaccggtcgtgcgtgtaacgtagctacggcagccgcctgatctttaacaagcaacgccaagtcaattgttggacgcgctaataattggggcatggccgtactacccacgtgactactttttaatagattcgcctgtaattgctggcgtaacaaggtttgatactcgattgcttgcttttgccagtcagattgataggcagttaattgaattggttgcatagaatccctccactcgaataagtcattgaaaggatacactttttgagtggttttgaaaaggaaagacgtgcctttcaaagcgagaagcaataaaaaaaacacgattgcagatcaaccgtgttgtgtgtggcgcttatttgagattgagtgttgtccgttgtcgccaggtcttaatcagcgcaaccactgtggctggaatgagcgcggcggccataattcctagaaaacagagcgagaggtggttctgtacgaagctgatcgagccaaagaagtaaccaagtgaacagccgacactgacccagataccaacgccaactaagttccagatagcgaaggtcggttgcggcattttagcggccccggcactcagcgggacaaaggtccgcacgagtggaacaaagcggccaaacatgacagctttcgcgccatacttagcaaaaaattgttgtgcgcgttgttgcttggattgggggaggtggcgttgcaaccacggtaagcgaatcaggtggcggccaatttcgaaattgacagtgtcgccaattacagcagccacaaagaatactggcaccagaatctgaatactgagggcgtcgctgtgagttgcagccatcgtgctggcgagaaagatcaatgattcgccgggaagaaatgggaaaacgaccatgcccgtttcaagaaagataacggcgaataataagatgtaagaccaactaccaagcgtggttaatagtgggacgatactttgttctaaatgggttaaaatggttattaaattgaccaacggcgccacctccaatttaagttgcatttattataagcgtctgcgggttgaaaaacagatgtaaccgattacatttctttcagtttaacacaatcgtaactttgatagaccaatgttcaaacaaatttgcataaaaaatcaaaaactggcggctgccatgggttattaattgagtcgggccgccgatagtgataaaattattgttcgatatttaggaatggagggcgttcaatggctaagtcaattaaagctgcagaacaggaacacttagatcatgtggttgcgaaaattaaggtggctgaagaacaacaaagccaaaccattacgcgctcggaaaaagatcaggccgatattaaacgtgacttgctgaataacatcaatattaaaacggatagttacgaaggcatgatggagaccggattatccgtgcggcagcaacaacagatgatggatgagcggcagaatagttggaagcacgcgactaagcaattatcgacgttaaaaaagttggaaaagaatgcttattttgcgcggatcgattttcatgagactggtgagcctaagcctgagacgatttatatcggactcagttcattttctgacacgccggatcactttttgatctacgactggcgagcgcctatttccagtatttattatgacggtgggttagggcacgtgacgtaccagactccggatggtgagcagaccgttaatgtgaagttgaagcggcagttgatggttgagaatggccagatcgtgacagtctacgatactgatgaagccgttggtgactcgatgctactagaagtgttggatgaaaagtccgatgtgaagatgaagagtatcgtgacgacgattcaaaaggaacaaaataccattattcgggatacgagttctgacctcctgtttgtgcagggggcggccggttccgggaagacctcgtccgttttacaacgggtcgcatacttgttgtatcgttaccggggtaatttgacggccggacaagtcatcttgttctcaccaaatcaactctttaatgattatattaaccaagtattgcccgaactgggtgaacaaaacatggttcagatgacctatttccaatacgcatcgtaccggttaccacacatgcaagttgaaactttacagcagcggtttgaaactgaaaatacaccgcagatggcaaagattacgaagttggaaggtagcctcgcattcttcaacgcggttaccacgtatggccgacatttggaacaagcggacatgcgtttccgtaacattacgttgaacgatgaagtgattatttcccgggaaaagattaaatcgatttactactctttcaacgaaaactaccacttagcgaaccggttatcagcaactaaggaagaattaatcaagattttgaatcgcaaggttgaatcggagatgcgttccaagtgggtcgaagaagcggttcaagacttatcacgcgaagagatcaatcaattatatggcaatcagccgcgggaatttaagaatggcgataaagagtttaaattcttagcacgtaaaattgtgatgcaacgcttaggaaaagcccggacgcaaatcgtgcgtaaccgtttcttgagcatcaacatgcagtacgcgcatttcttacgcgaagtaccgaagatcatcaagttggctgatcacggtatctcagctgctgactgggatgctacggttgaacggaaactagccgagattaaggaacgtcatatctcgttaacaacggtctcagcttacatgtacctgcatgacctaatgaccggaaagcacgggcagcgtgacatccggtttgtcttcttggatgaaattcaagattacaatgcctttcagttagctttcttgaagtttagcttcccccaagctcgcttcacaatgctcggtgacttgaaccaggcgatttttaccaaggaaaacagccattcgctgatcaatgaattggccacgttatttgaccctgaaaagacgcgggtcgtgcaattgactaaatcgtaccggtcaacgcaacagattactgatttcaccaaggaaattttagtcaatggtgaagccgtcacggcttttgatcgtcagggcgacttgccaaatgttgttgtgacgcctaactttgaagcgggggttgatcaagtcgttgatcagctagcgatgaacgattctgaacgtgatacgacggcaattatcgggaaatccttagcagaatgcgaggcgctcacgaaggccctgaaagctcgtggtgagcaggttacgttgattcaaactgaaaatcaacgcttggctcccggtgtcattgtagtcccgtctttcttagcaaaagggttggagtttgacgcggtcatcgtgtggaacgctaatcaggaaaattaccaacgtgaagatgaacggcaactattatatacaatctgttcacgggccatgcacgagttaacgttagtcgcggtgggtagcttgtcaccgttactagcgcgggtgaaccacgccttgtatacattaaatgaagcaaaagtttaagtcagtttaagacagtgagtaccgctccattcacctggagtggtatttttttagttttacttgtgaaggaaatcttaaggtgtgtcaggatgatcagtggtggaacagttggggaagtgtgtcggaatagctgagaaaacgctatcatagcgatggaataagcgttaaaattaactcatcaagtgcagtagtcggtgagagacaatggccttaatactgactaggcacacaatatcgtgaaaatactaacaactagttagaacggttgttagtgacctgaggaggaaacgacgatgtcaatcactgaaatgttaggtattcaatatcccattttttctggtgccatgatgcgaattgcgacccatgaattagtcggggcggtttcggaagccgggggactcggtgttttaggttcagcggggttatctgccgaacagttgcgagcagagatccaagcaacccgcaagctgacggataagccgtttggtgtcaatttaatgttacagatgaagaactgtccagaactggcccaagtcatcattgatgagggggtcaaggtcgtgacgactggtgcgggtaacccgacttcatatattccgccgctacacgcggccggtattaaagtgattccagtgattgcttcggtccaccatgcccataagatggtggcggccggtgcggatgcggtggttgctgaaggtcaagaatcaggcggacatatcggtcaaacgtcaacgatggcattattacctcaagtcgtggacgctgttgatattccggtgattggtgctggtggtgtcggtgatggccgctcgattgcggcgatgtttgcgctgggcgcccagggtgtgcagtgtggcacgatctttttgacagctgaggagtgcccggttccagctagttataagcaacgggtattggctgccagtgacacggatacaatcgtgactggccgcagccagcgcgatccggtacgggcgctagttaacccgatgttggcgcaatacttgcaattggagcaaactaacgcgccggtagcagaattacacgcgttagcggacggttcatttgcgaaagccgttgaagatggcgatatggaacatggtacgcccatggctggcgaagtggcggggatgatgacgacaattcggccagtcaaggaaattattacgacgttatttggtcaggctcgtgaggtcgcggcacaactgaaaatcgaataagatacagtagcatagctcggtactaggtcagcgttaactagtatcgagctattaatggttattggctatcaattaggaatccggttaatttgaattttaatcagcgtttgataagggtttcatgttataatcaacccattaatttagtaatggtggcagacagaaatcatggaagatcagatgaactattatcgcttctcacgtgaacagtggaagcaattttatcgtaacaatcagcatcaagtaccattgaccgcagccaatttgcacgaaattgaggcgtttaatgaccggattagtctcgacgatgtccgtgatatttatatgccgtttgcgcatttgttgcaggccaagtatgaacactacttgtcatggcgggaaacggagtccgtttttttacaccgccagaaccgccaatcaccctttattattggagtgtctggaagtgtggcagttggcaagaccaccacagcacggttattagagattctatttaaatatttatatccagaccggcggacgcaattgattacgacggatggtttcttatacccgaatgccgagctcaaaaagatgcaattgatggaacgtaaagggtttccggaaagctatgatatgacgcggctgatccaattcttgaacgatgtgaagagcggaaagccgttagcgaaggccccggtatactctcatcagacttatgatattgtgccaaaccgctttgacgtgatcacgcatcctgacattttgattattgaagggattaacgtgttgcaattgccaagcaatcaggcgatctacattagtgattttacggacttctcagtgtatgtggatgcggatgccgatttaattgaagattggtacttagaacgcttcaaggccctgatgaaaacggctttccaggatccgacgaattatttctatccttgggcgatcggtgatccgaaggacgcgatggcgatggccgagcgtgtttgggaagaggttaacttgaaaaacttgaatgattatatcttgccaacccgtaatcgtgcggatttaattttgcacaaagttgcgcatcatgtgattgatgccgtgtatttccgcaaatattagcacctaagaaatttctcatactggttgaccgaacgtttagaaatcagtatgatagacctattgagcattaattaatccaaaggagtgaacaacttggcaaaaacggataccgcgtctttcgattccattttggtattggatttcggtagtcagtataatcaattgattacccggcgcattcgtgatttcggcgtttattcggaactacttccgaacacgatcaccgctgaagaaatcaaggcccgtcacccgaaaggtattatcttttctggtggccccaacagtgtttacgatgatggcgcctttcgggttgacccggagattttcaagttgggcttaccaatcttggggatttgttacggcatgcaactgatgacctacacgcttgcgggcgggaaggtcgaatcagctgataaccgtgaatacggcaaggcgaacattgacgtgacgagtgactcggcgaccctatttaaggacacgccagctgaacagtcagtgtggatgagtcatggtgacttggttactcaagcacctgatggttttgacgtggtggccacttctaagaactgcccgattgcggcaattcaagatgttgaccggaagttatatgggattcaattccatgctgaagttcggaatacggactacggtaatgatattctacggcactttgcatttgacgtttgccaagctgaagctaactggtcaatggatgatttcattgatatgcagattgaaaagatccgcgctgaagttggcgacaaaaaggtcttactgggactttccggtggggttgattccagtgtcgtcggtgtgttattgcacaaggccattggcacgcaattaacaagtattttcgttgaccatggtttgttacggaagggcgaagctgatcaagttatggcgagcctagaaggtaagttcggcttgaacatcatcaaagttgatgctaaggaccgcttcttaagcaagttggctggtgtcagtgatcctgaacggaaacgtaagattattggtaacgaatttatccaagtgtttgatgaagaagccacgaagttaaacgggatggaattcctcgcacaggggaccctctacaccgatgtgattgaaagtgggacttcaacggcccaaacaatcaagtcacatcataatgttggtggtttgccagaagacatgcagttcaagttgattgaaccgctacggacgttatttaaggacgaagcacgggaactcggtgaaaagctagggatgccgtctgaccttgtttggcgtcaaccattccccggccctggtctcggaattcgggttattggtgagattacggaagataagttagaaatcgtgcgcgatagtgactttatcttacgtgatgaaatcaaaaaagccggcttggaccgtgaaatctggcaatacttcaccgtattaccaggcatcaagtcagtcggtgtcatgggtgacggccggacctacgattacaccgttggtattcgggccgtgacatcaatcgacggtatgaccgccgactttgcacgtattccatgggatgtcttacaaaagatctcagtgcggatcgtcaatgaagtcgatcacgttaaccgcatcgtgtacgatgttacgagtaagccaccttcgacaattgaatgggaatagaaaatcatataaaaatgaaatcgtaatattgatttaacagtatttgtgagcttataaaatggatgaattggtggcgaatctgaaagatttcctatcaacagtctcactaagaatcgtggaggtctttagtcacttaggagtgattaaggatttgcacgattctttttttattggattcttgtttgttcacaaaacattgcggataatgtaagtaagtagagatgtatcatatagagtgtggaagaactgttatggcaattacagaagtttaagactaaatctaattgataattgatgaaccaaatcacaaagagtttgttagcacttttgaagagtgaatcaaagagaacccagaaaataatttctaagttatgaaagtggtaatgatttttacaaagaattgaatgaagcttattaaaaaacaaacttttatttaagcgtactaattcagatttaatgcaggcgtaatatcgatggtgtaataggattatgaatggtttgttttcagaagttagtgcaatcaaggttaaattctgagtgataattttattttttatcattagtaggacattttttgacatttgtgactagtgatattgcagtgcacgatacaaaggtgatagtgtagttagtatagaatagtgagtgaaaaggagtgaggaggggtcatgagtaattatctagtgggtcctgataagaaaaatctgtttggtcggcggtcaacgtgggattttgatcaggcaattgaagcgtccagtgatggagatgtcattgagattgaggcgggatttgatccgttcaacggtcaaaataaccaatctatagttattactaaaagtattacaattcagggtcacgttgaaaatagagagaatgaacatatctataccaatacaatcgatggtattgtagtgaaggatggagctacagtaacgttgcaaaatatttgtattcagaaaaatactgataagagtaatgcaattactgtgcgtatgggttcaactgtaattgctgaagatgtttacttaattaacaaatcaacgactggaacaaactatccaattgtgtatattagtggaaattcacatgtacaattaaagaatgtaacagtcggagctagcaaaatttcagatggaaagcatcgtatttacgtcgagaattctgagctgactattcgtaattcatggatttgtgcaaaggtgtatttgaagcatgctcaatttttatgtcataaaagtcaactagaatacacggacggttgtgtgcttaacggaaatgaacaaagtactatccaattaatatcgtcaactttaacgggtggaaaaattctgtctaaagaagtgtatccatgcgttcatatatgtgattccaaattaacctgtcaagattgttctattaatcagcccaagtttgacatggctctattggtgttaaacagtcaaatgacacttaaaggtggtcaagtggattcagttagtttagatcacaccacggctaatattaacgaaacactgattcgggaaagctttgcaatcgaaaatggaacacaagtcactggaaatcgcttttttattctagggcgtgacaacggcaaagtaaatttgtatattgcgggccgctctaatattcaggtctgccatattatttttggacaaatctcaaatccaaatttgaaacttgaacggaatgtagatatcggtaagacagcattagattactaccaatataatttaaacaatgggacgtttgtggtggatcaaacaaatcattacatttccgcggacaagcaggggcaagtgagttattttggtaaaaagcctgcgttggatcgtctcaatgaaatgatagggattagtggagttaaatcggagattaatgaatttattgctatagcccaaatgaataagcagcgtaaggagcaagggataagtagtgatgccatgacactacattcactattcctaggtaatccggggacaggaaaaacaaccgttgcacgtattttaggtgaaattttatttgacaaaggaatcattaacgatcagaaatttgtcgaggtttcacgttcggacattgtaggacgttatattggcgaaactgcgataaaaactcgtaaagttctagagtctgctcttggcggagtcctatttattgatgaggcatatacgctagctaacggggatgagaaagactttggacgggaagccatcgatgagattttaaaattcatagaggatcatcgtgcggatgttgttgttattttcgctgggtataccgatcgtatggaaaagttcttaaaaatgaatgagggactgcgaagccggattcctaatcactttatgtttgaagattatacaccccaggaattaattgaaattggctggaatgacttaaaggctaaaaattatattgtggataaaactgcatacacggacttagttatgcataattttaatgtttctcacgatcatagtaatggccgctgggttcgtaatcttaatgaaaggttaatcaggaaatttgctgttcgtgtcgccggccagcaaggagaagacctttctgcaattaagcagcaggatattgatgctgcaatgttatagtgacaacagaggagtagtgaagaatgacagaaaagaaacagtatgttcggccgcccaagccagtaaagataaagcctacggtatctaggaaaaaacttagccataaattagacgcatataattatttacatcccgattattggaagcgaaagttagctcacttattactagtaataccagttgtgtggaccatttatggtatgattctactggccatcttttatccaggtatgcaatcaggaattggagttactgttagcttattaggagtaacgatgagtgtattgcatattgttctgacggcaataagtgcttatttctatccatttagtttgtactggtatcgtgaaagtttgataggacgcattttaaatggcatgtggtactttggtggcttctgggctgttattggaaaaattattgtcacactgattggtggcattttgattgcaggtcttttggcaccgattgctggaccaataacattacgtcgttgccgacgaaaaaatataatcattggtgacgcaaaagattttgaatagaatattattaataataagtaagtggatctagaacctgttgcagtgctatgatccctttatggttgtcagatgaaataatataattcatctgacaaccatggagggattttttatatgccaaggtctagacatacaccggccgaaaaattggctttaattactgattttcagagctctggcctttctattagcgcatttagcaagcaacatgaattgagttgttattccattagataatgggatgttatgctatcaacgtgacggtattgatggactagcagaggccactaagaatcagcactacagtcagactttcaagcagaagatcattcgagcatatttgaatggcgagggaacaattcaaggattaactaataaatatggattacgttcaacttcacagctaagaaactggccaatcaagtataatagggacaaactgtgacggcttcaccgtctagaaagcaggtcctaaaatgagccgtaaaacgacttttaatgagcgagtaacgattttggaatggattaataaaggtaatcattcatacagtgaggccgccgaacatttcaacgtttcttatcagcaagcccgttattgggccttaaaggaccaagctaaaggttttgaagttttggtcgataacctaggacatcgtaaacccgaatcagaattaaccgatttggacaaagccaatctgtggattagacaattagaatcacaaagcaaggatcagcagttattagaggctttcataaaaaaatatcaggaactttagcgcaagggtgaattcacaacgtcgactggcttaccacgcaatcaaggaagttagtcaaaataatcacggtacggtcactaagttattatcaatactcaaagttagccgccaggcatattataaggggctccatcgtgacgtaacgacttgggaaattcgagataacttcttaactgaacgggttcaatactggtataaccaacatcatcaaagtattggcagctatctaatctcagaaaagacccgaccgttaccgaacaggtgacgttaaagcaagttaagcgaattatgatcaagcttggaattcgttgccaggttcgtcagaaaaagcattcacggatcaaacaacaggagcaatacttacaagataatgttttaaatcagcattttagcgttaaccaaccaaatcaggtctggttggccgattcaactgaattaatttatggtgttaatggtcagtataaagtacgcttgagtggctactgggtctttgcggtcgcatctaattgcccataaactaagtgaaactgaaactacgaatgcggaagttcaggtttttcaacgggcctttaattttgcgggtgacgtccaccctgtagtgcatactgaccgaggttcggcatacatatcaggagtattcaataatttttggcgcaacatgaggtactcgtagcatgtcacgaccaggaacgccatatgataacgcaccaatggaacgatttcaaattacgttggatggaccgacatgccaaaccagctacctataaagaattagtggccttggttgaagaaggcagcaactactttaatcagctagaccgttcatcagcaagaaacgacctcaccccagcggaatactggaatgaggccgtttaagtagagcaaaacttatattatttcaaatgacaacttgacagatactcgtacagtaggaactccaatgaaagaggttttcgtcttggtgtttttattttgtaaaaatactagtggctaacttgattttaaaactcaccatcaatgttccgtctcatttcaatgaattttttatatctaggatattgaatgtgatgaaaatctagctcaggcataatattgattagggaactgtcgtgaaaatgcgtgttattcaatagccattctatctttctgtaacattcagcaactacttcatcattactacattccataaaaatcactgaagtgacaaaaatatcgtcaatattatcttcagtttttttcaaattaaagaaataacgctttaatgaattagcaagatcatctagattgagttttttgggattttcaatatagctgaggtaaatatttgcccaggtgattccagtttcgtttcctattgaggattctaaagtatcaaacgtaacctgtttgaaggtctcaggttccttcataaacttctgtattgtcttaatgggaggtttcaagagtgctttagaaacttctgtatagtcagagttccaagtacttatttcaaaaaagtttccaatcaatctttttactagagaacgtagcacgtcaaattcagatacgttttgagaaatgttaaaaaatggagtcagcggccaccggaatattggctgaaataaaaatctgccgtgtgcaatcgcatttctaagtttaattactgattcaacgaaatacatatcattttctgaatctataccattttttgatagtaaatattttatttttgtgctaaagttagggctctttgcgcctagagctgttgatacaatcttataattatcgttaacatagttatcaagttcgtcattccttgttagcataagtgaagcatattctttcaaacttgactttattttgctttccgcaattttctttaattcatcttcgcggctgttactcaatagttctaaaatttgaaagagtccaagtaaagcttcatcacgatataaattgctttctaaatcctcattctctaggttgagatttttgcgccatcggtcgagtagagaaatagaaaggtttttatactttgaatcattgattttaaataatactttttctaaatcttttgaatagtcattcatttcggtttgaaaaatagtttttgggggattgtcgataccatttttaaccacgaaagaggatcctgattcagtaatgtcataaatagtgatgggacattcaagaaatagagaaattatcccttgaatgacaagtaaccatggtctcattagtcttgaagtttttacttgtgaataaattgggtctatattcaattcaccacgaactgcaattacagtgcttttatcacgactaattgattcaactgttataccattgaagctaaaatatattttgatattacttaaatcgtaagtattactgtcgacagagtgaactgtaaaaaagtgagttttcaaaatgttttcatcttctctcaagttttagtaagcatacatttttcttgcttttatacatacatcatatcaataaaaatttcatttaaaattttttcaagcattgtcagaatttatgatagttgaaggattgattcagcttaaacgctggctgacaagtgtacttatcggcatttatcgcaagtatgtcaaatcagaattaaatagcatatcgaatccatccggtaaggatagttattctatattcatcagttaacgttccacgggcgtttctaagagcagtagcgataaacccggtgatagtagtcgctatgaactttgaagtgttaacaaattgttggtaactttgttagccaacgggcattcgaatgtcagtattgagaaatgtgtgcatagcactgagtaaatttggtttgctttgcaattgcaaaagacttgtcagaattcgttaattgtaacggccttttataaatggtttgcacaattggaacgtacgttctttttgggcctgaataaaagcccagttaagggctgatattactaactgattgcagattagactatgcttgtggttgactaaaatgctttaatgaagctaaatataaagatccaccaataattgcgagaattccgccaatccaacccaagaatggaataagcgcgattgcgccgccgacaattagtaaaacgcctgatgcagtaccgacacgcttatcacctttataataaattaatgcaataattcctaatgctaaaatagcaattttcaaaatgtttaggaaagcggccgcacctgatgtattagatactgatccagtggcagcatcgctaacaataccaccagcaataaaccagcccccgaataataaaataatgccgccgactagccctacaatcccgttagtaagtgctaaattttttgacttcatgttgaagctcctccctttattaacagcttttcgtgtcgatcagtttattggacataagttgttgaagcctacccaaaccattaatccccgtattgataggcttatttttcgtataaataaacaaaggtgatcaatattctagccgataaataagctttccataagcgtgcccgaagtaacttggttcgaacattaagatacttcatcgtaaggggcgttagtcgcgtttagccctattcccagaagatgacggccattgctactcgtacttgttggcgttcttcttccgtaagtgcttcgcctccgtatgtcatcgaatccacatgagctgtgagaaagtcttttaagtcagtggtatcttttctagcaatccatttagatgcgctatcttcacccagcaggtagtcggttgtcacatcatatagatctgcaatctgtttaagcatgttcaaatctggctcattcgtgccatattcatagttagcatatcgctgcatactgctcaaccctaatttcctggccacctcagtttttgaccagttccgactgtcacgaaggttaattagtcttcgaatgaagttgttttgtgtttttgctggcatgttatagtctcccaatgaacgtattgtataatatttaaacgtaaaatttatatttttaaataaaaaatttaagaaataacttatttaaataaactatttaatataaaacatgatttatcgatataaattaatcgcttgttaattataatgcattcaggttgttggaacaaaatagattagtatcaagtgttatctagatgatggttttattcctaggatgctactagatttagatacgatttttctcactttaatatatacggagataatgatttgagaattagtatgatttggaatatcggcagagttctccaaacagataaataattaaaaataggtggttagacttaaaacgatcactgttttccgatgattatggtttcttaagatagactggtcaaatagtgcaatcataatttcactctgaagaggtgattgttcacaatcaaatggtcttcattatggtattatgacaaggacactagtggatgtttagtcagcttggcggactaatcccaaaacgagctgaaaagctgatgcaaacacataaggaggttggaaaattttgaagtcgaatcgttctattgtcacctggctcctcaatatcgttaaactaattggtctattcgcactatatcaactcgctatgattcctacgatgatgccagcaattcgacacgggttctcggccacggcaacactaattgccggagtggcaagtttagtcttgctcggattactcatttggtggctggtaacgatttatcgtcgtcaagcgccaatcgtgaccagtttatcacgaccgacacgtccggtgttaacgatagtgggcctatttatcctggttgagttaggtaacgtgttggcgggacttatcgtgaaacaaacccctgaaaaccaagtgattttggataaggtatttactactagtccagtcattaatgttgtcatgatggcagtactggcaccgattgtcgaagaactgatttttcgtgggctgatgtatcgttggttatttccgcgggtcacaaattgggtgagtttcacggttgcattagtttttgcgagtttagtatttgcccttgcccatacgttatcatttagccctgcgctactagcctacttaccgatcgccgtcgtgctgacttttacgtacgtgtggttcaacgatattcgctatagtgtcgccttgcacattatcaataattcattagccatggttggcatgttgactttgctttcacgttaacacaggttatcctaccgacatagcggttgacattcgcgtattagttgcgtgatgtgtaatgattaaaacaggcaacgtccaaattttgggcgctgcctgttttattaatagcggtgtggttgatgtagtggtaatcattgtttggtcacttaataatattaaacagttcagttataccaagaatattattatgatacaattttcgatggaggtggcgagatgcgtacaattacaccaattgagaacagtcggcgacatgaagaattttgtccattggatacaactttgagtatcttgtcgggtaaatggaaatcaattattatctgtcgattaatggggagttcgcagcgcttttcgtccttattaaaaggcatgccgggctgtaccagtcgaatgttggcgatgcaactaaaggaattagttgcggatcagattgtgagtcaacaaacggtcgctaatcattcagtttatgagttaacgaacattggaatatcactagttccaatcgttaaagcaatggatcgatggggggaggcttaccttgaaacgttacagttggcgtagtcgattggtcaacgcttagactaagtataggacgtcattattagccactatttttaacaatcataaaaattgctcgcaggaatcttcggagcagtttttttaatacgcattaaaagctgattgtctcaaagctaatccgaatagtggctaagtgcatttgcaatcaatactgcgactaataaggccgtggccgctgcaatcgtcactgcgtaaaagccaattttagttaaaagcaggccgccagcggcagatcctaacgttaagccatagtataaaaaagcactattaaatgacatgatggttgaacgattagatggcacaatattaacgattgtcgcagttaatgcagtgacaccccagccttgagataaggcgagcacaaccagaataatcagcaatactgctaaatgttgtccccagatgcctaaggataagactaatgtagctgaaactaagccattaattgtaacgctctgttttttaccaagcgatgatataagtttaccggcaaagaaactcgcaacaaaattagcacttccataagtgataaagatgagaccagtttgcattgtgttgaaatgaaaggtcgcggttgcaaaaacacccaaaaaggtataaacgccatagaacccagtcatccaagttaatgtaatcagtagagcagcgatggcgtgaggagtgtggactaatgtcttaaaacttgtaaaataaccgtcaggctgggcattctgactcggtaatgaaggtatggcaatggttaaaatcgataatgcaatcaaggttagcatggctgaaccccagaaagccatatgccaactactgagttgtgctagtaaagcaccgagtggtacaccggtagcaattgataatgaaagtgccgacataacgatgcccatgacttggttaagtcgttgaccattgaagtaagtaccgataaaagcccaaatgtttgggacaaataaagctgcaccgatgccagcgatggcacggtaaagatagaatgttagcaatgagtttgctaatccacagagtagtgttcctagtaagaagatgccacagccactgattagcaaaaaacgtttattaaagcggtcacctaatgggccgaataaaggtgcaccgatggcataacatagtgcgtaaacggtgactccgtatgccgcggtgttagtcggcacatgcagactagtagcgatagcggggagtagtgctgaaataataaatgcgtcagcaccagtcacaaaagccccacagaaaaggccaataataagccaattttcagtatgttggttatggatagtgatttgattgaaaataggactcactccttttgaattaggtacaactaggagtttaagggccttacaatagagaaacaagtgaataaaagtataccagcgactgtcgttaatcggatagaaatataccaccctagtttcgtttgtttttgaaaacagtggctattaatgataactaggtaatgtttgattagcaattgttgattatcaaaataactttatactgtaaaattggaacaatggtacttcctgatttgcgacttcttcaacgactaaaattcataatagtcccgattaaataaggttttccaatgttcaatcaggacataagggtgtaaacaccatctagcattatggcatcattggtttataatgatatttatattagattattggagtgagtttatgaataagaaattattgtataccagtattaccactgcggcattattcgtggggacccaattgggtgttaacaatgcgcaggccgacacggcaactgataacagcgatacgacgaatcagacgagtgccacgcaggggagcgctcagacggcaactaacgaaaagttagcaacggtcaaaccgactagtcagcaacagtatcaagccaacgtgcagactgccaaggggaacgtagccacggctcaaaaccaagtcaatacaacacaaactaaagtggcgactgcgcaggggcaagtgactaatcaaagtcaattagttgcgattggacagtcccagtatgatgctggtaaagcccaagttgaccgtgcacaacaaacactggatgctaacaatcaggtcctcgctgaggctgagaataaagtcgacgctgctaagtcgcaaatggcagcagctgaaacacaaattccagctgaccaacagcaaattgcggccaacaaagtcgctatcgccaaccagccagctaccgagaagaaagcacaaacggctaaggacgcggctgacacggccttgacgcaagctaaaactgaacaggccacggcccaatctgatgccgatgcagccagtgccgtcactgccgctaaacaggcgacggttgaccaagcatctgccgcccagcaaaaagcggccacccaagcaaatcaagctaaagtggccgtagcatcagcgcaagatgcggttaataaaaatacccaggcaatcaattctgccaagacagcgattcaaaatacgaccagtcaaattaatgcgaataatcaagctgtttccacagcgcaagccaaagtgaccgcagctcaagcagctttagcggcagcagaacggccaacgaccacgacagaatcgcaaaataagtatgacgctgccgaattcccacaatctcaattgactggggccgaaacagtcagcgtcgcctatccaagtaatggcaagtatgtgcctaatgcggataaaatcaatcagtatatgtttgaatatatcaatcagctacgggcgctgaatggtcaaccagcattgaaacagacggcgacgttgcaaaataatgcgattgcgcgagcagctgcccaagtcgacggtggcttggatcatactggctcaagttatgcagaaaatttaacacaagtttatccgcaatggttcatgagcgatcaagaaacggcctataatgctgtgatgggttggtatgatgaatccaataacattgagtccggttcctttggtcaccgcgtcaacctaatatactcgactggtgatgccggagtagccatcaacttggccaaacacgtggcggcatttgaagtcgataatgccgggatgacggaagcacagcaagacaagtatgttgatttgttcgacaatgcccatgcgaatgccgctactgggactaaggccttaccagctgtcacgttcaattacgtccagacggcccccgctgatccgaagaagattgcggcggctaacgcaacgttgattgctgcaacggctagtttaaatggtttacaaaataccgggaagacattagcaaccacgctggctaaccaaaatgccagtttacaagctttacaaaaccagacaagtggcttacaagcgactgttacgactaaacaggcccaagttcaagtcgctgcaactagtttgaaagcggctaatgttgctttgacgcaagctcaagggcaattagcaatggcgcaacagcaacaactatcgcccgttcgtaatttgaagacagcaatcgcgaagacggctgcggcgcaagtaactgccacgcaagccgctaaaaacttagccagtgccaagacattggtagccgatttgaccgctgaaaatgcccgattggcggccgaaatcgcggccctgcccgcgcggattgcaagcatgaaggcccaaattgctacggctgaacaacaaatcgctgttgccaaggccatgctcgcgcaggggcaggctcaagtcgatacagcaaacgagcaacttgctgctggaaaagcgcaactggatcgtaaaaagaccgatttagcacaacttaagcaggtgctcggcgctgccagagttgatctcgccgttgcacaaggtgatttaacggctactaaagccttcttggcacgcgtcgaagctaacaaatttacaacgacgacggctgctgcggctgatagaattgctgaaacaacaaatgttgctcaatcgactggtgttaccgcaccacatgcgacagctactaaaaccgtagcgaataacaatggtaccattaatgccacgagtactagcgtagatgtttcagatggcgatgcaacaactaagctggttgcgggagctaaacaacagccagttgccgcacaggccacggcgttaccacaaacggatgaaaaacagtcagcgagtttgactgtggtgggattactagcggcagggttctcattattgggtttaacaaagttacgcaaacgcgcttaatttctgagctcaaagctttttagaattattgatcatatgaaataataaaaacagttggactaggatagccgatggataccgggaatgatagataggcaatgaatgcttacctatggttgtcaatcagccgaaatccttggcctgactggtttttttagtggttagatattaagtttagtgaattaaacataaccggtattaacaataaaagacaactcatttttgatattttgtacacggcaaggctaatatttagtaatatattaagtaatacggccattgaagtttttttgattatttaaataaacgaattaaattaatggataattaacggaatgaaaaatgatccgttattaaatgcagagttgcaattgacagccatggtacataatgtgtccgtataatcccgtggatgattgggaaatccagggtggctaactgccgattgctttaaggggaattaaggttgtgaaaggaatagaggtatgggaaaaatcagtagcagaatggtctttgaaattatcacgattatcggtattgtcacttttgccgttatcagtctaacaccatcaacggcgaagcagcaaagtgtgcaattggatcacggacggatgagctacagcggagccgttttgaagcacaagtttgacggtcagggtacgttgcaggttaacaaacaggggcgctacgtgggtaattttaccaatggccggtttgaaggcccaggcgaattcattgcaccgaacgggtggcgtttgcaaggcaacttcagcaagggtgcgttgaatggtgtggtcaaactgcgggtcggcaacaagacttatgccaaaaaaattacgggggacggtaagttagaaaatgcggattaaatggtttagtttagtacggataacgggactcgtgctggtattgacgtatcactttttccaaacccagtttactggtggctttatcggggtggacatcttctttaccttctcagggtttttgattacgtcattaatggtggacgagtttgctcgttcggataactttaaactaatggctttctatggtcgccggttttatcgaattgtgccaccattatttattgcggtgttattggtgctaccgctaacttacttgattgaccacgattttgtgaccgacattggtaagcaggtcgcggcggctctcggatttacgactaattattttgaaattgcgacgggtggcagttatgaaaacaagtttattccgcacttatttgtccatacgtggtcattagcggttgaaatgcacttttatattttatggggcctgattgcgtggttggtcgctaaaattagtcggcggttggcgagtggtcggcgcgcattgacccgttttcgctggggcttagggctgttgaccactgcctttgcgattgaaagctttgtcatgatgtactttggtgcggtcggcttaaaggacttttcaccagtctacttttcaagtctgacccactgttttccgttctttgtcggcgggcttatcggtgtcctgagcggcatcaaagctcaagggccaatctatcgttggaccacggcgcactgcaatccgatcattgcgggcgcggtgatgcttattagttttatcttgttagttgctttaggcgaccggatgaagttcgatgcgctacaaacgtatcagggtgggctgttactggctactgtactcgctggcatcatgatctatggcgcccgattgttgcatgaccacacgccgaacctcaaggaaccgcggtggatgacgttcttagcggatgtgagctatagcgtgtatctctatcactggccgttgtacgtgattttttcacacatgatggtcaactggttggcggcgctgctcacgacggtactgtcgattatcctatccgcgttgtcatactacgtgttagaaccagtgattgcgggcaaacgcgcccacgttttcggacatacagtgacgtggcgacagttgcagttacccgttatcaccgcaggagtgttgttggcagttaataccggggtcgtagtcaaaaatgcgccgcaactttcgacactggaacagaatttatgggtgagcgggatttaccaagatattgataaaatcggaacgactcatgaagctgtgctcgcggccgtgacgcccaagaagaagcaggcaacgcctaaaggtgaccaagaaaaggcaccaggcgtttccattattggtgacagtgtcacgctggggacgcggagctacctgggcgatcacgtcgcgaacagcaatattgatgcggagggcgatcggacgatgaacctggcatataaagtcatgatgaaccagcagcgaagccatacgttacggcagtacgtggtgatttgtattgggaccaacgcgctggatgattacgaagaacaaaccatgaagatcattcatgacttggagccggggcacaagttgattctgatgacaccttataatgcccgggccgatgctgactggaattcatcaaagttggccgttttggaacggcgtctgccagctaagtataagttcattacggttgccgactggggcaagattgcggcgcaacatccagaagttttcaaagggacggatggcgtacatttcggtggcattcgggctggtgatattttatacgccaaggtaatcaatcaagcattgacggcagccaaacagactccggctaaaccagcctaatctagctaagtcagagcagttattagtagtcaatttaatagaaataatcagcttgcgatgtaacaattggcaggctgatttttttatgtttgtggttaaattgcgaagcggcgggattcgttgatggtaattgttcagattttaagtgacaattcgaccagtgtgcatattaattgtcccaaaattaaattatggttatcataagcatgtactcaaatataactgtaaggagtgattagaatgttaggatggctatggtcattaattgttggtggtgtcattggtgcgttagcaggtgcgattaccagccgtgacgttccaatggggatcattggcaatattattgccggtttagttggtgcctggattggtcaagcattgcttggaacttggggaccttcgttagctggtatggcattggtaccctcaatcttaggcgctattatcttagtattaatcgtttctgcaatcttcggcatgcgtaaaaaacgttaggcggtgattagatgagccgcttagctaagtttacggtgacgttagtcggaattgtattggtgttattagcggtttttgaactgggtcagttgtacccgatcccgtggttgacgtcctggttagctgatctgacgattaactacccaatggtttggagtatcttattgatggtctttgccattattgccggaatcgttggtatcttattggtaattgtcggcttgtttcgaccagttaaagtcagcacgttgacgtatgatggcaaggttggccagttaacgattccgcaacgggctttggaacgtgatttgcagtaccgactcgttaatcagttgaatctgattgatcctgaggttcacttgaaattacggcgtcgtcgccgggtacgagtaaaaattgatgcgatggttaatactgacgcatcgttagaaaccacggcccaacaggcggcaaccttggcacaggactatttgaagaatcaattgggattgacggtcgaacaaccagtagtgcaagttaagccagcaaatcaccagcgtaagttaaccgtggtgtaaaggagggtcctgatgagtaacgcacagtatggttttctgattggactgcttttaggtatcgtctgggtattaaccagtttttcggcagtcttattagtcgcagttttagggctgatcggctgggcgattggacggtttgtccacgtcgatttggctgcagttagtcagaagttgagtgagtatttatctaaataatgggaggaattacaatggcacaaccagaacaacaattacagactcaattgacgtttgatgacggtgtgattgaaaaaatcgccggtctagcttcacgcaatgttgacggcgtgttatccctagaaggcggcatgttaagcaatttaacgaaccgctttcgtgatgaagctgacccgacacagggggttgacgcccaagttggtaagaaacaagttgctttagatatgacgatgatcgttgaatatggtaaggacatgcgacaaatcttcaatcaaatttgtcaacgtgttcagcaagatgttgaacggtatactggcttgaaggtcattgaaattaaggtacatgtcagtgacgtcatgagcaagcgtgattggcaagatcaggccactggcaaaccaaatacggatcaatcaacagataagcggcaagttgaatagcacggtcgtttagagtagtcattggtaagacgatttttgacaaaacaaggaggaattttgatggaagcaacagcgacatctttaaaaccagaagttgtttttgacgatacggtattggcaaagattgctagtaacacggcccaagaagttgaaggagtattgagcttacagggaaatctgattgatgatatttccaatcgctttacggataaggatcgcccgcagaccggtgtttcagtggataccgatgacgatgaccagacggttggaatcgaattgacggccattctagcttatggtaagaatggtcaggagattctagcacgggtggcggataaggttgccaaggccgttaaatcaatgactggttatcaagtgactaagttaaaattagtcgttaaagacatgttaacgacagaagagtggcggcaacaaaatgacaagcaagaaaaagcaccagaaaagaaacacccagaaccaaaggatgacggcccacattaatggcagccgtaatggttaaaggtactcgcaaattaggcgggtaccttttttagtgatgagcgttacatgaagaaatatcctgagctaagttcgtaattgcgtttgaacgttcataaagattgtccggaatgaccgtcacgcaactatcattattgttatgattcatgagatgagtgtacaataatatcaatgaggtgattaatatgaaaattggcatgcgggccaaccgaccgtttatcattacggatgaacagcatggacaaatagttttaaatgcgaagacagttttgggagcgctacatatgccagcagcggaccggaaacttggctcgcttgaaacgtttgcgccgcaagaattagcggcaccaatcacggccccgcaacagatttttgcggtggggatgaactaccgcgaccattcggcggagatccacattacgctgccgaaggttccaagtatttttacgaagtttagtagttcactggcaccagcgaatgtgaccgtggtgacgcatggccctgagaccgactgggaaaccgagctagtcgtgatgattggcaagggtgggcgcgatattgcgacggctgatgcaatggcgcacgtggccggagtgatggttggtgaagacttatctgatcgagccgttcagttcgagaatgataatccccagttttcaatgggtaaatcgtttgaaaattacgcaccagttgggccgtggttaacgaccgtcgatgaattagctaacttagacgatgaggtgatcacgaccaccgtcaatggtcagacgatgcagcaagcgccgttgagccaactgatcttcaaggtaccggatttggtgcactacttgtcgacggtctgtgagttacaaccaggtgatttgatttttaccgggacgcctagtgggaccggcgttggtcgcaatccccaagtctttttgcaagccggcgatcaactgtgcggtcagattacacatttagggacgttaaatatcacgattaagtaaatagccatagtcggtaagtgagatgggtgaagatttatattgtaacgcccagcacaatgccgactttttttggtaccataaaagtaattattgaatagggggataccggtacgggaccggtgaggagcaacatgaaaaaagtgtgggtcggattattattaggaagtttattattagcgggatgcacgacgtcgcccaagtcgtcagcgcccaagacgagtcaaaaagcaacgtcaaccaaggtagcggcaaagcaggccgctagccaaaaaaataccgctagcagtgattcttcatcacaggctgaggcaaccttgtggaatacgggcaagcaagcggctttatcaacgtttatggccgcttggcaacgcgagatgggccagacctatgtcgggacgtatgatgacaaggtcccggatcatttaggctttcgttttcccaatgctttgcttaatggtagcttagcaggccgaatcaagtggggctcgcagtcagtggatctcaagtggtccaaggacggcgaagaccgtagtgaatttcaagtggtggcggtcgcaacgggtggtaaggcggaagcacaatatccaaacacgtacttcttttgcctccatcatcggcgaccagtcgtctttgtgactcagacgaccaacggggacgagttgatcattcatgatacgcagaacagtgctttgcaagccggctttgctaagatcattacgggcagtcgaccgacgacgctgacagatagttcgctgaacgtgaacatgagtcgtgatgcgaaggctaatcaatggcctcaaggttatcaggggacttggtattactataataagtacgatcacaagattaattcgatgacgcaaagtgataccgacgggttgaagctatcttatgtggcagctgagggacaaaaatggattcatattatgggggccgagcagactgctggggccggtaactttgaatacgtgcgttatcattattttgatggccgccaaattccagtattaatgaatgctagtggtgcgggggcctggttcgataataacgcctatccttcagcagccgcggcaaatcaaatgcgtgactggcaatatggggatgaatcaaagaccagtccggccgctgactcattagattaatcgagggtgtcatgatcggtagtgcgggcagggataaattaatcactgtgaaaatataatattaatataaaagccgggacaaatgcacgtaaattgccccggttttcattttgtaaagtttatgtatatattgaaaaagtcggaattgttttctgaaaataatgctatactatgacataagttaacggtgtcaagacatctaacggccggcgcattcatgtgaacggcacgacattttaaagctgattgtcgatcatgattgctgtcatttgggggaatggcgcgacgatgaagattaccgtcaacacaagtgtgtacgattggtcaaagagtaggaaatctaaagaaaaaaggtgtagacatgcagaaaaatatggaacacacgctcaaccttacgatgacgatgattttgaaaatcggcagcgcccggtcaatgattgcggctgccttagccgagattgcggcctatcgctacgaggcggcgcgtgaaaaattacgtcaggccgaaactgaattgctgacggcccagcggttacaggtacgccgactgatcgagaatgccaaggctcaacggtttgtgcactcgacactctttatgaatgcccagtcggcactagtcaacgtgatgggcgagttacagatgactgagaatctgattggcgcttttgaacgctgggagccagaagcggcttaatacgaacgtgaagctgacgagtgaaaggtcgtggtactggttcatgattagattttggaagatggtattcggtagcaacttagacggatagagatggggttaaaaaatgacagttacttttagtaatgaagatgatcacaagtttcataagcttactgaccaatgttttactgccaatcctaaattactgacaaaggcaagtatatcagtaccactaactacccgtaccattcagccacgccgttatttggtggtcaccaagatcaatcaggctaccttagcgacagctacgtggcaaccagtcaccggtgcaattgcgctacataagcatgaacgtttgatttatgatttgggagcgctatacgtcggccattttcaagttgccattgacgtggccggttcgccaatggacgcgccgttactgatgcggacaaggtttgccgaacagttgcaagagttaagtgtcgatgctagtcgcgtgaccagttggttgcccacagcctggattcaagacgacacgcgccacgttgaattattgccgaccacggtccagttcgaacgccgctacagctgtcgctacatcatgttggagccggtgggtcagtcgctgaagtggcagccggtgttggcggatgcggagtttgaagaaattatcgatgactttagacaagcggcgtaatatcgtcgttcgcactaatgattatcgatatcgtacggtgcaaggaaccgtgtcatcattagtgatgggggttgtcgagaattagttgctagtcgcgtgacaaattcatgggcggcagaggacgcattccacccgtaattgtcgtataatgaatatattcttaaaaaacgaggagaataatatggcaaccacaactcatttttacgaaacatttcaaccagaacattacgatctttatatcaatattaaccgggcggataagctgatttcggggaaatcaacgattaccggggatgctaaggcgcaggaagtgctgattcatcagaatggtttgaccattgctggtgtccaagccgatggtgcggacgtgccctttactgtggataatgcgattcaaggaattcgaattgaacttgccaaggccggtcaaacaactttgacgattacgtacagtgccaaattgacggatacgatgatgggtatctacccatcatattacgaagtcaacggtgtgaagaaagaactaatcgggacgcagtttgaaacgaccgcggcccggcaagcctttccgtgtgtcgatgaaccagaagctaaagcgacttttgatcttgccatcaagtacgatgaacatgatggtgaaacgatcttaagcaacatgcccgaagatcatgaagccgatggagtgcattactttgaaaccacggtgcggatgtcgacttacttgattgcgtttgcctttggtgaattacaaggcaagcagacgaagaccaagagtggcgtgaccatcggtgttttcggtactaaggcccacaaggctaacgagctcgactttgctttggacattgccaagcgctcaatcgaattttatgaagatttttatcagacgccatatccattgccacactcatggcaattggccttaccagacttctcagctggtgcgatggaaaactggggcttagttacttatcgggaagcctacttactattagatcctgacaacacggccctcgaaacgaaacaacgggtcgccacggtgattgcccatgaacttgcccatcaatggttcggtgatttggttacgatgaagtggtgggatgacctctggttaaatgaaagtttcgccaacatgatggaatatgtggcgacggacgccttagaaccagactggcatatttgggaaactttccaaacgtccgaagcatcaatggcgcttcaacgggatgccacggatggggttcagtcagtccacgttcaggtggaagatccggccgaaatcgactcgatttttgacggtgcgattgtctacgctaagggtgcgcggatgttagtaatggcgcgggccttagttggtgatgatgccttacgagcaggcttgaagcagtactttatcaatcataaatatggtaatgccaagggtgatgacttgtggaacgccttagcggatgcttctgggatgcaagttggagacatcatgcattcatggctggaacaacctggctatccagtggtcacggcagcggttgttgacggtcagttgaccttgtcacaacaacagttcttcatcggtgaaggtgaagaagtcggtcgtcaatggcagattccgttgaatagcaactatgaggcggcaccagcgattatgaaggaccaagctgtgacggtcggcgattatgctaaattacgtgatgcgagtgggcaaccatttcgcttgaacgttgggaataactcccacttcatcgtcaagtatgaccaaacgttattggatgatattctagcgcacgttgatgacttaacggccattgaccagttacagttgttacaagacttacgcttattagctgaaggtcgtcaaatctcatacgcagccgttgtgccattattaagccggtttgcagccagccattcaacggtcgttaacgcagcgttgtaccaagttgcgggtaacttacgtaagtttgttacgccagattctgatgaagaaaagcatttacaaacgttatttgaccaattgagtgccgctcaggttaaacggttagggtggttgccacaagctggtgaatctaacgatgatcagttgacgcggccatacgtcttgagcgcggctttgtacgccaagaatagcgcggccgtattagctgcccatgagttattcgaaggtaatcgtgataagttagcgaccttaccagccgatgtgcgggtcttcattttacggaatgaagtcaagaactttggtagcaaggacttattcgatagtttattgacggcgtcacggcaaacagccgatgctagttacaaggctgacatttgtgacgcattgaccgcaactacggaccccgaattaatcaaacagttagttgtgaagtttgaagatgctgatacgattaagccacaagacttgcgggcctggttccgcggcgtcttggctaatccagctggtgaacaagcagcttgggattggattcgcgacgaatggtcatggttggaagccacggttggtggtgacatggaatttaccacttacatcaccgtcatttcccgggtcttccatacggctgaacgtttagcagaattcaaggcgttctttgaaccaaaaatcaatacgcccggtttaacgcgtgaaattaagatggatactaaggtaatcgccagtcgcgttgccttagttgaagatgaacgtgatgcggtgaatgcggcggtcgcggaagttgtaaaataagttaatattcgttataaaggtagttcggtgctggacgtttcagcgcgggctacctttttagtttgtgcggtaagctcttttgtcccttgatctttcatgtataataaagccagatagattttttaacacgaggatgaagatatgcgatacaacaaaattgaagaaaacattggcgacattgagccggttgtagaaattgttccatataatactggttataatgttagcctacatagagatatgcagaatagagagctgatatttgaatatccgacagtctatttaatttatgataaattaggttctggccgcagtagtaatgaccctaagttcaaagtttatgttggagaaactaacgacataagtagaagaacacgacagcatttaaaagatactggaaagtcacggatggattggaaagcattaaatgagagtcataattcacagatgattgtaattggggactattattttaacaaatccctaacgctcgacattgaaaataaattgatgatgtatttattaagtgcggagagtgttactcaattgaataatcgacgctcaaatccgcagcgaaaatactttatgtcggatcagtttgagaatgtgtttgaaggagtctggcaaacgcttaggaaaaaaaagcctgagatttttccggaaaaatcagaaattgaaaattctgctgtgttcaaagcgtcacctttccactctttaaatgctgaacagcatgaaagtaagaatgagatttttggtaaaatcgagtctgcactgaaggaatcatctacggaacgcggtaagacaatctttattgccggtcaggcaggaactggtaaaaccgtgttgttgagtaatttgttttacgacttaacgaatagtagtttagtgcggaaagattcagtatatttattagttaatcacgatcaacaaaaaacagtttataaaacgattgcacataaattaggtttggatcacgaacataaagacatcgtctccaaacctactcattttattcagaaacatactggtgcagcaaaagttgatgttgtactagttgatgaagctcatttactcctgactcagggaaagatggcatatcggggacataatcagctagaggatttattaaagttagccaaagtggtagttattgtgtttgataagtatcaaatactaactaccgagggatacttggacgacatggctgttcgaaaattggaagatgatgctgaacgtgaaggcaatcgaattgagctaacacatcaggaacgaatgattgccgagcagcgtactattgactggttacgaaattttgcaattgatgggcgcattaatgtaattccagatgatgcacaatatcaacttaaaatcgcgacatctccggaaaaactacacgctaaaatcaaggcactagatcgattgaaaaatagtaacggtgctagtcttgccagaatgttggcaacgtttgattggccatatgttgagaaacgaaaaccaaaagatggtgactgttggcgagtaaagattgggacgtggagtttgccatggaatttgcagattcctatttctcgccaagaaaagcgaagaaacaaagggctagcttgggccgaacagtttcaaacaattaatgaggtcggctcaacatttacaatccaaggttttgatttgaattatgctggtgtgattatcggcccatcagtgaagtatcgagacggaaagttaatttttgataaacaagctagtaagaataaaaaagccacgaatcaacgaacatggaaacatcaaaaaattgacgtttccgaagaattgttacgtaacgaactaaatgttttattaactcgtggtgtccatgggttatatatttttgctgtcgatgaggaactacaacaggccttactaagggcagctggaaatcaacatattttgaggtgatttaattgaattattcggagatagaacaagcattaatcgaattccgtaataaaaaaggctggcagaagtatcataacttgaaggatttggcaatttctctaaacattgagtctagtgaagttttggaaatttttcagtggcataatgctaatcagaagttggataatagagaaaatcaacatttgcaagaagaattagctgacacgttaatttatatattttatatgtgtgaaaagctacaggttgatccatttgagattgttgctcaaaaaatgaaaatcaatcaatcaagacattgggatacggagaggaaaacacaatagtaatgaagaggctaacttacaatttaatttattaagtgccaaaagttaagttgtattgagacggtagttgctagatgtttatgataattattaaatgaatattattattgtgaggccagggtaaacatgtcaaatgattaatcgtttctacttcacagtatttaagttgtgttcagccattaaattgacatatgacttcattatgagtgatataggcgatatactagtacttgccaaagactgtatggcgtggtagcgaatgtcggcacttgtttcgcagtttttaagcctgattattattagattgacagtggttgatagttcattataggcgaccattgtttggcgactgcttatgaattgtcaattaaccgcaataacacgcacaccacaataatccacgtctttctgatcgccaaactgctgcatgacctcgccgtgcgtgacgcaggcgatgcaatcgtaagatgcggcatacttattcaaagttgccaaaactcgggccttcatttcagctgctgattcgtaggggaggggactagcggtggtgcgcttgccggcgtgttgtcgatagagcttgtaggccgtggtcgcttgttcatcggtatcagtccgactacccgtgttatcgggtagccactcgtgtaatccaagttcgacctttagtgggatatcattaaaacgcacaatttccagtgccgtttgtaaggcgcgtgtgtagggggacgacagaattaattggacttgtgcaaataacggctgctgggcgcattgttgtgccagcataataccacggtcggttaagccgccgagttcacggccgaaaccagttaatccagctgtagtgacctgttgataagttggttcggagtgacgaatgagatagactttcatcgattaggacttccttcatcggaattataattattaatttcattataggcacctttgatcagaaaaaacgacacttcgaaaaatgaagtgtcgttttcgttagacctgatgacgttatgattgccgatgtttaccatagaacccgaacgtgacgatggataataacagtcctaggatgaccgctaatttgccagtctgttcgttggtttgtggtaactgggctgagtgttcagtgacgggactcgttgttttgaccaaacttgcctgggcggccgcgggtttaagcgttggtttcacggtcgctgctggttttacagctaccgctggttgagtcggcttaatgcgatccggctgcgttacggtcgttcctggttcgttaggcgtctcgggtgtggttggctcaacaggcttaatcggcttagtcggttgttccggttcttcgggatcaataatatcgtcggtaccagtcgtgtcagttgcttggtagacgtacgtgacgtctacgttatcagcagtgaagagacccatggcattttccggctgaccaacgagttcatgatcagtgaacgtcaggggcacggtttgataagtggttcccgtcttgccgctcagcacggttggttcgtttagtttaatgccgtccttggtcatgtaatgcaccgtaacggttccttgggtatctggaattgtgggggtgtttacagtgtaaacataggtcacagtcttcgcggtagttccgaacgtcccactgacgtcaccctgcacagccttgaaggtgtaaccatcgataaccagctgttcagtcgagtagctgtcacctaaatacccgctgtgaacaacgtcaggatggatagacttaccatgctcatccagatacttggcagtgacgggtagcccagccgtccgttcatagacgtaggtcacagtcttagcagaagtcccgaacgtcccactgacgtcaccctgaacggctttaaaggtgtagccgtcgataacaagttgttcggtcgagtagttgtcacccaaatacccgctgtgaacaacgtcaggatggatagacttaccatcttggtcctgatacttggcagtgaccggctgtccagctgtccgatcgtaaatgtaaacgacgcgttgcggctgtacagtataggtcccagtcgtgttaccctgtgtcgattttaccgtatagccgttaatgttcagcggtgacgtttcatagggccgtcctaattgaccttgaccgcttaatacgctatcggcggctaactgctggccgttttcgtctaaatactgaaccgtgatgtcacccgcatcctcgcgagtgtagacgtagatgacggtttgcgcttggtcgctgaattgcccagtagcgttcgccggcgtttgaattaagcggtagttttcaatcgtcttggcgctagtctgataggggcgaccgagctgaccgtcaccagttaggacgtcgtcgggagctaaggtcgtgccgttagcgtcttgatacttcaccgtgatatggccagcattcgagcgcgtatactggtaaataacggtttgcgcgtcggttgaaaaggtcccggtggcgttcgcaggtgtggcgactaggtaaaagttaggaattgaaatggcttccgtttgataggctgctcctagctgttctttaccgtctaaaagcttgtcgggtgctagtgggttaccagcactatcttgatacttaacaacgatctggccagcatcgcggcgcacatagacgtaaatgaccgtctgttcctggtctgtgaaagtgcccgtggcgtttgtcggcgttgtcgtcagggtgtaattttcaatatccaacggttcagtcgtataggcttggccgagtgattgggagccggaaattgtcttatcgggctttaattgttttccctgcttatcttgatatttcaccgtaatgttaccggcgtctaagcggacatagacaaacgtgatgctttgcggatcagtcgtgaaaacgccagccgcattgccgatagtttgctgtaatttaaaatggtcaaaggttggcgcatctaaattgtaggcgttaccgagattgtgttttccaggtagaatttgcggttcgtagactaagttgccgttagcatcgaccatgtgaatcgtaatgtcgccggcgtccttacgagtatagtaataagtgacggtctgggcatccgctgtgaagacaccactggcattgccgacaatgttcgtaaagtcataatttggtagctcgtcatcaatgcgctgagtcgtgtaaggctgaccgacgattccgtttaaggtgaggtcagcggtgactaaggattcaccggtaagcgcgtcgacgtatttgaccgtgatgggcgcagcagtggcagctaagacatacgggcggacgacgacaaagttgttaccgtcagaagcggcagtcatgaaataataatcgtccatgggaataaccgtggtaccgttaaaggtcggacctgttagtccgggttgctggggcttcatattcgtgtagtagatatgaccgttgctgtcgtaattaccaccgcccgcaccgttaaagtaccagcgaacgtaaagctgaccgtttttgtagaaaacagtttcaccgacgccattattgggcttcagttgaactttagagccatctggcaaatagcaatcaatcgccagcgtcgcaatattattatctgcactaatataggcgggtggtaaggtgataaattggttactgaatgtgcctttcagatttttaaatcctttaagtggcgaaaaatctgaaatgtggttataggcggcatcgacctccgttaaattctttaagtttgcgagcggtgaaatgtccgtgatccggttttgctgaatattgaccacttggagtttttgtaagttggctaatggtgaaatatcagtgacatcactatagtaactgccagacggtgcgttcaagttgttgttgagccagactgtcgtaaggttagtggcatattgcagtccttctaatgagtaggaagtcttgccgtcgatataagtgtccttgccatagtaggtggtcagtagtagcatatctgccttagtgatgtctgcagctgagttccaggtacgatctgggttctgtttgcgcagttgactgagtacctcttgttgcaataatgtgtttggcatccaatcgttaatattttctgacgcggtgcggctaatggcacggacgactggttggttagttttcaaaactagcttttcctggtttacattggtaacaattttatcatcggttgacgctgagctagtcgctgactgagtattcacctcggtggtagtggagttggacggcgcaggtgcggcttgctggcttggttgcttggaaacttgattatcggttgtcgttgctttagcttgactatcagtcgctgattcagtgtttgattcggtagttggttcagtagttgatgcggaggttgtttgagctggtgcggtttgagttgggtgcttaatatctgtggtcggtgttgattctgacgtggtagttgcttgagattgtgatgctggatttgctgattgttgttgtgggttggtgttcactgacgacgagtgctcagagggacttccggttgatgtggtgggtgacgtggctgcgactgctgactggtcggattttatcgtggatactgatgtagaagtatccgctttcaaattgacctgagtagcgttaacttgagtattcgtattcaactgactgttggtcggttcgttgtttgtggtcgtgactgtatcgtcggcagccgccgcctgactggcaatcgttaacgttgtcagtatcatggcggttgcgctcgtgattacccatcgcgattggtgacgtttattctgattattaacattgtttggtttcaaagatccccactccttcaaaatacttatataatgtcgttgacaatttaagggtaacattgtcattgccgttagtctaataaatgataatttaattattgggagctaattgtatctgtcaatgtcagctggctgcataatagttgacgtaagcataagattgattataatttaaatggtaataattactatttatcagaaggcacccatgatggaaaaacaagatttagcaagtgcgcgcaggcgtctacgggggaccaacttaaaatcgcggaaacgcgcattgaagattttacatgatgcccgacgtaacgccagtaaagccaaatagtatcagcgaacgttagccaatttggctaacgtttttttgttagctgtgcggtatgattaagatacaggaatgagtggaggacatgtggatggaaacaactttggtgattattcgggggaattctgggagtggcaagacgacgcgtgggccatcatacgttgctagtgtcccaagatgtcgttcgtcgcgacatgctgatgagtcatgattacccgggaaatatttcaattggtctgattgaacaaattgcgtgctatgggctgggacgtgtgcctgtagtcattgtggaaggcatcttagcacgtgatcggtatggaaaaatgttggcgcggcttagtcaatcgtttccacgcgtccttacttattattttgaagtgagctttgccacgaccttggcgcgccatcaaaatcgtcatcgtgattttggtgtggaagacatgcgtcggtggtggtttccacatgatacgttgggcgttgctaacgaagtcttaattggcgagcaacaagatttaacaacggaagttcaacaaattatgactgccatgtatgattgtgactaaacaaccatgagttgattggtttgatcgtggttgaggattaagctgaaatcataaagggggcgagccaatgttactcgcagcattattgaaaacgcgtcgttgtcagtatggattgacacaggcgcaattagcgtccaagttatttgttacgactcaggcggtgtctaagtgggaacgcggaaaggcgattccgtcaatcgataatttactggcactgtcggatctgtataatctatccttggatgaattagttcgtggtagtgctttctttccaaagccatatgttgttggtcggcgactaagctttgggcgacttctgggtctcggattattttggctatttgtttgtctattatttactggttttggttatcagccgtggtggctctttttatcactttatattgttggattgattgtggtcgttccagtgggaatcaatagttactgggtgattcagcctgctaccattgagttgcatacgtatgctgcatcgacattgacgaagtttcgccaaattgtgttcaattgtccacggtgccaactaatccactatacagatctgcagcgagttaccatcagttatcggtgtcgcaaacgactttcaccatttgatttcaatccggattattttcaattgattttaaagactaatgcccaaacttatcagctggaatgtgcgttgaaggccagcgactatttaccgcaatttgtcagttatttgcaacgacaaggtgtgacggttgatgatcctcaacaagttgtggaattgttagtttcaggaaagtcgttgtatcaacattttcataccgagacttgatcttgagtggttgcaaccaaccgttgcggtagcgcttaagtgtgttgcaatgaattggtgcacccaatagtctagtattttaatagaggagcgggtaggatgaaaattgtgattggtactaaaataaaagagcaacgacaacagcatgaatggtcccagcagacggtggcggagcggttacacgtctcacggcaaactatttccaagtgggagttagggaaaagttatccagatttagagttgttggtagcactgagcaaactatttgctgtctcgacggatgagttattaggtttgagcagaagacctgttcagcgaccatggtggcagttgttattgcgtaaaaggagtcgaacagatatgacggtgaaatggtacagcggggggcaggatcgggcacgtgttgctgtgggcataattagtgatttagttgctaatctaaataccacgaatgagcaaccgttacgacagctgctggcaacttattatcaggaactattggaacaacgaactggttcagtactgggagtattcgacagaatgaacttagacatctccaaatgtctgcggcagcaacaaatcaaactatcaccagaaaatgagcaactaatgcaacagctggtggggttgaacatgatttactaccggtgatttattttgaaagtaaaacgcaaactgtcaatcatctagcttaatagatgctgacagtttgcgttttatgttaaaaatcaatcgcaggattaaaggtttgacaagcttgttcgactagataagcaatcggtttagctagcacgtgacttggtaagtaggcaatactaaaatcaaggctgagctcgcttgttggtaatttgaacgcattgatagggtacttggctggttcagtggctagtcttgccaacattgcagtggctagaacaatgctaccaagtccttgaagtgtcaagcttagtgcaaagcgagagttatcgacttcaatgagtggaatcgtttgaatgcctttatcggcaaagtaatggtcaaccagttcttgaaagcgagcttcaccgactgcacggatgacaggctcaccagtcattcctgtaagaatggtgggggtgaacggtcgccaaaattgattggactgatatattccggctgtttttggaatgactaaagacaaagaaattgtctgcaaagggatggttttgacgttagtttgatgaattgttttgccaataaaaaagtctagctgatgactagctagcaacgtttctgcttttgatgttgtgatttctagtattttagtgcgaatgttcggaaaacgttgataaaaagcaggtagtgtttgactaaaccaagcattagccattggtggtgtaatcccaatcgtcatactttgatacttattttgactgatttctttaagttcagtgttcattcgctgatggagacgggcgtcactttgcaaataagtcagtaatctttctccagcataagttaattcaagtggatgatggccgcggtcgattaagggggtcccaaaatgagtttccgcacttttaattgtgcggctaatgtacggctgactgatgaataaactttgtgcagctttcgtcatactattgtgctgttgaatagcttctaaaaatactaacaatttattttccatgaaatcgccacctttaatgcttaatcttattaaaatcaagtataacccattactcatttgtaataacagataatcagattgttatttctataaaaatgaaagcggttatataatacagatgtagttaaaaaatgattctgtttgtgatttaaatatcaatttcaattgtgctttagaatacgttaaatggattttgaaagggtggtcagcatgctccaaaaaatgaatcaggttaaatgggattatcaatatgatacggtagttattggctttggtggtgccggggcgacagcagcgcggtttgcggcggatgcatatgcgaaggtattgctcacggatgcagcgccgaatggtcatgaaggaggcaatacccgttattctgcccaactcttaggaacggtagatagtttcgatgagggtaaaaaatattatcaaaacttaacggcacccatgcaattagacgatagtatggttgatactttcgtagcgggcatggcgaatatgcgcgactatgttcaaaagtatctcaatgttgacccggtgagtgtcaaaaatgattttacagctgctgattctccaatttcattagacagtgcagttcatgagtttcctgaatttgatggagtccaatcctatgactttacaactgtccatcatggcatttttgatgcagctttgtggaaaattcttcgacaaaaagtgttagatcggcagcaacagattgatgtctggcttagtgctccggcacaacatctgattcaagatcccactacgaatacaattatcggtgtccaaatcgaacgtcagcatcgtttagttaatgttcgagctaccaatggtgtagtcctagcatgtggtggttttgaaaataatcaacaagccatccaggactaccttggtgctgagcacttggcaccattaggcacgctgtttaataagggtgctggtattaagatggcccaagaagttggcgcggacttttggcacatgcaaaattatgaatcactcggatttttacatggtctttcgattgccgtaccacaaggtgaacgtggtcgcttgattttaggctggccggaagtgaaccatggtagcgttattacggtggctgatgacggtagtcggtattttgatgagagtgaagccaaccggcacggtcacatttatgatcatggaatgtggcgagtaccgcggacaaatgtccatccatacttggtttttgatgaaactcagtatcaacagatgttagcaagtcaatatacgccgattaataatctcaccgatttagttgtgaaggccactactctaaacgacttagcacgagttatggaagttgatggtacggtacttaccaagaccgttcatgatttcaattattttgttgagtctggtactgactacgcgtttaatcggcaggttgatacgatgcgggcatttgatggtgggccatattatgtgcttaagttaacaaacaacgtacttaatacccaaggggggccacgtcgtaatgaccgggcagagattttagatgcaaatcagcaacctattccgcacttgtatggtgcaggtgagttgggcggtatttgtgcaaatcagtatcaaggtggcggtaatttagctgaatgcctgatttttggaaaaatcgctggtgaaaatgcagctaaacctaaggaagaaacgatacaattagtcgatgaaaaagcagtggctaagccggatgcgaatactagtgcttcggtgcatcagactggtgccaatgatttgctagctgaagcatcaccggacatcacagttggtgaacaccaatacttagggcgctcagatgatggcattggtgggcaagttgtggttcgtatcacgtatgttgaccaacaattaactcatgttgaagtagttgaacaacatgagactggtgaagttggtggtcaggcagttgccgaattgccggcaaaaatggtggctgctaacacttatgatgtggatgcagtttccggcgcttctgtatcgagccgtgccatcaaggccgcagtcaaggacgcgctatcccaggccaaacagaccgtgtcaaatgattaaccactgatcgcacaatccacgaatcacctagtgcttttagtatcttttagtgcgtaataccggtaaactagaattaacaaattcaatcaatggaggccgctcatgcgtattacaaaaacgagtttactcctcagcagtttatcattggtactcaacacgttgtcattgattatagcaattcgcaagtatcgattacaaaatcactaatcattagaaattcaaaaacaccgctgtgactaacgaacgcattagtcgtagcggtgtttttggttttattaagcttcataatccgtcaaatcagccaagaagcgttgaatcaccgcaagttctgctggtgagtagtgttcatgaaggagcgtgattgcttgatgattgcgggttgcatgcatcttatcatgatagcgggccagcttacgaccactcggcgttaagcggtagaagatctttttgtgatcatcgggttgctggaatgagccaattaagccctgcgttacgagtcgtttggctgcccgggtcacaccacctcgagtgacgccgaggttagtggctaagtcgatgcccgtttgtggaccggcctctagttcagataataaatgtaggccaacgatggaaatatccggcaacaggcggcgtagattggcttcggtgatatgctgctgtaaccatttctgttcaccagtagtggaagcacgcttggttcgaatcgttttgagctgcgttagaattgtctgttccgtggatattgacatcgattgatcccccttagatagttgtgcgtcatggcgactggttctcgtggtggttagcgcgcaattatcaattaatcattagcttttattactattattataccggttttaaaattcaccggcgagtttttctgctgctacctgtgcggcagtgatggcctgttctcgctgttctggaaattggtccaatccttcaatgaagatggttcggtaatcctgaatcccatacagttgcatcatgccacggaggtaggggtcgcctgcttcaacctggttgtgctgatcaggttggtgatagtagccacccgcagcctgaatgtgtaagacgtgtttgtcgggtaataagccgaccgggccgttgaccgtgtacttaaaagttttacgggcgactgcggttaagtctaagtattgtttgagttcggctggaagaaagtgattgtacattggattaacgaagacgatcttgtcggctgctagaaattcagctagccaggcggcgtgacggctaagtagttcagcttccactgacgttagttcttcaccgtatttttgtttacgccaagcttcgaaggttgtgtcgttcaaagcgggaacgccgtcctgataaagatcgcgtgtcgtaatctcatcgttcggatgggtttgctgatacgcagttttaaaactcgctgcaacggtcagtgaggcactggggacggtcgtgtgtggatgagcattaatcattaataattttgtcattttaaacagctccttaattttgttgacaagcaacattttatcttgaatattgttgcttgtcaacaaataagataaaaaattccccacacattcgaaaatgcgtggggaatttaaaggatgcacgattaattttgattaaccaatgctactagcactaggttggagcgactttacgggtaaatacggtgcaacatacgtggaaacggaatggtttcgcgaacgtgatcttgcaaagtgatccaagccagaaaacgttccagacccataccgaaaccggagtgcggcaccgaaccatatttgcgtaaatcgagataccactcgtaatcctgcaagtcttgaccgctggctagtaaccgttccttcaagtagtcataatccgttgagcgttcggaaccgccgatgatttcgccgtaaccttcaggtgctaacaggtcagctgcaatgacgacatcatcgcgcgtcgggtgtgcctgcatgtaaaaggccttgattgctttgggatagtttaagacaaagactggttggtcaaagtgttctgccaaaaatgtctcttccggtgagccaaagtcgacaccccagtcgacgtcaaagccgttcgcttggagtagtgtaatagcatcgtcgtacgaaactcgcggaaatgggagcttggtgtacttttgcaacgtcgcaacatcgcggtccaaaacggccagttcgtgggggcaatggtcaatcacggcttgaacgaggtaggccaccaattgttcttggacttccagactttcatcttgatgtatccaggccatttcaggttcaagttgccataattctgttaagtggcgacgagtcttggatttttcggcccgaaaagttggtccaaacgtgaagattttgccgaacgccattgcgccagcttcaccgtataactggccggattgtgataaataggcgtcctgaccaaagtaatcagttttgaataattcagtcgtcccttcaggagcggaaccggtcaaaatcggcgcgtcaatcttaataaaaccgcggtcattgaagaactcataaacggctcgaatgacctcgttgcgaatccgcataattgcgttgggacgcgatgaccgtagccaaagatggcgatgatccaacaggaaatcaataccatggtccttgggcgtgatcgggtagtcgtgactagtcccaaccacttcaaattgtgagatggcaagctcgtagccaaagggggaacgggtatctgcatgaatcgtgccggtgacccagaggctagtttcttgcgcgaggtcggtcagttgtgcaaaagctgtttcaccgagctcgtttttgagagctaccccttgaaaagttgcagtgccatcgcgtaattgaagaaaggcaattttgccgctagaacgcttattactgatccacaccccaattttaacttgttcattgacatggtcagcggcgttgataatactaatggtttccatgatattgatcactccttcttgttggattttaaatcagattaaagtaaatgaatgttatgttcggcacattggtcgatcatggcttgtggccacaaggcagcttgtacttcaccgacatgggctttgccaagtaataacatgcagagccgtgattgaccaatcccgccaccgatcgtgtaagggacgtccgcgttcaagatcatttggtggtatggcaagctaagccggtcttcggcgtccacgtctttaagttgtttcttcattgattcagcatcgacccggattcccatacttgagatttcgatagcttggtctaatggttcataccagaagaggatatcgccgttcaatttccagtcatcatagtcgggggcgcggccatcgtgacgttcgccggaatcaagcttccagccaatttgcattaagaagacacagccgagtttcttgcaaatggcgttttcgcgttcgcgcggcgtcatgtcagggtacatgtcttcgagctcttgtgtggttaagaagtgaatttcgtctggtaagtggtgaacggcttgtgggaacttgtaccaaacttcgtgttccatgtgcttgatcactttaaatatttgacgtaccgtggctttcaaagtttcaacggttcgttcttccttactgatcactttttcccaatcccattgatcaacgtaggcggagtggtaattgtctaaatcttcatccttacgaatagcgttcatgttcgtgtagagaccttcatgcatatcaaaaccgtagcgctttaaagcgacccgtttccacttagcaagtgagtgaacgatttcgatttgttcatcacccatgtcttgcatagtgaaggagacaggtttttcgacaccgtttaagttatcgttcagaccagttttcttttcaacgaacatcggtgctgaaagccgagataagtttagttgcttcccaaattcatcttggaacgtttcacgaatgtaacgaatggcctgttgggtttctttaacggataatttaggatcgtaatcctttggaataattaaatgcatatgcgtggtctcctttaaaataagttcagattttagttacaggataaaagaaaagagccttccatcccttgaattatcaagggacgaaagactctttcgcggtaccacccaagttgtttaccttacagtaaaccagctttaaaatagtgtacaaacatacaccaccgatggtaacgtaccggttaacggctaatcctactttaacgaggttatttcagttagcaactaagaaagtgtttttcggattagtcaagttctggtcgggtttccactcactcccgattcactggcaggttgactaatcgtactcctctttcctccgttttttatcttgtgacatttatattagcacgattctggtatttgtaaaccactaaattaaaaataaattagtttagtctcatgaattcaccataaaaatcttagctaaaaccgcaagctaccgggcttaattaatcgttcaaattataacgtaatttcattttttcagaaccggcaatgaccatatcgccgagtaatttagtttgtaacttcatcgcggtatcggccaattgttggttagccgtttcaagataggccgtgacgtcttggtggttagccaagtcagcgtcggtatcattctcgattttacggtaagcactcatggcttcgagttcgtaactattccgcatatccacgtaaaagtcgtagtcggtgtcacccaaaagggcggttgtacagcttaaccagtacatgtggttgagattaaaggtgccgtccgcatctttgtagctagctggcgtgtcattgacatttgcatagaatggtacgaccgtgttgaaggtattggcaccaaaggctaaccagtgaataccggcaacagcagcggggacgttgttgcgaatctgtaagatgtgcacatcgtggttacggttgatcccgattggccggaaaagggttttgtcagcttcagagccactcccgtaaacatcgtatttcgtgttttcaaagtgagaactcaaaacgaacttgacgtcttcgatagaaatcttacggttagcatggcagatgaatggtaagtcttgttccattggatcttgcacaacgtccggcgtgaagtatttctgaccgaaccaagcccgggggttgttgtaaaccgtatctttgattgaagcacttccaaagatgtgccgcaagttgacacggtcaaagtcaggattcaagtggtaatcttcaattaattgttcaaggtcagctgaagctaaggtatcatcagcgttaaaatcgaaatcgtcaatattcatgcggttcggagcaaccacgtaagcatcgtcaggaatacgtttagcagcccagtggtgaccaccaatggtttctaaccaccagatttcgtcttgatcagaaaaagcgataccgtttggttcgtaagtcccgtattgttcaagcagggcacctagacgagtaacgccttccttggcgctgtgaatgtatggtaatactagggtgcaaaggtcttcttcaccaattccgccggcaacgaagggatcgattcccaagatacgcgagttcgtggtgatggtttcggttgcggacatggcgatgttctcactgttgatccctgctgctggccaggtcccattggtcaagattgagttgggaattgaagtataccgtaagggattgtcaggtaagtcgacttcgaccttactaatgacggactgatagtgccggggttgatctgcgggattgaccacaactaatcgttcggggtctagggcttcgtgaccatcatcgtttcgtgaaataatggtcgagccatcgattgaggcttttttaccgacgagaatcgtggtacatgaacctttaatacgtttttccatgatattaaaacactccttttaagctattaatatcattatacgctttctgagcgggtcgggatagaacgggcttttttgagaatataattaatcccgctaatactaaaaccggtgaccgccgcaatttcacggtaagtcttgccacgtgcccgtaactggtgaacttgcgcgtggctggcatgttgtggtgtggggctaggcgtctggattgacggaaccaccgctggcaccgtagctggtagtgcgatcggtgcaggcggtgtagtgattaccggcgtttggtgagttagttcagcaagcttaaccatgactaattcagttgtctgaacatcccaaatggcgttatgctggtgtggattgctgatattaaagagtgcggctaagccatttaatggcagatcatggctaccgaccttatggttgccacgattgatcaaggtattcgtataggcttgggcatcaaaaatcgtgaccgggcgactgactagctgctgttcggtgggggtcaattgctgataatactgagttagtaataatcgaatgtgtttcatgtcctgtgtctgatcccaaaaaacgagggggagttgtggctggataacttgctggataaatgcttttagaatcgtcagggggtcgccttgcgcctcgtaagcgacggtcgttaagccagttgctgataaaccggccaactttttgtcaggtaaaaagttaggatcatcgaagtaacgattgaaaaaaggcgctgtctgcgtatgatgggaaaaaccgatggcactgagctggaagatactagcccgtaattcgggtgattcgatgacgtgccaactgacggctttagcggagccattacgacgaaagcgagtgccgaactcgcagtcgatgattacgtaagcggtcggacattcactcaattccgttggtgaaggtaggatcgtgggttggcttagttcaccggccggctgcgcagggggaaactggtatcccagcgtcgccagaaattgaacggtatcctgcccgagctggttattggttactttagcgaccttcttttcagttaagacaatttctttacgcgccacgaataaaatatgatagcgctgctgttcatcacagataatttcggtcacgttgccggcaaggttgtattctgaagcgagtgctaattgatggtccttttgaatacggtaaacgggatggttgacaaagtatagacaattcaagttatttgagatcttacgctcaagtaaggttaggttcgttggcatcatcgacaacagctcctctgatctaagtacttatattttagcggctttgtacattagctggctagtgtttgcactgcagatcgaaccatgaatttggtaatcacgaattggtgcctggtgttatagtgaccgtagagtgctagttgtgcgtcaggttggagttggtaaaataaagtcaatgcatgcttgacgatgatgcagttgatgggcataggctcggtcgcctttaatggcgtgacttgtaagtacaacataaaggggtccaactttaatatcttgcttttatttaaatacttaacggttagattttttgactgcatgctaatcacctcaatacgagtatacgaacatacgttcttaaatgcaagcaaaataactgcgttaacaaatttattttaagatgagcgctaggtgcactggactgattcgaaataatttattaaaaatcgcaacgaatcaggcaagtcacggggaaaaagctacaaaaaattgagaactcttggtatgatgaatagtagtgaatgagaggaggccgagtcatggatcgaggacgacgcgcaacgctggaagaacgaattgcgatcgtaaagtatacgctggaccattgcaacgattatcgagaagccgctaagcattttaatgtttcgtatccacaagtctatacatgggtacgaaaatatcgacaacacggcatggaaggtttggtggatcaccgtggccgacccaagcaaggctaagtcagcattgtacatataaactgtgtgggcgagtgccctttgatggccaatctgacatggtcgtttaatcgatatcggtctctttaaagtgtccgttcctataaaatcaatagggacgggcacttttcggtattttgatagttttcgtggcgcaagtgcgacttaacgtacctagtgattaccggggcgcgttcttgtcatgggccggtattctcggtagaatgagagtattaattcaaagagggagtttacgtgtgatgattgacttagcggcggcacagcaagtattaaagaccacgttcggatatgatgaattccgaccggggcaaaaagcagtgattgaacaagtgttggccggtgaaaacaccctagcgattatgccgactgggggtggtaagtcattatgttaccaaatcccagcgttactttttcaggggctgaccgtcgttgtctcaccattgatttctttaatgaaagatcaggtagacgcgttaaatgataatggcatcgcggcgacttttattaacagttcactggatttccaagagattaacgaacggctccaagaactacgggcgggggattataccttactttacgtggcacccgagcggttagattcggattactttattcaagcgctgggccggttgcccattcaactgttagcaattgatgaggcccactgtatttcacagtgggggcacgattttcgtcccagttatttagcgctcagcacggcgattgaacaattgccgacccatccgcaagttctagctttaacggcgacggcaactgagcaagttgctgcggatatttgcggccgcttagcgatcgatccacaacatgaagtgaatactggttttgcccgcgataacttggatttgacggtggtcaaggaccaagacacggaccgttacattttagattatttgaaagttaatcatggtgaagccgggattatttacgccagcacccgtaaagaagtgatgcgtctgacgagtttgttgcaaaagcatgatattaaggccacgccgtaccacgctgggctagatgatgcggttcgtcggcaaaaccaagaggatttcttgtacgaccgtgttgacgtcatggtggcaaccaacgcgtttggaatgggcattgataagagtaacgtgcgttttgtgattcacgcgcaggtccccggaactttggaagcttattatcaggaagccggtcgggctggccgggatgggttacctagtgaagcgattttgatttttcgaccggttgatattcaacttcagcacttctttattgatgagtcggagatggatacggagcaccgacacctggcgtatcagaagctacaggtgatgacacggtatgcgaatacccagggctgtttacaacagtttatcttgaaatactttggtgaaaaatccgcgccgtgtggtcggtgtagtaattgtactgatcagcgagaatcacaggatatcaccacggcagctcaacaagtcttatcgtgcgtcgttaggcttcattcccggttcggtaaaggggtcgtggcccaggtattgacgggcgctaataatcaacgggtccgcgaatcgaacctcaatacgttgtcgacgtacgggttgatgtccgggcagcgacagaagagtgtcgtggaactgatcgattttttgactgcgagcggttatttgcagtcggtgggtggtcagtatccaacgctgacagtctcagcgagtggagtggccgtgcttaaaggaacgaccacggtacaccgaaagacggcccaaaaggtgcagcagacggtgccagagaacagtgccctcttcgaacaattgcggacacttcggcgccaattggcggaagaacagggcgtaccaccatttgtgattttttctgaccggacgcttcattcgatgtgtgacctgatgccagaagacgatgcagctttcttaacggtcaaaggggtcgggaccagcaaacttgaaaagtatggtgaaacctttatggcgacgattcgagcggcagctcatgcggaatcagcaactagcaccgatgaggaaaccgattagatggctgattggtaaactacgagatgaaatggagtaacacgtatggaatttacttggcaacaccagggacaaccaatggcaatgaaacgattcttgacgacgcatgccatcagtatgcgaacaatcaaggcaatcaagcatggcaccggcgcgtttcttgtcaataatcaagttcaaacgggcgttattaccattcatgatggcgatattgcgggaattcaactaccagacgaggcaccggatacagcggtagtcgtcagcgaacaaccaatccaaattgagtatgaagatgctaattggctcgttcttaataaatcagccgggttaaccagcgtgccggggcctagtaatcggaccgatacgttggtcaatcgaatcaagggttatttgatagccagtcatgccagtaatcaacgaccgcacctggtcacgcggttggaccgggatacgagtggccttgtgttagttgctaaacatcgggtggcgcaggggatgttgacagagccccgaattgcggcgcaattagtgaagacgtatcaagcttggatcgaagggaccattacgccggctagtggcacaattgatcgcccgattggccgggtggctgacagtcctcggcgagtggtcaccacggcgggccaacgcgccattacgacgtatcaagtggaggcggaccaattgcagcataacgtgagtcggttacggttggaacttgtgactggacggacgcatcaaattcgggttcatctaaccgcgcttgggcaccccttattaggtgatgcgctgtatggcggtaacttggcgtggattcaacggcaagccttacacgccgctagtttacagttctttgaccccttttcggaacagattttacactttgaggcggcattgccagctgatctgcaagccttgaatcacgactgagttcagtttaggaccagtgaccatccggatgaatggttaataaaaatcggcactgctagaatgcgttgaacattctggcagtgccgatttttggttggcaaccgtctaaaatcaagctaacgtttagcgggtaagttgcaggcccgcgttatcctgaaggttgcggtgactattgaatgaggcgctagtgcttacgactgactaagtggcgcgttatcagccgttagcgtcgcaaaagttgcctgtaattgctgtaatggtgcggttaacgtgagaaaataaatatgctcgactccgttactgcgcatatcaatgaccccagcttcacgcattaagcgtagatgatgtgaaacggcggggcgtgaaatattgaccaaggcggtaatatcagtaacgttgagaccattatcactgttccccagagcaatgataatctgacgccgaattttttcggcgaagatattaattagtgtggcactttcaataagtgccgtttcggattgttgaaaattagccatggtgactgcgtcctttcaaattcaatttacacttaaggactaactccccccatcggcagtacgctgaattagttgttaagtgttggtatgacagctcgattgttcaagttctggtgaaatagttgcagccaagaaaactttaagtctacaagttgtcagttagactaattgttattggaacgttcgtacttatgtataattaaagcaagtcgttaatcgattgtcaaacctttttgttaaaagtaagtactattagcgggtttaacaattgctgttcgtttgataaccatatttttatgttgaaatgcgttaaaataaaaatagcttttgaatgaatgatgggagtggaaaatgtgaaagtcttaggaatattaggttcgcatcgcgctgatggcgtgactgcccagctactgcaagccgtcttaaagggggccgcggccagcgctgacacggaactagtcaacctcaacgattatgagttgcgaccagatcacgatagtcaaccgaatgctgacttagacgcgctggaagcaaaattaatggcggcggatgtctgggtattagctgcaccaacctatttggggagcttatcgggggtaatgaaaaacttctgtgactgttttcgggggcggatcgcacggtttaattccgtgggtgaagcagtacctgatcgctttaagaacaagcattatgtgacgatcacggattgttacgcgggtggtattgaaaattatttgaccggcgtgactgacgcaacgtttaaaacacttgataaatttttgacgatgggtggtctcatcaaattacgggagattgtcgtaactaaaacgtggggtatgcaaaccatcacagctgctaagcaagcagaatgtgaacgggtcggcgcgcgggctgcacataaaaaggaaagggatgacagtacggtgaaacggtatattcaattattcttcatgattgcggtgatggcactactaaccatgggaatcgaagcggggattcaacaattgattccgctgaacaatttttgggcctactacggcgtctttgtcgtcgtcttttatgttcttttagcaatgattttacatttcttcactgttgttaaacaccggcgtcgttaagggatacggcatgtgcattcagcaacaacgacattaaaattcaattgattagcaagctgggcttggcgtcttaatcgccggaggtcagcttgttttgctataataagaacaattacgaagtaccagcgattatttcagtgtctacgcgtataattaatatggtatcgtcgaattagaaaatgaggacacttggtactggttgccaggcgtatgaaccataattaaaacatgttaaattagatgaatttttatttggcagcatgctgtgattggtttcggttttggcgcatccaagctgccggtttttgaatctaactttgtcaaaaactaatcatgggtcatgcccaaaaacgtattattgatttcaaaattaattttgttaaataaaggctgtcaatcaaggtacgaggaggaatagcatgcaagtttttggacaatttattgcaacagtcggttggctaggattggcactagtcgccagcgaactaggtgcgacgttaatccattggctcggtcagtgggtcggatttcgattaattggtgctcgaattgtccggattaccggttttcgacttcaattaagtcgggttcgtggtcattggaaattagaacgaccgctgacgcgtcatccacatatcgtggcagcacccccggcggatgccaaacggttcaatcacgccatttattgttttggcggtggcctgttcaacttactgacggtcatgctcagtttaataactctgaatcaatttaagtttagtttcgatttatggttgttttcgttcattatttggatctgggtcaatacgttgaaagccgcccaattattaccaatgaacttgcacggttatcccacggcgggccaggaatttcggcaggcacgcgaatcaacggcggcgatgaccgccgcgtatgtcactgcgtgtgctgcggccgttaaggttcagactggtagtgtccgtgaccttgatgcgagtatgattgttatgccgcgcgatggtggcaatcggaattatttagtcgtccggcaagcctggttgattctggaatggggacttcaacatgggctggacacccccgaactgttagcggggttgagtcgcttggagccaagtttcaatacgttgccgccagctgatttggcgaagtatttagatgcgacattgtactggaacttggtcaccaatcatcgtgacccccagatcatagcctggtatcaagatgatggtgttcaacagttattacgtcgttaccaacctttggctcattataagttaactgccgtttatgaatggcgggtccatcagcaacctgaacaggccctggcattgattgaaaagggactaaaaattgctcagcgcctccacgatgaggaagaaattgcttggctgaaagctttacgcgttcaagtaacggcctagattaccgtagaaacttagattctgttaaagattgccagaatcgaagtttgtattggaaaatgggtggtaaactggtgaccattgaagtgaaaaaaggtgaaaatgtgaaacagcgaatcaagcaacggtgggggttgtggttaacactgctggtgattattttaggactaatcggggttggattgacccgagttaatgcgggactttatcagcagacagttgcacaagtgacccacgtgcagactaagagtcgaagcacgacgacggatgaatttgagaataaggatgcgacagtgacacagttggtaacggtccgggtgctcaataaggcacatcgtggtcgaacttaccagatcaagaatacgtatacgcgctcaggcgcaatggatcagccgtatcacgtccgtaatcaagtcttcttacggattcctagcgatcatagtagtgcagtgacgattcaggggttaaaacgagataccgcattggcgtttgtcgcgtggttagccctagcactgctcttgttaattatgcgtttcagcggtctgatggcctttttgagtgtcgcgctcaacgctgtactattttatgccgccattcagatcgatttagctactaatggtggtcacatttacctgctctttggcgtattggccgtaatcttcgccgtgctcacactgttgctagttctcggttttagtcgtcaaatgttagtaacattgggtgcgactgtggttggcacgggactggctgtcattattagtctgatcgtctttgcggtgacccatgagcgtggtgtgacttatgaatcgatgcagtacgtgacgcaggttccccgaccgttatttttagtcgaaacagtcctcggttcactcggagcagtcatggatgaatcaacagatattgttgcttcattgtttcaattgaaaacggagcgcccggacattgcaccacgacaagtatttaagtcgggtattcaaattggccggtctattatgggacccttgatcaacgtgctatttttgattttcatggcggatactttcgcgatgactttgctctatttccgtaacggcaatagctggggttacacttttacaatgaatatgtcgttggggatggtccaaagtttgatttctggtatcggtatcgttttagcgattccagtagccagttggttagccagtcgattgatgcctaaggcggtgatggcatgaacacgattaccgttttaggattgatcttactaggattgatgacattaattggtggtaagactggagcgacggcctttttgagtttgttatttaactttggattgttgtttttagccgttgttttgatttcatggggctttccagcaatgggggtgtcgttggtcattgggacaatcatcttggccttcacgattttctttggggaggacaacgaagtggcggccaagccagcttatattgcagcattgattgttatggtcattttagtgctgattatttttcccgttgaaaattggatcatggcgcagggctttagtttagaagatagtgaagatctggaaggtatgtcgttagccattggggtctcctttattggcgtagcagtaactgaagcaattttaagtacactaggggccattgcggaagctgctattgcgattgcggcgggtctgagtgaaattctggcgcagcatccgcagttgccaactaagcgactctatatcgatggtatcagtattggtaagcagattatcgggacgacttttaataccttgtttttcggcttttttggtggcttcttggcgctatttatctggtttgcgggcttacattattccttcgggagtgttatcaataataaaatatttgttgcggaagtattaatggtattattctcgttaattggcgttatcctggtagttcccgtcacgacgtgggtgatgacgattcaacatcggcaacaaattaagcacaacgattgacgatgaccgcgggatttgctacggttgagaaaacagttgggagcgttgtgatgatggaaattcgaacggcacaaccgcaagatagtgctcaaattgcaccattgattgcgatgatttaccgtgatatggaaatgccagtcttaaaaaatgttagcgaggccgacctattggcaatgttgactgagttgtatcagcgaccggccaatttagatgggttagcgcagacttttgtggcggtcatggctcacaaaatcgtcggtgtcgcgttcgggcacttagcgaagaatgaagccgctgtaaacgatttgttgcggacgacttcaggtcatcatgcggggtttgaggcaccactggaattaggtggtgagacccggccgaatgagtggtatttaagcatgttggtagttgatccgcaagctcagggccacggagttggtagtgccttactagaagcattaccaggactcgttggtcaactgggggccacgaaactgagtttaaacgttgatgatggcaatccccgagcagctaagttataccaccggcatggttttgtcccggatggtcagctcatgattggcacacatccgtaccagcacttggttaagcctttatcataataactgaaatatcgtggtgtgtttcttagaccacggtatttttttacgtcattatggcactgaagacttttctattgagcatgacacagttagaattaaactattgaacggattaggaaggtgaacgtgccatgcagatttatttcattcgtcacggtcgaacacaatataacttagaacaccgatttcaaggtggacgagcagattccccgctggttgctagcggaatcgatggggcaaaggccgctggtgattacttaagaaccacccaattttcagcagtatatagcagtccgcagcaacgagcgctggatacggcgaaatacattgtggctgccaatcagtggcaaccgtcgattcaaatcgacgatggcttgcgtgagtttgattttggtgattgggacggcaaacaggaagcggaagtacagccgcagtcctacgcccaagttatttttactaaacccgccgaataccgaccggaactagctggcggtggcgaaagttatgcggattttgtcacccgaacgacttcgacgctacatcgtttgattgatcaagttggggtagctagcacgcaaccactattaattgtatcgcacggcctggtgacgacgatgactgtcaaggcgttaatgggtgtccccgtagcagaattacgagcaccttttgtggtcgatgggcaagttatgaagacagtcggccacggaatcgtggataatgatagcctgacagtgttatcgacgacggataatcagcattttgaactgacgacttggaatgaaaccgggtacttgaagtaaatggctgagccaagtacaacgccttactttagctgttaacttgactctgatcgataaaattttaagtagttagtaaagggacgcttctggcatggtttgtcaggagcgtccctttgaaattaacggttgattcaagttatttgtctgtgttccggttcaaaactgttgttaatatgatttatagtgagcgctcgcacgtgatagtgctttaccacagcccactaaaaatactagctgccgccacgccccaataatattcggaggtgcgggcggtttgggtgtagagtgtgttaattgcttggagtggttggtgcatgtgatcacgcatgacgcgcattgccatgccgttaactttagtggcaattaataaatagttaccgttcttgtcaagttccatagcatagcgaagtaagtcagcacgaacttgtgcgtcttgtttaacttcaggatcattataggcaacgtcgatttgttgcatcaaacgcttggctttatcatttttgttcacgttaatccccccatgccaagagtatagcacaagtctcagacttaaatgttagcttaacgggaaaccgcccgcatttcggatagtaaaatgcggggcggtttttatcagtccgcttgttttttacatgtgatttctgcaacgtgatactggtgatttttgatatgccctggtcgctaaattaacgcggccgccatcacttgggccacatcttggctttgccaatactgatccactaatggtgcgaaagcgtggttcaagccctgatactgaataaacgtggtcgcagtatcggcagcggccaggcgttgtgcataagcccaagcttgtggtcggaagggatcaaactcgccgaccatgatcgtggttggtggtgtcattgtgaagttttcctggtgtagcggtgagatgagtggagaatgtgaatcaaagttctctggaacataataatccgtcatgatgctgtcaagttgccgaaagaggtcgtgatagttggtgagaatggcacgctgtgagtcaataatcggaaaggcggccaaatcccagagtggaccggcgtggtcagcatttggggcggtaactgggtacaacagcagttgttgattgatacgattgctaccgagttgttgattcagatttgttgcagccatgatgacgttagcgccagccgaatcgccagcaacggtaatcattgtttcagcgtcacgttgttccaaatattggaaaatcgcgagcccgtctaaaataccagcgggtgctggtgcttctggcgctaagctgtaatcgacattaagaatctcgcagtgacttttagctgcgaccagctttaaaaggaccgtattattgccgggaacaccgccgtaaaaggcaccaccgtggaagtagaccagtactgtgtgattaatgacattttgtggtgtcagccattcaacgctgaccgtgcgattcagagccgtaatatttcgactttgaactgtaaccgcatcaccaacagggtccgcgatggcgggggttaaactaccactgcggagcgccgctagatcattttcaaggatggctggttgtttgaaggccgttagtgtttgaaggacgtgcgggtcaaattgttcaccggcgatgtcgttgttaaatggtttaacgattttgacgacgccgttgacggttgtttgaatcgaattaattgttggcatcatattcaacatcctccttaggttcaactttagccgctgcctcggccttgttggcttgtaattctttttcgtctaaccgatagaattgcatcatgaaaatcatcgcggctaataaaataatcggcatccaaataaaagcgagattaataaatgtaatggttcgtccggactgtacagctgccttggcattgaattgtccccatgcgagaaattgaccggctagaaaaccgccaattcccattcctaatttggcgccaatcattggtacggcagataagaatccggtttcatttaggcccagtactttcgttgagtagtcaacggtatctgatagcatcgcgaagacaatcgtgaacgtgatccccatcgcaatcaagaaaatgacggagccagcaattagtaggctcacactacgcatcttttcagcgattggcagcagtagttggccgataacgcccagtacgagtgaaaactgcaaaacgttacggttcttaaagcgttgtgataggaatggtacggacaggttcccgatgacggaaacaaagccaatccccaggaaaattggcgctaattcaggccgaccgtagacgtatttgataaagaagatcgctgaatttccccgtagcatccagaaggtttgtagcagaatgaatgagcaggctaataatagccatggtttgttgctagccgcacccttcaagctttgccagattgagagtgattcggctgactcagtggtaccgtctggattttgtgcaccgttagtttccttgagattgagaaaagcaaagatgaagagtcccatgataacgaggcctaagataatagcccagagggtgaaacctttcgactgattgcctttgccgagtaatttaaccattggcaaagtgatggccgccactgcactggtcccgatggttgtcatgaccatccgagcactcgctaacttggtccgctcaacgctatcatcagtcaagcttggtaaaatcgaagtaatgggcgtgttggcaccagaataaatcaggctaaagaaagtgtaagtgattgaaatgtagacgagtcgcattgtggtattgccgccaaatgatggaatcatgaatagcgacatggccagcaaccctaacggaatgccaaaccacacaaagtaggggcgcgattgtccatacttcgtgtgtgtatgatcaatcaaataaccataaatcaatgcatcaaacgcatcaatgaagcgcacgacgaagaacagcattcctgcaaaagcagctgagatgcccgcgaccgttgtgtaatagaacagtaagtaagtgctgaccatttgccaaataatattaccggccatgtcagtggaaccgtatgcaattcggcgtttccaagtttgaaaaattgacattataaatccccccaaacgaattaaacttaaactaacaatgataattaaccccttttatcaacataattatatttccaaattaggtgaattatcaaagataggcgatagtttggctggttaataatcgaaaggtgggtgcatcttttgtacaaacacgactgatgcctgttttgtagcgctggttgggagaaagccaaacaagcaaaaaacacccccagcaacggccaatcaaattagctgttgctgggggtgttaatggttaaagacgcgtgtcgcggatgtcaccaattgttaacagaaatagaattgaaaatagccttgtcggtcagttctgttttgaccattaatcaatggttggtttcagagctagtgctttagcggcttcttcactgtcatcaaagtgatgcttagtccggccgatgatttgataatcttcgtggcctttaccagcgattaaaacaacgtcgccgggttgtgctgcttcaatggccttggcgatggcaacgtggcggtcttcgtagacgggcacgtcggcgtttggcacgccggcaaccatgtcatttagaatcatggttgggtcttccgtccgaggattgtcagaagtaaagattggcttagtactgtgttcgacagcaattttagccatctttggccgtttcgtcttgtcgcgatcaccaccacagccgacgacgcaataaatatccttagtcgcgaaatcttgaatcgtttctagggcattcaataagccgtccggagtgtgtgagtagtcaacgatgacactgacacccgtgtgggaaggaacggattggaagcggcccttaacgccggtaaccttctccagtgacttaatgatttggtcttcggggatgccactagcgtaagctgcggcgaaggccgccagcatgttgtacacgttgaactggccaatcagttgcatcgtcacgtgggttacgtggccgaagacggagaggtcaaattcagtcccgtggctcttgatttcaacattttgtgcgttgatcatggcatctggtttgagtccaaatgttagtacgtgcgctgccgtatactgttcaaattcacggccaacgggatcatcggtgttcagaacagcgaccttattagttccgtcggcgctgtacttattgcccagttgtgcaaagagcatggccttggcttccgtgtacttagccattgttttgtggaaatccaaatggtcttgcgtcaagttcgtgaaaacggcgatgtcgtaatcaatcccccagacccgtccgagtacgagggcaattgaagaaacttccatggcgacagtttcaacaccggcatcccgcatggccgctagagtccgttgcgttgtgatggcgtcgggggtggtgttggcagttggcagtttttcatccttgattttgcgatacatggtcccaatcaggccggtggcttgctgctgatcacgatagatttgttcgatcaggtgggtgacagtggtcttaccattggtacccgtcaccccaatcatccgcatcttttgactaggcgcaccgtagaaaacgtcggcaagaattgccatagcgcgttcggtgttttcaacgtagatgaccggtacgttgacgtctaaaggttttgacgccacgatgatcttggccccttttccgatggcctgatcaacgaggtcgtgaccgtcgacgtgataaccaacgacggcaataaacatggcgccgggctgaacttcgcgggtatcctgcgtcagcatggtgacatcaaagtccgtggtcaaggcgggctgaacctgcttgaattttaaactattaattaattgacttgcttgcataatattagcgtccttttcaataaagttactgtttctagaatacatgcaaaccggataattgtcaccccaaatgagaattgaaattaagcttgtaatcgctcggtacatggtgtactgctggttgaacgtgccatctccaggccaatctaggtcaacaaaaaagcccggcaattaagccggacttgcagggatggttattcgattcctaagaactcatcatgtaaggcgttcatggccgcttttaaatcggcttccttaacgagcacccagatggtcgtataactatcggtcgattgtaaaatatcgatatgttgtgcagctaatgccgagacgatccgagcagtgacgccgggtgtcccagtgataccagcaccgacaacggaaactttagcacagttcgcaattgactgacaatggacgtgcgcgtcagtcagtagttgcttggcaacgtccgcgtcaccatcaaccaggttgaagacaacttggtgtggtgtaatgttaataaagtcaacactcaaaccgtgctgtgccatcaattggaaaatggcacttgaacttaacgtatcggtaggaacagtaaattgcgtcaaatcagtttggtgtgcaatccctgtcacggtacgataatgttcgatttgggtcgtggtccggtcagtgactaaagtccctaattcgtcgggttcctgataagttgaccgaatccgcatcggcacgtgagcttgttctgcaatttcaacagcacgcggatgaatgaccttagcaccttcatgggccatgttagcaagttcttcgtagctgatggccttaatgaagcgggcgtgggtgacgagtcgtggatcggcagtcatcatgccgttgacatcagtaaaaatatcaacacgttttgcttttaaagcggcgccgaggatggctgctgatgtatcggaaccaccacggccaatcgtagtaatgtggccgctctcagtagcaccttgaaaaccagttacgactaccacgtcggcgtcaataaaggcgtccgtgattggtttcggatcaacgcggagaatcttcgcattttgaaaatcgtcgttagtcacgatgccagcatcatgaccagtcatggccgtgacgtttaggccttgcttacgcgctaactcggtaaagacagcggtcgagatggtttccccaactgagaccaacatgtcgagttctcgattggttaagcgggagtgctcggccccaactaatccgagtaatgagtcggtggcgtaaggggcacctttccggccaattgctgagacaacgacaatgactttatcgccctgatcgacggcgtattgaacgtgctttaaagcttgaatacgggcggcttcgtccttgactgacgtgccgccgaacttttgaacaataatttccattgatctaaaactcctcgactttttccgcaacggcgttagcttcggggctatccatcaagtggtcagattcgacatagagtcggtgccacatcatgaaggtgaggaccgtccagagtttccgagaattatcccgaacgccggccttgtggtcatctaagagtttcaagaagtagtccttattgaagtattggtcagtttgcgaatcgttaatgatctgcttagcccagtcgtacatttcatctttgagccagaaccgaattggtactgggaaaccaagctttttacggtgaaggacgtgcgctggcacgatgtcttcgaccgctttacgaagaatgtactttgttgtgccgtgactaattcgaagatcagctggaatttcggctgctaagttatacacttcacggtcaacaaacggggtccgcagttccaaactgtgcgccatcgttgtccggtcggcgttatgcaacaagtcaccgtttaaccacgtgtgcatatcgatgaattgcatccgactgattggatcatagtcgacggattcatcatagagcggttgcgtgatggactggaacggatggttctgattgtaattcttgaagaaggcttgtttttcttgttcaccaaagataaaggcgttcccaacatagcgattttctaatggggtggtccctcgtagtaagaatgaccgaccacgcattccctctggcatcatgagtgcgatacgcttcaaggcaccattaatcggtttcgtgtagcggaacggtttcaatgattctggttcatgatagatggtgtagccaccgaagagttcgtcagcgccttcaccagtcaaacaaaccttaacgtgtttgaccgcttctttggctaagaaatactgcggcacagcggccgggtcagccaacggatcatccatgctccacacaaagtgcgggaaggccttcatgaaggcttcaggcgtaatcgtcatgctgtaattcttaacaccaagcttttcagcggtctcttgagcaacgtcaagttcactatacccttcacgttcgaaaccaacggagatcgtttcaaggtttgggttgaagttttttgcaatcgcgacgatgattgatgagtcgatcccgcctgaaaggaaagaaccaactggtacatcggaacgcatgtgaatcttaacggagtcaattaaggcatctttgattttttgggcatactcgtcttcagaacgttggaccggatggaattcacggtgataataccgatcgatccgtggcgcagaccccaactttttcgtcaaggagcaaccaggggcgagcattttgatttcttttgtgagtgtttctggttcaggaacaaattggaacgtcatgtaatcttgtaaggcatttttatcgaaggttttatcctttaaaatcttgtaaatggccttgctttcagaagcataatagaagtcatcgccactgatagcgtaatagaacggcttgatcccgaactgatcgcgcgcggcaaataacgttttttcttgtttatcccagatgacgaaagcaaacattccccgtaagtacttcgttgcgtcagcgtggtacttggcgtacatcgcaagaattacttcagaatcggagcttgttttgaattcatagccttcttgtttgagttgttcacgtaattcaacgtagttataaatttccccgttaaatgtcatccagtaacgttcattatcataagatagtggttggtgaccaccggctaagtcaatgatacttaagcgccgaaaacccatggtaatgttgtcatcagcaaaataaccgtcatcatcgggtccccgatggacaatcattttagtcatttcgtggatggtctgatcgtaagctgcgttatccgctttagtccgatcagttaagcaaccagcaaaaccgcacatgtctgttcatctctcaatctttaaagtttagacagttcttatctactatatgtgtacagatggttcgttgttaatttacccgtttcattcacggatgtaaagcactctgaacaattataacggtttcttaccaatgtctgtcataattatgcttgacaatccgcgacgtacactttgactattatacttgctttaattcataagataaagcggagcgcgcagatggaacgctttcattgataaaaatttcatgttgcgcgaaacgtccaatcagttagatgccggttccttggcggagcggatttctactgactatttggttagttcgaattgaccgttattgacatgacacatttagatgctgattgccggccttatggctgaaaaagtcacagaaaaatcccgcaaactcatgcacaaatttgcgggacgtttaagtgggaatattaaattagatgtgcccttgcgctctaagcccagccaactaggcgcaatacggccatggcaacgatgcctgttataacgacggctagtaaacttttggtgagcactcctgcaagaatggcaggaattgaggcataaatatttgggagattaaattctggccagtgtcccgcatggtaggtgagcagactttcaacaaaaatagcggtcataatggcaattggcacaaatgataaaaagctgattagccattgggggactgacagatttttaatgatggcaaacgggacaatgcgtgatagccaagtcacgaggccgcagagtaagatggtcacaaaaatgtaagtacccatttatggtccaccaccattccaaaaccgcaaccgagtagcgtcgcaaagatcaaagccaagttgcccggaacccaacgcatgagaaaatacatggcgagggccacaaatagtacgacccacaactgggtcggcaatgatttactgcgatccgtgatgatctgcaagtaaagtaaaccaatgaacataccaacaacggcgaaatccaagccgaattggttagggtcagtaatcaagttacctaaaaggcaccccaccactgtcgcggctgcccaaaccaagtaagccacaatgttagcagcgtgtaaccaactcgtttttaattgttgattggtctgattgagcttgttcatgctgagcgcgaaggtctcatcagttagtaacgatcccagtccgatattttgcaataacgactcttttttgaaatattgagcgactgacatgctcattaaaatcatgcgtgaattaatcaaaaaagtggataagacgattgccgaaatcggactacctgctaggagcatactgacgataataaattgtgcggaaccagcatagacgattagtgacatgagtagaacggcccaaactgataggtgactcgtgttggcgacaatgcccattgctaggccaacgccaatgtatccaaagacggtgggaatgacatctttgatgcccgcgcgaaaggttaaactagaatccataaatgtacgacctccaattcaataagtatgcgttaaccaacactaaatgggattatctgacaattagtgtggttcatgaaacaggataactatgtaggttaagtttgagtgcgtgttatgatgaaaaagcacgcttgatatccgccaatagtaaggtgacgaatgaggcaaaggcgggttaagaattagtttaatactttcggtgaaaataatgaagaaaattatcattgacttttaatcgtgacgttacgaaattgttgcttgcatttcaaaagctgggggcgtaacataatcacattgattttttgaaaggacaaatggtgagagaaaatgactctggaacaattagcagcccatagcggggtcgctgctgataaaatcgtcgcctataccaatgccgggttattaccttgcaaggatgtcaacgcgcattttagcgccgatgatgaatattggctagatatggtcaattgcttcttagaaaatggctcatccgtcgaggatttgaaagatttaatgccactttgtgaacagtgtgcagctcaataaataagtaagttaagacaatcgcaccgattctactagaattggtgcgattgtttttttattactcatcgttattaaacaatcatgattaaaacgtgccgattcttaagttcaaaagcagccagcttagacccgctgggaaaagttcaagttagcgtaaatatgcttagattggttcgtcctacatcgacctccaggcatttctgccaattgccggaacgtggtgggcacagatttgagccgaaaaaccacgtctcaaatactggcctttcactaaccaagcacagaacgcttgctaagtgaactttcaccactgggcattgtcaaaaatgccttccagtcgggatagtattcgaatggcagacggtgaggtacccaacttttgatgaattggtcgttgcttttcataaacggtaattttgtcaatcaactgtcagactaaaaataatattgagatggctcactaatcctgaatcggtgtagtaggatttaatctcttgacagagtgcttaatgcacctagcgctttgtttaaacttccagcatcaaaatagtcagctactaattgtaccaaattaggtggtcgttcatcagccattcgagcggtttcccgaccggaggggctgggtgacaatgctcagtagccaaattattcttagtcggaagtgggttgcttccggcttagaataagactcgtatttgagatgacgcgggttatgcgttagctcaaatcgacgtcggcttacgttccagcaattgtcacccagccccggaggtcgacataggacgcgcaccggctgacgaacaggaatccacctaatcggcacggtttaatcataattagtcctgattggtgttttggagcggacactattttttaaatgttcaatcggaatataaattaatttatatgggctagcaggattgagggactaacggtatacttattgaagcataaataccaaccaaaaaggatagtgaagcagggatgaaatcggggaagcaccgggtatcattattgatactgttatgtttgatggtggtcggtttagctggctgccataacaaggcgtattcgcagtcaatcgagaaggggttaaatgcggttgctgagaataaataccaaaaagcgctgacgtattttgataacgcgctagcgcagaagcccaaggatgaaaaggcacaggcgtaccgggatcaaacgcaggcctacttgacgaccacatcggagttgaaggccggaaaagttaaaacggcgctgacgacggttgataagggtgtcaagattacgaacggggcaacaagtttgacgaataagctgaaacagttgaaagtcaccgtaaccagtgattatcaggaatatcagcaattgtcagatgatgttaaagcacagttaaaggtgaagaacggcaactattcagcggacgtgctcaaacgttgcgcagccatcaactgggataaaaagccatatttgaaaccgttgaaggctaaggtaaaacagttattgactgcggcaaaaaaggccaagacgaatatgaaagttagtacggctgaagcgaaacgagcagcggcgttacgtcggaagattgctgccgctaaaaacaagtggaacatggccgcattagacgatgtgcccgattggttcattttggcactttttgccgacgatagtgatgtggatgatgctgctgaagaattagatgacgaatatgccgatcaggccgacgataatgacgattattcggatcgggatgagcaaacgactgattcgaatgatgacacgaacgacaccgacgcggattcggctgatgacgattggagtgatcaagatacggattcgaatgacgataccgacgatgattccgatactaatagcgatgctgacagcgattcggattactcagaagatgatgacgatgaagattcgaatcgtgatgacgccgatgacagcgaaacccaatccgatgacgattacgatgatgatactgatagtgagtctgatgacgacgattatgatactgatgatcaatatgacgatgatgatgactacgatgacgccgagagtctactcaacccggcacctgttcaaccgtcagtggccgaccggctgtttgcgtcggctagttgttagtcgttcagcggtaaaatcaccaaagatcgtctgacagttttaataatgcagttatgggcgacataaaaacaagcgtccgcgttgattagatcaacgcggacgcttgttttcttacgtggagtttgttgccgaacatgtctgagtaccagttgctcacgggcaagcctttatcttagcgttgattaaggctgatgtttaaagcgagcgtaaatcgagctcattgttgaaaatccgatgactattaagaccatgatttgtaatacgccagtgggttgctgaatttgcctgacgataatgtaagtcagaatagccaagttgatcagccaaccaaatcgtcttatttgcttaattataaaatttttagggtctgttttactaagcatataaagtaaaagggcgatgatgatccaaaacaatcctgatgttgagtgatagtacacgtaatcattcctttagacgtctgactttctaatgacatcgtaacaatcaacttggtacgtgataatcgtatcatttgctcgaaagcatcaaaatcatgttttagtaaagatagtgtacattttcagaaaagaaacgtgaattttttgtaaaccaccggcataattaaccggcgcatcgattttgaataagtgtggtcttgacgctggggcgccggcgctagttttggcaagacgttagtgaaagggggggacaagccatgatgatctttagacaacaaagaccccggcatgccggggtcttgtcagctatttttaattgttagttcaagttatttgctagctttaacggttttaagcatgctctgaatggcattggcttgatattgagcagccgctgctttttgaacttttgcgagttgcgctttgctcattgtcgggttcttgaccattgcggccttgacctgattagtcacgtagactttagcacgcgcttttaatgtcgcttgctgttgcttcatcaatttactgaattgtttagcttgggttgtgctaagtacgacccagttcttattgatatagaagtagttggttcgcttgatcaactgtttgtcattgttggctaagccaaaccagaacttcatggcgttactcttataagtccaccgtgtcgtcttagtaactaacttaggtgtcgcggtcgtcgtcttaacttggttagcagtcttgacgctggctgtcgtatggctaacttttttctgattagtggtctttttataaatatagacccggtgcttgtcagcggtacccacactttgatagagcaataaatcaagttgcttgctactaccagcagactttaatgattgcgtggtggtcgtcgttgttttgaccatcccgtaatgttgaccatcattcttggagacgaagacgatcgaggtcactaagagtgccgcaaagataacggataggctgattcgtaacgtgttttggtgaacgtagataaatgataagaagagcgcgattgcgctaacaacgagtagtacgagaatcattagtcgttcacctccttagtgttcattactggcttaacggaatgctgcttgcctttcatgaagaacgcgacgacgagcccgacaactgagaagcccacggcaacccagaaagccgcgtggtaaccatttaaggttgcgttgaaatagctgttctgataaccaagtggattgctcttaatcaagctatgagctggttttgtggcgtccgtaacgtttgataagacggaagtcaagatggcagtcccaatggaactagcgatttgacgcgtcgtgttgttaacggcagtcccatgacccattagttcaacgggaagggcgttcatcccagcggtagttgccggcatcatgaccatggcaatcccaaacatccgaacggcatagagaaccacgatgtaaaccgttgcggtattacgagtaatgaaggcaaatggaatggtcccgattgtcagtaaaaacatccctaaaattgccaagcgtttggcaccaaaacggtcaaaggcccggccggtaattggactcataacccccatcattagggcaccagctaatagtgatagcccagattcaaaggcggagaaaccatgaataatttgcaggtaaagtggaataaccatttcggcccctaccatggccatgttagcaactgagctcaaaatagctgcaattgtgaactcggcatgcttgaagacccgtaattggaggaatggattttccatcgtcaattgacgccaaataaaaccaatgatgaagataacaccaataattaaagttgagagaaccacggttgacgtccagccattgtcaccaacggatgaaaagccgtatagtaagctcccaaaaccaatggtagaaagtaccaaggatgcaaagtctaattttggcttagacgtttccaagacgttggccatgaagaagaagccagcgattagaacgattgcgacgattggaacgatcaaaccaaataaatcacgccatgataagttgtcgataacccacccagataaggttggaccgatggctggggccaaaccgataacaattccggcagtccccatggcagccccacgcttatcagcagggaagatagatagcataatcgtttgaagtaatggcatggtgaccccgaccccaacggcttggatcaaacgcccagccaataagaagccaaagtttggtgctgtccaacagataatagtacccacttcgaaaatggccattgcggaaagatataaccatttagtggaaatccgtgaacttaaccacgcactaacgggaatcataatcccgttgactaacataaacccggttgttaaccattgcacggtcgacgttgtgatgtcgaaatctttcatcaacgttgggaaggcagtggttaaaatcgtttgattaagaacggtacaaaaagtaccaactaataaaactgcaatgagcaagccacggttataaggcttcccatgcgtatcaacaggagttgacaagtaaatcccttctctctaaaaaagtacgttgtctaatataatcggatttatcgactttgtcaacaagcttgacattaatattaaaaaataatatactgagtattgaaaatgttagaaaagaggttgacccgtggataagcaagaagacggtgtattttttaagaaatttaaagaacagctgggtaagcatcaattcacaatcggaattagcgatttggcgaagatgaccggcgtctctcagacacagctacgttactgggaacagaaaaattatattcatagtcttaaagtgagtgagaagaataccacgcatcgttattcgtatggtatgctgatgcgtgttcattttatcaagatgatgttagacgagggttttacactggcagcggctgtcgagcgggccgatgggtataataaccaaatggaaatgatgcgcatctttatgatgacggcttttcaaggaatcgaagaacgggatggtcaccacatggtcaagttgggatattttgacgaagcgaagacacaacagctttattgttatattcaagatgagacgccacattatcgactttatcccgttaagtcagagcgctagcaaccttcagcttgtgtaaccgattaattaatgttaaatttaagttggtaaatgtcggtaagtcacttgggcatttaagtttcccgttcgtcaaccgatcttatggctgggttgaccgttgtcatgttggtcgtgttttgaagtttaactttgcaaaaggatttacaacggagcgcgaataagcgctgagagatgcctagctagaactaggtagtaatcgtgcataaaacaacgtgtaattgaaactagtagtagtcttcaatcgcccggtgatgatatttaccagaggtcccaagtgctgcgggaaagcttggggcttttttgtactttcgtacgttaaaacgtaatctatcagtgtggttatcaacaaaaaagagaccgagtatcaactcaatctctttaaataatctataagtacgcgtggtgcttgtctttcatttagtattaattctacttctatatgaaataatcacgagtagcgcgcgttaattaagtaggaattgttaagatgtcgcagtttgagcaaacttggcggctaaccattcattccatggtagtgctggattaccactagtaaagtattgttgatcgagtcgatcaatcaagttgacgtaggcggtaaatgaaaaactaacggtgtcactcaagcgctgagccttggtcatgtagcggccgtaagtaaggtgttcattgatgtctgtcatatagctggcaacatcatagttggacatcatttcaaggttgttagcgtcaaaaagtggtaagtagaatgcggcaaagtcttcaactgccttgtgctgcaaagaactatccaattgcgtaattgataattgagcatcatcattcacgatgcggttcctccttagttgaacaagcacgtttctaaattagtaaccaaattggttattttgcgctacaattaattatgtcacgattaggcaattatttcaaagctttgtcgttattagagactagaactggtgtctcaattgtagtaagatgttagaattatattagagagaatcagaagtaactatttagttgaggtgaagaatattcatgacccccatgaaggaagattacttaaaaattattttcgagcttggtggtacgaaaaaaaaggtgtcgaataagcaaattgccttaagtttagacatcgcggccggctctgtaacggagatggtcggtaaattagttcaggaaggcttggctaagcataccccgtatgctgggatttcgttaacaaagaaaggcattcgctacgctgaaacgttagttcgcaagcaccgaatctgggaagatttcttagttgataaattggattatgatttgccagacgtgcatacggaagcggaagtgctggagcatgtgaccagtgaacgactagtggattctttggaagcctttttaggcaatccgacgcattgtccgcatggtggcgcgattcccgataaggatggtcattatcaggaagacagtcatgtgagtttagcagatacgcaggatggcacaacggttacgattgagcgatttattgataatcatgatttattagtttatttgcatgatacaccgctcaagattggacagcaggtcacggttttaaagcacgatccatttgaaggccctgttaccgtttccattcagaaaacgggcgaggaaatcccagttagctataaagcggcgcacaatgtctttgtaaagtaagcatgcggcacctatttccgaacaaacctgttaattgttagttagttattctgtttcatttatcatcacataaacatttcatggaaatcatggtgtttggctaccctttttagaaacaatatgctacaattgttcttgtagcttggttaggtaattttggtcagatcgtttcaataaactatccccatttgtaccgaatcatgatttacattattttatacgtgcaaaatgcactaggaggattttttattatggaacacggaacagttaaatggttcaacgctgataagggttttggttttatcactcgcgaaaacggtagcgatgtattcgtacatttctcagctatccaagaagacggcttcaagagtcttgatgaaggccaagctgtaaacttcgacgttgaagaaagcgatcgtggcccacaagcagttaacgttacaaaagcataattaacagcttaaatggcttaaaccggtgatgagaattaattctcatcaccggttttttgtcgttttgcagcggatgcttaattatcataaataaagctttactaacagccagacattggctaaagtaagaattattagagaatgtaattctgattattaaagggtgggatgacagtgacaaccgatgagatgattattgcgacttgcttgaaggctggtaaaatcatggtcgagaatggttcggagatttcgcgagtagatgatacgatgatgcggattgctcagaatgcgggggttgttgctgccaatacctacgtgacgattacgggtgtcatgatgtcgattcaaggacgtaatgcaacgcagattgccgcggttaaccagcgaacgatcgatcttgaaaaagtggcacaggtcaatcagttatcccgtgaatttgcggctacgaccattgatttaccaactttatatcaacggcttaatcagttagatgcagcttcgcgctcatttccgttgtggttgcagttggtcggtgcagccttagtcagtggccccttgatgattatgtttcgtcaggaaattgttaatacgtggccaactgttattattggaacattaggttacttggtcttttatctgcttaaccggtatcttaaaattaaatttttgagcgagttaacggcggcacttctaattgggtttggcgcggaatgggtgtgtcagattgggtggggaaccaatgtcaatgatattattatcgggtcgttgatgccactagtgcccggagtgccattaacaaacgccgtacgagatactctggctggtaatttcgtcagtgggcctgcacgtggcgtggaagcgatgctgagtgcggcagcactaggctttgggatcgccgttgtcattacattattttaagtacgggcactagcctgggtattcggagggatcatgatgggcacaattggacaattagtgctggcttacattgcggtactggggtttggcctgattattaatattccacatcaagcgttaaacgttgcgggctggattggtaccctaacgtggggtggctatttgattgttcaggcttttgatggtggggtcgtcttaggaagcttaattggctcggtcggtattggcgtcctcagcagcttagcagctcgctacaagaagatgcccgctattatcttcaatattccgagtttagtttcattcgtgcccggcagtcaggcttatcagatggtgcgtaactttgcgctgggtaattatcgtgaggcggtttcattcacgttgcaagtgattatgattactggtgcgattgcattgggattcttattagctgaattactcaaccggcttatcgcattttgtattcgccagtggcggttgcaccgattggagtcgtaacctaactgttggctgattagttgtgaatcgtgaacaaagtttgcggacgctaagactaagcgccataaataaattccgccaaaagtggtgggttagtgcgactaatttgccgtgtgccagcgttctgaatagttacgcgcttagattagttattacgactcgcattcaatacagaaaaaggcgccaactgaactgctctactaagcagttcagttggcgcctttttaattagttagctgagacatcgcaacaagtagtcacgactcttatcatcaaatcagatggttagttttggttagcaaatttttcgccggttgtcgcagcctttaaattaagggacttacgtaagacgttcgtgacccgttgcttttcagattgcgaaacaacttcgaaagactgaccatcaatcatcttaccagtaccctgggcgtgatcagagacgatattcttggttgcactacggtaattagtgacgatactagttaaattaccgaatgttaagtcagtccgtgtttgtttagcaagtgaatttaagaaatcttgtttaagcaagttggaagcactggcgctttctccgataatggcggtaattaattgccgttgccgctgttgccgaccatagtcgccgagtggatcatcataacgcatccgggagtaagccaaggctttggcaccattcatatgttctttttggcccttagtaaaggtgtagccttcgtaggtaaatgtccgaattggagtaatgtcaacgccaccgatttcatccacaacttttttcatgccacccatgttgatcagggcgtaatagtcgattggaacgttcaaccatttttgaacggtcttgatggtcgttccggcactaccataagcgtaggcagcgtttaacttagtcgggaagtcctgttcgaagccggagacagctacttcagaatcacgtggtaaactcatcagggtcgttgtcttagtcttggggttgatcgttgctaagatgatcgtatcggtccggcctttatagttccgcccgagggccccggtatcagttccgagtaataggatcgagacgggtttcttaccattcaatacggcgctcgtattccgactctttttaataccactactcttgaagacggtgtcggccgcattcttggcgttaaaataagttcgcgcggcaaaggccccggtcccaactaataacacggcaataatgattaaaacggtattgcgaacggggtgcttcttcttgggcccgttgccgttcccctgtgaattgtttccttgtgatttctcacgatgcatttctgagcgacttggcatgtcttccatgaactcttcctccaatggtaatagttattcatagtttagcattttttcgggtcagcgggaactgaatccacgtaagatttagcttgattaccgatgactgtcagataaatcataacctttttgttaataaaacgtgattaaaatgggaattctttgtttttttttaaggttccctgagagatattaatgattcgttcagtcgattaatagactatggtataattttgttaattttaatattaaatgggggttcttgttttgatgatcgataagtcgcgtagtcggccgatcaagtttgtcattggggtaattttatttgcctacttaagctattttattagtgacggcgcggttggtattgatttactagatgtggccttaacgtcgctggtccaaattagtaatagcggtatttggacggtattttataaggtgattgcttggttggcgtcacccggaatggacattttgtggatcgtcatcctggcgtttctaatgtacggatttaaatataagattcaagcgttctggacgctagcatatatggttggtgcaatggcgttaggctttattgtcaagcacatcatcggccgagcgcgaccaattggtcatttagcgcaggataccggatatagttatcccagtggtcacgttttaggaacctttgtgttggtcagcgtgattatcatgttgattgttcctgagttgccaagttatcgaatggcaatgatcgtcaagtgggtgagtgtcgtatggttagtattggtcattttctcacgtatttacttgaatgcacattatccaactgatacgattggggccgtgttgttggcatggtcttggagtcaaatcatgcaatggttctacgttttctgggcaccaggattattgaaatggccgttgttttatcgctcatatttataaagacaattaacaaacttaaactaatctattatttagcaggcaaccgtgtcactaaataatagactcaaaataaaaaattgtttgctttaatcgacactactcggctgattgcgagaaattgatcgaagcaaacgattttttgtttacagctataaaatattaactagcaacgactggtaatgaactaacgattatcagctagccattcaagtgctaacgttaaccagtgggcgacgtgcggctgattggcgtctggtttccatgctgtttgtgcattcgcaagggctagtccgtgtgggccatgtttaaagacgtgtagttcataaggaatcttagcagttgctaacgcagtcgcgtaggcaagcgtattggttgctggaacaattgggtcgtcagccgttgtccagataaaagtcggctgattatctgaattgacgtgttggtcagcggccagttcgttcggcgttggtgtccaggtagccaaggtcgcgtcatccttggggaaacctagcaatggactgatgactggatagccgagtaccacgttattcggctttaacatggcgggcgttacgtttaattcagttgccacgcgggtcgcccagtaatcgttatacagtgccacaatgtgaccacccacgctaaaaccagcaggcgtgatctgttgcggatcaatatgccattcggccgcgtgttgacgaagcaagttgactgctcgtcctaaatctaatacgggtgctaatccgagtggttgttgatcagtgagtagcgtatattccaagtaaaaggcctggtaaccgtgcccagcgaaagccatggcgagactctctgcttgcgccactggaatatgcgtgtatgagccgcccggaacgataataatggcgggtaagttcgtttggtgtgcgttcgtatccggttgatgcaaataaccggtcaattgcgcgcacgtcgctgttaatttttgcttaataacttgcatgcaatcacctcaatttgatatggttaacataactattataacgcaagtcaggtggaacagatatgggcatggttacggttacaactcggaatgagcaactcgagttacggccatttacgttggcagatacagaggattattatgacttagttcgtgatccgtcaattgcggcatcggcgggctttacgccagcgcacagcttagtggaagccgaattcttattgaaacagcaagcgaagttaccacagatttttgcgattgaactaacagcgatccaccgcgtgattggcagtgtggggttgtatgagcgcatgacgaatacgggcgaaccagcaactttagagatggatctcgggtatatgttgaacgctcgatattgggggcggggcattatgacggcagcagttgcacgtattttacgatacgggtttgaaacgcttcatttgcggcggatcacagccagttgtctagctaataatccggcgtctaagcgaatcttagagcatgctaattttcgacagtatgatgctgttcgccatccagattacgccccgtttggcgctggtcagacggagttattctttgattgtgtggaattaaacctttaggaggtgagttaatgcaactcgcaaaatcgtttgaacaggccgcctgcgtgttggtattgttggctacacagcaaccggagattccgttgactgcggatgtcttgcacgagcgaattggtggttccgcttcgtatattcgtaagattattcgtaaattagtagtggcaggactggtcacgtccaccagtggaaataacgggggtgtccacttggcacgctcacctgaggacatttcaattacagatgtggtcgcggccatcgaggggacgttgcagacctttccgaattatggttattttgaccgagtatttaaggacgttgaaccggtcgctcatgaagggacgaaagtggtcaacgggattttttcgcgagcggatcaattatggttagattttttagaccagcaaaaactggcgacgttgatcaaggaattattagttgttactcaaatcccagtgttggattggacgaattactcagatgataaaatggcccaattaaatgcgttgcttagtcggatgcgggcacataagtgagacgtcgtacaaactcgataaaaattgggagcggtttcgcttggtaaaccaatattgacgcgcttttgccaatcggggatcattttcaaaatgatacactttatttcacaaggctgaaaatactgttattaaagcgttttttatggtattctaacaatgaatttcacaagatagaggggaacaacatgccagataagaaatattacggggccgatgcgatcgtcgacagccttgtaaaccacgacgttaagtacgtattcgggattccaggcgctaagatcgatcgggtctttgagcgcttggagcacccagtcaacccgaaaagtccgcggttgatcgtgacgcggcatgaacagaatgccgcgtttatcgctgccggaatcggtcggattactgggaaacctggtgtagtgatgacaacatctggccccggtgccagcaatttagccacggggctcgtaacggcaactgctgaaggtgacccagtcttggcaatttctggtcaagttcagcgtgctgacttgttacggttgacccaccaaagtatgaataacgcggcactatttaagccgattacaaagtacagtgcggaagttcaagaaccggaaaacatttcggaagtgctcgcaaacgcctaccaagaagccacagctgctaagcagggcgccagctttgttagtgtgccacaagatgtcactgattcgattgtacgcacacctgttattacaccaatccaggcacctaagttaggacctgctagcccggtcgaagccacgttattagcacaaaaaatcaaagcagctaagttgccggtcttgctagttgggatgcgggcttcttcaccagaagtgacgaaagcaattcggaacttggtggctgctgctaatctaccagttgtcgagactttccaagcggcaggcgtgatctcacgtgatttggaagccaaccatttcttcggtcgggtcgggttattccgtaaccaaccaggggatatgttactaaagaagtccgacttagtgattgcggtcggttatgacccgattgaatatgaaccccgcaactggaatgcggaaggcaaatcccgtatcgtggttatcgatgcaatgcgcgctgaaattgatcataatttccaaccggaaaccgaattgatcggtgatattgcccagacgttagactttttgttgccgtacatgaagggctatgatattagcgatagtgcgcgagcttacttgggtgaattacaagaacggcttcagacgcgtgatttcgtacctaatattgataagcagtccaagttaaatcatccgctgtcagtaattgcagccttacaacaacgggtcagtgatgacatgacagtgacggtcgatgtcggcagtcattatatctggatggcgcgtcactttcggagctatgaaccacggcacttgttgttcagtaatgggatgcaaacgctaggggtggccttaccttgggcaatcgcagcggctttggttcgtccagatacgcaaatcgtatctgtctctggtgatggtggtttcctattttccgcccaagagctggaaacggctgttcgactgaagcaaaatatcgttcatttgatctggaatgatggcacctacgatatggttaaattccaagaagaaatgaagtatggcgaggatgcagcggtccactttggcccagttgattttgtgaagtatgctgaaagctttggtgcgactggcttgcgggtaaaccaacctgctgatttggaaaaagtgcttgatcaggcctttgccacggatggtccagttgtggtggatattccaattgattattctgataacaaggcgttaggtaagacaatgttaccagaccagttttattaaaattaacattagtgaccggttgtcaaaagatggtcggtcagatataatggttgagtatatcgaaagaagaggatgcggttaacaatagtagccggctggaagtgggtcaccacttatgaaggtcagtgaacggggcaaccgccgaaatcgatggatcagtgaccgattcatccgttgggccttggttgaataaatcaaggactgtcgcagctagaatagttgcggggcgctatcgacgatgaaatcagcaattatgtcaatcaatctgattaaagtctttttgcgcacgttatcgtgaggcaaagaggctttttattttgattgtgctaacctgaatcggtgtgaacacttttagatataaatcgatttttggaggttctgcaatggcagaaaaacaacatcaggaagtgcatcgttccttacagacgcggcatttatccatgattgcattaggtggtagtatcgggaccgggctgtttgtcgcgtccggttcggcaatttcaacggctgggccggggggagcattactggcctacgttggtattggagtgatggtttactttttaatgactagtctgggcgaaatggcaacttatttgcccgtttcaggttcgttttccacgtatgccacgaagtttgttgacccggcacttgggtttgcgatgggctggaattactggttcaactgggcaatcacgttagcggtcgatattagtacggcggcgattgtcatgcagttctggttgccatccgtgccggggtgggtttttagtctgattgcgctcgtcttgatttttacgatcaacgcgctgtcagtccggtcgtttggagaaactgagtactggctttcgctaattaaagtggtgaccgtgctcgtattcttggttatcggtgtcttgacgatcgtgggaatcatgggcggtcatgccactggcctcagtaactttacctataaaaaggcaccatttgtcggtggaattccaacgattttgagtgtcttcgtggtcgctggtttttcgtttcaaggaaccgaattaattgggatcacggccggggagtcagcaacaccggagaaaagtattccggcggctattaaacaagttttctggcgtattttgttattttacattttagccattttcgtgattgcggcgattattccttatacgtcgaaagatcttctagggtcatcagcgagcgatattgccatcagtccgttcacgttagtctttaaacgggctgggttggcggctgcggccagtgtgatgaacgcagtgatcttgacgtccgtattgtcagctgctaattcggggatgtacgcctcgacacggatgttatattctttgtcattacagggttatgcccccaagacatttggtcgggtcaatcgtcgtgggattccaatcatggcattattaggaacgacggtgattggattactcacgttcttgtcgagtctattcggtgaacggatttatattttcctcgtttcggccagtgggttaacgggctttatcgcttggctaggaatcgctatttcgcatctgcgtttccgtcgcgcgtttgttaagcaggggcatcaattgagtgaattgcggtaccatgccaagtggttcccatttggcccgtggttcgcctttatcttgtgtgtcgtggtcattattggtcaagacttacattcatttgcaacgcttgattggcaggctattggggtgacctatatgagcatcccgttattcatcatcttgtatgtctattataagattcgctatcatactaagatgattccgctagacaaggttgatttgacacgcaaacgacaccatcaagattaagcacgcactttgatagtttgattaaatgcggttgacactgggtcaatcgcattttttgacggcgagagttggacctgtcaactcaaggcgcggtcgtatttttaggtgtcctgatttatgctgataacactgctcgcaacagatggtcacggcggatcgttatgagtgggggcttgcacgattgtaatgatagcaagcggcaaattgagggtgcgctaatctgatatctatggtaatttgatagaatgagaatatggaatcattaaaaattcgcaaacttatccttaagaataggctagtcggctatgactatgctaagctgaaatgagaaaggcagcgagagagatgttaaagagaaatttgttaagaggtctagcattagtgtcattagcaggtgtcctggctggctgtggtgctagccagttgacgtctaaagcgactagtagttctacgagtgctaagtcgacgaagacgcagaccaagcggcaacgactgattagtgccttaccgaaaggcgttaaatcgaccgatagcgacttagtggtcgtcaataagtggcataagcgcgctgagatgacatttaataagtcgagcgtggatggtattgaagtccgtagttctatcgtcaaaccattggaagcctttctagcgggggcaaaaaaagccggctatccagcaacaatcgtgtctgggtatcgttcagtcgcttatcaaaaagaggtttgggatcagtcgattcaaacctatgagaatcaaggaaaatcagccaaggaagccttaaagctgactaaagaatatgtcgcagttcctagtggtagtgagcatgaaactggtctcgcagcagatatcatgaacacgcactggtacagcactcatggtaatcaattattgtcatcatccgacaagaacaagggtcagcagtggttgattaatcacgcggcggactatggatttgtgttgcgctttactaaagatggtaagcagtcgactgggattgactatgaatcttggcatttccgttacgttggtaaggcgagtgcggaattcatgactaagcacaatttgactctcgaacagtacgtcagtttgctgcaagctcgagaaaaggcggccaagtaataagctagccgtattattgatggccccaattaataccatttatggcgtacgttaggaattagctagcgtgcgcttttaaattgtcttcggtttagcaatgtgggttcgtctcaactgagtattatttggtcacgacagattatgctggtcagaggccgcactcaaagctgaagtgccaccagcgccggcttgggtagtaacccagtgtgtgttagtgagttgcttggatcgctgactagtgcgtcgcagttgtggctggtgcgaagttttttactgaattgactcaccagatattgcattttaagacgtgggtgcgtacaatatgtagtgttgcttttagagataatcaaaattttgacgtgattaaaaggagagacgccccatgcttgtaatgtcaggaacaatcggtgccggcaagacgagtttaacgcagttagtggctaaccactttggttctaaagcgttttacgagtcagttgatgataatcccattttgccgttattttataaggatcctaagaagtacgccttcttattacaaatctattttttaaataaacggttagacagtattaaatcagcttttgctaacgatctggacgtcttagaccggtcgatttttgaagattcattattatttcatttgaatggtgatcttggccgggcgacgaataccgaagttgacatttatgattcattattagataacatgatgcaggaattgccagaagcgtctcatcaaaagagtcctgatttacttattcatatcaatatttcttttgatacgatgctcaaacgaatccaaaagcggggccgttcttacgaacaaattgatcaagatcctgatttatataaatattatcagactttgaatgaacgctatgacgactggtacgctaattatgatcatagcccgaagatgcagatcgacggggatcagctggactttgtcgccgatgcggatgcgcgtaaggaagtcattcggttgatcgacgaaaaagtggctagtttaggctagttgcctttttagaatcaatgttttatagtagacagtgaatattaaacacggcgcgtttttaagtagacgttcagagaaccggtgggtggtgtgaatcggtagtcgaaactccggcgcgacaatgtgggcaggtaatactgcacggcacggccgttatccgtttaagggtgggattaatcatgatcctgaacttgggtggtaccgcgaatcgcagtctcttcgtcccaattgggaggagagactgtttttatttacgattaaaagtgaaaaggagacgtcgttatgttagatgttaaaatgattcgtcaaaatccagattttgtaaaagaacagcttggtcatcggggtgttgctgcgagtgacatcgatgatttattggccgctgatgaaaagcgtcgtgaattgatcgccaagagcgaacaattgaagtcgacgcgtaaccaagtttcaggcgaaatttcacagaagaagcggaacaaggaagacgctagtgccgaaattgcagaaatgcaaaaagttagcgccgatgtgaagacgttggatgaagaacggcggacagttgatgcccaagttcaggatatggctgcacatttaccaaacatgccccatcccgacgtaccagttagcttgaaagaagaagatgccgttgaattacgtcgaatcgggacaccacggcattttgactttacgccgaaagcacattgggatatcggtgaagatttaggcatcttagactttgagcgcggtgctaaggtttctggtagtcgtttcttatactacgtgggcgatggtgctaaactggaacgcgccgtttacaactttttcttagaccagcacgaagctgaagggtatacggaagttttgccgccatacatggtcactgatgaatctatgtacggtaccggccaatttcctaagttcaaggaagacgctttccggattacgacgcaagatttgacgttgattccaacggccgaggtgccattagtcaactattatcgtgatgaagttattcccgctgaaaaattaccagtttactttacggccttatcaccagccttccgtgaagaagctggtagtgctggtcgtgatacgaaaggcttgattcgcttacaccaattcaataaggttgaaatggttaagttcacgaaaccagaagattcatgggatgaattagagaagttgaccaacaatgccgaatcattgctaaagaaacttgggttaccatatcacgttattacgttaacgactggtgacatgagcttcacagctgccatgacacatgacttggaagtttggttcccagaacaagacaagtaccgggaaatctcgagttgttcaaattgtactgatttccaagctcggcgggcgcacattcaatatcgcgatgacgatggcaaattgcaattcgttcatactttgaacgggagtggcttagctgtcggtcggaccgttgcagctattttggaaaactatcaaaatgaagatgggacggttacgattccagatgtattagttccatatatgcacggtaagacgaagattgaaaaacaaggttaattgagatgaagttagcgaactcgcagtgatgcgagttcgctttttttgcataattaatgagtattaaagggaactgtcgattttaaaatgtgagtggaaataacggccgagttgactaaataattgcgggacgggcagaatgtcgggagaacatttcaggcgcaaaagggcgaaaaagctgggtttactgaaatttattcacctttttttgaaaatagggtttgctattttcggctaccgtgctataatatttcttgtcggaaaaatataacttgtttatccagtaaaaagtatatttatccatttatttgaaaaaagttgttgacaagtattcaacatgatgataaagttaaatagttgtcaaggcataccagtaagaactgtttgaaccggcaacaaggcatgattaacatcatgcgggtgtggcggaactggcagacgcgctagatttaggttctagtgtcttacgacgtgggggttcgagtcccttcacccgcacatgccgacttagctcagttggcagagcatctcactagtaatgaggaggtcggaggttcgaatcctctagtcggcatttacaatttaatagctttattatgcggaagtagttcagtggtagaacatcaccttgccatggtgggggtcgcgggttcgaatcccgtcttccgcttttaatttgccggggtggcggaattggcagacgcacaggacttaaaatcctgcggttagtgataaccgtaccggttcgatcccggtcctcggcattttaaataagcacccatagcgcaattggatagagtgtctgactacgaatcagaaggttgtaggttcgactcctactgggtgcattagtatcgggaaatagctcagcttggtagagcacctggtttgggaccagggggtcgcaggttcgaatcctgttttcccgatcgtttaacacagtcttagttaagtgctaaggctttttatttaattttctcgggaagtagctcagcttggtagagcactacgttcgggacgtaggggtcgcaggttcaaatcctgttttcccgattacggttaaaccaactaatccagtcatttggctggattttttttatggccttttttgtaagcaggggtgtttcaacggtcaggggacacttttgcgacgttactcactaagtcagccatgtgaagaatacggtggttgtgactcataatcccgacaaggcaacagccactgttagtcatgagctcggagaaattagtctcggaactgctgttcatcgttgtgataccagtgcccatcgcctgcaatgaggagtgactcaacttgacatattttaaataggtagttcaatgaatatggagacctaataatttaatcattatgaggttctaaacggttgaatcaattgaaagcaaacgtttggcgtgctatgctgtaacaaccgttaagcacatgctagtccgcggtttgggtgaaattctttgcttttttccattatcctcgtataataatagtcaatattagtcaaagataatgaaaagggtgaagcacatgcaaagtcaaaatatctcggatattattgaaaagtatttaaaaagtattttggcggactcggagcatgttgaaattcgacggtcagaaattgccgaccttttcaacgtggtaccctcacagattaattatgtgattaagacccggtttacgatccaaaatggttacttagttgaaagtaaacgtggcggtggtggttatattcgcattgagaaggttaatttggtcgatgatgctgatgtgttggacgccctcatacaggtgatcggcgattcaatcacacaacgagatgcttatgcggtcgtccaaagtttatacgaggacgacgtcttaaatcgtcgagaagcgcaattgattttagtggcgattgaccacgagacgttaggattaacggaccgggatttagaaaacagtctgcgggcccggataattatcggaatcttgaaccacttgcgttacgaaagctaaagaaagcgaggaatcgcaatggataacttatttacacctagtgccaaaagtgtgctggtactggcacaggaacaggccaaatatttcaagcatcaggcagttggtacggagcatttgctattagcattggccatcgaaaagaatggaattgctaataaggtgctacaacaatatgccgttagtgaagatgacattcgtgaagaaatcgaacggttcactggctatgggacgttgagcaatgttggcaaggatacttacttgccatattcaccaaaggccaaagaaattttgtccgttgccggtgatgaagcaaaacggctcggtgccaacaagattggaacggaacatttgttgttagcgatgctctctgatgaaagtatcctttcctcgcgaattttaatgaatttaaacttagatctaggtcagacgcgtaaagtcgttcttcgcaagctaggtgtcagtgacgccatgagtaagcgcaagggtaacgcggctaatcgcggtggcaagaagactgaaggaacgccaaccttggattctctggcgcgcgatttgacccaattagctagtgaacaagaaatggacccggtagtaggtcgttccaaggaagtcaaacgggtcattcagatcctgtcacggcggacgaagaataatccggtcttgattggtgaacctggggttgggaagactgcaatcgccgaaggtctagcccaaaagatcgtggccggtgatgtgccaactgatatggcagataagcgcttgatgatgctcgatatgggatcattagtcgctgggacaaagtatcgtggtgaattcgaagaccgcctgaaaaaagtgattgatgaaatttacaacgatggccatgtgatcttatttatcgatgaattgcataccttgattggtgccggtggtgctgaaggggctattgatgcctctaatattctgaaacccgcacttgcacgaggggaactccaaacgattggggcaaccactttaaatgagtatcaaaagtacattgaatctgacgctgcgttggaacggcgttttgcaacggtcatggtcaatgaaccgaccgaagacgaagccgttgaaatcttagatggactacggccacgctatgaagaacatcatcgggttacgattacggatgaagctgttgatcaagcagtcaagctatccagccggtatatcagtgatcgtttcttgcctgataaggccattgacttgatggatgaggcggcagctaaagtccgcatcgatcagatggatcaaccaacgaagctatccaagaaccaggacaagttagcgcaactgcgtgaggataaggaaacagcgatcgaagcacaagattttgaacaggccgctgatattcgtaagcaggagatgcaactgaagcaacgcctagatcgaatcgaagctgaccaagacgccgaagtgactgagggggcaacaccacactatgatttacaagtcacaggtgaggatattgctcaggtcgttgccgaatggaccggggttccgttaacgcaattgcaaaaatctgaaagtgaacgcttagttaacttggaaaagattttgcatgaacgggttgttggacagccagaagccgtatccgcagtggctcgtgctattcgccgtgcgcgcagcgggttgaaagatccgagtcggccaattggttcctttatgttcttaggaccaactggggttggtaagacggagctagcaaaagccttggcagcagcgatgttcgggtctgaagataatatgattcggctcgacatgtctgaatacatggaacgctattcgactagtcgtttgattggctcggcacctggttacgttggttatgacgagggcggtcagctgacagagaaggttcgccagaaaccatactcggtcgtgctatttgatgaagttgaaaaagctcatccggacgtctttaacattttgttacaagttttggatgacggctacttgacggattctaagggtcggaaggtagacttcagaaatacgattctgattatgacgtcgaaccttggggcaaccacacttcgtgatgaaaaatcagttggttttggtgcaactgataaggccaatgactacaatgcggttgctgcgacgattcgagcaacgttaaaacagacgttccgcccagaattcttaaaccggatcgacgaaacaatcgtcttccattcattgaataaggaagaattacacgaaatcgttaagttgatgtcacaagaaattgttgatcgagtggcccaacaaggtatcaagatcaaaatcactccggctgccattgacgtggttgcgaaggctggctttgaccctgagtacggagcacgaccaattcgacgggcattacagactgaaatcgaagatcggttgagtgaagaattattgaccggcgcgatcaaggtcgatgaccaagttacgattggtgctagcaagggtaccattacaattaatattaaaaaccagcctaaggcagatggtcgttcgaccgtttcctcaaagtaggcgcgattaaattaaagatgacgcttgaagtggtagtccacttcaggcgtcatcttttaggttcaatcggtattaagatgctacccactgaagtgaactgtaggatctgaggctggtggttcggtgctgattggtgtaaattataataggaaataaagtcaagaaagaagatgataacatggcgacacgagccgaacagatggcgaagacgcaccaggcgattttagacacagcccgggaactgtttttaagaaatgggtatgatgcgacaagtacgcgcgacattgcgaatgcgattggcattacgcagcccgcgctttatcaccattttaaagataaagaggtcatctttctggctgtcattacgacggtcggtgcggaaatcaaggctggcattgaagcgattcaagtccgtgcggattggtctccgttggatcaattaacagaagtctcgctattactaacgcataagcatccggctgatgtcttcacgttaattcattccagtttcaaagcattaacgcatgaacatattcgcgagttgggcggcatatttgttactgattatgtgaagccgattcaaaccgtttttgagcaacctgacatgcaactacatgtgggggtcacaccacagatggcgacgaatttctatatcaccagcttgagtccattgtttaacagttttcatcaaatcggtgatcctcatgctgacgagcggacccgcgttcaaactcttttaaagatgatcttatacggggttgcgagtgaaccagaaaactaatggcggcagagaagtctactagttgacaactaacgttattcgatgtatattataacttgtctgtaaccgtgaactcgagcgaacgcgcaatctattgtctgtgcggctcgttaatataaatccaaaaatagtcaacttaagcgactatttttggtttttttatgcctaaaattcggtcaaaaacgcatttgtaacacaaatgtaatatttgaccggaggtggcgggttccggaataataagaaggggtgaacaacttggccggacatttagtaaaatacggtaaacaccgtacccgtagaagttatgcacgtatcaaggaagttcttgatttgcctaacttgatcgaaatccagaccgattcttaccaatggttcttggatgaaggtctccgggaaatgtttgaagatattatgccgatcgacgatttcgcaggaaaactttcacttgaatttgtcgactatcaattattagaaccaaagtacaccgtcgaagaagctcgtgaacatgatgccaactactcggcaccattgcacgttaccctacgtttaactaaccatgaaactggtgaaattaagtcgcaagacgtattcttcggtgattttccattaatgactgaacaagggacgtttattatcaacggtgccgaacgggtcattgtttcacaattggttcgttcacccggcgtttacttcaatgaagaattagataaaaatgggcgtcctagctacggcacaacggttattcctaaccggggtgcttggttagaacttgaaactgacgccaagaatgtctcatacgtacggatcgatcgtacgcggaagattccattgacggaattagtccgggccttaggctatggttctgacgatgacattattgacatgttgggtgaaactgacagtttgatgttgacgttggaaaaggacgttcataagaacaccgacgactcccgggttgaagaatccttaaaagatatctacgaacggctacgtcctggtgaacctaagacggctgacagttcgcggagcctattgactgctcggttcttcgatccaaaacggtatgacttcgcaccagttggtcgctacaaggttaacaagaagttaagcatgaagacgcgcttaatggaccaaacgttagctgagacattagctgatcctgatactggtgaagttattgcgcaaaaggatacggtcattgacaagaatgtcatggctaaactatccccatacttggaacgtgacgactttaagacggttacttacacaccatctgacgaagccgttgttacgaatccaatggtcttacaagttgttaaggtttattcacaaaacgaccctgaaaaggttgtgaacgtgattggtaatggcaacattgatttgaagttcaagcacattgtgcctgctgatatcattgcttccattaattacttcttcaacttgcaagaaggtcttggctcaaccgatgatattgatcacttgggtaaccggcggattcgttccgtgggtgaattattgcaaaaccaattccggattgggttatcccggatggaacgggttgtgcgtgaacggatgtcgattcaagatgctgcgacggtaacgccacaacaattgattaacattcgcccagtggttgcttcaattaaggaattctttgggtcatcacaattgtcacaattcatggaccaaaccaaccccttaggtgaattaacgcataagcggcgtttatcagccttaggacctggtggtttgactcgtgatcgggccggatatgaagttcgtgacgtgcactatacccactacggtcggatgtgcccaatcgaaacgcctgaaggccctaacattggtttgatcaacagtttgtcttcttatgcgaaggtcaaccgttacggcttcatcgaaacgccataccggcgtgtcgattggacaacgcataaggttaccgataagatcgactacttagcagccgatgaagaagaccaatttgtgattgcacaagccaactctccattgaatgatgatggttctttcgttgaagacactgttttagctcgtaacaaggaagaaaacttggaaacgccaatcgaaaatgtcgattacatggacgtttcgcctaaacaagtggttgccgtcgcaacggcatgtattcctttcttggaaaacgatgactctaaccgtgctttgatgggtgccaacatgcaacgacaagcggtgccgttacttgatcctcacgcgccattaattgggactgggattgaatataaagctgcacatgactcagggattgccttgatttgtcgtcatgaaggaacggttgaatacgttgatgctcgcgaagttcgcgttcgtcgcgatgatggttcattagacacttacaagttaatgaaattccgtcgttctaacggtggtaagaactataaccaacggccaatcgttaaagttggcgatcacgttgataacgatgaagtcttagccgatggtccagcaatggaaggtggggaattagcccttgggcaaaacccattagttgctttcatgacttggaatggttataacttcgaagatgccatcattattaatgaacgtttagtccgtgaagacgtctacacgtcaattcatattgaagaatatgaatcagaagcacgtgacaccaagcttggacctgaagaaatgactcgtgaaattcctaacgtcggggaagatgcattgaagaaccttgacgaagacgggattatccggattggggccgaagttaaagacggtgacatcttggttggtaaggtaacgcctaaaggggttacggaattgtcagctgaagaacggcttctccatgcgatctttggtgaaaaggcgcgtgaagttcgggatacgtcactccgggttcctcatggtggcggcggtatcatccaggacgttaagatcttcactcgtgaaaacggtgatgaattatctcctggcgttaacatgatggttcgggtctacatcgcacaaaagcggaagatccaagttggtgacaagatggccggtcggcatggtaacaaagggacggtttcaatcgtggttcctgaagaagacatgccgtacatgcctgatgggacaccaatcgatatcatgttaagcccaatgggtgtgccttctcgtatgaatatcgggcaagtgctcgaattgcatttggggatggctgctcggaagttaggaattcacatggcaacgcctgtctttgatggtgctcaagatacagatatttgggaagccattcgtgaagctggggttgattcagatgccaagtcgatcgtctatgatggtcggactggtgaaccgttcgataagcgggtcgctgttggggtcatgcactacatgaagcttagtcacatggttgacgataagatccatgctcgttcaatcggaccttactctttggttacgcaacaaccacttggtgggaaagcgcaatttgggggccaacgtttcggtgaaatggaagtttgggccttggaagcttatggtgcagcttataccttgcaggaaatcttgacttacaagtccgatgacgttgttggtcgggttaagacctatgaagcaatcgttaagggcgaaccaattccaaagcctggcgtaccggaatcattccgcgtgttggttaaggaattgcaagcactcggtcttgacatgaaagtcttagattctgaagacaaagaaatcgaattgcgggacatggatgatgatgacgatgaagttgtcaatgtcgatgcactcagcaagtttaaacaacaacaagatgagaaggctgcggacaaggccacaaaagctgacgccgctaagccttctgaaacaaccaacgctcagcaagataatcaataaaaagggaggtcggtcctttgatcgatgtcaacaagtttgaaagcatgcaaatcggtctggcatccccagacaagattcgcagctggtcatatggcgaagtcaaaaagccagaaaccattaactaccggacattgaaacctgaaaaagacggtctgtttgacgaacggatttttggtcctactaaggattgggaatgtgcttgtggtaaatacaaacggattcgttataagggtattgtctgtgaccgttgtggggtcgaagtgactcgtagtaaagtccgtcgtgaacggatgggtcatatcgaacttgccgcaccagttactcacatctggtactttaagggaattcctagccggatgggcttagtcttagacatgagtccccgggcacttgaagaaatcatttacttcgcttcatacgtcgttatcgaatctggtaatacgccacttgaaaagaagcaattactttctgaacgtgaataccgtgagaagaaggctcaatatggtaacgaatttgaagctgccatgggtgccgaagccatcaaacggttattgaataacgtggatcttgaaaaagaagcacgtgatttaaaggaaactctgaaggatgcttctggtcagaagcggacccgggccgttcggcggcttgatatcatcgaagctttcgtgacatctggtaacgaaccagcttggatggtaatggacgcaattccggttattcccccggacttacggccaatggttcaattggaaggtggtcgttttgccacctctgacttgaacgacttgtaccggcgggttatcaaccgtaataaccggttgaaacgcttgttggacttaaatgcacctgggattatcgtgcaaaacgaaaagcggatgttgcaagaagccgttgatgcgttgatcgataatggtcgtcgtggccgtcccgttgctggtcctggtaaccggccattgaagtctctttcacacatgttgaaagggaagcaagggcggttccgtcaaaacttacttggtaagcgggttgactattctggtcgttcggttatcgatgttgggcctttcttgaagatgaaccaaatgggcttaccacgtcaaatggcgttggaattgttcaaaccgtttatcatgaaggaattggttaaacgtgaattagcttctaacatcaagaatgctaagcgaaagatcgaacatgctgatgacgatgtctggggtgtgttggaagacgttatcaaggaacatcctgttctcttgaaccgcgcccctacgcttcaccgtttagggattcaagctttcgaacccgtcttggttagtggtaaagcgatgcggctccatccattggcttgtgaagcttacaacgccgatttcgatggggaccaaatggctattcacgtcccactttcagatgaagcccaagctgaagcacggctcttaatgttagctgcccaccatattttggcgcctaaggacgggaaacccgttgttacgccatctcaagatatggttatcggtaactactacttgacgactgaagaaatcggtcgtgaaggcgaaggtatgatcttcaaggacttgaatgaagctcaaaaggcttaccaatcaggttatgtacatttgcatagccgggtcggcattcaggtctcatcaatgcctgacaagccattcacggacgatcagaagcaagcagtcttagtcacgacggttggtaaggcaatcttcaacaacattttgcctggcaagttcccttacttgaacgaaccaactaacgataacttgattgctggtacaccggacaagtatttcttgaagcctggtgaagatattcatcaattcttggatgcccaggaaatcattccaccattcaagaagggcttcttggccgacattatcgctgaagtttacaagcaatatcacgtgacagcaacgtcactcttgcttgaccggatgaaggacttaggttacaacatttcaactaagtctggtttgacggttggggttgccgatattactggtttgaaagaaaaaccagcaattatcgccgaagcccataaacaagttaatacgatttcgaaacagttccgtcgtggtttaattactgatgacgaacgttatgaacgggtcattggtgtctggaacgacgctaaggaccaaatccaacaaaaactgattgaaagtttcaacgcggataacccaatctttatgatgagtgattctggtgcgcgtggtaacatttcaaactttactcagttagctgggatgcgtggtttgatggctgcccctaacggtaagatcatggaattaccaatcctttcaaacttccgtgaaggtttgtctgtcttggaaatgttcatttcaacccacggtgctcgtaaagggatgaccgatacggcgcttaagactgccaactcaggttacttgactcggcgtctggttgatgtggctcaagatgttatcgttcgtgaaaaggattgtgggactgaccgtgggttgcggattcacgcaatcatggaaggtaacgaagtcatcgaaccgttgtatgaccggatcttaggtcgttacacgatgaagactgtctttgatcctgaaacgcatgatgaaattgttggtaacaacgtcttgatcgacgaagacttagctcataaaatcgttgatgctggtgtaacggaagttacgatccgttctgcatttacttgcaacactaagcatggggtttgtgaacattgctacggccgtaacatggctactggtgatgaagttgaagttggtgaagctgttgggacagttgccgcacagtctatcggtgaacccggtactcagctgaccatgcggaacttccataccggtggtgttgccggggacgatattacccaagggttgcctcgtgtgcaagaaattgtggaatcacggaatcctaaagggcgtgccgaaatctcagaagttactgggacggttgaattaattgaagaaaatccagcggaacggacgaaggaagttacggttaagggtgaaactgatacccggacttacacgttgccgttaacagcacggatggcggttagtgaaggcgactttattcaccgtggtgctgcgttgaacattgggtcgatcgatcctaagcaattgattcaagtacgtgatgtcttatcaactgaaaactacttgctccgtgaagttcaaaaggtttatcggatgcaaggggttgaaattggcgataagcacgttgaaatcatgattcggcaaatgttacggaaggttcgggtcatggatccgggcgataccgacgtcttgcctgggacgttaatggatattgcagacttcaaggacgagaactacaagaccttgattgctggtggtattcctgcaacgtcacggccagtcattcttgggattactaaagccgctcttgaaacgaatagtttcttgtcagctgcttcattccaggaaacgacacgggtcttaactgatgctgctattcgtggtaagaacgatccactgatcgggcttaaggaaaatgttatcattggtaagatcattcctgctgggactggtatgccgatttaccgtcatatcaaaccaaaggaagttggcaacgtggctgatggggtttactcaatcagcgaccttgaaaaacaaatgcaagaacaagatgctagcaagtaattgctaagtaactaaaaagggcggccattgtggtcgtcctttttgtatgcacgattgtaggtaggctatctggggcgttcggcgatgaaggttaatcttcagggggagaagcctaactgagcctcactggaaaagttcaagtttgtgtaaacttgcttagttagtgtgtcctgcactgcgctccaggcatttctgctaattgctggactgccgtgccttaatactatattggtgaaacgtgttcagattggaatgagactttcggttagctaacactaatcctcagtctcagcccgtctaaaccggacactcttgcagtgctaagaaacgtcttccgctcgggatggtgttcgaatggtgggcacgtgcgtacgcaacttttgacggattagtcgttacttttttgagaccggaatcttatcgggtaactttcaggttaataatagaattgtgagctgtccccgatttctaaatcaccatattactactgagggtcagaacaactgatacaatattaacgcttgtttaaagttccaagtagtaaacaattcgacaacaaattgtaccaagttgagtggtcgttcatccgcacaggacgcgtactgactaacaagcaataatcgggcgtactagaatattgcaattatagctcgctatgcgagacccgtgagttgggtgaccatgatgaagctccaactgatgaagggcacaaatggtaagcgatggcgtggggcactgatgataaaaccaactaatgcggcaacggccgcaatggcgagacaggtcaacagtgtgtcggctggaatgatgaagacaagcatgagtagaacgtcaacatcgccgagaccaagggtggcagttagccgggccagcaagtataacccgactagtaaggcaagtacgaggtagagactgatcgtcaggggtggccgttgttgccataagcccagtccggctggaagaagtaatgtcagcgggtagacttcaaaagtgagataatcagtaagactattgaaaatcaataccaagtaactaatcagcagtggcagcgtcaatgacaatgacgcactgctagaaactagtagaccaccacaaagtaattcaattagactggaacggaggctgataggagtgcgacaatcatagtactgcccccgttgaagcagaatgccgagtaatggtatcagttgccagaaccgtaattgatgtcgacagtgtggacaccgtgatcgttgagtgctaatgagtatgtgtccgctgctgatgcgttccgccatacaggtcacgaatgagcccagacagagaccaataataaaaagactgctggttaacatggaaggaccacctttcatcactagttacgcaatgtaaagcatcactattttttcaggacatttattgacaacttcggcatgtcatgatagtctagtaaaggtgctttttgcagacagattcctgtatcaggaatacagacatgctgactggtcggctaagcgcacaattaccatgctccaggcattcttttttactcaaaaaagaaccacctggatgtgtggacttaaaaaacagatatttggaaggaggacactttagaacatgccaacaattaatcaattaattcgcaaaggccgtaagtctaaagtatcaaaatcaaatgccccagcgttaaactttgggtataacagttacaagaaggttgcaactaataacccagcgccacaaaagcgtggggttgctactcgtgtcggtaccatgactcctaagaagcctaactcggctttacggaagtatgcccgtgtacgtttatctaacttaatcgaagttacagcttacattcctggtattggtcataacctccaagaacatagcgttgtcttaattcgtggtggtcgtgttaaggatttacctggtgttcgttaccatgttatccgtggtgctttggatactgctggtgtcgaagatcgtcgccaaagccgttccaagtatggtaccaagaagccaaagaaataataaggaggtaagttaaatgccaagaaaaggtgcacctgcaaaacgcgaagttttagcagatccaatgtataactctaaattagtaacgcgtttaattaaccacttaatgttagatggtaagcgcggtaccgcatcaactattttgtatgatgcttttgatcaaatcaaagaacaaactggtaacgatcctttggaagtcttcgaagaagctatgaagaacgttatgccagtacttgaagttaaggcccgccgtgttggtggttctaactaccaagttccaatcgaagttcgcccagatcgtaagacgactcttggccttcgttggatcgttcaatatgctcgctcacgtggcgaacacactatgtccgaccggttagctcgtgaaatcatggatgctgctaacaatactggtgcttcagttaagaagcgtgaagatactcaccggatggctgaagccaaccgtgccttcgcccattatcgttggtaatatttccgtgagatggttaaaggtcgcctttaactaatcacaaaaaggtgactattatatgcgcgcatatagtagtcattttttgaaataaactttatactgttaattccatttatattgagaggagtaacacattttctaatggctaatacacgagaattctcactcgataagacccgtaatattggtattatggcccatatcgatgctggtaagaccacgactactgaacggatcttgtactacactggtaaaattcacaaaattggtgaaacccatgatggtgcttcacaaatggactggatggcccaagaacaagaacgtgggatcaccattacctctgctgccacgactgcacagtggaagaaccaccggattaacatcatcgataccccagggcacgttgacttcactgttgaagttgaacgttcacttcgggttttagatggtgcgatcgccgtattggatgcccaatcaggtgttgaacctcaaactgaaacagtttggcgtcaagcatcaacgtataacgttccccggatcgttttcgttaacaagatggacaagattggtgcggacttcaagtactctgtaagcacgatccatgatcgtttacaagctaacgcccacgccatccaattaccaattggtgccgaagataatttcgaaggggtcattgacttaatcgaaatgaaggctgacctttatgatgaagatcaacttggtactgaatgggatacggttgacgttcctgatgaatacaaagaagaagcccaagctgcacgtgatgacttaatcgaagccttagctgacatcgatgacggcatcatggaaaagtaccttggcggtgaagaaatcagcaaagaagaaattaaggctgctatccgtaaaggaacgttagcacttgaattcttcccagtattagctggttcagccttcaagaacaagggtgttcaaatgttaatggatgccgttgtggactacttaccatcaccacttgatgttaagccatacaaggctactgatcctgaaactgaagaagaagttgacttgattgccggtgatgataagccattcgctgccctagcatttaaggttgctactgacccattcgttggtcgtttgactttcatccgggtataccaaggtactttggaatctggttcatatgtcttgaacgccactaaggacaaacgtgaacgggttggtcgtttacttcaaatgcattctaaccaacggaaagaaatcccagaagttttctctggtgatatcgccgctgcaattggtttgaagaacacgactactggtgactcattgacttcgattgaccatccatatcacttggaatcaatggaattccctgacccagttatccaggttgccgttgaacctaagactaaggctgaccaagataagatgaacgttgccttacaaaagctttctgaagaagatcctactttcaaggctgaaactaaccctgaaactggtgaaactttgatcgccgggatgggtgaattgcatttggatatcatcgttgaccggatgcggcgtgaatttaatgttgaagccactgttggtgcgcctcaagtttcataccgtgaaacctttactaagagcactcaagttcaaggtaagtttgttcaccaatctggtggtaaaggtcaatatggggatgtttgggttgaatttacacctaacgaagaaggtaaaggcttcgaattcgaagatgccatcgtcggtggggttgttcctcgtgaatacattccttcagttgaacaaggtttgaaggaagctatggctaacggtgtgttagctggttatcctttggttgacgttaaggctaagctctatgatggttcttaccatgatgtcgattctagtgaagcagccttcaagattgccgcatcattagcattgcggaatgccgttaagactgctggccctgttatccttgaacctatcatgaaggttgatatcgttgccccagaagattacttaggtgatgttatgggtcacgttactgctcgtcgtggtaacatcgaaggtatggaagaacgtgggaatgcccaagaagttcatgcatacgttcctttggctgaaatgtttggttatgcaaccacattacgttcagctactcaaggtcgtgggactttcacaatgacctttgatcattacgaaaaggtaccaaagtcagttcaagaagatatcatcaagaagaatggcggcactcctgccaaataagcttgattgataataagaaggacgttcagcttcggctggacgttctttttttacataaatttctggtcgaactaaatgtgattattgctcgtcgtaagacaacgtggcacatcaattgaagcggcttgggatagtttggccgtcactggcattgggtacggctgtgacgagcacagtgctgctcaggcctgtgtcatcgcgcaagggtacaatcgcgcaacaagggtcgcactagttaagttactagccgctgcgaccataaaactggcagccataatattaaagggtgcgagactcatagcataataaggagaacgcggacaacatcacattttttgtaccggagataaccacatgagttgacggttgtcggtgaccacggccaaggtgctgacggtcggtggtaagcagatgacaatataatagaaggtagatgaacaagaacgtgggtcagtgtgacggcgccgtcagatgtaggagcgattgaattaagcgtgttgaagtccgattaaatgactccagacaaaaatgtatgacgctgaacgcgggtcttgttcctgagaaagtgttaatgcaatctagtaggtgtccacatgatcgtggccggtcggcagtgagaaatgtaaagcgctcaccaaaaagaaattaggcgcaaacgctattaattggatggaatttgtgttacattaattgagctggttcaaaaaggtaacacggtttacaacgatggttataaaaaaagtgcgaaaacacttgctattacagagcttttcatttattatagattgtgcttggtatttagaaggggataactatatccccatcatcaagtagtcgtagttagctttgatgtgaaaggttgcgacacgcccggccacattgtcatgggacgtggcggtaattttcacggagctagtcttattttcaaaatagacgaaggaggtcacaacaatggcaaagcaaaaaattcgtattcgcttaaaggcatacgaacaccgcattcttgatcagtcagctgacaagattgtcgaaacggcaaagagaactggtgctactatttcaggtcctattccattgcctactgaacggactatttataccgttctacgttcaccacataagtttaaggactcacgtgaacaattcgaaatgcggactcacaagcggttaatcgatatcgttaacccaacgcctaagacggtcgactcattaatgaagttagacttgcctagcggtgtagatattgaaatcaagctttaatttactaaactaaaatcaattaattggaggtgtactcatgaccactaaaggaatcttagggaaaaaggtaggaatgacgcaagtcttcactgaaagcggcgaattagttcccgttacagttgttgaagttcaacctaacgttgtgttgcaagttaagaccgttgaaaatgacggttacgaagcaatccaattaggtgttgacgacaaacgcgaagtcttgacgaacaaacctgctcaaggtcatgcagcaaaagcaaaaacgactcctaagcgcttcattcgtgaaattcgtaatgttgagcttggagattacacagtaggtgacgaagtcaaagcggatattttcgcagctggcgacgccgttgacgttacgggtatcactaaaggtcatggttaccaaggtaatatccataaggacggccaaagtcgtggaccaatggctcacggttctcgttaccatcgtcgtcctggttcaatgggtgccatcatcaaccgggtattcaaaggtaagaaattaccaggccggatgggtaatcaccaacgtacgatgcaaaacttacaaatcgttcgtgccgacgttgaaaacaacgttttattaattaaagggaatgtccctggcgccaacaagtcatttgtaacagttaaaacatctgttaagagtaaataaggaaggaggacataatacatgactagcgtagcattatttaaacaagacggtacgcaaaatggtgacgttactttgaacgacgctgtgtttggtgttgaaccaaacgaaaacgtggtttttgatgccatcttgatgcaacgtgcatcaatgcgtcaaggaactcacgcagttaagaaccgtagtgctcgtcgcggtggtggtcgtaaaccatggcgtcaaaagggtactggtcgtgcgcgtcaaggttctatccgttcaccacaatggcgtaaaggtgggattgtcttcggaccaacccctcgttcatacagttacaaattacctaagaaggttatgcgcttagctttgaagtctgtcctttcacaaaaggtcttagacaacagcttagttgcagttgatagcttagctttcgacgcaccaaagactaaggattttgtaaatgtattaaacaacctcaacgtcgataccaagactcttgttttggttgaagaggacaatgaaaaggctgctttggcaggtcgtaacttaccaaatgttaagatccttaaagccaaaggtgttaacgtcttagatgtcgctaatagtgacaaattagtcgttacccaaaaagccctcgatcaattagaggaggcgctcgcataatggaagcacgcgatgtaattttacgtcctgtagttactgaatcatcaatggctgacttggacgacaagcgctacacatttgatgtcaacgtacaggcaacgaaaacccaagttaaaaaagcaatcgaagaaatcttcgatgttaaagtcgttaaagtgaacgttatgaacgttaaaggaaaacttaagcgccaaggtcgttacgccggctacactaagaagcgtcgtaaggctattgttaccttaagttctgattctaacgaaatcaagttgttcaacgacgatcaacaataaatctaatttaggaggtaactctagtgggtattaagaagtataaaccaaccactaacggccgtcgtaatatgactgcttcagatttctctgaaatcactaagacgaagcctgaaaagtcattattagactcacaaagtcacactgccggtcgtaacagttatggtcacattactgttcgtcatcgtggcggcggtcataagcaacaataccgtttggttgactttaagcggattaaggatgaagttccagcaaccgttaaggcaatcgaatatgatcctaaccggacagctaacattgcattattagtttacgctgacggtgtgaaatcatatatcttagcaccaaaaggtttggaagttggtatgcaagttcaatcaggtgccgaagccgacatcaaggttggtaacgcattaccattaactaacatccctgttggtactgttattcacaacattgaattgaagccaggtaagggtggccaattagctcgctctgctggtacctcagcacaattactgggtaaggaaggcaagtacgcaattgttcgtttgtcttctggtgaagttcgtttagtattattaactagccgtgctactattggtactgttggtaatgaacaacacgaattaatcaactcaggtaaagccggtcgtacacgttggcaaggtaagcgcccaactgttcgtggttctgtaatgaaccctaacgatcaccctcatggtggtggtgaaggtaaagcaccaatcggtcatccatctccaatgtctccatggggtaagaagacgcttggtaagaagactcggaacaagaaggctcgttcaaacaagcttatcgttcgtggtcgccgtccaggcaaacactaataaaatttgaatttactgtagttatcgagaggaggtcacacgatgggtcgtagtttaaagaagggacctttcgcagatgcgcatttattaaagaaaatcgatgcacaatctgattctgacaagaaatctgtcatcaagacgtggtcacgtcgttcaacaattttcccaagttttatcgggtacacaatcgctgtttatgatggtcgcaagcatgtcccagtttacatccaagacgacatggtcggtcataagttaggtgaatttgtaccaacacggacgttccatggtcatggaactgacgataagaaaacgaagtaatagttaggaggatataaagaatggctgaacaagtaacatctgcacgtgcaactgcaaaaactgttcgtattgccgctcgtaaggtccgcctagttgtcgatcttatcagaggtaaaagtgttgccgaagccttagcaatcttgaagttcactccacggggtgcttctccagtagtagaaaaagttttactttctgctgttgctaacgctgaaaataactttgacttagatcgcgaagatttggtcgtaagcgaagcttttgttaacgaaggaccaaccttaaaacggttccgtccacgggcaaagggttctgcttcaccaatcaacaagcggactagccacattacgatcacagttactgaaaaataggagggataacgcgtgggtcaaaaagtaaatccaaccggattacgtgtaggaatcattcgcgactgggaagcaaaatggtacgctgaaaaagattttgctgcctacttgaacgaagatttacgcatccgtaagtatatcgaacaacgacttgccgacgcttccgtctccaccgttgaaatcgaacgcgctgcaaaccgcgtaaacatttcaatccataccgcaaaaccagggatggttattggtaagggtggttctgaagttgaagctcttcgtaaagaattaaacaatttaactggtaagcgagtacacatcaacatcatcgaaatcaagaagcctgatttagatgctaaattagttggtgaaagtattgcgcgtcaattggaaggccgggttgctttccgtcgtgcgatgcgtggtgctatgcaacgtacaatgcgttccggtgctaagggtattaagacacaagttgctggccgtttaaacggtgccgacatgtctcgtgttgaagcatactcagatggtacggttccattgcatacgcttcgtgctgacatcgactattcatgggtcgaagcacggacgacttacggtaaattaggtgttaagacctggatctaccgtggcgaaatcttgccagaaaagaaatctgctaaaggaggaaactaaacatgctggtacctaaacgggttaagtatcgtcgtgttcatcgtggtaaaatgcgcggtgaagctaaaggcggtaaaacagttgcttttggtgattacggtttacaaaccctcgaatcacactggatcagcaaccggcagattgaagctgcccgtgttgctatgaaccgttacatgaagcgtggcggtaaggtatggattaagattttccctcacaagtcctacactgaaaaaggtgtcggtgtccggatgggtaatgggaaaggtactcctgcaggttgggtagcaccagttaaacgtaacaagattatgtttgaagttgctggtgttccagaagaagttgcacgcgaagctttacgcttggctggaactaaattacctgttaaaactaagattgttaagcgtgaggaagtaggtggcgaatcagatgaaggctaaggaaattaaagcattgtccactactgaaatgctcgaaaaagaaaagtcttacaaagacgaacttttcaacttgcgttttcaattggccactggtcagcttgaaaacaccgctcgtttaaaacaagttcgtaagaacattgcgcgtattaaaactgcgttgcgtgaacaagagttaaacaagtagagtataaaggaggcaatcacgaatgagtgaagatactcgtaatagccgtaaggttatccaaggacgcgttgtttctgacaagatggacaaaaccattgttgttattgtcgaaacttacaagaaccatccggtatacggcaaacgtgttcgttattcaaagaaattcaaggctcatgatgaaaagaatgaagctaaaactggcgatatcgtcaagatcatggaaactcgtcctctatcagctactaagcgtttccgcttaattgaagttgttcaaaaagctgttattatctagattattagctgaataaaattacatgaagggaggacacttactgtgatccaacaagaaagtcgtttaaaagttgctgacaactccggtgcccgtgaaatccttactattaaggtattaggtggctctggtcgtaaaactgctaacattggtgatgtcattgttgctacggttaaacaagcaacacccggtggtgttgtcaaagctcatgatgtcgttaaagctgtgatcgtccggactaagtctggtgttcaccgtgctgacggttcatacatcaagtttgatgaaaatgctgcagttattattcgtgatgacaagactccacaaggtactcgtatctttggacctgtcgctcgtgaattacgtgataaggacttcatgcgtattgtttcattagcgccagaagtactctagtcacacaccgtaaataaggaggtgcgcaacctaatgttgattaaaactggtgataaagttcgagtaatcagcggtaaggatcgtggtcaagaaggtactgttaaaaaggttatctctgccaagaaccggatcgttgttgaaggtgttaacaagatcaagaaacaccaaaaaccaacgaacgttaacccacaaggcggtatcgtggacatcgaagcaccaatcgatgcttctaacgttatgtaccttgacccatcaaccaacgaacctacacgtttaggtgttcgtcgtgaagatggcaagcgtgtccgttacgctaaaaagtctggtaaagacttagaaaactaagactgactgaaaggaggaagcaagtttcatggaaaaccgtttaaaagctcaatatgaaaaagaaatcgttccagcattagttgacaagttcaattacacttcagtaatgcaagtgcctaagctggctaagatcgttttgaacatgggtgttggtgatgcagttaccaacgctaaaaacttagacgaagcagttgaagaattaactttgatctccggtcaaaaaccattggttacccgggcaaagaaatctatcgctggtttccgtcttcgtgaaggtatggcaattggtgccaaggttgacttacgtggcgaacgtatgtatgacttcttggacaagttgatcaatgtttcattaccacgtgttcgtgacttccatggtgtaagtactcgttcatttgatggtcgcggtaactacacattgggtgtccgtgaacaattgatcttcccagaaatcaactatgataatgttaaccgtgttcgcggtttagacattgtaatcgttacgacagctgatagtgatgaagaatcacgtgagttgttaactcaatttggcatgccatttgctaaataaccgaagggggttaatcgaagttggctaaaaaatcacaaattgctaaacaaaagcgcggtgctaagtttaacgtacaaaactacacccgttgtgaacgttgtggtcgtccacattcagtttaccgtaaattccacttgtgccgtatctgcttacgcgacctggcccacaaaggtcaaatccctggtatgaaaaaggccagctggtaaaaacaaacccaagttaaaggaggttaaactttcatgatgactgatccaatcgcagatttcttgactcgtatccgtaacgctaatatggtacgccacgattcactagaagttcctgcatcaaaaatcaaacgcaacattgctgaaattttaaagaatgaaggttttgttcgcgacgttgaatacatcgatgatgacaaacagggcatcatccgcgtcttcttgaagtatggtaaggacaacgaacgtgtaatcagtggcttgaagcgtatttcaaagccaggtttacgttcatacgtcaaggctgatgctgttcctaaggttttaaacggtttagggattgctatcatctcaacttcagaaggtgtcattactgataaagaagctcgcgccaagaagcttggcggcgaagtattagcttacgtttggtaatcattaattaagacgggaggtgcaagtaagtgagtcgtattggttataaagtaattgaactacctgctggggtagaagtatcacaagctggtgaagtcgttacggttaagggtcctaagggtactttaacgcggaacatcgccagtgatattacgatgacggttgaaggcaacgaagttaaattcactcgtccatctgatgactacaagatgaaggcattacacggtactacccgtgcaaatgttaacaacatggttgaaggggttactaaaggctttactaagaaccttcaattggtcggtgttggttaccgtgcccaattgcaaggcaagaagttagtattaagcgttggttactcacaccctgttgaattcgcaacgcctgaaaacttgactgttgaagttcctgataacacgcatatcaatatttctggtattggtaagcaagctgttggtgactttgctgccgaagttcgggccgttcgttcacctgaaccttacaaaggtaaagggattcgttacgtcgatgaatatgttcgtcgtaaggaaggtaagactggtaaataatgcagcgtaaagctgtccatactaatatatagaggtgactattgtgatttccaaaccagataaaaacaaaacacgtcaacgtcgtcacgcacgtgttcgcggtaagatttctgggactgctgagcgcccacgcttaaatgtttatcgttcaaacaaaaacatctacgctcaagttattgatgatgtagagggtgtaacgctcgcaagtgcctcaactttagatagcgaagttaaaggtaacaacaagactgaaaaggctgcatctgtcggtgaagttgttgctaagcgcgctgctgaaaagaaaatcgttgacgtcgttttcgatcgtggcggttacttatatcatggtcgggttcaagctttggctgaagccgctcgtgaaaacggacttaaattctaacaaaggaggaataataccatatgactttcattgatccatcaaaattagatcttgacgataatgttgttgccattaaccggattaccaaagttgttaaaggtggtcgtcgcctacgttttgctgcattagtaatcgttggggaccacaagggacacgttggtttcggtactggtaaggctcaagaagttccagaagcaattcggaaagcttccgaagctgctaaaaagaacttgatcactgtaccaatggttggtaccaccattcctcatgaagcacttggtgtttacggtggtggccgcatcatgcttaagccagccgttgaaggttctggtgttgccgctggtggcgccgttcgtgccgtcatggaattagccggtgtggatgatgttactagtaaacgattaggctcaaacacccccgttaacgttgttcgtgcaacgttcgaaggcttaaagagcttaaagactgctgaacaagtcgctgctttacgtggcgtttcagccgaacatttagctgaatagggaggacaaacaacatggctcaattaaagatcactttagtacgcagtgctgctcaccgtcttcctaagcaacgtaaaatcgttaaggaattaggtttgggtcggattaatagttccgttgttaaacctgatgacgcagcaactcgcggtcaaattttccacatcgcacacttagtcgatgtcgaaatcatcaagtaattcaaattttcaaagaggaggtgcctactaaatgaagttacatgaattaacacctagtgaaggttcacgtttttcacgtcgtcgaattggtcgtggtgactcaagtggccaaggtaagacttctggtcgtggccaaaaaggtcaaaaggcgcgtggtaaagttcgtgtcggtttcgaaggtggccaaatgccattgtaccgtcggattcctaagcgtggatttactaacattaaccgtaaagaatatgcggttgttaaccttgacggcttaaaccgttttgatgatggtgccgaagttacaccagaatcattaaaggaagctggcttagttaagaagagttctgctgttaaagttcttggtaatggtaaactcaacaaaaagttaacagttaaggcaagcaagttctctgcaacggcggttgcagccattgaagctgctggcggtaaaactgaggtgatctaatttgctgactaccatgaagaacgctctcaaagttaaggatattcggaataaacttctgttcacgttgggcgttttgattgtatttcgtcttggctcttatatcacagttcctggagttaatgcacaggcacttcagtcggtggcatcttcagggctgataagtatgttgaatacattcagtggtggcggtttaacaaattattccatccttgctatgggggtatccccttacattactgcacaaatcatcgttcaattgttacaaatggacattgttcctaagtttgttgaatggggcaaacaaggtgaagttggtcgacgcaagcttaatcaagcgacccgttggttaacgatcgtcttggcctttgttcagtcgattgggattacggctggttttaactctttgagtcaactcaagctcgttaacaatccaagtatttcgacttacctgaccattggggtgatcctcactggtggggcaatgctgacgacttggatgggtgatatgattacggatcgaggaatcggtaatggggtttccattattatcttcgccgggatcattgcccgtatgccaacatcgatttatcaaatttatcaagaacagttcgttaatgtttcacagagcgactggtggaagagtggcttgtttgttgttgggttagccttgcttgtgctgatcatcgttatgtttgtaacgtgggtcgaacaagctaatgaccgaattccaattcaatacactcgtcgtgcagctggtgcacctgacagtagttacctaccattaaaggtgaacgttgccggggttattcctgttattttcgcgagttccttcattgcaacgccccaaacgattttgctagggttccaatccagtcatggtgacgaaacctggtataccgttttgagtaatatcttcaatatgcagtcgacgactggtgctattctttacaccattctgatcgtgctcttcacgttcttctatgcgtttgttcaggtcaatcctgaaaagctctctaagaacttacaaaagcaaggcagctatattcctggtgtttggccaggtaaggatactcaagattgggtttcaaaattgttaatgcgactaagtacggtcggtgccctctacctggggttgatttccttgattccattattagcttctgatatttggggtctcgatgaatcaatcggtttaggtgggacgagtttactaatcgttgttggggttgcccttgaaacaattcgtcaaattaaaggattgatgatgaaacgtgactatgtcggtttcattcgttaatcagcgaatgtgttggggagactcaacacatttgtgcattcaggaggaaaaaacatgtcaacaatgaacctgattttaatgggattaccgggtgccggtaagggtactcaagcacagaagattcttgaagattttgatattccacatatctcgaccggagatatcttccgtgcagccattaagaacgaaacgaagatgggcttggaagccaagaagtatattgatgcaggtaacttagtaccagacgaagtcactaacggcatcgtccgtgatcggttagctgaagcggatactaaaaatggtttcctattagatggttacccacgtaacattgatcaagctcatgctttgaaacaaatcggtgaagaactcaataagccacttgatggggtcatcaacattcatgttgaacccgcagtacttgttgaacgactttccggtcggtttatctgccggacttgcggtgcaacttaccataagttgtacaacaagcctaaggtagaaggaacctgtgatgtgtgtggcggtcatgatttctatcaacgtgatgatgacaagccagcaaccgttaagaatcggttagacgtgaacattaagttgaacacgccattaattgaatattacggtcaagaaaagttactctacaatgtcgacggtgatcgcgacattgatgatgtctacaaagatatcaagaaaattcttgataacctgtaaaccaggttccttcagcagcgacgtttgcttttcaaaggtcgttgtgataaaattattcaggtttagccgttgactgatttaatatttttttaatgttatgattagacaatgactggttcagtaatggaccaaatacgtggtagcacggaatctgataataaggagggacagtacttggcaaaggaagacgtcatcgaaattcaaggaaccattaaagaaacgttgccgaacgcaatgtttaaggttgaacttgaaaacggcgctgaaatcttggcacacgtatcaggtaagattcggatgcattacattcgaattctgcctggtgacaaggttacagttgaaatgtcaccttatgatttaactaagggccggattacctaccgtttcaagtaggctcggtctacgtaccttataggaggtaaaaaactcatgaaagtaagaccatctgtaaagccaatgtgcgaacactgcaaagttattcgtcgtaaaggccgcgtgatgattatctgctctgctaatccaaagcataagcaacgccaaggtaaataatttaattaagttggaggtgaaatattaatggctcgtattgaagggattgacttaccacgtgacaagcgtattgtcattggtttgacttatatctacggtatcggtaacacttctgcacagaagatccttgctgaagccggtgtttcagaagacgttcgtgtacgtgatttaactcctgaccaggaagacaaaatccgtgccgttgtcgatggttacaaaactgaaggtgacttacgtcgtgaagtcagcttaaacatcaagttattgcaagaaatcggttcataccgtggcatgcgtcatcgtcgtggtttaccagttcgtggtcaacacacgaagaacaatgctcgtactcgtaagggtaaaaaggtcagcatcgctggacgtaaaaaataataataaaggaggttttcgaattttatggcaactagaaagacaacccgtcgtcgtcgggtaaagaagaacattgaatctggtgtggctcacatccattcaacgttcaacaacacacttgttatgatcactgatatgcaagggaacgccattgcatggtcatcagctggttcattaggtttcaaaggtagtcgtaagtcaacaccttttgctgctcaaatggctgcagaagctgctgctaaggcatcaatggaacatggtatgaagactgttgaagtcgctgttaagggtcctggttcaggccgtgaagccgctatccgtgctttacaagctactggtttggaagttagcgcaattcgcgatgttacgccagtgcctcacaatggttctcgtcctccaaagcgtcgtcgtgtttaatctgtgacgttcattttgagggcaaacttcattttgtacgcacaactactaaacaccacgcgttttgaaaggggtaaaagataagaatgattgaatttgaaaaacctaacattcataaaattgatgaaaacgacaactatggtaagtttgttgtagaaccgcttgaacgcggttatggtacaactttagggaattcacttcgtcggattcttctttcttctttacctggcgctgctgttactagtattcaaattgatggtgttcttcatgaattttcaacgattgagggcgtaacggaagacgttacagcaattatcttgaatgttaagaagattgcacttaagttggaatcagacgaaaccaagacgttggaaatcgacgttaagggtcctgctaacgttactgccggtgatatcattggcgatgcggacgtagaagtcttgaatccagacttaccaatttgtaccgtagcagacggggcacacttccatatgcgtatgaccgcaaatactggtcgtggttatgtttccgctgaggataacaaacatcgtgaagatgacatgccaattggcgttttagctgttgattcattgtattctccaatcgaacgtgtcaactatcaagttgaaaacacgcgggttggtcaacgtgatgatttcgataagttaaccttagacgtttggacaaatggttcaatcactccaagtgaagccattagtctatcagccaaaatcctgactgatcacctttcaatcttcgtaaatctcaccgatgaagctaaaaacactgacgtgatggtcgagaaggaagaaacgcataaggaaaagatgttagaaatgacgattgaagagttagatctctccgtccgttcatacaattgcttgaagcgtgctggcatcaacacggtccaagaattaactaacaaaactgaagctgatatgatgaaggttcgcaaccttggacgcaagtcactcgaggaagttaaggcaaaattagctgaccttgggttatcattacgcaaagaagactaatacaagggaggatatccgttcatgagttaccgtaaattacaacgtacaagttcacaacgtcgtgccttattacgcgatttgacaacgtcattgatcgttaacggcaagatcgaaacgaccgaagcccgtgctaaggaagttcgttcaactgctgacaaaatgatctctttggccaagaagggtgatttaagcgcccgtcggaaggctgccgcattcatgcgggacgtcgttgccgatgttaaggaagatggcgacaacgtggctgtacaaactgcattgcaaaagctatttagtgacttaggtcctcaatatgctgaccgcaatggtggttacacacgaatttacaagactatgcctcgtcgtggcgacggtgcacaaatggttgtcttggaactcgttgactagttaagattgttttacggatcactgggactgatgattgacgggcgttatgatggtggctactggcaaaatagtagctaagtctagttcggaagttatttatggttagacatagatggcatatcgcagttctaagtgattttttttggtgctagttacgagcaaccgctgatttagggattgattccctaaatcagcggttttttgttggaatggataggtgtttttaatactcgtgatgacaacggtttgttatttgcagattatgacctgttgaatcgggaaagtggatatagtggtctcaggtactgactgtgaagatgaagcacatgggcgtttagctgtgtctgggcgacaaaaaaggtatcaaacaggatgcttgataccttagtcgattgattactagttaattatgccggtccaacagccgtttggttagactaatcagatccgtcttcgcaggctggtctggaagtttacgcatgattgccagcgcgtcttgagtgtacttggtagcgagttcttgggcttgcaccacaccgccggcattgatgacaagtcgttgtacttcctggcgctgagtgtccgaaattgccccctgtagtcgcatcagcggcaataaatcgtgcttagcttctgtctgtaaggcaaaaatcaacggcgaggtgtagacaccttcagcaacgtcttcgaggatgggtttgcccgtttcctgactgacttcttgatagtctaaaatatcgtcaagaatttggaaggccatcccaattgcgagacctgctttacgagcgcgctgggcgaaatgactactttgaccagattcataagcacctagaaaacaactcagtgcgaataactcggcggtcttaccttgaatttgttgcaagtattctgccatggtaatgtcaaggtggtagtggcggtccttttgttggacctcgcccactagaatcttttccatgttctcagagttcatctggatgcttttgaaactgcttgaatagtgcgctagaatcttgaataccacaacgaataggtagtcgcccgcatacacagcagtatctttaccaaaacgttcttgaatcgtgacatggtgccgacgtagtgcagcatcgtcaacaatgtcatcatggatcagcgtagcggtatggagcgtttctaatgacgccgctaaggccaccatccgttgccgatcagttgttgtaaattgtgagaataggaggcagtatgccgggcgtaagagcttaccaccaccatgaatcatttctaaaatcgcgtcattgatgtcggcatcttgaatattgatgttcgccgtcatcagctgcatcacttgttgcagctccggttgtagtgccgggtaatcacgccaaattgggtgtaattgtgttgccgattgcatatgggttactcctttgtttgatctggatggtgttctcgattgaatttgagatagcgtaagatcgtgacgtgggtgaacaagtagttggcggcgattccgagagcacttcccgctgctagtccaataatcgaaagcactggcaagtagagcatgaccgtccacgtctgtgcaataggactcgcgaccaatagctgaccaacattatgcatgacgccaccagttgctgaaattccaataatactaacgcgtttaggccctaattgtttgaccaacagcatggcaaacaggctgagaaaggcgcccccaaaactatacagaaaggttgataaagtgccacctaggagggccgttaaaatcaaacggagccaggttagggttatcacgtcagttaatgataatgtatagattgcaacaatggtaatcagattggctaaaccaagcttggcacctggggcaaaggcaaacgggaatggaatcatccgttcaaggatgccgatgatcacgccttgtgcaaccagtaacgcgatataaatattacgatgagttttgtttgatcgttcaaatgaattattcatattctactccgtaactaaaccattaccgccagatttgacttgaccgttgctggccttaatttcaaccaagagtttgtggggcaaacaaacaatcgtttgaccaggtttatgaatccagcctcggcggacacatacttggtcagaacagttggctttcgtaatcgcaacgcgcttaggtttaaatgtgatcgtgttgtagtgcccatggttatcgcgataggtgaagtgcttagtcgttttcagattcgtaatattgacacgcttcaagacggtcccattatgtgagaccacggcgttatacgtggtttcactgctcgtggcctttcgcttagccactagtgccgcatgttcagcttgttgtttttgctggtatgaaaaaatcgctagtggggtgaacgataaaataattagcgcaacaataataataatatcaaacggcttgatcatatccccataacgtttgaatgtccggatcattgtccgtaatttacgcatcgttaaccctccaattcaatgaaataaaaaatggttcaaggggggaaaaacaacccttgaaccatcgggaaaggatttaattaattataacgcatctagcgggttttaacaccgtcgtaatgagaacgaacgttgccgtaccaccagtgtccaaggtgtttttgcatccacggaacgacccagtagtctaacccaaatgtccgtccggaaccgttcattaaggcgagggcaacaaagatcatccaaatgttgacccagtagaacatgccagataagcagaagacgacaactaagccaatggtgactgcgttagcaaaccaagtaaagagtccgaagaaaatacataatgcaatgacgatttcaacacaagtcatgaatttctggaagaagagggccatttgcatgttcggaatgaagaccttggtaattgattcgaaccaatgtggcattttgtcaaagaccatcaggggttctttaccgtacatgtatgaaagactgaagacacccttagcggctttagcggttgacgtggcagcgcttcagaagcaccactggttgcagcggctttagttgcttgagaggcaccactggttgcggccacggtaatccattcgaatggtaaccgtaacttgtcagtgaaccaggattcagatccctgaactttagtccagcagtcccataaccacatggcaccatagaagaaccgcagtggcacactccagagtacgttaccagcccgtgagacccaaccgcggaagacgttacggttattacgagtccggaagaattcgtgcatgaagtactggaataggtagtaacctgagaaaatctgaacgtagtacatccagttgatggcgtgttttaaaagcacggcaataaaaccagagacgttccacttctctaaaacttgtgcaacggcatatttggaaccaattgagtcgacggatgcttgataagcgcccttaaatggcttgatcgtaacgtcagtctggtcaacgttcttaataataccttcgacggccttagctgcggtttcttcagccccttgaacgatttgtgggactggccgtggttggtcaggttcttggtagctggttgaatcaccggctaagaagatattgttacaatccttagcttgcatgaattcattggccatcaagcgaccaccgcgggggttagtttcaatgccgaactttttaacgatactattagcacgaacaccggctgtccagattaacgtgtaggttggaattggatccttgccttttaagttaacatggtcttcacagacttcggtaatcatggagttcgtcatgattttgacaccatgtttttccatgtacttagcggccttaccggcttgcgtccggttgagcatgttaataatagtcggcgctgcttcgaccaattggagcgtgatttcacttggatcgagcttgttgtctcgagccaaaacatcacgatattcgattaattcaccaatcagttcagaaccagtaaaaccagaaccacagactgtaaaggtcaacatggctttgcgcttagcagggtcgagctccgccgccccccgccgaataattgcagataagtgagcacgcaatgccatcgcttgttcgaaggaccacaattcgaagccgtgttccttaacaccgggagtcccaaagtcattggattccccacccaaactaattaaaagttgatcatattgataacttacgtgttcggtagtaactgtttgtgcctttttgtcgatgcccgtcacggtatcggtcacgagacgaacgttttttcgccgtgcgaacaaccgttgcaaatcatattggatatgctcaggttccacccgttcggtagcaacttcatgtaattcagtcatatacgtgaagtatgaatgccggtcaatcaacgtaatctcgacgtctgcattttttttgaaatgcttagacagtttcttggttgcgtaaacaccagcaaaccccgcaccgacaacgacaatatttttctttgccattgcgtaacaactcccttgaataatagtgtaaaaagataattccactaataattataacgataatgtaagcggttgtctatggattatgggaaagaatgcataaactatcacattatctaagccgcgaaaatagtggcatcgaggtttgaacggaaaacgttgtcaataccgctattattaggctaaaatatcatttttttaatggaatgggattgactattaccagtttaaacgttaagattaatgtgaattttcatacaaaaaggttaggagtgggatatcatgaaattcaaatcagttattacgggtgcttcagttgttgcaatttcagctttagctttagcaggttgtggcagcagttcttcaagttctagctcgagttcatccaagaagagttcatcttcaagctcatcagctaagacaactaaggttgctaaattaaccgctggcagcaaaatgaaagcgggtacttataaccttgaagaagaaaattattcacatggttatcggaccaagatgagtatcacagttaataacaacggtaaaatcactaagtccagttatgaccaagtgaacaagaacggcaagtccaaagttgatgatacttcatataacaaacaaatgaagaagatcgctgggactaaccccaagacttacatgcctaagttaaacaagacgctgacgggctctgccgctactggtaacgtgggctccattgatgttgtgactggtgcgactgaatcatcaaagaccttccaaaactacacacaacaattagttcaagctgcccaagcgggtaacaagtcgaccattaagattgacaatggtgccaagatgaaagatggtacctacaagttgaacgaaaagaactactcacacggttacaaagttactttcgcaatcacggtcaaggataataagattacgaagtctgaatataaccaagtgaacaagaatggcaagtccaaagttgacgatgcagcttacaacaagcaaatgaagaaggttgctaagactaaccctaagacttatcaaccagctttgaacaagtcattagttaagagtagtgatccaactaaggttgacgttgtcacgggtgccactgaatcttctaacacctttattatgtacgcggaacaattacaaaacgcggcacaaaagggtgacaccaacacgattactgttgacaacatgattttctctgaataagcaatttaattattagattcttttgaggcctgaggcgcatgctgagggccttttgtttttaattgaacaaccacaaaagtttgtcactcagttgggcacgactttgagcaagctaaatccatacatggatattggtttaaaaaataatagtggcggtgaatgttaagtgcaaaatggctgtggtagtacaaacccgaccgtcgagttgtaccgtttgctgtaggtgcgctgatgtcagactagcgtagaaaagcttggatgacgcgcaaacagtctcaccggatgaatcaagactttggtataatgacaattgaaattaaaaataggggaagtattggaatgaagctaaaaaaatgggttcgaattggattaattgttgcaatgatcgtgccattgacggcgtgtgggacgagtacgagtcgcaaaaatgctgctagtagccgacccaaaccaactaaggtcgtcaagacgccgatcgaggatacccagttcatgatgggcacagttgtcacgttgcggatttataataagggtaaggataacgtgttagctggggcgtttaagctgttgaaaacggaagctaaggaaattacggtcaatcaaaaaggatctgaaattgataagatcaacgccgctgccggtaaaaagccagtggctgtcagcaaggatatctacccaatgatcaaagcagcttactattatagtaagaattcagacgaatcctttgatttagccattggcccgatcacatcactctggcatattggattttctgatgccaaggtgcccactcaacaagaaattgacaagaacgttaagctggtagactacaaaaaagttaaattaaatgacaagaaacggaccgtttatctagaagaaaagggaatgcaactagaccttggtgggattgccaagggttacatgaccgatcaagtgaagacgtacttattaaatcatggggtttcaacggccattattgacctcggtggtaatatttatgttctgggtgacagccctaaaggaacgaagtcaggtaactggacagtcggtatccaagatccaaaagcgtcacggggtacggccattggctcactacctgctaagaataagtcaatcgttacttctgggatctatgaacgctatttgaagaagaatggtaaagtttacagtcatttgatggacccacaaacaggggccccttatcaaaacaatttgatgggcgtttccatcatctcgaagaagtcggtggatggcgatgcactatcgacggccacctttgacaaaggcctcaaaggcgggatgaagtacattaatggtaaagcggatcaaggtattggggccatttttattaccaaggataaaaaagtatacgtctccaataacttgaagaagcagttcacgctgtttggcgatgctggttacaaatacgggccagccactgatttaaagtaagattggacgtgaagttcagttactacaagttccgtcagatatgttatgataataaccatgaattttaaggaaatgagggacaatggtgagtccgattattgacgttaaacatttagattatcgttacccgcaacaagctacggatcagttaacgttacacgatatttcatttacggtcatgccgggtgaatgggtcgccattgtcggccataacggttctggtaagtcgaccttggccaagaatttaaacggactgttagcaccagcggctggaacgattacggttgatggtcaagtattatctgaagaaaccgtttgggacattcggcgcaaaattgggatggttttccaaaacccagataatcaattcgttggggcaaccgttgctgatgatgttgcgtttagccttgaaaaccagggcgtgccgcgttctgagatgctaacgcgggtacaggcggctctagaacaagtcaacatgcaggattttgcgacacgtgaaccggcacgtttgtcaggtggtcaaaaacaacgggtggcgctggctggtatgatagcggcgcggcctcagattttgattctggacgaagcgacgtcaatgttggatccccgtggtcgtcaggaagtattgacgacgattcgcgatatgaaggctaattcagcgttaacggtcttgtcaattacgcatgatattgacgaagcggccagcgctaatcgggtcttagtgatcaatgacggtgaggttaaggaagaggggactccagcggaaatttttcagcatggagaagccttaattaagatgggattggacatgccatatgctgagcgcttaaaagcagcgctaaagcggcagggtgttcaagtgcccgcacagtatttaacagagaaaggaatggcggactggttatggcaattacgttcaaacaagtagattttacttaccaaccgggtacgccgttcgaaactaaggcgttaactgatattaacgtcaccattcccaccggctcttatacggctttgattggtcatacggggagtggtaagtctacacttttacagcatttgaacgccttactcaaaccgactagtggaacggtcacgattggtgaacgggtcattacgccaacgacgagtaataaggatttgaaacgattgcggcaacacgtgggcatcgtctttcagtttccagaaagtcagttgtttgaagaaacggtggccaaagacattgcattcgggccccagaattttggggccagcgaagcggatgctttgaaaactgcggctgaaatgttggctttagttgggttagacgagtcgttactgacgcggtcaccgtttgacctctctggtggacagatgcggcgagtggccattgcgggggtccttgcgatgcagccgcaagtcctagtcttggatgaaccgactgccggattggaccctcagggccgtttagatatgatggagatgtttgcccgtttgcgccatgaacgtgatttgaccgtggtactagtgacccatcagatggatgatgttgccaattacgcggataatgtaatcgtgatggatcgtggacaaatcgtcaaaacggggacgcctcgtgagatcttcaaagatcctgcgtggctgactgcccatcaactgggcttaccgaaaacaacggcctttgcacatacactccaaaagcaaggctggcaatttaatgagtggccgttgaccgaggacgaattagcagcagccatcgtccaacagttgccaccgaacgcaatgggggaggtggccgctcatgatgaataaattgatctttggtcgctacattccgggagactccgtggttcaccatatggacccccgggcgaaactgttactgagtttttattttattgggattatttttattgccaataactgggcgacctatgccttgctatttgcctttacattggccgctatttacctatccggtgtgaaatggtcgttcttcatcaacggcgtcaaaccgctgatttggttgattttattcaccgtcatcctgcaagtgttgtttagtgcaagtggcgggcacgtttactttcaatggggcatcattacaatcagccaacttggattgatcaacggagtctatattttttgccggttcgtgttgattatttttatgtcaacgctgttaactctaacaacgccgccactggaattgtcggatgccattgaatatatcttgatgccgctcaaagcggtccattttccagtctatgaagtggcgctgatgttgtcgattgccttacgctttgtgccaacgttgatggacgaaacggaaaaaattatgaatgcacaacgggcccggggggtcgactttggtgaaggcaatatctttcaacaaatgcgtgccgtagttccgctgctgattccgctgtttgtcagctcatttaaccgggctgaggatttagcaacggcaatggaagcacgtggctatcaaggcggcgagggtcgcagtaagtaccggattcttaagtggcaccaacgtgatacgtgggctaccggatgctttgcgatcttgaccgttgcattgattttcttgcgtgcataaatgaagactgattaacgtgggcgtcgcactgatggcgacccacgtttttaactggagggatattgtgaccacgcggtataaagtagttttagcatatgacggcaccaattttgcgggttttcaacgccagccacaccagcgaactgtcgagcaggtcgtcactaaggcggtcaataagatggcgaaagatcccgttgaaccgattgtgatctacggcgcgggccgaacggatgctggtgtacatgcgtttggacagacgttgcattttgacttgccgtacgaaattaatccagaaggggttcggcgcggcctgaacagcatgttaccgatggatacaatcgtaaaggccgtttccattgtgccgaatgattttcacgcgcgttatgatacggtcggtaagcggtactggtatcgggcctatcaaaatgaatttgtagatccatttaaacggcactatacggggcattttaagttcgctgcggatattgacagaattcagcaagccatcggtgacttagaaggacggcacgatttctcgaccttcgttgcgtccggttcgcaagcacatgaccatgttcgtgagatctattcagccaaagcgtgggccttgccggatgaacgcgaaattcagtttgaattttgcggtagtggttttttatataaccaggttcgaattatggtggctgttttgatggaaattggtcagggccggcgcgcagttgactgtattccagcattactagcggctaaagaccgtgagcaagcgcggggaacggctcctgcggctggactttatatgaaaaaagtgtattatgaacaaaatgaattacaagctgatttgataaagtattgacttctgaggcgaaattgggtagactagtcgttggtattgtttgccccacgataagccccggaaatcttattgagtgtcaaacaaacacagaaaatggaggaacacaacgtgcgtacaacatatatggctaaaccaggtgaaattgatcgtaaatggtatgtagttgatgcaaccgatgtacctttgggtcgtctttcaactgtcgtcgcatcaatcttgcgtggtaagaacaaacctacctttacccctaacgtggatactggtgataacgttatcgttattaatgcaagcaaggtcgctttaactgggaagaaagcagaacggaagatttattatcatcatactgcttatgctggtggtttaaaggaacggactgccggtgacttcttggcaaaggaacctactaaattgattgaaacttcagttaagggtatgcttcctcacaactctttaggccacaagatgggcttgaagttgcatgtttatgctggtgcagaacatacgcaacaagcacaaaagcctgaagttttggacatcactaacttaatctaaggaggaaactacattggctcaagtacaatatcgcggcacaggccgtcgtaaagattcagtagcccgcgtacgcttagtaccaggtactggtaaaattgttatgaatgacaaatctgttgaagattacattccatttgcagatattcgcaaggaattgttacaaccattcgaagtaactgaaacaactgatcaatatgatgttttagttaacgttaatggtggtggcttccatggtcaagccggcgcaactcgtcatgggatcgctcgggcattgctcgaagttgacccagatttccgtactcctttgaagcgcgcgggtctcttaactcgtgatgctcgtatgaaggaacgtaagaagccaggtttgaagaaagcccggaaagcttcacaattctcaaaacgttaatattatccaaaaacgttgttttatcaacattttctggctatatgagaaagcacctgtctatggacgggtgcttttttttgttgtttgaacagaaaaaataacacaaaactaaaacatggtagggctcatgatataaaatagaccactttgttagcgtcctggctggcagcacgtgttcatgtcagtacgacttccggggtgagcgactatgcagttagcccgccttgaaacaagctaagcaagtaacgctcggttacttaaaaatggattgggccattgacggctcaatccattttaattactgacgtttagttttaccaaaagagaagacggcaacgcaaccgaggccggtatggctagtgatagtcggcccaatgtgttcgagcaaaatttcagcatcaggaaccttggctaaaatcttttcacgaacggtttgggcggcttcctgagcgtcgctagtggcaatgataatgcgcggcttggtctgatcacgtaaatcggctagtgtgttgttaactagtgtggtcagtgaccggcgccgtgagcgcaccttttgtactggacgcaagtggccgagtggatcgacgtccatgactggcttgatctgtaagagtgatccaaccgtcgcggaggtccgtgagacccggccgccgtgataaaggtaatttaagtcatcaacggtgaaccattggtgataatagaggcggttttcagtcagccaatccgccaattgggcgattggcataccagcatcgcgcttgtcaatggcatctagtagcatcaggccttcaccgcagcaggctgctcgggaatccacgaggtagatctcggcatctggctggtcttgtaaaagcatggtcttggcctgttgcgcattattgaaggtcccacttaagcctgatgaaaagccgaggtataggattggcgtatgtgcctgaacgtacggcttgaaaaattcaataaactggccgatattaatctgagcggtagaaggcatcacaccgttaccaatccgatgataaaagtcagtcaagtcaaagtggtgacccaaatcgtccgcgtattcctggtcgtcaatcgtgacgttcattgaaacaaaatcgacatgcttgtccttaagtagttgataaggtaaatcaacggttgaatctgttaatagctgatacatagctttctcccttaattgtacttactgttacattgtacgcttatttgggcggccatggaaaattaatacatgctgtatttttacatacagcagtaatttacggtaacaactagttggttgtcgcaatcctggtagcagcgtgaatgctgatcaagaaattgaactgggcatgtcagtaaatactggacgcatcggaaggtcagttatgggttaactgcaataatggcgtagtgactaggaccgtgcttttcagtcatggtgatgaggttcgacgactaatttgcctattcaatgaggcgctgtaagttgattgaaatcagccgatcaatggcgtgattttgctgctggcggtagggggtggccccggtttcataaaggagttgcgcctggtgatgatgaacgctgatctgttcgagttgcggaggcaatcgaagaatcgcgataccggtggtcagttggtgctgttgaattaattggctgcgcttgaatagcagtaagtgtgaggcgctggggccgtatgactgtgataacaagacgtagtggtcatagaaggccattccttgaatattgggtgggagcttgccgtgccagtcactaactgcctttggtaaaatggcgtgactcgtggtcattctgtatggcgtgccggcgctcgtcagtggatagcgggcaaccaaggtggtctgtccaggtttgaactggccgacataaagggcctgatggtgataggtcagtagtgaggcattgctcagtgttggcagtgaccagcgttgctgatagtgaacggcaatggaagtggtcgggtcgaagtgccgtaatgcggccagactaacgctcacgatagccccatgaccgtggcgatgactgcacaaccaaatccgctggtggtgagggtcataagctagaccacccacatgtggtttaccatgcaataagacagtgttgcataattgatgtcggaaacgatcctgtacatataggacagattgggttcgaccagtggcatcgtaagcggtggttagacgataacgaccggcaataacaacgccctgtggaatcatcattgtcgtcgtcgtgagttgtttagtgacgaggtccttagtcagggtggcttgtagtcccggctgaatggtggtgccttgcaacataccgattgggtcgaattttgctagtttaaccagatccggatactgacggatggtttgataaaattcggttggtgaaaaaacagcttgggtggctgttctttgaagggtggttggtgggtacggtagtgtcggtcgtacgcgactagctagaccgccgaggggatggccccaaattaacaagcctgtgattagtcctgtataaaaatgataggtataacggtgcatcgcgggtccctcctctagtttaagtgtcttcaatatagcatggaaagacaggccgcttagcggatagtgaaaggttagttaaggaaagaaactgagtggggcataattgaaaaattaacgttttacacatctgtttttaattacatttacataaaacattgaattttctaattaggaatctgataatgaacgtgttcaagctgtttagcaatctgaataaagtgtgatatcccggtgctcgccaagttaggcgagtgctggctgtcaaaaacggaggaaaatataacgatgcgaattagtgcggaaacggaacgacaatttttagaagcagtttttaaggcccaacggtttagtgccaaggatggggcactgctggcagacaccctggtcgatgcagatttacgtggaatctcatcacatggtatccagcggctggcttggtatacgcggatgatcaaggatcataccttggaaccgacgaatcaaccgaagattttgaatgaaacacctaccagtctattgatcgatgcgaaccagagcatgggccagattgcgtcggcgtttacgatgaataaactgattgaaaagactaagcaactcggtgtttcattagcggttatccgcaattcgaatcactttggaacggcgggctattattcgcgcatggcttgcaaagcgggtttgatcggtatttcaacgactaatacgcggccgttggtggtgccgacgaatgcgacagaagcttttttgggttccaacgcattagcttttacttttccagccgacccgcatcctttcgtttttgacggcgcgactgcggtggtttcaagcgggaagattcaagtgctggccaaaaaaggtgcacagattccgggtgattgggcggttgatgagcatcgtcaagtcttgcatgatgcgcagacggtggaggataacttggctaaaattgcgttttctgagaatcgtcctggtggtggggtcctgaccctaggtggccagcaggaagtcaattcaaattacaaaggctttggcaactcactaattattgagttactcacgggaattttagcgcaagggtcgctgtcggctgatacgaacaccggtaagcatgactttagtcagttcttcatgacgattaatcccgccttatttggcgatcccgaggtgttgaaggccaacgtgacgactatgtttgaccgtattcggcatttgaagcatctaccaggtactaagatcatgataccaggtgaccgggaataccggcactatgatgaaaatttggtgcagggcgtcagtattgatccacagacgttgacggaaatgcagcaagttggtgctgaatttggagtggcagtccccgcagccttgaaagcgtagtttggtgtagttgcggcaattattgtgactaaaatggggatcacataaactgatgatagtgtggctggaatctgctctggatgctggcgacactatttttggttatcacgattatgtgcggtggtgaagaccagctagctggttgggaatagatggcagttcagacaactgacgagcggctaaggttagttgctaaagcatacggaacattgttgaaattgtaatcgaaaatgaccgtttgtcagtcgttcgttgtgagaaatttagcgttggagtgcggcttttagactttaatgatttgcctggcggtggattataagttaagtcagtgcaagctactggctaaaaatattttcagaaagtggcagggaaccattttaatatctgtaaaatgatttgacacgcaaacttgctgatttaccagtatttattagcagttagcgaggatgatgacgactagcaaatcgagggtggaccaacatgtttttgttgattaatagaaaaagtttgcaaaaaccatttgacaattctattgattagccgtatattttaagtcatcaaatacacattataaattaaggagattttaatcatgacgattaataccaatttacaattgaattcgtattattattactggtttacttagtgccttggcatccactgcgaggcacgccctcgcaacggatgtgaccagtaaattttggaatgattaaaatttatggaaaagtcatatcagtgttgtgaacaaccactgtgtgacttttctacttctgagtagcggtgtttttcgggcaccctgcgaagaattagtggactcacagttggtgtaactgtgagtcttttttattagccaaaatgagagggagcgaagttaatgcaagcatttgatgaaattgatgaattagcggtgaataatctacgagtactgagtgcggaaatgattgaacgggccggttctggtcatccaggattgccactcggcgcggctccaatgatgtgggcactgtggagccgacaattacgggtcgatccacagcagtctcaatgggctaatcgcgatcgctttgtcttatcagccggacacgggtcggcgttgttgtacagtctgctacatgtgagtggcttcaacgtgacaatgggcgagttacaacgttttcgtcaattcggcagtcatacgccaggccaccctgaactgggaatcgtggatggtgtggaagccacgaccggtccactgggacagggattagggatggcggtgggcatggccctggctgaacggcaactagcggctcagttctccgagtcaccgcagttggtggatcactatacttatgcgttagtcggtgatggtgatttgatggaaggcgtctcccacgaagctgccagctttgccggtaatcaacaattgcaaaaattaattgtattgtacgacgataacgctgtttcgcttgatggccccaccagccggtcgtttcgtaccgatgtgaaccagcgcttcgctagttatggttgggatacacaaacggtaggtgatggcaatgatttaacggcgattaatgccgccattgagcgtgccaaacacagttcacgtccaagcctgatcgctgttaaaacgacgattggatttggcgcaccacaagcgggtacgaatgcggtgcatggcaatccgttgggaacggccggtttaactagtttgcggcaacaattagggtggcaagccgcgccatttacggtgatgccggccgttgctaaacgcgcacagcaactaatcttgcaacgtggtcagcgtacacatcgccggtggcagtcacaacgagaggctttaccacaagccgtgcaacaccgtttcgaacaacagctcagtatgcgtctgccagttgacttagccaccagtttaccgatctttgatgaaggcgcccaagcttcgcggatcacgagtcataccgtcattcagaagctagccgctcagttaccaggattagtcgggggcgcggctgatttagccagttcgaataaaacgaccattgagcaggatcaattgtcgactccggtgaccccggatcagcgcaacgttgcctttggtgtccgggagtttggtatgggcaccattttgaatgggatgactttacacggtggcttgcgggtctttggtggcaccttccttgtcttttccgattacacgcgtgcggctattcgattggcggcgatgatgaagttaccagtcacttacgttttcacgcatgactcgattgcagtcggcgcggacggtccgactcatcagccaattgaacagctaatgagtttacgattgattccgaatctaacggtgatccggcccgctgacccaaatgaaacggtcgcagcttggtggcaagccatcaacgcgacggatcatccaaccgtgctcgtcttgacccgtcagaatttggcagtgctatccggatctaagactaaggccatgactggtgtggctcgtggcggttatgttctctcaccgcagcgtggccgccagccaatgggaatcttgattgcaagcgggtcagaagttgctttagctcttcaggcccaggcgaaactagctacgttaggtgaagatgtcagtgtcgtttcaatgccgtcgatggaaaactttgcgcgccaatcaacgaattaccaagctcaggtcttgccacctcaaattcggcggcgagttgcagtcgaaatgggcgcaacatctggctgggaacgttacgttgggttagatggggcggtactaggcttggaccactttggcgccagtggagcggccgaccaagtattagccgctaaccagttcacggtagcagacctagtgcggacgtatcaacaaacgcacgtggatcttggtcaacaattgcgagtcatttagaaaggaagttagttaaagcatgattgatggacaaacggcactctttggatttatcgcgcaccccgcgcggcacagtcgctcaccgcgaatgcataatttgagttttgactactgggggctaaatgcgcgctacttggcgtttgatgtggcaccggatggattggctgatacgcttgctggaattcgtagcatgggtatcgcgggggtgaacctttcaatgccattcaaacaagccgttataccgctactagatggtttgacagtgcgagcgcaacggattcaagcggtcaatacgattaagaatgaagctggcaagctgattggtgacagcacggacggcgctggagtttttcaggatctcttacatcaaggtctgaacttggttgataagcacgtcatggttttaggcgcgggaggcgcaggtaaggcaatcattgcggcggctttagattatggtgtcgcgagtgtaacggtctttaaacgcaacaacgaacgctacgccggtgttcagcactggttggagcaactcagtaccacgacttcggtaccactccggctctgtgcctatgaagaccaagtacggatgcagcaagttgctcgtaccagcgatttgatcattaacgcgaccaatatcggcatgacgactgctggaacgccattaccaatctcaattatccagcaattagtcccacaacagacggtctatgatgtgatttaccaaccgcttgaaacgacttttttgcgcttagcgcgtcagcaggggtgcgccacatataatggcttggggatgttaatttggcaaggtgccttggcttttgagttttggactggtaagcagatgccagttcaacaggtccgccaagatatgttagccagcattcaagcgactccgccgattacggcgcgggcttaggccttaacttttgagaattgattagtaggaggaaattattatgattattatattaaaaccagcaaccgctacggccatgcaggcaaagttagtgagtcaatttggtgcggatcacgagatcttcacgcacaataatcgaattgcaattcaaggattgcgtccagaagcacttcccacggatgtgcaagcagccagtgaatcaatcttgacggcagttcccgcagcggtccaaagcagccgtctctttcacccagaagatacgattattaagacgccacacagtgtgattggcggtaatcaattcgtcatgatggctggcccgtgttcagtcgaaagcgctgaacacgtggaccagatggccgcggttgccaagcagggtggtgcgacgattgttcgtggcggagcattcaagccacggacgtccccttacagcttccaaggcctcggggagacgggactccaatacttacggacggcggctgataaacatggccttgatatgattaccgaagtgatggatgatgaacacgtggcgatggtggcgaaatacacggatatttttcaaattggtgcacgcaatatgcaaaatttctcgttgcttaaagccgttggacagacccaaattccggttgcattaaagcgaggaatgtcggcaacaatcgacgatgtgctcaatgcagctgaatacattgcagctggtggtaatcatcagatcatgcttttggagcggggaattcgaacgtttgataataagtacacacgcaacacgtttgacttaggtgcagtgccagtcttgcaatcgttgacacattacccagtcatcgttgatccgagtcacgcggtcggtacctgggaactcgtgaccccgatggcgatggcaggtgtagcagctggcgccagtggcatgatcgttgaaattcatgaccagccaacgcaagctttatccgatgggccgcaagcgttaaaacccgcgacgtacttaaaaatggcgcaacaggctttccagttacatgacctgatgcaaacgtgggcgtaggatgtgcctatgacaaacattgaagtcaagacgcgagttaaacagtatcagatcaagatcatgattgacagtttacatcatctaggaacgttggtaactaaggtatggtgtgcccgtcaagtagcggtggtaacggataccaatgtgggcccgtactatgcgaagctggtaactgatgaactgacggcggctggattcaaggtgcgtgtgatgacggttccagccggtgaggcgagcaaaagttggtcacaagtccagtcgttaatcgatcagctgagtgccgcccattttagccgcagtgacggtgtcatcgctcttggtggcggggtggttggtgacttagcagggtttgtcgcttcgatttatatgcgcggtattgccttgattcaagtaccgacatcattattagcgcaagtcgatagttcggtgggcggtaagaccgcgattgacttaccaactggcaaaaacttagtgggcagtttttaccaaccagatttagtcgtcattgatccggcaattctggtgacgttaccgccgcggatgctcgcagaaggttatggcgaaatcgttaagtgcgcagcattagttggcggtgatttttggcaatccttgcaacaaattaccagtgtggcagcgattttaccagcagcaccagatttaattgcagctagtgtggcgttcaaagcgcgcgtcgttatggcggatgaacatgaacagggtcagcggcaattattgaattttggtcatacgattggtcacgcagtcgaactattggctgacggtcaactaatgcatggggaagcggtagcgattggtctagtacaggtttgtcggttgtttgcagcacatgggttagcgccgactagtttaacgtcgacgctcaaggcacgcttaatggcggtagggttgcccacggaattaccgccgatagcgccgcaagccgtggccgcagtgatgcaacacgacaaaaaagtgcacggtacagcgctgacctgggtctacttatcggcggttgggcaaccccacctgtatcccatagcggtcacggacttggcgacttggatgggtgacttgtggtcggtgtcgtgattagacgtaagtttacaatatgcttcagttcgacacatgacggttagccgggtgggatctgaaaatttgagggagcatcagaacttttgacgtccaggttctgatggacttacatggtagattaacaatcggctttccaagtaatagttggaaagccgattgttattggttagggcgtgatgtttgtatgatcaagtcgttagtcaggagtaagttcacattgtgcgcgttaattttcatgaagcatgcattaaaatatgccagtcttgagtttaaaaagccagtttagggtcaccggcaaaagttctgatttgcgtaaacttgctcggctagatcgtccttcccccagaaatgggcactcagcccggagtcgggaaatacgtgaatgagtgtctgaacctgtcaaatggtatagttgaaaaacaactagcttaccaatagcctaaaagtttcatccagagtgtgccaccaacgccccatactaatagatagaaaccaccaaggcacagattcagacgccaccattcggactgcgttatgtaacctgatccgaacataatcgaggcgggaccgttggcgtaatgggtggtcgaactgaaaatggcaccgtcaaagcctaatagtagggctgctagcattgggggggcgccggctgaaattgccacacccaagaaggcgccgtacatggcggagacgtgagcagtggcgccggcaaacaggtagtggctgtaaaagtaaacgagcatcaaagctgccaagacccatagccaactgattccttgcagggcctggcccatagtttgtgaaagccatggaataaagccaagactgttcagtttgccagccataaaaataagaattgaaaaccaaacgagtgtgttccaagccccagtttcatgtaataagtcgtcaacggataatacaccggttaataagagcaaagtgacggctatgaaggccactaaggtcgcgtctagcccagtgagactagctgagatccaaagaaagagggccaacataaaaataccgcccatgagtttttcggccaaagtcatggcccccatctgctcaagttcgttggcagcccacgcatgcgcgttgggtgtatccttaatttctggcggatagagccaataaataatagctggaacgctaattaagcaaataagaccaggtaatagagcggcgagtaaccagtccatccatgtgatgtgaatctgcattgcttgggccaaggccacggcaacgagatttggtgccatcgcggtcatgaataagccactggtggcaatattaccatggaaagctgacataatgagaaaactaccaaccttacgctgcgtaccgttttgtgggtcagagccgtatgctttagctaaagattcaataattgggaagacgattccaccggcgcgggcggtattgctaggcgtggccggactagtgacgagatcgacaccaatcagcgcgtaggctaatccaagggcctttttaccaaataatttgacgaagaccagcgcgactcgtcgccctagccccgtttttacgaagcctcgtgataggaagtaagccattgcaatcatccaaaccgtgttatcaccaaagccggccatggcatccgtcatcgaggtaacaccaagtaagacaccaagtgtgagaccaataattgcgacaccggcaataggtaacggctgggtaatgcaaccaatgatagtgccaataaagagagccagcatgtgccatgctaatagactgagccccgcgggacgaaatggcgcgctcagccaaataatcaaaccaattatcagcggccatgtaatttgctggtagttgacggattgtaatttggtcatcgaaaacgaccacctttctagtcaaacgttaaaatcgtctcacggtgactgctgaaactagtcagcaaatgatgctaatccggacacgatttctaaattagaattaatgcaaccctaatgtcatttttgctgcccgtgacattttatcaagcgaccaggtcggttcccagacaaggttgatgagtacctgatcgatacccgcgacggtcattaatgcgcttttgatatggtcattcaaatagcctgtcagtggacagcccatgatggtcagtgtcatggtaacggtgcagagctttaggtcagcatcgtaagcaacatcgtagatcaaaccgaggtcaacaatgttcacaccaagttcaggatcgatcacggtactcagagcggctaaagcttgggtttttaaagtagattgtgtatccatactaatcatgagaaagactcctttagaccaacagcctaagcagggtgatccgcttaggctgttaatggtcggttatttaatgaatttaacttgttcgttgatttttttaatctcagcttctttacgttcgttgaagatgaccttgttcttttcaaacaagttgtcgccattcgtatcgatggagacaattaacggaccgaagtctttgacctcacacgcccagagtgtttcgggcattccgaggtctttccactgggcatcaacaatcttattgacgtgcagggcggcataaacagcattgccagcggggtagacgaggtgtaaggcgtgatatttcttgcaggcccgttcggttcccggtcccatgccgcctttaccaacgattagtttgacacgggtttgttttacgaattcttcttcaaatttttccatccgcatactagtcgttggcccgactgcgatcatttcgtacttgtcatggccgagatctttaatgatcgggccagcgtggagaattgctcggtctgtcacgttaacgggtaggggacgatgttcttcgacgagccgccgatgggcaacgtcccgacaggttgttagtgagccattcaagtagacgatgtcgccgatacgaatgtccttaatatcgtcatcagaaattggggtggttaagtggtaagttttcatgataattcgactcctttgttcagtggtaagtcatagtttagatctgcgtcaaagttgataagtccgcgccggtgtgaccagcagccggtactaacagcgacgccaattgttgatgggtgtcgggcggtattctcgacattgacacccattactgacttttgaccgccaaacccctgtggtcccaggccaatgtgattgatgccgtcttctaataagtgttcgagtttggcagcattagcgtttggattttcactatcgacgcgccgcattaaagctaatttagaattaagcgcagccgtttcaacggatgtggcgacgccgacaccgacgagtaaaggtgggcaagcgttaatgccgtagctcgtcatgcgatccatcacgaaacggacgacgccttcgtaaccttcaccaggcatcaggactttggcagccccgggtaatgtgcagccaccgccggccatgtacacgtacattgagatgtcagtgccattaccatcaacttgcagaaaaatcgaggggatgccgtcaccaatgttcataccggtattgtattcgtcaaatgtctgaacagcattatgtcggagtggcgctttttttgtcccacgataaacggcgtctttcaaaatttgattgagtttgcctaatagtgggaactgcgcgccgcatttaatgaagaattgtaatgcaccggtatcttggcaacttgggcgtttaagtttattggcaagtaattggttttccatcatcgtgtcgtagacgagcttttggagtggatcgacttcgatcttactgagttcttcgagtttggcagtcacatcatctggtagtcgatgactgatgagtgcaatataatcggccaaaatgtcgcgcatccgttggcccttagttgataacgttggttcggtatagtcgtatgtcattgtatccatagctggtttcctcctatcaatttacagctacattgtaagtaactgtgtgatacaaaactaaccgctactcgccaagttatgccaggtatcagattgtgaaagtgatggtaagcggacaggtagccggttaaaaatgacaaaaaaataccaaggccttctgacgagtgatgccatcgtaccttggtatgacccaatatttgatcaaaatatcggtaagttcagttgttcgtaatcacaaaaattgttatgccgttaattattgattgagcagtgtttttaattgcgcgattttttgtttgagcgcctgatattcttgaaaatgtagtttatacatgcaactttcacaagcactgagttgatcagtacttgtgagttgggcccagtgcttgagttgcttttggacaatggtagtttgtgtgggagtgagcggttgcttgaactggtcatattcaggacgctgcccgtgtgacaagtgttgacggtaactggaaggtgtctgaccaaaatgcttcttaaacattagattaaaggacttgacctcctgaaacccattggctaaagctagatcggcgacccttgtggttgggttttccagatcgtagatggcgtgttgtagtcggcagcgggttagatattcgtaaaaattcaggccgagttccgctttgaagatgcgtgagagataggctggtgaatagtgactgatttttgccgtttcgtttaaggtaattggtcgatcgtaagcctggttaatgtaatcaatgacccggtttagtgaactctgcgtcttgggttgggggtaagtcatcgtgattccagtatcaaagaaatcgtgatgtagcaggttcgtcaattgaaagtacagggcgttcaagtcaaaaattggccagtcctgctgatgtaatcctagatagagttgtgccaggatttggcgaatcgtttggtagtcacggtgttggggcgtcgtcacgctgttgagtagaaaagcacctgaactgaggtcgatgccctgattagtgtagaagtcgggcagaatatgtaaacggagcgcgatacattctggggtcaaggcaaaggtggcatggccgcgattggcattgatcaagatgaggtcatttgcgtgtaattgatggcgagtcccgtcaacattcacttcgacggtaccttgcaataaccataagagttcgatttgcggatgccagttgtagtggtaactaccaatcatgtatgttaataagtcaaattggacggttggagtggattgaaaatgctgactaggtatcatgacagggtcctccttaggaataactttgattagctctagcttacacgttcagaagatgcttgagcagcagtcgacaaaagaatacaaagaaaaatgacaaaaattgactagtatcagttatgatggaaatataagtaatggtaactgaatgttggttgtggtcacgcttaatcaagactgaaagtgacccaggcacatcatcgttgttagactaaggatgaaatggtggagaaatagtggatacgaagataattgtcaatcatgcgctacgagcgcttttatacgaagtgacggtcaaccctaagcccgggctggtcgacccgttgtcggcgggtccccatccagacatgaacgcttttatgtttattgatagtgctttgagtctagccccctactttaatgcttgtgcagcggcgggcgtcgcgtatacggctgtcgatttgacgggtttgttcaagcaaattcggggcagtggtgttcaagcggaacaaaccatgtttgcggcgaccaagggcgtgaatacccataaaggggcggtgttctcactgggcgtgctagtgacagcggcggcgtatcagttgcagcaccccgacgtcgacttagcaacgattgtgcgcacgatgctggcggggttaacggcaaatgattttaatgaattaaacacgaaggatccaacgaccttaactgctggagaacgtcaatacttaacatatggcatcaagggaattcgtggtgaagccgaggcgggttatccgaccgtgatgcaagtggcactacccgcattgagacgtagtcgtggcacgattaatcagcggttattagacacactgatggcgattgtccaggcgacggtcgataccaatctggtaaaacgggcacacgacccacacgtcattgactgggtccacgaccaagcacaccgctacttcgatttagggggaagccgcagtgaagctggaatggcgtttttacgcgaattgaatcagatttttgtcgaccataactatagtttaggtggctcggccgatttgttgattttgacgatttttattggattgcagacagatatattagcttaataatgagtgtcgtgattgtaagtgacgacacttttttaataccaaatattaatggaaattaaatgacgattgcaatgcttagttgatgagtggtcagtgctttttagtggtgatggcatcgaaagtcgtttcagtaggttctggattaagcttttagtatgttggttgtaacgccttggttaagcagaaatagtattagaatgaacgaaaatttaataccaattataaaaaagttaactgcacctaacaattatttgcattagcgttaattatcagttatgcttatgacgatgtagaaaaccgactaccgcgatgaacggaggaaatgtgatgttaaaagtacaaaacctcaccgtggcatacagtgacacaccagtctttactgatgttgccgttaactttaacgccggcaaaattactggaatcattggtcccaacggtgcgggaaaatcaacgatgatcaaggcaatgcttggtctgatcaaatcccaaacgggaaccgtcgaatatgaaggtcgtgcgctaaaacaatttcaaaaacagattgcatatgtcgagcaacgtaaagatctcgacttaacctttccaatcaatgtttttgacgtcgttttgactgggacctatggcaaactcggacttttccgcgaaccaagcaaggcggatcgtcagcgttgccaagatgcacttgagcaacttgagttagccgatttagcacagcgccaaattagtcagctctctggaggacaattacaacgggtctttgtggctcgagccttagtccaagaagccgatatcattattcttgatgaacctttcgtcggcattgatttacagagtgagacggctatcatgacgatcttgcatcagtggcgtgatgccggcaaaatgattattgtcgtgcatcatgatttgaacaaagtttcacgttactttgatgatctcgtgattttaaatcacggtatcgttgattatggtcccgtggacgcggtctacacacccgcaaacattgaacggacgtttagtgctgatctttcggccgtcctgtttacgaaggaggaaacgcgatgatgcaatcaattacgacctttatggctgctttggggaagtatgatttcttacaaagtgcgctaattacggctattatggtcggggtcatgtcaggaattattggtagctttattattttacgaggcatgtcgatgatgggcgatgccatctcgcatgccgttttacctggtgttgcggtagcttatatgctcggtatcaacgtcctaattggtgcttcggtttttggaattctagccgctagcttgattggattcgttgcgagccgtagtaagattaagactgacacctcaattgggattgtcttcagtgcgttttacgcactcggttttatcctaatttcattagctgaaagttcgacgaacttgcaccacatcttattcggtaacatccttgctgtgagtgatactgatatgatgacgacgacggtcgtgttaggactagtgattttattcgtggtcttcttctacaaggaattactgattacgtcatttgatccgacctttgcgaagacttatggtctcaaggtccaactgttacattacgcgttaatgctggtcttaacgctagtgaccgtttcagcgctacaaaccgtcgggatcattttagtggtcgcgatgttgattacaccggctgcgacggcctttctatggacagaacgactggcagtcatgcttggactgtcagccttaattggggtcttgtcctcagtggtgggcttatatctcagctacacgttgaactgggcttctggtccggccatcgtgctagtagcggctattttcttcggtatttctttcatcatctcacctaagcaggccttgttaccgacgctttggaaagggcaagcagcagcgcgacgggtgacagcatgaaaacgaaattaattgcactgattggagtcatcgcgatggttaccgggatggcagtatttctgaatcaacgccagcaaagtgccaaagcgacgaccactagtgccaaaatccgggtcgtaagtacgaactcgattctagatgatatggtgaaaaatgtgggtgggcagtacgtccaaaattacagtattgtgaagcgcggcactgacccgcatgagtatgaaccacggcccactgatattgcggcaactgccgaagctgacgtgattttttataatggcttaaaccttgaaactggcggtaatggctggtttaaaaagttagtgacggcttccaaaaaggactttgaccacgatgtttttgcggccagtaagggaattaaggtcaaatatttaacgacgaacgttaatgagccggacccccatgcttggttagatctcgccaacgggattcaatatgtcaagaacatcaaccggacgttgcaggccaaggatcctaagcacgccgctgtttatcaaaagaatacggatcgctacgtggcaaaactaacaaaactgcatgagagcgctcaaaccaaattcaagcagatcccgacgagtcaacgattattagtgacatccgaaggcgcctttaagtatttctcggcggcctaccatgtgcccgctgcttatatttgggaagtgaatacggaatcgcaaggcacgccagctcagatgcggacggcgttgaagaaaattgaaggaacccaggttcgaagtttgtttgtcgaatcatccgtatcaccgaaatcgatgaataagctttcacaggagacgggaatccccgttgctagtacgatttttaccgattcgctggcagctaaaggcaagccgggtgatacgtactactcaatgttgaagtggaatcttgataagatttatgctgggctgactcggtcgtagtacttgggcctataattcggttgtgttgatgtcatgtgatataagtttgttctaaaaaggaccgtggaagttaaatcttccacggtcctttctttattttgaactgctagtttagtcttccgattcgaatgacaattccgtcattgatagttccagatcatcaagtacgtcgttttcactcagaaattgttcccaggcagccggtgtttgttcgcgggtatgggggacgattttatcatgaatattggcaatcacatcatcgagcatcttatccgcttgccgggcgatttcagcatcgttatagcggcgtgctggcgcccggtcctcattttttcgattcagaaaatcggttgctttctccataaaaatggtaataacttgggagttgtttgcgagatagtcttttaaagtttcattatccaatgtattagtcctctctagtttgagtcgtacttctaatataccacgctaatcaggttttaactgtttcaagatcggttggcgggtaaaaagttttgtaacttgcgcagatgtttcgaattgacgccaatcaggcaatttaaacgcagaattgtaaccgcttacgaaaatgatttcacaagctgacactttagaaaaagttcacaatcaaaataattttaaatgctgctacacaggcgttttaagtaataattatatttaaatttttcaaaaaaataatttatttttaaaaaattagcaaaaatgaaagcatttgcgttataatacttgtgagttaagtaactaagtagttggaaccacatgtgcagcacacatttttgatgaaagaaggatattgacatggataagaagcaacgcaaagtcgtaattgttggtgatggctcggtgggttcatcatttgccttttcattggtccaaaattgcgccctagatgaactcgttatcgttgacttggttaaaacgcacgcagagggggacgttaaggatttggaagatgttgccgcctttacgaatgcgaccaacattcataccggtgaatatgcggatgcgcatgatgctgacatcgttgtcattacggctggtgtgcctcgtaagcctggtgagagtcgtttagatttgattaaccgcaatacgaagattctggaatccatcgtcaaaccagtggttgcgagtggttttaatggttgcttcgttatctcaagtaatcccgtcgatattttgacttcgatgacgcaacgtttatccggttttccacggcatcgggtcattggtaccgggacttccttggatacggcgcggttacgggtcgccttggctcagaagttgaatgttgccaccactgcaattgatgctgcggtacttggagaacatggtgatagttccatcgttaattttgatgaaattatgatcaatgctcagcccttaaagacggtcacaacggtcgatgatcagttcaaagctgaaatcgagcaagctgttcgtggtaaaggtggtcaaatcattagtcagaagggggccacgttctatggggtcgccgttagtttgatgcaaatctgccgagcaattttgaacgatgaaaatgctgagttgattgtctccgccgctttgtctggtcaatatggcattaacgatttgtacttggggtcacccgccattattaaccgcaacgggctccaaaaagtgatcgaagctgagctatcagatgatgagcgtgcccggatgcaacatttcgcagccaagatgctgaccatgatgaatgtggcatcataaaaatgatgagtaagtatgaggaggaattgagatgacactaaataaggtcaagtatcgtgattttattgcaccgttattggtgggcctgatcatttggttaagtagtcctatcaaaccagccagtgtttcgatgaacgcatggcatattctggcaatttttgtggcaaccattattggttgtattacgcggccgttaccaatcgccggggtcgcaatcattgggttgacactaaccgtgttattgggcatcgtgcctatggatacagcggttgccggatttgggagcagtacggtatggatgattgcgatggcgtattttatgtcacgtggtttcatcaatactggtttaggtcgacgtgtcgcgttggtgtttgtgcggctgtttgggaaacgaacgttgggtttggcatacgcactgattggcgtcgatttagtaacagcacccgcaacgccaagtaatacggcccgtgctggtgggattgtttatccaatcattcagtcgttagctgaaacgtttggttctgatcccaaggatggcacacaaagtaaaatcggttcattcttagtgttcgcagaatttcacggtgatttaatcaccagtacgatgttcatgacggcgatggcgcctaacttagttgctgtcacgttagccaagagtttacacatcacgttatcgtggatgcaatggttcttagccgggattgtcccaggacttatttgtttattggttgtgccatatttaatttataaaatgtatccaccagaaattaaagatacgcccaatgccaagcaatgggcggatgatgagctggcaaagatgggtaagatgagtcttccagaaaaaatcatgggcggcgtcttcttgctagccttagtcttatggatgttatccagctttatcggtctcgaagcttcattagttgcctttatggccgtctccttgctactcgttgctggagttctatcggtagatgacgtgctacacgaaactggtgcttggaataccttggtgtggttctcaattttgatcttcatggctaatgagttgaacaaactcggctttattccatggttgtctggcgcgattggtggtgccttgaaaggcttcagttggggcattgttttagcggcactcgtcttgttctacttctacagtcactacttgtttgctagtgggactgcccacgtttccgcaatgtacggtgccttacttggggtcgcggtttccgcgggagcgccagcaacctttgctgcactgatacttggctttactggttcgatcttcgcttcgacgacgcattatgcgaacggcccggcgagtgttctcttcggttctgggtatgttactcagggaaaatggtggcaattaaactttattttaggtctcttctacctagtcgtttggggtggcattggcgctctctggatgaaagtgattggtatttggtagtctgattttaagcataaaaacaggtaccaagctgccggcaacggtcagcgttggtacctgttttcgaagaagcggattatttggatagtggtgtggcttgatcttcttggagaacccgattcgcgacggcttcatcaatgatgatgtcagtgagtaattgtccgcggagggcgccaagtaaggcttcgctcttgaacttacttttgatgatgccgaaacgacgcggcactttgagaatggcgggcattttagcgccaaagagtttgtcgtggtcggcgttcagaatgtgaccattgatgtcgtatggccgaccgtataacaggccgaccaccgcctgcggatcagcgccacccagaatggcttggcgatgttgatgccagacgggaatcgagtcaatggatgctaaggtgccaattccggcaaatagcatgtccattcggtcaaagttactgatggccggtgtaatggctggttcttgagccaatgcttggtgtgcttgatcattaaacaagtagagtggtgccgggatggtgacgtactgtgcgccgaacttagcggcggctttttgaaccaacggtgttgagccgttcgctgcgttcgttttcaggttatcacccataaactgggtgaacagtaagtcatcacgagtgctcgtttgaaaattatcgatgacgctaaggacagtgccaccccatgccaccccaattacattactttgaatgatctggcgctggattgtttcggcggcaaactcgattacgtggcgttcatcgtcactcgtggtatccgcgtctttgataatataaatatgttcaattggaaaacgatgtttaaatttagcctccagctcactatttcgttcgatgggggtgttaatgttaattttgactaggccggttgccatggcttcgtctaagtattttgaaattagataacgactgacttggtatttctttgaaatttcagcgatgttgattttggataagtaataatcatgtgcaattccaatcaacaggcggcgatgattcatatcgtccatatcgatgacctctttatcaacctaagatttaaaattttaaaactcgtttataatattttaagtttattataccagaaaagctgactttttaaaaattataaaaatccaatctaaatttgatatttttaaaaaatggtcgtacactggggataacaaagtgaacggtattattttgagaagagaaggcagatattgatggtagaacaagatgagattttaaagttgcacgccgcccatacgggggttttggacattcattcagaccttgcagtgaccgataaggctgatttaggtaaagcatatacacctggtgttgcggtgatttccaagctgattgcggcgcatccggaattaaaggcaaaatacacgatgagtggtaaattagtagcgttgatcacggatgggtcagcagtactgggcctcggcaatattggtcccgcgggtggtttgccggtcgtagaaggtaaggcactcctatacaagaacctcgcagggattaatgcgattccgctggcgttaaatcaggtcagcgtgccagcaatggtggcgacaatcaaaaacatgtcgctctcatttgcgggcattcatctggaagatattacggcgcctaagtgttttgaactagaagcggccttgaaagatgagcttgatattccggtttatcatgacgatcaggaaggcaccgcaattgtcgtgttggcgggactgatcaatgccgctcacgtagtcggtaagtccttacggcagatgcgcatcgttgtcaacggcgtcggcgcatccgggttagctacagctcggttattagcagcggtcggtgtcaaacaactgaccttggtcgatgtttacggggtcgttacagcggatgatcagcggtacaaccagtatcaacggaatcttgccaaacagttgggaacacctgcacaactaaaggggcaaccactggcgaaggtcatggccgaccaggacgtcttcattggcttgtcagacgccaacgtcttatcagcaggggccgtccacttgatgaatcatgatccaatcgtctttgcactcgctaatccagtgccagaaatcaatccagcagtagctgagaaggctggggccacagtcattgcaacgggttctagccagtatccaaaccaggtcaataatattctggcttttccggggctcttcaagggcttactcacaaatggggtcaagcaagttgataatgcgttacagatccaagtggctcaggctttggctaagaccgtgtcgaacccaactgcgacgacgattgtgccgagcgtctttgattcacaagtggtaccgaacgtgacggcggccgttgcagcgtacgcgcaagcacagcattaatcataggaggttgtctgatggcagcgcaagttgttgaaatgcaattaaataatccgcacgagcatgcccagtggcgacaattcttaacgtcattagggattactaattttagcccgcaagaggttgaacatattgatgtgaccttaggattgatcgaggatggccaacttgttgggaccggatcgttagcgggcaacgtgcttaaatatgtgggtgtctgtaataagaatagtcagccgggggcccggtttaatcaaatcgtgagtgcactggtcaatcggctgtttcaagcacagatctttcatatgatggtatttaccaaggccaagtattcagcgagttttcaacacgtaggctttaaagaattagctcattcggatgaagcggccgtattagaaaacggcgcaccggatatgacggattttgtcaaacagttgccgatgattcccaaccaagcacaacagcgtgtcagcgcgattgttatgaatgcgaacccgtttacgcggggacaccgctatttagtggaacaagccgcggcggtcagtgatttagtttacgtcttcgtcgttgcgacagatgcgagtctattccgtacggccgagcgcgttaagctggttcaacaaggaacagccgatttggccaacgttcgggtcgtcagcgggcaggactatctcgtgagtgcagcgacctttccagcctacttcttggattcagcggcgagcgcaattgaagcgcagacgacgttggacgcccggatctttaagcagcaacttgcaccagcactgcacattacgacccggttcgttggtagtgaaccgacgtcgcggacgactgcgatttataaccgagttttgcagcgtgaattaccaccggcagttgctgtacgagtgatatcgcgaacgacggtggctaatcaaccaatttcggcgcggactgttcggcaacggattcaaagcggcaacttaactgagttaaaccaactggtaccggcaacaacggcccagtttataaaaaataacctaacaacattacaagcgcgaattcagaaaggaatgaaaattgatggaaattaagacaacggcagtcgccggaaccttggaatcatctgatattcaaattatgttaatggcgggagacaacggcattcaaatcgaccttgaatcggatgttatcaaacagttcggggcacaaatcaagcacgtgatcacgacgacgcttcaacaattgaatatcgataatgtgaaggtgcgcgctgttgataaaggggcgttggactgcgtcattaaagcgcggaccattacggcagcacaacgggcgttagaaaccacgacaccagcatgggaggtattataatggctgaaaatgaagaacgcttacggcggacaatgatgtttgtacctggtaataatccagccatggtaaaggatgccgggatttacggtgcagactcgatcatgtttgacttggaagatgccgtctcaatggctgaaaaggatgcggcccgggtgctggtttacgaagcgttaaaaacgcaagattatggcaacgctgaattggtcgttcgaatcaatggtttggataccaagtattacgctgatgatgtcaaagcaatggtcaaggctggcattgatgttatccgtttgccaaaagtcgaatcggctaccatgatccaaacgttggaaaaggatgtcgcggcagctgaagctgaatttaagataccagttggcacgactcatttgatggctgcaattgaaagcgctaagggcgtgcttaatgccccggcaatcgcggcagcctcggatcgaatgattgggatcgccttgtcagcagaagattatacgacggacatgaagacccaccgttatcctgatggcgcggaactggaatttgcccgtaacatggtgcttcatgctgctcgtgccgctggaatcgccgcgttcgatacggtctttacaaacatggccgatcccgatggcttctaccgtgagacgcggcatattcatcaattaggatttgacggtaaatcattggtcaaccctcgacagattgcaatggtcaattcagtctatgaaccaaccaaggatgaagttattaaggcccaaaaagtcatcgccgcgattgaggaagcccggatcaagggttctggtgttatttccatgaatggccaaatggtagaccggcccgttgttttgcgggctcaacgtgtgatgagcttagccaaagtttccaacttactcgacgaggagggcaattacattgaaaaatagtgtagaccgcgaattaccagcagaattaatgacgaagttaaattaccaaggttttgagtcaaccgaaatcggacatcctgaaattcaacgggtggcccccaaagttcacgtttcaacaggggacaacaaagtcgttgattccgttgctgacgtggtaaaagccactgtcaaagatggtatgacgatttcatttcaccaccattttcgtaatggggatttcgtcttcaatcaagtgatgcgggccattattgatgccggtattaaagatttgaccttggcgccatcctccttaacgggcgtgatgaacgatatggtgatcgaagcaattaaggccggaacgattacgaatattactagctcggggatgcggggctctcttggggacttcgtttcacacggtggtttaaagaaccccgtaatcttccgttctcatggtaatcgggcccgggccattgaacatggtgatattaaaattgatgtcgcctttctaggtgtgccgaatgctgaccgactaggaaatgcgaacgggatggctggtaaagcagtctttggttccttaggttacgccctgatggatgcgcaatacgccaaccaagttgtcttattgaccgataatattgtggcttatccaaatacaccggcctcaattaaacagacacaagtcgattacgtcgtgcaagtcgaccaagttggtgaccctgacaagattggttcaggtgcgacgcgcttcaccaaggacccaaaggaattgaagattgcccagaccgttaatgatgtgatcgtgaactcaccatactttaaaaacggcttctcattccaaactggttccggcggtgctgcgttagctgtcactcggtacttgcggcaagcaatgctcgataatcaaatcaaagcatcgtttgcacttggtggtattacgaaaccaaccactgatttgctcgaagaagggttagttgataaagtcatggatgttcaagactttgacaaaggggcggcagcatcgatgcacgccaatcctaatcaacaagaaattgacgcatcatggtacgctgaccctgataataaaggagcgatggttgatcaattggatgttgccattctgagtgcgttggaaattgatacgcacttcaatgtcaacgtcatgtccggttcggatggcgtgattcgtggcgccattggtggacatcaagacgcggctacggccaaactgaccattatctctgcaccacttgtccgtggtcggttagcgacgattgtgccagaagtaacaaccgttgtaacgccgggggactccattgacgttgttgtgacggaatacgggattgcaatcaacccgcggcgtcaagacctagttaaagcactcagtcatgtcccaggcgtgccggtctatacgattgaagaattacaacaattagccgaaaagaaagtcggccaaccccaaccacttgaatttacagatcgcaccgttgccttgattgaatatcgcgatggcacgattattgatacgattaaagcggtgaaggactaaagtatactgatgacaaaaatgaccttgcttggcaaattgctagctaggtcattttttgtatgacgaattgtcaaatcaagcgcaactttgtcccgaagaaaacttcaaatggactcttccagcctaagaccttacgtggtcggtgatttaaatccctgacaaacttgtcgatatcttgatcagtcagttggtctaggtcggttcctttggggaaatactcacggataagtccgttggtattctcattggttcccccgttgctgaggcgcatgaggatctgggaaatagactgggatacttagctcttgactaacttcgcggtatcctgcgaattcagttccacgatccggcgtaagcgtccgaactcgtttgggcgtcacggtatgcaagaggtcaatcatcgcttgtgtgacgttcttggcgtttactttgggaacccgctgagataataaataccgagatttgcggtccaccaaggttaccagggccgaacgcccggttttaccgcgaacggtatcactttcccaatgaccaaaccagcttcgattctcacatgaaacaggtcgttcatgaacggaagggacgtcgttaaatcgtccccgacgttccttaatggttcccttgacctttcgggttttaccacggtgacggagcttacgggcaaagccatgagcctcgtgattcttacgtttgatgcctaaattatcacgttcaatcccacgataaatggtgttataactgacatgccattcactgttttcgtggactaaacgaccggaaatttgttccggggaccactgacgttgaacaatacagtgaagaacaaaatcccgtaacttcaaatcagttagaagcctaggacgtcggctttttagtcgccgtccctgatagttctcttgggctttgacggccgagtatgccttacgaccaccattgcgcttgatttcgcgcgatacggtggctttggaacacccaattttctccgcaataacttgataggtattgtttaaagtgacgcccaacagtatgcattctcggtcttttaaggtaagatggttgtacggactcatagcctaggatctcctttagatgattgttgtggtgacttcattttataggactcaggctatgagttcttttttatttttttcttacttgttgcacttcaattgtaaattcgtcattaacaacatgtgtggcgcttgttcgcatcgaggtttatggggaaaaataataaactaagacggttaatcccaagttttaacttaaattcagttgtactacgctaaatttatttttgtgaataaatcgggggaagttataagtgatagtattagtgaatttaggttacaagaataggaaaatcttggtagaccagattgacaatgttattagcccccatgcgcgtaagtattgagcacatttttttgctttttcgtattgttgcaataccattgctaaacggatcttactcaataatagtaaatcataccggtgagcgtgtttggttaactcgatacttttttgtaaatagttaattgttatgcttttaccgaatgcattggagttggtcatgttaatgaatgctaaattagaataaatagcattttgtagtaaaacattattatctccatactggttaagtttagtaataattttttcccaattcttagtgcagtttggaagtcaaaaatatatagtaaattattaataataaaaaggtctgtatgattccagatacttaccgtagacaattcgttccagacaggtttgacaaggttagtaagttgatcgcaattgtacgtatcaacgtgtataagagcatctaaaacacaaattatataatggatatagcgtaacgtcgatttttcttccagctgtcgagcctttttcaaaatagatttcatttttttaacttcagaagtatctgagatactttcaaactcatttagtgtattttcaagttttgatggtttttcagaaagtataggtgaaatacatgcacaggcagccaagtataagagagttgcacctaagcctaagggaaaatggaaacttaggaaaaaattcaaaaaaactgttaaaataacaaaaaagttaaagaagtctgggtctgcagcaatcatgacttacgtagtacaggcgcttgcgtccaaatatggcggacaagcaatttggatgttcgggggtacattttttgggagctattttcctgcaggaaatacttatttaactgcgtgggcgtataagcgcgctaacaagtatgtagtacaatataaaacagttattcatatttatacgaataaatctaggaaacacattcgtaaaaaggcttcacgtattcagtcgtttgtaaagaaatataaggtggttagggtggattaattatggatcaatacccaaattttaagctatttattgataaatatttaccatggctagccgttattggctttgttgtgacagttagtgttaatggcaatgtttggttgtattttatgtcggtgctgattgtatttgttgtgattgcaattattgacttgctgtttaagtattggaaccacgccaaaattttaggtatcatgattgttcttttagtacttggactatggttgaatcgctaagaaaataccaggattagtgtctgacgcggcattttcaatggatttataaagaggcattgtgcttttctgaaatgccatggctagcatcaataaggggcttctgtcaaccagtgtcgatgaagttatatctagaatccaattcatttatgaattggattcttttttgaagtgcgcccggcatgggtgataactaggcggtgtaagtccgctgtgggccgtagtagtcggaaccacgagttgagggcaagggcgttcgccgtgagacggagtctgaaggaagcctaagacaaaataccgaaccgatgtacaagaagtggctacaaggctgattagactggatgaagttgcttcacaaactgaagtcctacactacttgaagtcgaagttagtaaagccaacggttgcatggtatgaaagctatcattcttacccggggaggcctgtcggataagctcccaacaaggacgccgatatgggtttacaggagtaaactagtcagccgaggtcatagtaatctgccgtatggcagatgaaggactgaacaataataattctcaccgatactggaggtgttggtagtgcgaagattgcagaaaacagaacaagctgaccgccaagggatgaatagtctggaagacaaagagtatcttggggcgcatagtactactaacggtgaaagtacggcgcaggatggcattcaatttgtagaccgggtccttccttgcaagtagtaatctgaacctagcgtttaagcgtgttcggaggaataagggcgtagctggaattgacggcatgaccgttgaccaactggccgaatatatttacaagaaccgggaagaactcctagagagtttacgtaatggaatatatcggccgcaaccagtcagacgggtagagataccaaaactcgatggctcaaccagaaaactgggagtacctacagttgttgatcgtatgatccaataagctgtggtacaggtgctttcgccgatatacgaacaagtattttccgacaatagctatggattccgaccaggtcggagtgcgcatgacgcgattcaaagtgtcaccgaactctacaatcaaggctaccactatgtggtagacctcgatttaaaggcatactttgatacggttaaccacgacttactaatgaacttcatcaaacaacgagtaactgatccatggctactccacctaattcggcgcttcctaacaagctgggtcatgaatggcgagctgtttcgaaagacgacgaagggaacaccacaaggtgggaacctgtcgccgctactggccaatatttatctcaacgagttggacaagctattgacccagcggggccaccgatttgtgcgctatgccgatgactgtaatatttatgccagaagtaagcgagcgggagaacgagtcttacgcaatgtcacaatctttcttgaaattaagttgaaactaacaattaactgtcataaaacgacggttggctcaccactccgactaaagtttctaggatttacgctcggtgtagaccgtaatggggcatatgcacgaccgcacaaggtcgtgaaacagcgaatcaaacaagcccttaagataatgactgggcgaagtcgtggaattagttggttaatgttgatgaagaaaattaaacagaaaatgcgaggatggctacagtactatgggattggcaagatgaagacgtttattcaacaactggaccaatggttgcgaagtaggattagacagttgatatggaaacggtggaagaaaatcaaaacccgatatcgtgagctaattaagctaggaatgacaccggaacaggccaagactaatgccaatacccgcaagggatattggcgaattgcccataataaaacactaacctatacgtatacaaatcaaaagctggagcgtcttggactaataaacctgtccaagacactccagcaaatacagagtgcttaaattattgaaccgccgtatacggaaccgtacgtacggtggtgtgagaggtcggtaattgaaataatcaattacctcctactcgattgcaaccgaatttgataaaaaagttttactagttaaccatacgtcgttcttttgatttgcctgatttcatctcttttcaactatgactcgatattttgtggtttggtatatttaggtctacaaataagaaaaagtgacaattatgagtaaaattaagcaagaggaataaataagaacatgtgaaaaaataaacatttttatctagaactcattctaagcaatctttgtatgctaatatactgatacataaacctcataactaatacttatagctaaaactgagtttgactatagctatatgggggcgctaaactaggattataaactaaatgttatttttttcacacacttagtaagcgcttaccaacacattaattggaggttatcaacatgacagaatatcgagttgaatcagatactttaggcgaagttaaaattcctgcgaacgccttatggggtgctcagacagaacggagtcgccataactttccgactggtacgaagatgccgttggaaatgattcgggcattacttcaaattaagcgggccgcagcgattgcgaataaagaagttgaagcaatgactgctgaaaaagctgatttaatcgtggctgccattgataagttattagcgctcgacgatgaagatttgcgtaaggactttccgctggttgtttaccaaactggttcggggacgcaaacgaatatgaacgttaatgaagtggtcgcacacatggctggtaagatcaatcctgatattgaaatcttgccgaacgacgatgttaaccatggtcaaagctctaacgatatcttcccaacggcgatgaacattacggccgcagttgccgtggataagctgattgccgcagcggaacacttattagcggaattgaagatcaaacaaaagaagtactggcgggtagtaaagatcggccggacccatcttcaagatgcaacgccattaacttttggccaagaagtgagtggttgggccagtgcgattgaacatgatattgcctacttaaaacagttgaatccaacgttaggcgagcttgcaatgggtgggaccgccgttgggactggtctaaatgctgcccctcattttgctgaaaatattgctgcggcgatgagcaaattgtatgggattgaatttacggctgattccaataagttctatggtttggcccatcattctggcttaaacgtggttcacggggccatcaagaccctagcagccgatttgatgaagattgccaatgatgtgcggttcttggcaagcggtccacgggccggttatgacgaattaaacattccggctaacgaacccggctcatcaatcatgcctgggaaagttaacccaacccaagctgaagccatcactatggcagcggtacgagttatggggaatgacgtggtcgtcgatttagcttctagccaaggtaattttgaaatgaacgtttacaagaccgttttgattgatgccttccttgaatctgctgaattgttagctggaacgattaccggcttcactgaccgaatgattgctggtttgacggtcaaccaagaccggatggcagagttagtcgacagttccttgatgacggttacggcattgtcaccacatattggctatcatgatagtgcgatgattgctcaagcagctgaaaaagcggggacgacattgcgtgaagcagccatcaagtctggcaaagtaaccgcggaacaattcgatgaatggatggttccactggatatgacgaatattgatgattaagctaaaataagtattgatcggcgttgaaccgttaacgtggatcaaggtggcacgggtcattgttcctagacttggaatggtggcccgtgtccagttaacgacaataataaatgagattttggttccatcctggggaataccccggacgaattgagaggagaagtggcaatcaatggctgaaaagtttacatttacaccaaccgccttagcggatctaaaaccgaactatgacgtagtgattattggatcggggggcgcgggtttgactgcggcaatccaggcacatgaattgggcctgaacccggttattttagaaaaaatgtcgaaaatcggtggtaacaccacccgggcttcatccggtatgaatgcggcggagacgaacgtccaattgcatcaccatattgttgatagttttggcgatttctacggcgaaacccttaaaggtggtggcggtatgaataaccaagcactgttgaaattcttcacggaacacagtgcgctcgcaattgactggttagcagaccacggcattaagttggatgatttgacgattactggtgggatgagtgtgatgcggacccatcggccaagttccatggctcccattggtggtttcttagtcactgagttgttgaaacaagtggcggctgaccagttaccactcttcacagatgtcaaagtcgatgaactagtcgtcgaagccggcaaaattagtggcgtcaaggcaacaaccccagatggagctgtcacgattacggctggagccgtcttgttagcaaccggtggcttcggtgcgaataagaccttgttaggccagtatcgtgatgatcttaaaaactatcagacgaccaatcagccgggcgcgactggagatgggattctgttggcacaagctattggggctaagttggttgatatggaccaagtccaagttcatccgacggtccaacaagatacagatcatgcttatttaatcggtgaagcggttcggggcgaaggtgcgattttggtcgataaccagggggctcgtttcgtcaatgaactcgacacgcgtaagaacgtgacggccgctatcgaccaactgggtggtactggtgcctacttgatctttgaccgcggtattcgtgaccgggtcaaagcggttgaattctatgatcacattggcctggtaaagactgggactgacttggaaacactggcgactgcgaccggcttagacgctgcgacgcttaaacagacggtggctgactggaatcaggcagtcgctaaccataatgatgcggcctttaaccggacgactgggatggatcgcgatattgcggcgggaccgttctactcaattcacattgcgccagctgttcactacacgatgggtgggattgccattaatcccgcaacccaagtgttgaatcaggacgaacgaccgattgccggcctgtttgcagccggtgaagtggtcggcggtctccacggcaataaccggattggtggtaattcaatcgctgaaacggtaatctttggccgtcaagccggacaacaaatgttcaaatatttacaataagttattttgactaacccaaatcaatagtccatgcgcttgagtaatcggtgcatgggctatttttgatttgggctgtagttagagaccaaagaaattagtttaaaaatcaactaatttcggttaagctggaaatataacaaatatataggaagaaagtgacaagcatggcgacgatttttacaaccggtgaaccgcaaacaatcacggcaatgctagcagcccgtgatcaacgggtcgcgtatcagcaacagttgacaacgactaacccccgggccacgattgcggcgatcaagttgaatatcccaggaccgattaagaataacgctgcactacgacggttgtttttggccggtgtccagcggtttgaagctgagttgtcgacatacacggtggcagctgattggaatcatccggcgggtaatgagcggttcttgattctgacgactgactttgcgactagcaaacggctggcggtcgcttttgaagaacacgatccgttaggtcgcttatatgatattgacatcttacaagcgggttcacagcgcgcgctgtcgcggacggatttggggctgccgaagcgtcgttgcttattatgtcaccgtgaagccaaggattgcgcgcgttcacggcggcattcagtggctgagctacagcaaaagattgcggcgatgtacatgaaggaatttggtgaacgcggatgaatacacgtgatttagattattttcgggcgttagttgattgccaaaattatacgatggtcgccaagcagtttgcggtctcacaaccggcagtgactcaagcaattcatcggttggaaaaagagtttgcagtcaaactggtgattcaagaccgtcgccatcaacagacaaatattacccgggccggtcagctgctttacaagaatgcacgccagatccaggccagtttgcaacttgctcatcgcgaaattcagagtacgttacagactgatattcgttttggcttaccaccaattattggcactttatatttccctcaaattgcggaaaagttacttcagaacgggttactgcaacagttaaaaataacggaaacgggctcagatgagctattgcgtaagttagtgcatggtgagatcaacatcgcgttattagggtcctacttaccatttgatttgccgacagttcgtgcggttcacttaggggcacggccattcagtattatcgtgagtcctcaaaatagtttggcgaaacaagccgccgttagttttaagaatctcggtcaggcacagttcattggattggatggcaaatacgtgcacccacaagccttccgagcctattgtgactttgccggggtacatccagaagttatctaccggacccccgatatctcatgggtcaaagccttagttaaagccaacttgggcattagcttactggttcgtgatgtggttaaagcggatgatggcgtcgtatgtttggagatcaaagatcaattgccggtcagcttcaatatctcggtggtcacacgggccgggtacttaccaaccactgatgaacaacggtttattgatcaattacttaaaatgaagatttaaacgtcgcgactgagccatctgtctaagtgaacagcacgattccttgagtggttcaacttttactttgagattgacgtgtcttcacgattgtttcatttggatatatcgcaatttgtcttgattacgaaaactgcaccaccctcacagactattctgtaagggtggtgcagttttgcttaatcggtctgatcagtgtcaaccgctaatgtttcgtgcaaaatggtcagtagctgttgctgcacgggggtcagaatatgggttgttcggtagacgatgcttgtgatgaattcagggggttcaatgtccatcaagtccagtcgtacgacgtcagtacggtagtgatcgacgattttggtaaagaaaccgatgccgacattttcaccaatcaatttcattaaaacgtgggtatcgttggaacgaaagacgatgttggggcgaaagtgattccggcgcgtgagtttgttgaaggccgtattatggatgaaattactattaaagaaaacaaatttttcacgtcgtagttcgttaaagtagacccgtttacgttgtgctaacggatgttgcttggacacgtagatacagaagggctgacggtcaaattcttcggcaatcaacgtttggtaagcgagcggctccaccgaaccaagcagggtcatgtcaacgcgaccgtcccgcacagcgttacgtagccagatcgagcccccctcaatggtttcgagaccggctaatagcccttccgcggccaatcgggcaccgatttttggaaaataatggttttcaataattggcggtaatcctaaaatcagtcgattttgggatagattgtcgatttcttggtgggcgaggcgtaactcatgtaaaacgattttagcgtgttcagcaagttgcgccccactagcagtgacgtgtaacgtatttttaacacggtcacgaatcacgagtggtgccccgaattcagactccaggcgtttgattgcggtggtcacagttggttggctcacaccgaatgttttcgcaacttttgaaaaatttttttgagaaattaattcatcgaaataagctaagtcttttgtgttcatttttattcctttctaaatcagcttttgtagcgaccttatttaatatatttatatcatatcatagttttgactataacattttactggcgttacagtattacttgtaaattgataggacgtttttcctagcaatgaaaattgatgaaaatgtaaattaattaggaggccgcagtaatgacaaaaactgcaagtgaaattttaaataacccattcttaaataaaggcactgcctttaccaaagaggaacgtcaagcacttggcttgacggggacgttaccaagcaaggttcaaacaattgatgaacaggcgacgcaagcttatgcccaattcaagagcaagcctagtcgtttggaacaacggattttcttaatgaatctctttaacgaaaaccggacgttgttcttccatctgatggatgaacacgtggttgaatttatgccaatggtttatgatccggtcgttgctgattccatcgaacagtataatgaattgttcttggatccacagaatgcggccttcgtttccgtcgatgcacctgaagatattgaagcaactttgaagaatgccgcggacggccgtgatattcgcttagtcgttgtgacggatgctgaagggattcttggtatgggtgactggggtgtcaacggtgttgatatcgccattggtaaattaatggtttacaccgccgccgctggtattgacccatcacaagtactgccagttagcatcgatgctgggacgaacaaccagaagttattagatgatccattgtatcttggtaaccgtcacaagcgtgtgtccggcgaacaatactatgacgtgatcgacaagttcgttgctgctgaacaacaattattcccagattcattgttacactttgaagatttcggtcgcgacaatgcgcaagtaatcttggacaagtacaaggatcaaatcgcaacctttaacgatgatatccaaggaaccgggatggttgttttagctggtatcttaggtgcattgaacatttcaaaggaaagcatcaaggaccaaaaaatcttatcatttggtgccggaacggccggtatgggaattgccaaccaaatcttggatgaattgatgcaagctggtttaacagaagaagaagctaagcaacacttctacgctgttgataagcaaggtttactatttgacgacacggaaggtttaaccccagcccaaaaagccttcacgcgcaaacggagtgaatttagcaacgctgacgaattaaccaacttggaagccgttgttaaagccgttcacccaaccgttatgattgggacatcgactcagcctggtacctttactgaaagcatcatcaaggaaatggcggcgcacacggaacggccaatcatcttcccactttctaacccaaccaagttagcagaagctaaagcggaagatttaatcaaatggacggatggccgggccttagttgccacaggtatcccagctgatgacgttgattacaagggtgttacttaccaaatcggtcaaggaaacaacgccttgatgtaccctggtttaggatttggtttgattgcttccacagccaaagtgttgaacgctgaaaccttgtcagcggcctgccacgcattaggtggaatcgttgatacgtcgaagccaggtgccgcagtcttgccaccagttgcgaagattactgaattttcacaaaaattagctgaagtcgtggcacaaagtgttatcgatcagaagctcaacaaagaaccaattgcggatgctaaacaagcggttgctgatatgaagtgggtcccagaataccgttccatcagcaaatagtgtcggtaaaataagagaattgtaagagggtataaaagcacatgggagttttatggaattcaattcaaagcgtcttagttgtcgttttgattatgatattaggtttcgtcctacgacgagcaggttggtttgatgataagtttgctggaacgatttccaaatttattaagaacatcgctttgccagcatcgatttttgtatctgtgctgagccgacttactcgtgggcagctaggatcatttgcaggttacttggcttacgcctttctagccgtgattattggctacttgattgcctttgcgctagttaaggtgatgcgggtccgtccgggtcgtaaggggattttcatcaatgcgatcgtcaacgccaacacgattttcattgggttacctttgaacattgcgttgttcggtgacaagagtatgacgtatttccttgtttactatattgtgaacaccgtttcgacgtgggcattcggggtcttcttgatttcaaacgacgacccgacgaagtccaaggaaaagacgcataacaagatcgactggaagaaagttattccaatgccattggttggtttcttagttgcgttaattttcttactactaaatatcccaatcatgaaggtatcattcgttagttcaacgttgacttacgttgggaacttggtaacgccactttccttgatctacatcgggatcgtgttggccgacgctggtctgaagagtattcgtttcgaccgtgatacgatcgttgcgttgattggtcgcttcatcttgtcaccagtcatcatgattcttgtcttgatggttgctggtaacctcggtgctagcttcccaaccttagcatcgcaaacattgatcgttcaatcagcaacgccaatgctagccgtgttaccaatcttggctaacgaagcacatggtgacgtggaatacgccactaacatcgtgacaacgagtaccgtgttgttcatcgtggttgtgccagtcttgatgaccttgatccaatatatttaaagtttatttagaagcattccggttgagagagacggaatgcttctttttttgatcaaaactgcttgagttgaacccgattaaaatatgttaaaggtcaaaattaaggtcgatcagtcgaattctttcagctgaccgaccttaattttttgcgaaaggagtgcttgaagatacaagcttgtggcgattgcatttaaacagatgaatatgatagaaacaaatttaagtcgggacgtatgactgtgggactggtcagctcggttttcagcggcgattaacaaaagttggttaagtcgtaacccataataatgcggttaaattaaaattagtgaatcttatggattattaataaatttatttaaaataaccaatgctgtaaagtgctgccttgaaaggattcaattaggaattgattgaaattgttagatttacttgactaattgcacaaaaattaatagaattaacaacgttgcattattaagattttgattaggaggcgtaccggatgaaagcatcacaacgattgctggttaaaaaatcagtcaatccagctaattttaataagggtggcctcgaaaagacgttgagcgcatttagtttaaccatgatgggtgttggcgcaatcgtgggttctgggatttttatcacccccggaattatcgccgctaagtatgccggtccggctgccatgctctcatttgtgattgctgcggtagtgtgttcgctggccgcattatgttacgctgaattttcttcaaccattcccttggcggggagtgcctatacttacgtttataccgtttttggggaattcttagcgtggattcttggttggtctctgatctcagaatatttattcgcggtatcttcggtggcggtaagttggtcatcgtactttcagaatttaatgagcggctttggcctaaaactaccaacatttctgaccgccgcagctggtactgccggtgtcagtggtgctggattcaacttaattgcttttgtcgtggttttggctgtctcactgttattggtcggtgggttacaagagtcaacacgggtcaattcaattatggtaatcgttaagattctagtgattgttcttttcattggcgtggcaattttctttgtgaaacctgccaattatcatccgttcatgccccatggtgttagcggactggtcaaaggcgcgtcgttagcattctacgcgtatattgggtttgatgcggtgtcgactgcttcagaagaagtgaaaaatcctaagcgtaatatgccaatcggaattgtcggttcgttagtcgtagcatcgattttatacgtggcaatggccgccgttctggtcggggtcgtgcattacagtaagcttaacgtgggtgatcccgtggcgtatgccttagccgtcattcatcaaaactgggcggcggggattgtgtcactgggtgccgttgtcggtatgacgaccgttttgattgtcatgttatatggtgggacccggttactgtttgcgattagccgggatgggttgttaccgaaagtctttcggacggtcagtccccataccaaagtgccagttaagagtacttggatttttggcattattgccagtgtatttgcggctgtgattccattagataaaattgcggagttagtcaatattggaacgctatttgcattcgctatggtgtctatcggtgttgtcttcctgcgtcgacacgaaacgctacaacaaatcaatagttcatttaaagtaccattttatccagtgttaccagttgtctcgttcctcgcatgtgtctacctgatgcttaatttgcaggcatttacgtggcatatgtttggtatttggctggttattggcatcgtgatttactttgcctatagttatcggcactcccgtattcgagcagggttacgtgccaaagaatcaaaatcgtaattaatagtgggtgcttaccggggcgggtaagcacccattcttttcgcggctactaagcttggggatatgctataattaagcgcataattcataaggtaaagagagttgaggtggctgatgatgcagagacgttcaaacgcctatcatatcagtgtattagcggtactaatggcaatcgtgatcattcagaatattgttccgttttttgggtacattccattaccaggattgagtattacgacaattcacgtgacggttatcctggccgccgtggtcttgggaccgcgtgatggggcaattattgggggcgcatggggaattattgcgtggatacgggcgttcgtcgcaccgacgagtcccttagcaccaatcgtatttaccaatccattgatttcggtgataccccggattctcgtcggtttgatagccggttgggtctttatttggtttcagaagcggcatcaaaaagtgttggggatgacgctggcgggcgtggccggggcattaacgaacacgattctagtcttaggtttgattgggctactctatagtcatcaagcagccggcttttatcaagttaatttgagcaaactaatgccgtacttgttaacgatcgtggcctcgaatgggattccggaagcgattttagctggaattctcacaccactgatcgggacaccattactacgttttaaaaaataagtcgctaaagtgacagctagcttgaatcaattcaaatttaaaacagccacccttgaaattcaggagatttcaagggtggctgttttaaatcgctatttaacggcttgaacttgtttctgactaataattactttgttgtgatacttatcaacgatggctggatcaggacttgtaaaggtgattaaatacgaattagtgtaacttttcgcaatggtcccggtataagtctgcctttccaaaatgaacgtcacttgtgttccaatatccatgatgatgcctcttttcgcacgatagttttattaaggataacacaccagtggacgtaacaggtaaaagttcactaattaaaacgtcgccgaacttgggcccaaatccccgttgctagggctaagagactggtacccagcgttgcgagccatgactgagttgtttcgtcggtctgcgggagctcagttgtggctttggatgatggtgaggagacggcaactaagtcggcactgtcagtattagttgttgtggcagataccgtggctggcgtcgtcacacttgtttcctggtcactataatcttgaagcagactagccgtgacggccgaaccgctgtcatcgtgattaactaaccagtcagtgttagtcatggcggttgaactgaccataattgaatcactgacttggcccttaatcacgctgctctgatcgatagtgcttgtctggttcacagtggtcgtcgcacgtgttgcgtcaaccgccgtgtcggaatcactatccactgcgttatccgtgtcgttcaagtcaacgtaactagtcgttgaatcatcattaggtttcgcatgattggtcgtgtctggtgttgtatcactagttatgttggtagtgtcagtggtcgtgttatccacgatagtttgatggtcgctgatggcctcatcagccgtcgtttcatcggtaacattgtcctgtgctgtggaatcggtcgttgtaccgttgtcagccgctccctgattacgattatccgttacttgatcaacatcaactgcttcatcttcagcatccgctacggatagcaatggtgttaagaaagctaacaagtgttggcggtattgtaggatcgcgttattagccgcagcgtgaccaccgacagtccctggtaagatccaaacttcttggttggcagaatgattggcggccgctaattccaatgattgagtatatggaatgaaggcgtcgtcttgcgtgtggatcaagagtaacgggatagtgattttgctagctgcatcggttgctgataagtcatcgacactgaaaccttgttccttgatcaaacgagcgttcatcgcggccacgattttatcataggataagaagggcaggctcgtgatggctggcagaccaacggattgaagtgcgtttgaaacggcggtgatggctttgctgtatagcgaactacctagttctggtaaggtcgcgtacccggcgtccgacacaactgctttaacggattttgaaagtccaggaactgaggctgcttctaacacggtgtcggcacctaatgattgaccataaaagacgacttgactgtcggcgccattgcgttcgtcgaccatcttaacccaattcagccagtcatacttgtcctgataaccaaacgttaagttatcaccgtcacttaggaactgcccacgttgactcggcatgaggacgttataacccatgtcataccaaatttttgaaacgtagccgatccaatcaacatgttccgtccaaccttggccgatgatgacggtcttggtggaatcaccattttgaatatagtaagcacggacagactgcgtcgggtcattgtattcaggcagggtccaggtttctttggtaacgttatcccaccaagtaaccgttgtcgggtaatattcttcggccgcagcccggtcagcagcataagcgactggatcgaggtcggtccacgtattggagatgtcatagcggtgctggttcatttcagtacgtaaattagatagggcttctgagccagttcccgtgaagacgattgggtagagtacattacccacgatcgtgctggcgatatctgtggggagctctttcaactcgtcaagaattgtcgtcagtttggctttggctgctgctaattgttcttttccagacggggtcgctgcttgatttgctaagtccttgatcgtattaacgacggccacaatatcactggcatctaacgtgaccgtggtggtgtccgtcttatcagaggtagtaacttttttccaggtcacactgtaagggccactttgtgtaatggtgaccgtactcttttgattgccagtcgtgtcgttggtttcgtagattaagccatgaccgctgtcacttgtcgcggcactagccgcgctggtcgtcgccacactagttggcgttgccgcagcggtcgaattggtgttggtactcgtatcatcagttgaatcaatagctgaatcggtcgttgatttagtcgtggctgtcaccatatccgtgacttgagtagcgtcactcgtcgctgagctagcggcctgttcgttaccacttatggtattggctgccgtcgaattagtagcgctggtcgtctgactagttactgtgccactcgcactgttagcaacctcactagcttggtcggtagctgacgctgcacttgtggcttgttcagtcgcgctagtctcagtagcgttagtactagtcgtaatttgattggtgtcagtggtagcgctgctgtcggtatttgacgtggtattactgtcttcaccagtagtcatgctacttgtcgtggttgactcggttgccgttgccccggcggcttggctgagttgactggcaatgctagctggggcgttggccgcagaagtggtcgtggcactaacgggggtagccgttgctgctaaggcgttagtcgtcagcattaacgtactaccgagccccgcaatggtaatccccgcgtaaacccaatgttttccatctttgaacattttataatgatcaacggtggttgattgttgtgaattccttttcattatatttactcctcgtaacgttttattctattgcacgttttaaaatatagcacgacaacccaggcttgtttgcgttttcgcgggctaaacttgttaaatgaggtacttttttaataacggcatcagttgtttattgtatgaactaatttgttaactgattgagtacgatgattgatttttatgatgcgacaagctcagttattcgcgggagtcacgcgtgattttaccagcagatgccagattgcaaaatgtgaacttacaaacgaataagcgtactaatagtggccttgaaaattagcggctttgactattttgggaataaaagttgagattgattgaaatttcacttatcacttgctattatgaaaggtgaataaagtgtttccgctttcgtagggaataaattaataaaggggggaccattatgaatctcggattaagtattttatccttggcgcgctttcagttcgcgatgaccacggtgtttcatttcttctttgtgccattatcaatcggcttagccttggttgttgccatcatggaaacggtgtatgttgtcaaaaaagacatcatgtacaagcacatggcacaattttggggccgcattttcttacttagctttgccgttggtgtcgtgacagggattatacaagaattccaatttgggatgaactggtctgattattcacggtttatgggtgacatttttggagcgccactagcgattgaagcgttagttgccttctttatggaatccacgtttattgggttatggatgtttggttgggatcggtttaatgccaagctccactgtgcgtttatctggctaacgtcgattgggacgatgatttccgcgatgtggattttagcagcgaacagtttcatgcaaaatccagttggtttcatgatcaataccaagactggtcgtgcacagatgacgagctttgcagcagtcgtcaagaacgaacagctctggtatgaattaccacatgtgttgtttggggcgtttgttaccggctcatttgtggttgctgggatggcggcgtttgcgttactcaaaaagaaaaacgtcacgttcttccgcaaatcgatcaaggtcagtttaatcgttggcctggttgcttccatcggtgtgattggaatgggagatttacagacgcgttacatcattaaagaacaaccgatgaagtttgccgcaacggaaggcttatataaggattccggctcgccagcttcatgggcagttattgaagggatggatactaagaaccataaggccaactggtcgattgaaatcccgtatgtgttggatattttaagctatcataagttgtccggtaatgtgaagggacaaaatacccttaacaaggaacttcatgccaagtatgacaagaaatttggtaaggacatgaactactacgtgccaacaaagacgcttttctggagcttccgggtcatgacggtagctggtgggctcttcgcactgattgccattatcggtctatacttcaaccgtgcaaagtcaacgctgattgagcggcagcgctggttcctgtgggtactaggaatctgtacgttcttaccattcgccgcaaacacggccgggtggctgattactgaattaggtcgttatccatgggttgtttatggtttactgacgattgcagatgccgtttcaccaaatgttagtgtcgcttcgttgctgatctctaacatcgtgtacttctgcttgttcagtggcttaggcattgtcatgatcgtcttatcacggcgtgccttacaccaaggccctgatgatttgttacaagctagcgatgacgcaccgtacgatccttatggtaaggaggcgttcagtcatgagtaatctacaattcttatggtttattctggtgggcgttctatttagtggtttcttcttccttgaaggttttgacttcggggttgggatgacgattaagagcttagcccaaacacgcgctgagcgcgatgttgtgattcatacgattggcccacattgggatgccaatgaagtgtggttgatcactgctggtggggcgatgtttgcgtcgttcccaatgtggtatgcttccttattctccggattctatcttatcttattgttgattctagtggccctcattatgcgaggggtctcatttgaatttagaagccggatggaaagtgacgccggccggaatttctgggaatgggccgcagccctaggtagtttctttgctgccttcctatttgggatgatgtttactgctttggtcaaagggatgccaatcaatgccaatggcgatatgactgcccacttcaccgattacgtgaacttgttctcaatcgttggtggggttgccgtaacgttactctgctatttgcacgggttaaactttattcgtctgaagacgaccgggacgttgcgtgaacgggcgcttcagtgggccaaaccgttatactgggtcctgtttgccggtgaagttgtcttcgcaattctgctgttctttaacaccgatttctttaccaagaaaccaatctcaaccacgattttagtggtcgccttagtggctttgacggtcttggcaacttggggtgtttatggaaatcatgaatggctctcatttattagcagtggtctctcactgatcgacgtggtcgtgctcctgttcaatggactattcccacgtgtcatggtggcgaacaattctgcatacagcattctgattaaagatgcgtctaattcaccatatacgttgcatctgatgactgtaatctcattatcggtattaccgattatgttgatctactttatttggagttactgggtcttctataaacggttggcatcgtaattcaaatgcagatgacgacagtatcactggtgcggtggtacaattaatttaacagcaccaacggggtcgcgaccttggccaagtgccagggtgcgaccccgttcattttaagtagggagtgatcgaatgtgtttgatccggcattatttaaactaccagggatgcgccgagcagccacgattttagggttattggccatcgtcgagggtatttgtattgtctttcaggcctactatctatcagtggcgattgttggactgtggcacttgcattcattagcgtcgatcagtcagcccatgctatggttcgcattagcttgggtcggacggcagttactggtcgtcattaaaaatcgtgtgatgtacccgttagtcgaacagacgacgggtgacttgcggcgtaaagtgatgcagaagttataccaactcggcccaagttatgtagctaagactgggactggtaacgtggtgacgacagcgcttgaaggtatcgataaagttcagacatacttaatgttggttgtgattaaagtaatcgacatgatggttatcccgtggatcattttaatttacatcgcgtggttgcgctggcgtgaggccctttttctactggcaatttttccattaattattctatttatgattattttgggctatgccgctcaagctaaagcggataagcagtacgtgggctatcaacggatgtctaatcacttcgttgatacactgcgcggtttaccgaccttgaagcagttaggactgagcaaacggtacgctgacaacgtttatcaggttagtgaaggttatcgtaagcaaacgatggcggtcatcaagattgcgatgttatcgactttcgccttggatttcttcacgaccttatcgattgcggttgtcgcggtcttccttggttttggtttgattaacggcacgattacgttgctaccagcgttggttattttggtcttatcgccagactatttcttgccattacgaacatttgctaatgattatcatgccactttaaatggcaagaatgcgtttgcggatgtccagaagatgctagctttgccggtgccaactgaacgtcaacagctcggtactcagcctgtgcaatggcaaagtgatagtacgttaagcttacatgacgttgattttaagtatgatgatgatcagctggccttaaaacacattaatattgatgtgcatggttaccaacggatcgggattattggggcatccggctccggcaaatcaactttgatcaatttgttaggtggctttctaaccccggtcgctgatcagggtaaaattcaagtcaacgggcaaacagtctcgcatttgagccaggacgcctggcagcagagctttttctacattccgcaaaacccatatctgttccatgcaacgttagcagagaacatcgctttttatcagccagacgcttcacgtcaagcgattgaacgagctgctgaaaacgctggattaacggcctggattgcaacgttaccagcggggttggatacggcgattggtgaaggctcccgtggtgtcagtggtggtcaggcgcaacggattgctttggcgcgggcctttcttgacgactcgcggcgagttctgttatttgatgaaccaactgcccacttggatattgaaactgaagcggaactgaaaacgacgattttacccgtacttgataatcacttagttttctttgcgactcaccggttacactggattaatcagatggattacgtgttagtgatggatcatggggaaatcgttgaacaagggacaccgacggaattggccgcgcatgacggggcgtacgttcggttacgtgatgaaatggtaggtgcgatctaatgaaagattttttggcaacttttaaaaatgatacttgggtcatgccgtatttgcgcaagtataaaaagttactagccctgacgctgtttttgggtctaatgacatttttctgcggttcagcgctgatgttcaactcgggctacttgatcagtaaagccgcacgacacccgtataatattctgatgatttatgtgccaatcgttctaacgagagcgtttgggattggtcggcctgcctttcgctatgcggagcgaattacgagtcataactgggtgctacggatcgtgtcagattttcgtaagaaactgtaccaatccgtcgccaagcacgccgtagcgattcgccaaaatttccagactggtgatgtcttgagcattttagctgacgatattgaccatattgaaaatttatatttacggaccgtttttccaacggtgattgcctggttgatgacgctagtgattgtgattggtctgggctactttagctggtggttcgggctattgatgttgttgatgttaggattggtcgttgtgataatgccgctatggtcggtcttactgaatggtgctcgtgaatcacgcagtcgtcagattcaacagggcttttatacgcagctgactgattcggtaatggggctcggtgattggttgattgccggacgtcaaacggatttctatgagcggcaaacccagcctatcgaagcaattgcggcacttcgtaaacaggaccatcgctttcagtggtggcgagattttacgattcagatcattttcggggtgatttgtttggcgctcttgatctggagtagtttttactggacaacgaatgcggctagttccaattggattgcggcgtttgtcctctccgtattcccgttggtcgatgccatgcagtctgttagtcagggtgttagtgagtggccaagttatcaacggtcaatcaaacgagtcaacgccttagacaccacgcctgaagatgaacacgatcagacagtcttaacggagccatttcaagtattgcgtattgcggaccttgactttaaatatgcggaaggtggtcacgcgatttttgacggtttgaatctgactttaaaagccggtgaaaagttagccctgctaggaccttccggaacgggaaagagtaccttgctcaagctgattttaggtgacctgacaccggatagtgggacggttcaattgaatgatgtgcccatcacacggttacaaaatgagcgcgcccagttattcggcgtcttggatcagcagccatacttgttcaataccacgattatgaacaatgtgcggatgggtaacttgcaagcgactgacgaacaagttaaagccgcactagcagcagtcgagttagcgcccttgatcgacacgctccccgatggttacgagacagttgtagaagagggcggtgcgcgcttttctggtggcgaacgacaacggctcgcgttagctcgcatcttattacaagatgcgcccatcatcattttagatgaaccgacagttagtcttgatccgattaccgaggcccatttgctgaccacggtgttccgggtcttgcatgataagacgattctgtgggtcacgcaccatttggccggggtcaaccatgtcgatcaagttcgcttcttggaagatggtcaattcgatatggccggtacgccgagcgaattgtacgcgaatgcaccgcggtttaaacgcctttatgatttggatcaagggcgtgatgatgcgaacaatgatcggtaatccggttgatagcagtcttccacgtgcaccttgggcttgtgaaacagacttttaattactgcgctgaatgggtattcagcctacgaatgtagtggtcatgatgaccattactgattacaccgccgatttagagcgtaaaaaggacttggtcgctgtgaccaagtcctttttatatgcaattaatcgccaggttatgatttaacctgttagtaattttgtaattgtgcccgattctgaacgtcgaccacgtaggctttcgtgcctaagcggctgagtaaggtccgtacatcattgtaattgattgagacgcaaccagccgttgcccattgattcttgacgtgaataaagaagcccgagccattatgctgaccgtgattgtccatcacaatcgctaattgatactgattgtggggcgcggccttcgtgtaatcgatcagatgctcgttcttattattggcccagtttcggttctgccaagtgttatattgccggtcatgtggatcttcaatccagtaagatttccggttgatctgtcgataggccataccactagttcttgcactggcagctttaccaaatgcgaagcttaagtgataaacgcctttgggtgtggtactgctgccttcgtgagaattgccgatgccagcggccccgatgcgacttgcggaagttagtgtattcttccagccgcgattggttttttgccaaagtttaagagtggccgtggatgagccattttgaatgaccgtcacgatttgctgagcctttttggacacgcgcattctggagacgagtgttgcttcggatggggtggcagctttggctttaactggctttaagtagccactccaaatccagccagtggccccattcttgctattgtgaacccagtagtaacgaacctttttgccgtgcatgataatatcagtttgctgagtcgttgtccagacggtgttgcgatagttcttcaaatcatgattggccctgaatgtccaacgattataattaccattagccctaaaggtatgtgatttggtattggtcgtataataggcctttctagccgttgcccgcgttggcgtgcgatgatagtaagtgctggcattcgcagatactgaacttagcattgtgaccgctgcgatcattagtacgctccccagcaaccaattaacaatctttttcatgaaacccctcctagtaaaaatagccccgttattacaatttttatacaaacactataatactatttatctcggcggaatggataacaattttgactaaatcgcggcggtgtagggtgagtaatggttgtagctgaaaaatcagcgcgtcagagtaataggttactttgacgcgctgatttaatttgtgtattaatggttgcgaaccagtaattcagtcactagccggcgtaaagtttgttgtgtttcaccagttggtagctgatcgattaggttcagtgcggttttggtatagtgagtagccaattgttgtgcctgggtaacgccccccaaagcaatgacctgatcgcgaattgtcagtagctgttcattactgatgtggtcgccgggttggggtaattgttcggccaattgtggttcagcggtcagggcgtagataagtggcagtgaataaacgccgtcccgtaagtcattaagcaccggcttttgagttaaggcctcatcaccggcgtagtcaaggacgtcatctaacatctggtaggctaaccccatcctttcaccaatctgttgcgctagtttaacgacgcttgcgtcggcacccgcgaagtgggcaccttgttcacaactgaggctgaacagacgggccgttttgccacgagcaattgctaagtagtcatcgaccgtggtcgtcggatcgaagttatgtgccatttgatccagttcgccttggaggatggctcgcatcgccgcagtattgattttaacgtcgtcagctgtcttggcagcaatcaggacttgatcgaaatagcaggtaaacagcagatcaccggcgtaaatagcattacgttgaccgtagtcttggtggatcgttgtcacatggcggcgttctggcgattcatcaattacatcatcgtgaatcagtgtcgccacgtgtagtagttccatagccgctgcgccagcacgtaaccgggccgtgttatgatccggtccaaattgactaaacaagtaaaagaagcccgggcgtaaaaacttaccacccgcagcgagtaagtcgtgtacgcggtcattaatggcggcgttatcaatttttacgttagtagctagatacggcttcagcgctgctagctcctttgcgacaagactttccggttgccaaatggtttgcatcataatcaaaataccccgctttatttgagagatggctccgggacgttttgacgccaacacttgcagccagtcacattctaaaatacaatctatattaaaggtacaaataacttgtttcgttgtcaaacaaaaggatggtgtaaatcattgaaaccaaaagtgtttcttgaatttgttgaaattaaatcattaattgcgagcgtgttaccgttcgttttggggagtatgtacgcctattataattatcatcagttacatcttggttatttattgctatttttcattgcatcttcactttttcatatggcgactaatgcgaatgataattaccaagacttcctacacgcgccacgtaatgacgacaatcaagaatttttgcaagagactaatgtggtcggtgttaaccagatttccattggtcaggcccggacgattacgtttggtttagccggaatctcattgattatcggactatggttagtaacacaaaccgggttgccgttgttgtggatggggctatattcatatgcggtcggttacttttacgctggcggtccgaagacaatttcacaaggcccgtttggcgaatttttctcgggctttacgatgggctttatgatcttctggattgccgtctttattaatacgtatgacacggcagccattacttggcagtcaacgctggctgttttaattgcgtcaggtctggccatttttgcaatttctaacattatgttagctaataatatttgtgatatggacgaggacattgcgttaggccgacacacgattttgtattaccttggcaaaccggtgatgcttcaggtatttgcatggagttacgttgctggttatgcttgtctggtgattgcggtcttgatgggtgtgctaccaaagtttagtttactaacgttgctcagtattattccagtttggaaaaatacgcgggtcttcttgcacaaacaggtcaaacgagaaactttcacgatttcaattaaaaacgcaacgttgatttgtctttcatttatcgttttcatgggcttaggactgatttttaactagtccttcaataaacgagtatggctttgagaaagcgccaactaaccaagttgatactaagcagtatttttcccagcgagtccaagctggctttctgattttatggcttggggtttttcaatggtatttcacgggggtaaaaaaagcttagatatcgtgtgaaaaaacacacggtatctaagcttttttaatttacataaagatgttatttataactagttttcaaatggatagcggaagtcccattgtgcacgagcggcagtcatgatatccataacgtcagtcgttttagcaagactcgtgttgtgtaattcgccagcaaccattttttgcatgtcagcaatttcgtaattcatggcgttagtgctatcgccggctgtgatggtttcagtatggccttcgctgtcggtgaaagtggcactgtcggcacgtggataggtatcaacggtaaagtaaccattctcatacgcgacgataccgcgtttaggcattttagctcggaacgttaaggcaacggtggccagttcatcattggcgtttcgtaacgtgattgtcgaagattcatcgacgccactgctgaatcggtgcatggttgttccggtaatgtatggtttagcagtcaagaattcttccacgaaggctagggcatagacaccaatgtccagtaaagcaccgccggcaaggtcgggattaaagaagcgattagttgggtctggttctttaaaactaccaaagctagcttggatcattttcagatcaccaagatgacgttctgccgcaaaatcatggagcttctcgtataatggcatgtgatacagggtcatcgcttccgctaagataaggtggttgctagcagccacttccttggcgattgcgagttgggtactagacattgtgatggccttttcactgaggacgtgtttgccagcacgtaaggcgggtaaaatcgtgtcaatgtgataattatggggcgttgccacgtaaacgatgtcgacttgttcatcagccagtagctcgtctaaattaccataagctttgggaatattgtgttcggcagcaaaggcgttagctttatcctgcgaacgtgagcaaacggcgtagatttctccgtcaggttgatcaaaatatttaacgaaactgtgcgcgatgttaccaaggccaacaatggcccagcgataagttttcgacattataggttcctcctaggattaatcgaatgtgaccacttacattttagcaaaaaaataaggaattggcgcccaataatcatgtaaaattaatacaaaagtcggtaaaatagagtgtaatatgaccggtgctcattgcgatttaggcttacttagaattaaaacatgttggttagttggactcttattcgtcagcacgtgtgcgtcttatgccgacttccggggccgggtgacaattactggaacgcagccgatgtcgatttgagctaacgcccaagccgcttcatctcaaatacgagtcttattctaagcacgtttacgctaactcgaactttttacagcgggcctaagctggcagcttttgaactaagaaaccagcatgttttaatcctaattcatgataaatgaacaggtgtaatctgtaaggcaattaccagaaaggaggcggctatgatggcgggtaagcggcgaaaatcgcgccggaagcaacggacaaagacacaattatttgtgaagaagggccgccttcagtgggtcaatatcttattagtgttggcggcgatggtggggatggtttggtatattcagcataattgggcggttaagtcgcgggttacggcgacaacacctacaacaacgcatgcggcatttattaaaaagctagtaccagctgcgcaacagcttgatcagcaataccacgtgctggctagtatcacgctaagtcaggcgattttggaatcggattggggacaaagtaccaatgcgacagagaataataatttatttggggttaagtccacgtcgggacggctcatgacgacgcaggaatattatgacggggcctatcatacggtcaaacggcgcttcgccgtttatgatagctggcacgcttcgctggtcgatcatgccaagaaattggcgtacggaacgacttgggattctcagcactacgctgcggtgattaaggcaactgattatcagacagctgcgcaagcattgcagacggctggatatgcgactgatccaagttatgcacaaaaattaattaatattattcaaaaatatgacttacaacggtatgatagaaagtaatgaaattaatagcagtatttcaatgtcgcttataattctaggagggtactatgcgagaacttgaagaacgcattttgaaagatggccgggtacttcccggtgaagtattgaaagtggacggctttttgaatcaccaagttgatcccgacctgatgtttgccatgggaacggaatttgcccacttgtttcaagatgcgggtgtaacgaaaatcttgacggttgaatcatcaggaattgcgccggcagtcatggcggggttagcaatgcacgtgcccgttgtgttcgcacgtaagcacaaatcagtcacgttaattgatgatttatatacagccgaagtttattcttacacgaagaagacgtctaaccacatctcgattgccaagaagttcttacaggcggatgaccaagtcttgttaattgacgactttttggccaatggtcaggcggttcaagggatgtttgaaatctgtgataaagcgcacgtaaaaattgcgggtgtcggtattgtgattgaaaaagtcttccaaacgggtcatcaactgattgctgatcggggtgtccgtttagaatcactagcacagattacgtcatttgatggtgaccgggtgcactttgcatcggaggacacccaggcttaagttaagaaagcgggggattgtgatgcaaattgacatggggatgctagtccttattttcagcatcaactttgcttacattacgttaaataccgtacgttttttgcttgtaatgcggggttatcggtattttgcagcttttgcaagtgtcattgagattacgatttatgtgctaggattatcattggtcttaaatcgtctcaataatccgatcaatttagtcgtatacgcgttaggttacggtgtcggggtgtatgttgggatggtaattgaagatcgattagcgttagggtatacaatgatttcagtcattttacctgatcccaagtcgtcgttaccgggagtactccgtgaaaatggttttggggtcacacaacacgctgcttatggtctagaaggtgagcggctagaactagaaattttggccccacggaagaacgaacggcggctgtatggcctgattaaagacgcggcgcccaatgcgtttgtgatcgcgtatgaaccacgctacatctccggtggcttttggctcaagcgagttaagcgacgcaatgctcgccgaaaaaagcagtgataaacttgcaactgtgcgtgtcagcaagtatgattgttacaggataatgagcgttaaaataattcaataatcagattataattatttaaagcataggaaagtagggactgaagtggacaactcgattttaaacccaggtggtacgcttggcattattggaagtagtactaatggtgttggattagtaattgccgcgcgtaatgctggcatcaatgtcggggtatacggcgataacgaaaatactgagaccatggaactggcagattttcgcgttgtcggggccctcaatgatcaacaacagttacagaacttcgcagaacgttgtgatatggtgacttacgagtcggaaaccattgatgcgtcggtcattaattttttggcggcccatacccgggttccacaaggcgccgatgcgcttgagattacacaggaccgctctttggaacgggcgtttttcagccaacttaacttgaatgtagcaccgtcagcgacaattgtcagtttggatgatgtctatcaatcgatcgggtcaattggatatcctagtattttgaagccgattcaaaagggcttgggtcaaaatcggcaactggtcattaagacgcagacggatattgtcaaggcggctgatctgttggattggggcacatacttgttagagtcattgattccatatgataaggaactctccgtttttggcgctaagagtggtgatacgacagctttcttcccaaccgttgaaaaccggtatcgtaatcatgagctagttgcctcgattgtgccagctcaaattgattcagctgtgaatgacgaaatgctgcggatcacaaaggaaattagtgataacttgagttatacgggtgtctttgaagttgccttcttcttaacgaagagtggtaatttatacgtgaagcggattgtccctgcgatgcatcaggcgggttatgtcttcgaacgtgctacgaatattagtatggcagaacaacacttgcgagcaattgcgggactgccgttaatgccagtcaagcagttgatgcccgtggttgctgcttactttacaccggctcaggagagtggcattcgcacgcagtggcagattaagacgaactggttctttaatttctatcaccgaacgttgttacaagcgcaccgggcaccagtcgctggccacgtgctagtcgaagcaccaagtgttaaagaagcactcgaacagatcgaagacacaagtatttggcagtttgggcaaacgacgccggctgataatgaacctgaagctgagtagtgtatgatcagaacctagttttacggattattacggttaaactaatcgtactgttcgcaccgggtgaccagctattatgggtaaccgtcgtgaataaataaagttcgaaatccaattcattttgtgaattggatttttttagcggtaggggagaagccagccaaatggcgagatacggttatctgagggggaatcgttgagattggcgtggcgggtattttggttagaaattgagggagtctcaaaattacttaaagttacgcaatattgccgtcaattcgtttcccgtgaatagtagaagttgtaaaattaacataggtgtcactgacaatggaaaaaccgcgatttttgtatgagatgctgaccttaaagtacagcaatcacggccaaaatttgctataatgtttggtgactgatttttagaaagggtggcgaacagcgtgtcgaaagaaagcctattggcaggaatgaatgacaagcagcaagaagccgttttagacacagaaggaccgctactaattatggccggtgcgggctcggggaagacccgtgtattgacgcaccgggtagcttatttaattgaagagcaaggggtcaacccctggaatgttttagcgattacgtttacgaacaaggccgcacgcgaaatgcgtgaacgggttggtaagctgttaggtgaatcggcgcaggaggtctgggtctcaacgttccatgccctgtgtgtccgaattttacgacgtgacattgaacaaatcgggtataaccgagcgttcacaatcgccggcactagcgagcaacggaccttagtcaaacgaatcttgacggaacaaaatatcgattcgaaaaaatttgatccacggtcaatcttatccgcaatttcaaatgcgaaaaatgacttacaaacgccggagatgtataaagaatcggctgccagtccctttgagagtgtcgtggcagacgtttatttgcaataccaacgtgaattagcggctgatcaagccgttgactttgatgatctgatcatgctgacgattcaattattcaagcagaatccagaaacgctggcgtggtaccaaaacaaattccattatattcacgtggatgaatatcaagatactaataacgcacagtatacgttagtcaacttgttagctgacaaatataaaaatttgtgtgtagttggggatgcggatcaatccatctatggttggcggggtgccaacatggaaaatattctcgatttcgaaaaggattatccgcaagctgacacggtgatgttggagcaaaactatcgttcgacaaagacaattttgtcggcggctaatgcagttattaacaataattcaacgcggcggccgaagaaattatggactgagaatgaaccgggtgacaagatttcttattatcgtggtcagagtgaaagtgatgaaactcactttgtcattgccaagattcaagaaagcatgcagcaggacaaaatggactacggcgattttgcgatcctttatcggacgaacgcacaatcccgggtaatggaagagtcactcgttaaggcgaacatcccctatacaatggtcggtggtaataagttctatgaccgtaaagaaattcgggacgtcttatcctacttgactttggcagtgaacgatcaagattcaatgaactttgaacgggtcgttaatgaacctaagcgcggcattggtcaaacgagtgttgaaaaattgcggttgttcgcggatgaagcgggttattccatgttggaagcagctagcaatgttgatatggctaatggcatttcagcacgagcgaagggtgctttagcgaagtttgcagcgacgatgaatgaattgcgcgctatgcgggaatacttatccgtgacggatttaacacaagagattcttgaccgcacgggttacatgaaggcgttgaaagatgctaaggcaacgaaatcgttagaggcacaagcccgtatcgaaaacattgaagaattcttgtctgtcaccaaacaattcgatgatagttatcaacctgaagatgaagatagtgacaaattcgtggacttcttagcggatttagcactggtttcggatgtggataacgttgaggaagaaccccaagccgtgacgctgatgacgttacatgcagcgaaggggctagaatttccggttgttttcttgattgggatggaagaaggtatcttcccactgtcccgggcaatgatggatgaagacgagctggaagaagaacggcggttagcatacgttgggattacgcgggctgagaagaagctgtacttgaccaatgcatactcacggatgctttacggtcggcggcagaataatccggcttcccgtttcgttgaagaaatcgaaccagaattactcaaaaatgaaaatacgttggatggtgcaagtagcactggtcctaaagttccatttggtgcggatcgtgaacggcgtgcttttacaccttcatataaaaagaatccagtggggacgcgggccacggtcaagaaggctagtggcacgggtgctgacaagaatagttggtcgatcggtgataaagtcaagcatcgtaagtggggaaccggaacggtcgtgaaggtctccggtgctggtgaagatgctgaactagacattgctttcaaatctgaaggaatcaagcggttattagccgcatttgcaccgatccaaaaagtacaggactagttaggaggactggctgatggcggacaaacccaacacaatgacggttgagcaggcggctgatgaagcggctgctttacggcaaacgttaaatgaatggcgtcggcagtactatgacgaagatgcgccgaacgttgaagatagtgtgtatgatcaaaagtatgaacggttggtcgaactcgaacaaacttttccacagctcgttacaccggattcaccgacgcaattagttggtggaacggttaaagcaggctttgataaagtgacccatgagattccgatgttgtcattgggcgacgtcttttcacaagctgagttacaagagtttgttgatcgcttggaacaaaacgttggtcatccagtcgattataattgtgagttgaaaattgatggtttagcgctgtcgttacgttacgaagatggggtgctcgttcaagggtccacgcggggtaacggtacggttggcgaagatattacggctaatattaagacaatcaagtcgattccacaacggttgacccgaccactgacgatcgatgtacgtggggaatgttatatgcctaaggcagcgtttgctgccttgaatgaacgccgagaagcagcgggagaaccagtctttgcgaatccacgcaatgctgcggccggtacgttacggcagctagattcacgagtcgtggcggaacgacagctcagcacgtttatgtataacattgccgactacgaaccgttaaccgcccgtacgcagagtgacatgttaacggagttcgcagatcttggttttgccatcaatcctgactttaaggtggcccattcgatggccgatgtctttagttacattgaccattatcaaaatgaacggccagaattagcatatggcattgatggcatcgtgatcaaagctaacccgttaccgctgcaacgctcactaggagcgacagtcaaggtgccacgatgggcgattgcctttaagtttccacctgatgagcagccgacccttttaaaggatgttgaatggaccgttggccgtacaggagtcgttacgccaactgcggttatggaacccgttcaactagctgggacgacggttgcgcgggcttcgttacacaatcccgattacgtggcggccaaagatgtccgcatcggtgatacggtcttgctacacaaggctggcgatattattccggaaatttcatcggttgatttagccaaacgacccaaggatgcgcaaccattagttattccaaccacgtgtccgtcttgtggggcgccgctggttcatttggaagacgaagtggctttacggtgtattaacccgaaatgtccagcacaagtccaagaagggctggttcattttgcctctcgcaatgccatgaatatcgatggcttgggaccacgaatcattgcgcaactctatgcaaatcggctggttagtgacgttgctggtttgtaccgattaactaaggcacaactgttaacattagataaaataaaagataaatctgctgaaaagctcttgacagcaattgaccgtagccgtgataattcacttgaacggttattgttcggtcttggtattcggcacgttggtgctaaagtggcgcggttaatcgcgcagcattttgggacgattgaggcgttgatggcagctagccaagaagagattgcggcgatcgattcgatgggcgatgtgattgcgaacgcagtggttcaatattttgagagcgacgaagttcatacactcatccgcgaattgcaagcagtcaacgtgaataccacttatcaaggccctagtgccaccgtggcagaagatagtaacagttggtttgcaggcaagcgggtcgtgttaactggtaagctggaaagctttacgaggccagatgcgactcaatggctacaagctcacggcgccacggttacgggaagcgtctctaaaaagacggatctcgtgattgcaggtagcgatgccggaagcaagttgcaaaaagcacagcagctggacattactgtatgggatgaagcccggttcagcgaaacaatgagggaggatgcacaagcgtgaatgttaaacgcatacgcacgattggcttagtggcagtagctgccattgttctagccgcctgcggtaatttaaagaattcgtcctttgggtcgactagtagtagcaccacaacgaccggaacgaaaacaacgaccaccactggaactgctgatagtgagttctatcaaggcgtcatcaaaaatggccgttatcggacgagtaagtcgcgaggcgtggtcgtttcgcaaaatgataacgtcatgaatttgaagagcttcgaaagtggcttattggacgtgtctaaaaaggtctttccaacgagtaagtatgtctttaaagaagggcagtatttgagctcatcgacagttgaaaattggctcggacggaaatcaagcagcaattcggagggcttgaacccagagaataacggtaagaaggatccgaatactcggaatccgatttacttacaacagcttgaagaacaagattatatggttcaaaatggtagtaagttatcgcttggcggggtcacgattggcttgggaatgaactcggtcgattattatactaaggtcgaatatggggcaacatacgaaacggacatctcaacgactgagttaacggcgcaaggtaagaagatggcgaatactgtcttacaacggttgcggcaacgctcagctttgaagaatgtgccgattgtcttggcactctataagcagtcttcgaatgatagtttagttgggggcgacatgattgcctacgcggtctctaagaacggctccacttcgatctcaaactggacgtcgttgaattggaagaattatgtcttcccagcgacctctgagtcaaagaactcaggtgcgaatagtaatgatgagtcggactttagtcagtttaagtcccacgtgcagaatttcttcccgaacttgtctggcgtaacggcgaatgctcattacaaggacaaatcgttgagtaaattaagtgtcaacatcacgactaagttctacagcgaaacggaaatcatcagtttcacgcagtacttagcaacggctgctaaacggtacttgccatctggtgtaccggttgaaattacggttaagagtgccaatggtgacattcaaagcttcttagccagaacggcgaagggtagttcgtattacacccatgtctttagtgaccagggcgacgattaaacaataatattgagtaagatttgagaaagaaggaaatctgatggctgaagaacgaattaatgccgaacaagtgcaacacgtggcgagcttagccaaattggagtttacaccagaccaattagcgatgttcacaccgcaactagaaaaaattatcggcatgttcgaagaattaagcacagttgataccacgggtgtacccgttacgtcacggatgagtgatcatacgaatacgctacgtgaagacgtggcagttaagagtgatgaagcactccgggaagcattgctgaagaatgccccagaaacggccaatggcttgatcaaagtgccagcaattattgatgaaagtggggacggtgaataatgacttatttcgaccaagatctaactagtctacacgctgacttggtagccaagaagatcagtgccacggaactagcgaaggccacttttgcgaatatgaatcaggttgaccctaagctaggggcgttcttgaatttaaatgaagaacaggccttacaacaggcggctgctttggatcagaatggcatcgacgcgaacaacttttttgctgggattccgatggcagtcaaggataatattgtgacgaagggcctaacgacgacggcggcttctaaaatgttggaaaacttcgtgccggtctataatgccacggtggttgacaaactattagcaagcaacgcgttgatcgttggtaagaccaacatggatgaatttgccatgggagggtcaactgaaacgtcggcgttccatgtcactcgtaatccttgggacatcagccgggtgcccggtgggtcttcaggtggctcagctgtcgcagtggcttctggacaagtgccagttgcattcggttctgatacgggtggttcgattcggcaaccatcatcatttaacggaattgtcggtatgaaaccaacgtacggtcgggtctcacgctgggggctgattgcctttggatcttcattagatcaaattggcccaatgacacggacagtcaaggataacgcggccgctttgaatatgattgcaggtaacgatgtgcatgataccacgtcatccaaacaaactgtaccagactttacggctggtttgacgggtgatatcaagggtatgaagattgggttaccaaaagaatacatgggcgacgggatcgatcctaaagttcgtgaagtcattcaacaagcagtcaagcagtttgaagacttaggtgctacggttgaagaagtctccttaccaaacagtcgctacggtgtggctgcttattacatcattgcgtcttcagaagcttcttcaaacttacaacggtttgacgggattcgttatggtttccgggctgacgatgttaagaatttggaagatgtctatgtccgtagtcgttccgagggcttcggtgatgaagttaagcgccggattatgttagggaccttctccttgtcagctggttattacgatgcgtacttccacaaagctggtcaagttcggacgatgattatcaatgactttaataaggtctttgaagattacgatttgattatgggaccagttgcaccaacaccggcctttaagttgggtgacgaattatctgatccaattacgatgtatatgaacgatgtcttgacgattccagtcaacttggctgggttaccaggaatgtcagtaccagctgggtttgcagacgggttaccagttggcttgcaattaattggtaaggcgtttgatgaaagcacaatgtatcgagcgggctatgcctttgaacaagcaacgcaagtttacaagcaaaccccgaaagtcggaggtgctaactaatgaattttgtaaccacgattggtttggaagtccacgttgaattaaaaacgaactcaaaaatatttagtccttcacccgtgcaatttggttccgaaccaaatgccaacacgaacgtgatcgactgggggtatccgggggtattgccaacgcctaacaagggcgtggtcgaagctgggattaaagcagcaacggctttacatgctgaaatcgaacatcacacgtactttgaccggaagaactatttttacccggataacccgaaggcctaccaaattacgcaacatgaaaaaccaattgcgcatgatggttggattgaaatcgaagttgatggtaaaaagaaaaaaatcggtatcgaagagatgcatattgaagaagatgccgggaaaaacacccatgaaaacgactattcctatgtcgatttgaaccggcaagggacgccgctaattgaaattgtttctaagcctgacattgcctccccagaagaagcttatgcttactgtgaagcgttgcggcaacggatccaatttacgggcgtttcggacgttaagatggaagaaggttcaatgcgggtcgatgttaacatttcaattcggccggccggttccgacaagtatggtgtgaagaccgaaatgaagaacttgaactccttcaactacgtgcgcaagtcgttagaatatgaagagcaacgccaacaacaagttctcatggcgggtggcaagatccaacaagaaacgcggcgttttgatgaaacaacgggccaaacgatcttgatgcgggtcaaggaaggtagcgatgattaccgttacttcccagaacctgatattccagcagtcgatatcgatgatgactggattgcatccgttaagaagaccattccagaaatgcctggttcgcggcgtgaacgttacatcaatgaatttggtttaactgcttatgatgcgggtgtgttgacccaaactaaggaaatgtctgacttctttgatgcaaccgttgctgaaggtgcggatcctaaattagcttcaaactacttgcaaggggacgttaacgcgtacttgaacgagcataaagttgatttgttagcgactgacttaacgccaactaacttagctgggatgatcaagatgatttcagatgaaaccatctcaagtaagattgctaagaaggtctttaaggccattatggcgggatcagaacctgtccaatgggtcaacgacaagggcttagtccaattgtctgatccggcgaagttacaaccaatcgttgacgacgtattggataataatcaacaatcaattgatgactttaagaacgggaaagaccgggccgttgggttcctcgtgggtcaaatcatgaagaagacacgtggtcaagctaacccgaaagtcgtcaaccaactattaatgacatcattaaaagcacggtagaagcgttggtcgataaggtgttgagcctcgattgatgcatgtccagcgttggggtagggatgagacgctgaacgcttgaccgtgtgagcggaggaataggaaacatgcgtaaacgggcacgacttatttataacccgacttctggacgtgaggcattggcccacgatttagttgaaattcttggtatctttgaacaagctggttatgagaccagtgcgttcgcaacgacgcccgcccctaattcggcggctgatgaagcgcgacgttgtgccaaggacgggtttgaactgattgtagcagctggtggtgatgggaccatcaatcaagtagtaaacgggttagccgggttaaagcggcgacctaagatggctattattccggcgggtacgaccaacgattatgcccgggcactgcggattccgcgcaatgatccggttgcggcggccaaggtagtcctaaagaaccagacggttaagatggatatcggtcaggctggtgaacagtatttcattaacattgcggctgggggcatgttaacggagctgacctatgacgtaccatcacaattgaagtcgatttttgggtacgcggcatacttagccaagggtgctgagttattaccacgagtaaaaccagttgagatggatttgaaatatgatggtggtcattatcagggcaaggcttcgatgtttttcttagcgctgactaattcagttggtggctttgagcagttagtgccggacgcgtcattagatgatggtaaatttaccatgattattgtgaagacgagcaaccttgccaaaatgcttcacttaatgacattagtgctcaatggtggcaagcatatcaatgatccaagcattatttatgtgaagacgagcaaggtcgtcgccaaaccagctgacaaggatcgcttaatgatcaacttggatggggagtacggtggtgatgcaccgatgacgttccggaatttgaagcaacatatcgaaatgtttgccgatacggatcggatccccgatgaggcaatcacggatacggatccagagttggaagacgctgagcgacactttgtctcagccgttgatcagttgccagctgcaactgaggacgacgaaaaaacagaataacttgcttaaattaccgtttaccgatacaatggtggacggtaatttttttaaaagtgttaccatcacagggacctgactgagcattgcctaacgatttaatcgtttgtcgatttagcaatgatttgtcagtggtgcaaagcatgagacagctcaaattcgcgcgttttgacactcatggtaagcaatttgaatagcatgtttaatcagtaaatgttaacgacactgccaagtgtggcagtattaatgaccatatcactcgctgcccggagcagtggctaccaggcagtaactaaaaaataataagtcactaacaaagaaagcaagaggaaacaaatgaaagttaatttaccagtgcacaagggtgaagttttagacgtcactatcatggatttaacctatcagggtatgggtgttgctaaagtcgataattacccaatctttatcgaaaatgcattgccagaagaaaaaattacggtcaaggtcacgaagacgacgaagaactttgcgtttggtgatgtggaaaagattaaccaagtgagtcctcaccgggttaatcctaaagggcgcgtttatcgtcaaaccgggattgcaccactacaacacttggaatacagtgaacaattgaagtttaaacagcaccaggtggccgaattatttgcaaaggtccacatggatgatgtcgaagtcttaccaacaattggtatggtcaacccgacgcagtatcggaacaaggcccaagtacccgtacgacaagtccaaggacaactaacgactggtttttacaagaagaacagtcatcaattgatgccaattgaagattattatattcaagatcctgcaattgataaggctatcgtggtagttcgcgacattttacggaaatatcacgaggcagcctacgatgaattccatcatagtgggacgattcggacgatcatggtacggcgtgggtattacagtcatgagatgatggttgttattgtgacgcgaacgaaacacttaccaatggctgacgtggtcacacaagagattcaagcagcattacctgaagttgtcagtgtgattcaaaacgttaattctaagaagactaacgtgatcttagggccagttaacaacgtgttagctggtaaggccactatcgatgatcagttactgggcctgacattcgctatttcagcccagtccttctatcaagtgaacccacaacagaccgaaaagctttatcagttagccattgatcaagctggtttgacgggtaatgagacggtgatcgatgcttattccggtatcggaacgatttcgttaacgatggcccaacatgccaagcaagtgtatggtgttgaaatcgtgccagcagccatcgataacgcacggcagaatgcggataagaatggtattacgaacgcgacctttgttttggatagcgctgaaaaagccatggctaaatggcaagcagatggcgttaagccggacgtgatcgtcgttgatccgccacgtaagggcttggacgccgactttatcaagagtgccggtgaaatggcgcctaaacgggtggtttacattagttgtaacccatcaaccttagttcgagacgtccaacggtttgcagaatacggctaccatattagtgccccggtccaacccgtggaccagttcccacaaacaccacatattgaatcggtaacggtgttagaacgcgaacaataagcattttaaaactggattattaatgaaattatgaaaagtgtgttggatgcctgattatttgtcgggtaaccaacacacttttttactcagcttgagggctaactttgaattagaagcacaaaataaccgtttttaagcgctgatattgatttgaattcgtccgattttaatagacagatcatttagaatcggctaataaaacagtttattgataattataattattgctttaaataatttaataaataatgcgctgtaattgctgtaaactagttcactggagctgtttgagtcaaatttagcgtattaaattaaataattgtatttattggtcaaaaaacacccacaaaagccatcaattgtattacttttgataaaagtatgtatttcatctcggtttttgaccagtttgggttataatgataaacgaaataaaccgataaatgggggagcatgatggtaaagagaagaacactgacacaggcaaaagtattagcaacagctaatcagttaattgaaagcaagggaattaacggattaacaattcgggatttagcgttagttttggatgtgcggccgcaatcgatttataattatgttgatagcttgagtgatttattagatcaggttggcctccaatttgttcaaaatgttgcggatcgtttaactgaaacaatctcagacgttgacggtgatgaggctttgatggcatttgctcaagaattccgggcggcctgcaaccagcatcgggggttggcaccgttattacttgacttaaatgataacctaagaatcccacggtctcgtaaagcaattgtgcagttataccaagatatgtttaaaccattacaattggatgattcggcgcgggtggagaataccttgtaccgttccacgttgttcggattcattattcaagagattggcggcttctttaagatgcaggggactgaacttgatgaacggttcacgaaggttatgcagttagcgattgaccagacacacttacctgctgataaaacgaaaaaataatttaagattcagtgcggctatcttagcagatagccgttttttttataggttaaattcgccaatatttagcagtaaatggggcgtaatacaataatctttgctaaggctgaaatcaaaatcaataatgatttattgaagtaattttatgatcaatcgtaatgaaaatcttaattctgcatggtaaacgctaaattagggcgttattttggccccaggcttaaaaaatcgtttacaataaggttaaagttaattttaagggggcccaccatgtcggaacgttatttatcagcaattgaacacgggttaacgactaagcaagttgaccagcgcctgacagcgggtctaaagaatgagccgttaccgcccttaacgcggtctgttaaacagatttttcgtgataatttgctaacactttttaactgtatcaatgttttgttagccggattagtctttttgacgggaagctataagaacatgctgttcttattcgtggtcatcgtcaacacggccatcggtatttttcaggagattcgtgccaagcgtcaggtcgataagctggcattattatcggccactaaggttcaagtccgccgtgacggtcaaacggtggcgattggtcaggacgaaatcgttcaggatgatttactattagtgacccgtggcgagcagattcctgtggatgggctcgtgcgggcgaccgctggattagaggtcgatgagtcgcagattactggtgaggctgatccggttattaaggggccgggtgatgatctggtttctgggagtgtcatccttggtggtcacggaatcgtgcaggcaacgcaggttggtcacggcagttttatcaagcagatggcgcgagcagctaagcaaaaacggcggacgccaagtcaactgttaacgattatcaatcgaattatcaaaattttgacttttacgattattccactaggtgctggactgttcatttccactatgatgcggggtgaaagtcagaaccgggccatcctcgggacggtggccgcgatggtcgggatgattccggaaggactggtgctgttaacgtcagtcgctttagctgctggggcgttcactttaggccggcaccaggtattggtgcgggagctacccgccattgaagcactggcccgggtcgatacgttgtgcctcgacaagactggaacgattactagtggcaagttagtttttgaacgcgttgagccgtggaaccagcatgatttgacagcagtggagcaccggttagctgcgttagtcactgccattgatgatgataatgaaacggcccgggccatcaagactgcttttggtcagccgccagtgcaagcgacagaagttcttcccttttcttcaagtcgtaagtggagtggggctgcgtttgatggtcacgcttacgttatgggcgcaccggaatttatttttaccacggtacccggcgagttacagtctcgcatcaaaacgctcgcgcaacaaggttatcgggtattagtgttagccgaagtggccgccttaacgacgcccaaaccgactcgaccgatgactttgggattaattctgatcacggatgagttgcggccacacgctaagacgacgtttggtttttttgctaatcaagacgtcgccctaaaagttatttctggtgataatccggtgacggtcgctagtattgcacaacgggctgaaatcaaagacgctgatcggctggttgatatgagtcaagtggggactacccccgactatgatcagctagtgactaattatacggtgttcggtcgagtgacgccgcaacaaaaagagcaactaattaaagcctatcagcgcaacggccataccgtagcgatgactggtgacggcgttaatgatttgttggcgctgaaacaggcggattgtagtatcgcgatggcgagtgggagtgaagccacgaagagtttggctgattttgtcttaatcgattagaactttgatgcgatggtgcaagtgctgaacgagggtcgccgcgttatcaataatattgaacgggtcgccgcgctctacttgattaagacgatgtattcggtcgctctgacgttgatttttatcttcatgagccacagctacccgtttgagcccatccaattaacaccgatttcatcgttgatggttggtattccaacctttttcttggcgttacagcctgattatacgcgaattaccgggcgctttatgaaacaggtgatggagattgccgttcccgcggcgatctgcgtggtcggctatatcatggtcatcatggtgttaggtaataagttccagctgaatttcgaaacgaccgcgacattgagtgtgttgatgaccgggatctttagtttaaatgcgttattgattgcagcccggccgttgaaccggttcaaaattgggttagtcgtgttaatggcaacactgttcgtcctagtctttttgtttgccggccgaattttctcattggttaatctattagattggtcgttagctgtgatttacctaccactgatgatcagtgcgtatccggtgttcattgttctgcaaaatggcttaggaaaacgcgttctcagtaagatcaattggcgataatcaatcaaattcaggtcacggggccacgctgcaattgcggcgtggccttttttggtgtgatcgggtcgccacgctcccgtctcagtataagccgcaccgttgctgaccaatcagattaaattaacaatccgatataagcatgattgataccagcatagcatgtaaatttataacagattttaataggcagtagcgtctaaaacggcttataatgaagttcagtagattactggaatgggggcagtattgtgtggcttgatgaacaacggttaattcaacggttagtgccgcgattgttgcggtttcggcaaactaacttttatcggattattcaacggaccttgatgttgacgttcccattcattttgatcgggacgttcagtcagattattcagctgaccgtgttgacgaaaacggggtttattgccagtatttttcacctgtcaaaatgggtcccgtattaccgttacttacactatccgtttgatagtttaacaaccttgacgctcaacggtgtggccgtagtggcagcgtttggtgcagcaaaataccatgccaaactcaatcagcgcgatgaccaattagcgggattgaccgccgcgattgcgttattgatcgtggcttatcagtatacgaatcaaaaccaaattggtatttttaacactttattgatcgggactaacggtctaacgggcgcattgattgtgggtggcttgaccggcctgtttttcaaatggttcagcaagccggttccggcacaaagtagtccgcatacggccgatatcttgacacggactttcagttcactacttccaatggccttaatactagtattggccgtgctagtgagcctcgctttgaactggctgatgattattacgtactctgctgaaagttggtcggcatttcaaaagtacgcaacgactagtcacagtctgtggctgacctttggcatggcagttgtgacgctgttgttagaaattcttggactagctggtccgtaccaagaacgcttggtgaccaacagtgcgacaatgacggccaatttgaattatgcactcacacatcactcggcgtatcacgtgccgtatccgtatacggccaacacgttgtatcacgcatttgggacgtttggcggaacggggatgttgctggccttagtgattgccatttatatcggtagcaacaatcataactaccacgtagtcgcgcggtggagtctattacctgcgctctttaatagtaatggaccgctactgacaggcttaccagttctatataatccaatctatctaataccatttgtgcttgcgcctgtcgtaaatatgggactggcggcgctggcaattgggtttcattggattccacccgtggtttatccggttcccgtgggtacgccgggaccgttgattgcctttatcggcactaacggtaacgtggtggcacttttacttggtatcgttgatttggcactatcagtggtgatctatttgccgttcatgcggttggcggaaaccattgtgcaggcggcgcaagcacaggtggggggtgctaagcatgtataatcgacctaattggcagcgacggcggcgaagtctgttagtgcttgtattaggcttactgtttctgggctttttgattcagccctcataccagtggacgaaaaccaacgtggctgcgatggcaagacgccatgattcgcagatgtcaccaattattatgattcccggcagtagtgcgactcagaatcggtttgacaccttagtcaagcaacttaataaggctgatcatcgtcggcatagtttaattaagctgaccgtgatgacggatgatacgattaaaatgacggggtcgttgcgtgcccgtgataacgagccaatcatcgtcgttggctttcaaaataatcgtgacggctatgataatattaagcatcaggcccgttggttctcactggcctttaagaagttggctgccaagtatcaattcaataatttcaaagcaattggtcactcgaatggtggtctgatttatacgtactactttgaacactattttaatcgcgacgatattaaggtcaaacgaattatgaccattggctcaccttacaatttctcagaagctaatttgaatcataagacacaaatgttagctgactttattaagtaccgcgatcgattgcctaagtcagcgacaatgtattcggtcgcaggtaccgaaaactatgattcagacggtcttgttccagcgcggagtgtcgaggctggcaagtatatctatcaagggcaagtcaagcattttacagagattacggttactggtacgaatgcccagcactccgatttacctcaaaatgcgcaaattgtcacgttgattagaacttacatgttggataagccgaaacagactcgtaagggcttagtatcgacggggactgtcgaatgagcggcaacgaggttcagtcgttgtggactggacagtgttcaagagtttgtgacggtggcacctgtgaggaagtttagggtgttattaagaattgtggtaaaatttggtcatggaggtggccgaaatgtccacacaatcaccagtacatcgcaatcgggtcctgactttaattcggtcttattatccgaatttaagtgtgacggaccgcaagattgctgactatattattgccgacccaattaaaacggcggctcagtcgatttcagacttggctgccgcggttggcgtttcaacggccacggtttcacggtttgtcaaacggattagttttagtagcttccgtgacttctcacgtgaactaacggcggccgaaccgattgaacaaactaatgcggaagcttttcaagatgtcgaaaaacaaacgactttcaaaggaattgcggaatcaacattcaatagtattcgtagttcgctagatcagacaagtcaggtaatgacggaagcagatctcaagcgggcggtggaattattgctaaatgctcgctcgattggcttttatggcctcgggggctccgcagtcgctgccttagatgggtatcataagtttgtgcgcaccggtattccgtgtgcccataatagtgactatgatatgcaactgatgcaagcggctcagatgaatgccagtgacgtggcagtggttatctcacataccgggcgtaatcagcaaacactacaagtgctagccaccctgacttcacaaagtgtgccagtgatcgctttaactagcttcggtaactcgcccctggctaaggacagtaccgttgcctttatttcagttgcagaagaaattaactatcgttcggaagggctgacttcgttgattgcccagatgagtattatcgatagtctcttcttgatgactgctgttcatggcaatatcgaaatggcagaaagtcttggccgggttcgcgaggccattagtcaaacacgaacggagctttaatgctgtaggcaaaggattgatgagatgacaaagcggcaacattatcgaccagtatacgcaaaaacgcggtgggcgcggtggcgttatcgactgggctggttattagttctattagtaatcattggcagcgtttggggcggcttggcttggttacgttggcgtagtgacgctgtcgtgagtgggtttgatgtccgtggggttgctgtgtcacaaaatgacggttatttagattttgcggccttgcaaaatgatgggctcaagtttgtctatttacacgctactcaaggagctagttatacggatgataactttgcaagcaattatgaacgaatcgttggcacaagtttaggtgttggcgtaatccatacgtttagtttttcatcgactgctgcggcccaagcggcctatttcgagaaaacggtcggggatagcatcggcaatttaccaattgcgattcaagtgcaatactacggtgactacacggaccagacgattgcggttcgaaaaagtcgtgccaagcttaaggcattagtgaccacgttgacccaggattataatcgctcctgcgtcgtatggtcaacgcccgcagttgccaagcagatcgttaagcccgcactaaaagacactgacttatggctggacacggcgaagacccaccaacagggacgacgagtgatgtttatgcattattccgatcgcgccgtttaccgccagaacgggactcgtcaagagttcgctggaattctattcaacggtagtgtgacagcgtacaataaagttgtggcgcagggcttaaattaaggcctaatccttgaataacttatttcgcaaatcaaattaacagcttattagctgctaggctgactaaaaataagtcgcaagttcaagactcttcttgaacttgcgacttattttgatggcgacctattaaaatccttaggacgtcactagcgtcattaggtatttggcgataagatgacataactgcgatcatcggcttcgtcaaagagggttacaggtcgttgctcattagcccgcacctcaaggtgaaatccatattgatcaagtaagacgagcgcactcgatgagatggattcgacggtggctggtaccgagcgcccgtcgatgcgaatcatcatgttgggatcaatctccaacgtgtggtcccggtgatgagcctcatcacgataggtccaagttcccgcgtagaaaaccgctaagtcaccgtcagcgatcgtactagggtgccgtttgtggagtagtgtactagaaagtcctgcaagtaatgataaaccaaataatattgcgccacgccgcttcactggatcaaccttctttctgaataaatctatagttaaaatataccactaaaacggcgttaacgtcacgtaataagtggattcttattaaagcctttatgtcactgttacctgcgggtaatgaacgtaatattttatcaatttcggaagggcggtaactaatttttttgaattaatttgtgttctgattggaaattactgggtgagtgtgttaatctatataatgtgattggcatttatgtgaagttttaaagtatcatttaattgtgttaccgtaaattctttataggtgttaataacatgtgttagttactttttatttttatatcctaggaggatttagttcatgaaaaatggtactgtaaaatggttcaatgctgataagggttatggctttattactggtgaagatggcaacgatgtattcgttcacttctcagctatccaaactgacggtttcaagaccttagaagaaggccaaaaagttacctttgatgaagaatcaagcgatcgtggcccacaagctgctaacgttgttcctcaataagcttagcttttaaaagggctgcccgtgtggcggctctttttttatgcgcaaaatagcgggtgacttttgatccttatggcccaacttaacggcgaaaactggtaaaatagaattataaactaaacgcacgagtaagcgccaccaatcacgactggttgactagcgccgttgagaggagtcaaatcgatgttaaaattaggaattatcggaacgaattggattacgcaacaatttattgatgctgccgctgcctctggtgaatggcaattgacgagtgtttattcccgccatgctgagaccgcgcaggcttttgccgccaagaatcatgccgatgagacttttacggatttagatgcatttttcagtcggggtagttttgatacggtctacattgcgtcaccaaacagtctgcattttgcccaggctaaacaagcaatcgcctatggtaagcacgtcatcgtcgagaagccagccgtggcgaaccaacaagaatttgaacagttagatgccgttttaaaggctcaccctgatgtcctattatttgaagcagcacgccagattcacgaagttaatttccaacgcgtcaaggatcagattaaaaagttatccttagttcagggtgcgacgttgacttacatgaagtactcgtcacggtatgacgccgtcttggctggtgaagaaccgaatatcttctcgttgaactttgccggtggggcgcttcaggatttaggtgtgtacctggcctacgatgcggtcggctggttcggcatgccggaagaggtggcttactacccaaccttgattcgaacgggcgttgacggtaagggtgtggctattttacgctacgctgactttacggtgaccttgaacgttggtaagactagtaattcgttcttgccatctgaaatcaacggtctgcgcgacgctattgtgatggataatcctgctgaacttggacaaatcacttatcaagataaggatggtcaggagcatgcgattggggcgcaacccgataccaatccaatgctggccgaggcgcgcgacttcgcaaccgttatcaatgacccaagcaatcaccagacggaatacttagcttggcggcaacttagtcgaaatgttaataaattattatttaatttgcggcagtcagggcacctatattttacgggtgaagcccctgataccgataaatagaaatgaggcactatgttagacgtatttaaaactaaatttgcggcggcggggttcaccgagttgtcgccgattcaaacggcagtggccgagccacttgcagctggtcaatcggtgttaggactcgcaccaacggggtctggtaagaccctagcgtttacgtggccaatgctcgaagcgttgcgggtcggagaaggcacgcaggcactgatcttagcgccatcacaagaactcgcaatgcaaacaaccaacgtggtgcgcgagtggggccagttgatcgatgccaaagtcctcgcgattacggggggggctaacgttaagcggcagatggaaaagctcaaaaagcatcctgaagtaattgttgggacgccggggcggattactaacctgattgcggatggtaagatcaagcttgggcatttgaagatgatgatcgtcgacgaagccgatgaattactgacagatgaaaccttggatcagattcgtgaaattctcgacgctacatttgctgaaacgttacaattaggcttcttctcagcaaccgaaactaaaattttagatgagttgccacgctggtttggtcagcatgttgaaaaaatcgatgtgcgggccattgatcagacccagggggtggttcggcaccggacgatgcaagtgggtaatcggcaccgggtggacttactgaaacggattagtcgtgttgaccatatgcgggccctcgttttcttcaataagatgcaggaactccaacatgtcgccttagaattacgacaccagcacgtgagttacgttgccttgaccagtaatcaacgtcaggttgaacgtgaaaaagcgttgcggttattccggcaaggcaaagtcgggctgttgttgaccactgatttggcggctcggggtctagacgtgcctgaattgccagctgtgatcaactatcagctacctaaagatgtcacgacttatattcaccggagtggtcggacaggccgcatgggtgctgatggactagtcttgacgttcggtgacgaccatgatgtccgcgactttaagaagctgatggcgacgaccgactatgaaattaagccgggttacttggttgattatcatattgttgatacgaaaccagataaagttgttccaccgttaacgttcgaccatccagaaacggctggcaacgcggctaacggtcggcaccgggtcgtgagtgctggtcacccagatgaggttaaacgagtggagacgagccggaagcggcccgctgcggcaacacctaaaaagaagaaaggtcacaataagcattctaagaaaaaagggatgcgcaagaaaaatcgtgatcgctttagcaatcagtaattgccaaaatgcacaatccgtgagatgatattttacggattgttaatggcctcatagcacaactggatagggcacccgcctcctaagcggttgatcccggttcgagtccgggtggggtcagttgaatattagaaagcaccgtttcagggcagcgttttagtgacgttaccttggaacggtgctttgggtttaagtagccacaaatgatatgaaatcgaaatgaatactgtattagtctaaacgcccgctaccagtccaaatgactagtagcgggcgttgcgattaacgaatgacgatgacgttgcaaggggcgtgatccacgacgtagctggtcgttgaaccaacggctacgcgatggggcgagttggtaccagtggcgccgagcacgatcaagtcaatttcgggatgttgcttggcatagtcctcaatggtgtgttttggaatcccgtagctgatttcagtttttaaattcggtgcggacgtggtggcgacgaattgttgtcgctgccgcatggcatcttttgcgtgagcggcttccgcgtctagtaattcagatagaaccgggtcgagtgcgggggtgtggtaggcgctgtcatccaccacgtagagcgcagtcaggtttgcttggtgccgctgggcaatgttgaccgcttcggtaaaagcggcttgtgcagcatcggaactgtcaacgggtactaaaatatttgtgtaacggcttggcattataaccacctccagttatctttacgataattataatggattagtgtcgggcaataaaattaaacgcacctagtgggcaaggccgatgaactagcgtatattatagacagtaaatttcttttgggggttaggtatgttaaagcatgtacagaacagcctattgacctttgaacgggtcgttgagcggcaacgttattggcgcgccttacgtgatacgttgacgctgctttttccattcgcattagttggggcgtacgttagttttatgaaccaggcaatctttcagcgcaatggttttttgaatcatatttattatctcagtcactggctgccggggtttaaacatttggcaacttacacgacgatgcttaatctgagtatcaacggcatccttgccgtgattgcggctttttcagccgctaattttgtcgcgcggagtgcccagcgtgataatctgttagcgggattgacggcggcaattagttttatcatgcttaatatcaattataatttttttagtacccagggtcagcctgctggcagtcggtttttagaagataatttgggaactcagggcatcttcctcgcactattggtgggcctgttgactggttggttgttcagtcatttgacacggtatccacacatccaccaggagatcgagacccagacccacttgctagcgcgggcacacgcgaactggttaccgatagtcgctgctttgctggtgttcagtgccatcgggtatggtattagttttgtcagtaaaggaggattaaacggcctgttttacgcggtcttcaccttaccattcagtaatccgggggcgtcgctactagcgataattggcgtggcatcgctcagcaatttatactggttaatcgggattatcggtccggttgactttagtggtaacagtactacaagtacggttcaaaatttggaatatgcgttgcaacacggttcggcgtggggcgcgccaaatccagtaacgctccatacgttatttgatgcgtttgcgaacgtaggtggtcccggaatgacgttagcgttattgattgcaattttgtggcgttcacgtaaccgtaattatcgaacggtggccaagaccagtgccttgccagtactgtttaatatcaaccaaccgttgctcgtcggcttaccgattgcttatagtccgattttagcgattccgtttctattagcgccactggctagcatggtcatcacgtggtgcgcgttgaagcttcaatggatgccgccggtcgtttatccggttggtagaacgatgccgggcttcttgaccggttggctgggaactggtggcgactggcgggccttcatcgttagtctgatcaatatagcggtagccacagcagtctacttgccatttgtcctattggcaaaccaggttgaggaggaggcgcaggcggatgcttaaacgatattggtggcggtggcttcttggaatcggtttgttagtcgggatctgttggccggcctacacgtggagtcaagcgaatatcaagacgctgaaaaacactggtcggacgcggatggcaccagttattatggtccccggatcgagtgcgtcacagaaccggtttgatagtttgattaccgagttggggaaggaaacgccgaaaaaacacagtgtattgaagctgacagttcagacggatgggacaattaagtatagtggttcgattgctgctaatgataatgagccgttcatcgtgattggcttcgcgaataatcgtgatggtaaagctaatattgataagcaagctgtctggttgaatacggcatttaaggcgttggtcaaaacgtatcactttaatcacttttatgcgctaggtcattccaatggtggcctcatttggaccctctttttagagcgctatctaaaggaaagtccgaaggttcatattgaccggttaatgacgattgcctcgccgtacaatatggaatcgacaagtacgaccgccaagacgagcatgttcaaggaactttaccgttatcggactggtttgccggaatcgttaaccgtttactcgattgcggggacggaaaactataccagtgatgggacggtgccgtataacagcgttaactacggtaagtacatctttcaagatcaggtcaagcattttacggagattactgtaacgggggcgaatacggcgcactccgatctaccacagaataagcaaatcgtcagcctgattcgacagtacttactggctgaaacgatgcctgacaaggttcgtcaaaaaaacgcacaacgggtacaaaattagttacgttgtgtggcagtgatactgctgttaagacaacactggtgagcgatctggttaagaaagttatacatgcagtgaatagaacgacaaaaacgattagcgtctcgtaaccgggacgctaatcgttttttagttagatttgcaataaattaatgatgatgcctggcgttgtgtgagcgggctgaccgtttcgagtagtggtgcttcgacggcttcgcccggtgcttgactcgcattgtgacacgggttccccgaactcgcaaggcttgtgcattggttgccggcagggtcagtaaaccgccacagacggccaggatgacgagcactggtaatcctcggtggatcgacatgatagaacgccccccttaactaaaatccttatttagtgtataagtaattcgagtcagcgtcaacctaaggtccgttactgactttacaaaacgttaacggcatattaacggattattcacaaaaagccggcaaatttgattgtattttgccaagttttcctttatggtgggagtaatatataaaagggagtttggctaaatgaatattgaaatcttaaactcagcaatccaagacttacatttccaaatcgtttatgatcgttctgaagacgatgacaatcctggtcaggggcaattcagctatacgaccgccaatccagatgttaagaagacgtttggcgatgacgttgtgcaggctcaattacaagtgacctataaagaagaaatgttcgacttatccgcgaccgtttttgcgattgtacgcctaagtggtgagatggtgggaattattgaacgtcaatctgacaacaaatcaattgaagacgacgaacaagaaatgttgaacaatttgaatggtgccatcattccagcgttgtctgccaaagtccgggcctatgcagcattattgtcaactgaagctagcaactttgccatcatgccagctgactttgatgatagccagcccaatgatgctgaataagcgtaatccaagagcttgtcaaactggcaagctttttttgatgacttaaggaatgagttctagcgttgtgtaaccgttaacaaaggtgctataataatgatggtcagagttgactaggcaactgcggttgcaatgacgaggtcagaaggtctgattggtgacttcagcaattattactttgatccaggcttatcggaatggttcaaagcgggggtgaccgcaagtcggttagcacacataggggcagtgaatattgacacatagtttgagccaagctggtaagtatcgtggtggccaagttacgctgtaatttggccgctatttttatcttattttcagccgaacactgcgacaaaaaatgaaaactgtcgtgatgaaatcactgtaaattgtcacatgaaagcgtatactgacggtgagaggggtgagtgttatgtttaaaccaatggcatctgtttttacgaaccatcaaattgcgggtcattatcgggccattgagcgggcgcaaaagtgcgtggttccatttcattttgagattcagggacaggagtatccaaagccaaaaccagaacgtaactggttacggcgcttatcggggacgtcgagcgagaagtacgcaatggtcgaactgaccccgacaaaggtcgttttgtggtcaccagaaggacgcaatctgggtgaaatgccactgagtgcggtgcggcgaattcagatcggtgcgattcggtgtcacgtaacggaaggactcgacccacgccacgcatttcgggcgacgatctttgtgctgactgatagcggtaattattattttgctaattctgatatggaagttttaccggcgatttgtaagttcgcccatgaacatcaagtgccggtagaagacccactgcggttgattccgcttttgaaggtcggctggcgggtcgcggccgtgacgttacatgaaacctacgcgcaactggttgcgcacacgggttatccggctgataaggtttaacttgattttatgattaataataatgaaaaacggactgtcgataatgacaatccgtttttttgatgcgattaaatgtagttggcttaaactaagccttgcgctaacatggcgtcagcaacttttgtgaagccagcaatgttagcaccactcaggtaatcaccgctaacgtggtattcgtcggcagcggcaacggagtgtgcaaagatatcttgcatgatttgcttgaggcgattatcgacttcttcaaaagtccagctcaaacgcatactattttggctcatttcaagggcggaaacggcaacgccaccagcattggcagctttggccggaccatatagcaagctggcagcttggtatgtcgcaatggcttctggactgctaggcatgttagccccttcggcaacgaccttggcaccattggcaatcaagttcttggcttgatcaccgctgatttcgttttgggtggcgcaaggtaacgcgatatcataagctacttgggcgtcccagacggaaccttcgtaatagctggcactggctacacggtcggcatagtctttgatacgaccgcgttcaacttccttgatctgcttaacgatcttgaagtcgataccgttttcgtcaataacgtaaccgtttgagtcggagcaagtaatcaccttgccaccgagttcttcaaccttttgaatcgcgtagatggcgacattaccagcaccagaaatggcaacgcgttgaccagggaaggaaagttggttggccttgagcatttcgttggtatagtaggcgagcccataaccggtagcttcagtccgggctaacgaaccgccatagttcaaacctttaccggtgagtacgccgcggtcagcgccacggagtcgcttgtattggccgtataaaaagccgatttcgcggccaccaacaccgatatcaccagcagggacgtcggtatcgagaccaatgtacttgctcagttcggtcatgaaactctgacagaagcgcataatttcgttgtctgatttgcccttagggtcgaaatcagagccccctttaccaccgccaattggtaggccggtcagggcatttttgaagatctgttcaaagcccaagaatttgacgatactcagattaacggatgggtgtaaccgtaagccgcccttgtatggaccgattgctgagttaaattgtactcggaacccacggttgactcgtgcatgaccagcatcgtcgagccaaggaacccggaattgaataatccgttctggttcggtcaaacgttccaaaatattggcttcgatatattctggatgttgttcgaggactggcgtgatcgttttgaagacgtcgttgatggcctctaaaaattcggtttggttcggatcacggtgttcaatgacttggtaaacgtgttggacataatcagttgcttgactcaatatgatcatccttccttgaataagttaactataatcttcattttaatggtcacgttcggaaattgcacgagttaaattaactaaattttgatgaatttttagtgattgtggtaaaaccgtgctgttgatagcgctttcgatttggttcggcggactaacaataattcgcattttaatgcaaagtcagaagtgagggcgtatgcttgtgacaattaaatagtagtcaagtcagatttgacgggcgactcatcaggaacaggggggatcatgatgaacaaacggcgttggttattaagtttattgccaatcttactggggttgattggtgtgggtgtgtggggatcacagcaattaggtcaaggagcacagcaagtgacaccaaagacaattaaagtacagcaggcagcgtcaaaaatcaaatccgcgacgaaaaagcaaacgacgactaagcctaaattgaagcccggccagcttactgaggcccaggcaatcaagcaaatcgatcagttgatcaaaagtcatcatattatggggacactattactgaccacgaacggtccggcgggggtccgggttcgaacgtatggttatgcggatgatgccaatcaagtccgcaatactgcgacggaggcttatccattagcgtcattacaaaaagctgtgactggcgtgatgattcaaaaactgatcaatcagggtaagttgagtctgacgacgaagctgagtcacttttacccggaaattccgtacgccaatcagattacgatacgtgaactattagaccatcgttccggtattcggatgactgagataacaccaaagacgattttaccaacggagacggcgcggctgaactttacactgcaacatttacggtcgacgaataatcatgcttatgcctattccaacgcgaactttaccttattggcaggggttattcgcaaagtgacgcataaatcctatcaggcggctttgactaatgacatcattcggccattgggattaaaacatacctatgaatataacgatattccgggcaatgtgatcaacccgacttcgtatcgcttggctaatgggtttggtcagagtggcatcatttctaagccgttacaatctagtgaattaggctgtggtagtctatatatgagtgtgggggattattataaatttatgtatgggcttcaaagcggccagctagttggcgaagccggtttaaagtcacttgcggataattttcaaattaaatattcggcaggcgtttattaccaggcaggccagttgattcgagtgggtggcaatgacaataattttcatagctactatatggggtcgcgaaatgccaaagtcgccttagtcttatttgaaaatcagggtgtttttggtggtgacaaccaggtagcgtataagattcgtgatattttattgaagacggtacctttttagaaacggtccgggctgaacatcatcttaattgcaggagaacgtgtgtctgcgattaaggtggtgtttttgcttacccgtccgtttggctgaatccttgaaaataactaaacttttactcgaaatgatggcgccacgacgtaactaacgctatgatgagattagaaactaaatgatgcaggtgaaagttaatgacaaaaccaattaaggtaatgacgattttcggcacgcggccagaagcaattaagatggcgcccatcgtgttgcagttgcagcaacagccacaatttgaaccggtaacggtggtgacggctcaacaccgcgagatgttagaccaggtgctcacgatttttcacattacgccggactatgatttgaatatcatgaagcctaatcagacgttagctggtatcaccagccgggtactgacgaagctagatgcaattatggatacagtcaagcctgatatcgtgctggtgcatggcgatacaaccacgacgtttgcagctagtgtgagtgctttctatcatcaaatcccagtcggacacgtggaagcggggttgcggacatggcagaagtactcgccatatcctgaagagatgaatcggcagctgaccgacgtgctggccgacatgtactttgcaccgaccgaattaagtcggcagaatctattgaaggaaaaccatccggatacggccatcacggtaacgggcaatacggccatcgatgccttaaaacagacggtttcgatggactatcaacacgctgcgcttgatttgattcagcctgggcaccggatgatcttactcacgatgcatcggcgtgagaatcagggcgccccgatggaagcggtctttgtcgccatcaaacgagtggttgctcagcatcccgatgtcgaagtggtctacccagtacacttgagtccggcagtgcagacagtcgccaaacgtatcctcggccataccgatcgcattcacctcattgacccgctcgacgtgcttgattttcacaacatggcggcgcgcagttacttcattatgacggattcgggtggggtgcaggaagaggccccgtcactgaataaaccggtgctcgtattgcgtgatactactgaacgaccggaaggggtcaccgcggggacgttacgattagtcggcactgatggtcagcaggttgcggcagcaatgaccagtctgttagatgattccgcagcgtaccaacggatggcaggcgctaaaaatccttatggcgatggtcatgctgcggaatacatcttacaagcgattatgaaaaaaattggtacacattaatttatttacatttttgtataaacagtgtaatattaagcactgacatagtgataaaaattttcatttcttccgtaaagatgtgaaagagccggatatggatgccgcgggggtatcaataccggttatttttttgcgttaaaatttggatgggcccagtactactgagcgtctaggcagctacttgattttgtcaaagtggctgacggctgggagataagcggattttactcgtcagcggccaggtattgccatcaattgatctgattggaccgactagtctattcgccgaaagcactaatcctagtataaaaggtgtttcccgcggcattccattgtataattgtaaatactataagtgagcgttgaggataaatgaatgaatttaaaagcccgttaccctaaaattacgaaaagcctggaaattattattcggcggtatggacaagccaatgtcagcaataatgcgattgtgctggcctactacgcgttaatgtcgattgccccgataatcttgattgccggaaacctcatagcccggtttgatttgaagtctggacagattttagcgtacgctcaggaagttattcctagtaatgtctaccagacgtttaagccgattttagtttcatttctgtctagtggcagcagcagtagtttgtcaattgggattttggtgacagtctggtcggcgtctaaaatcattgcggcaattcgcaggagtctaaatgaggcgtacggggtcacggatgcccaaaatgccgtatggacgcgaattattgcctttttcttaacgttgggactattactcctcatcgtagggctggcgattttcttcacgttgagtcagttgattctagacgtaatcttgaatttgacgaatctcacgcgtgccatcattccgaattggatcaatcagttgttggaaaacaaaaacttgattacctttgttgggatgttcgtcgtcgccatgttgttgtattactttgtaccgaacgccaaggtaaaattgcgttacatttggacgggggcgttagtcacgacgattggttggatcgtgatctcgcaagggttccgggtgtacatcgaattatttgctaaacggattacgacttaccaaacgattgggagtttaattgtactgatgttctggttgaatttttccgggattctcttgatgtttggtggtgtcgtcaatgcgtcggtgcaggaatggtttgagcataagattgagccaaagtctccacggatgattcgccgcattcgtcgacaattcttcaaacgcaaaaaaacaactaaaaaagaataatcagaaccttttaattgaatccgaacgtttaatcctgtaaaatcaagactttttgcgatttacatattaaacgattcggattttgtgtataatggtgttcgtgtgaaaaaagtgccggtgctttctgaaagtaagtggcgtctatttcaaaataaacaggcgtaacaacgccacaggaggagaaagatagtgattcatcagcttttggcagagttcatgggaaccgccttgatgattatttttggtgtcggtgtacattgtagtgaggttttaaaggggaccaagtatcgcggttccggccatatcttcgcaattacaacatgggggtttgggattacaattgctctcttcattttcggcaatgtctgcattaacccggccatggtattagcccaatgtattttagggaacctttcatggtcattgtttatcccgtattcagttgcagaagttttgggtggggttgttggtgccgtgatcgtctggatcatgtatgcggaccattttgccgcttctgctgatgagatttccccaattacgattcggaacttattctcaaccgcacccgctgtgcggaacttaccacggaacttcttcgtcgaattcttcgatacatttatttttatttctgggattttagctatttctgaagtgaagacgccggggatcgtgccgattggtgttgggctcttagtctgggccattgggatggggctaggtggcccaactggattcgccatgaaccttgcacgggacatgggcccacggatcgcccacgccatcttaccaattaagaacaaggctgacagcgactggcaatacgggatcattgttcctgggattgcacctttcgttggggctgcttgtgcggcgttgtttatgcatgggttctttgggattgggtagataatactataattattttggacggctattgtaaaaatagtcgtcttttttatcgatgtttatacaacaatataacgattgcccttttacattaaaatttttttgatataatggcatgatgagactttatatggcaaattacaagtttaatccgaacaagcccggaatctttcaatggcagtctgttgatgatgtatttttaatggtcgttgattaattagttcaagtgctgctaggatctcatcagtcggatttggctaaaattggtctttttcgggaaagaaccagcgtaaacctcttattaataaattcattggaacctcgctcccatggtgaatatggatggcaaaaaataaactttgatctgatatcctgttctaaggcctgataatggcaaactcttccatgatcaaagtaatggatttaacttggggaccgaaggcccccattaaacttgcaaaggcgggtgtttagagtcttagcgttctattagggggctttgatgcccatagagtcgggtctaacgttctacgaatgtaaccacgacatgatcgtgactcactcgactagaaagcaccgtattacttcccaatggaccaaaagctaaccgtgagaaacagttgttggccgttgttcgatggaagtcccacttgtaatgtatatttcccacgatttttgctcactcggtgctggcggacattccgattgggtgatcagtcaatttgaagggagccgccacgattagccaattataaattgacgcagtgctcaagttataagcggccgcaattgttctggtgaccaggttaatcgtaagtgattggtaataaagtcgctaatgctgccgtcagcatcgacgacaacgaccgcattcgccttttgcgatctgcatcttgctgagctaattctggatcataaggttaaccggtccaatcatagctaacgtgctttggcgacgcctaaggcgtcagccattacttggtaagatttatcccctcattgaccagttgtgctagtgcgccacgtgaaaacgtgataaagtagatgtacccaaagtaatcacctcctatattggttggaatagctactaccattgtaagtgattgctttggctttttaatttctgttcggattaattatagaattttgccgaataaaaaatgatgtgctgttcatgaatgccaaataatcagttctcggataaagtggtgttgttacatcattcctaaataggagaggttcaaaattgttacaaaaataataatttggatttgcagagttattttggtcagaggagaaagtttaacgggagaaatgaatggtgcgaggaggaagttgtatctctagaagagcaaatcggcgattttaatattaacgttgttcatatattcgttctgaattgaaatgtacatgttttttgagttataaacgactgaagactatattgatccgaattatgctagaccaatatttctgaagtaagaaaaatgaagacaagtagtactttatgtagtagcgaaaagtgtcgaatgtatgtgtgattttgggcaatagtttttcgtgatggaagtttgaagataaatagatttatagcattaaatgccaatgtttcactagaatgttgtcttccaaaaaatctgttaatcttatatggtgcatgggtattaaatcttatagaatagggtagtcagcaacggtacgttgtaaatgttggaaaatgaccgattagaaaaatgtcggtgtttcaaattttttacggttaaaataacgcattcaatttggaggaactgaaatgcgttagatgttgagagcagtgtgctcgcaatatattatgaacaaaataaacgcccaacttcgctgaaattggtcggcgatatcggtgttgatcacacgacggtaaaaagatactaaattagggctacgcccccagatgagcagccacaacccttacggcggccgagtaaacttgacgattatcgagaaaaacgatgaaagaaaaggttcagaaggactgttcggcaacggcaatgtattacttatcaaagaacgtggctatcaaggaaagcaaagtatatctccagaggactattgtcgaaccatcagaaaagcagccgcaacgaaaaaaaagccactatccgaggattgaacactcgcagggctttcagcccaggttgattgggaaagaagtttaacgtggttttctcggcaggagactctttcaaaaggccaaacttcttcttactgttctgggtactcgcgaatgaatacatgaattaccttcagtgcagtcccaaattaccttttttgattgctaatatgcctttgggcaaccgggggtgtgtttgtgctgtccgaagaaatatggatttgacaaacaaaaggttgtcgcgctctaatcaaagtaattttggttataagccggtattaatgtgaaacatttcgttgaatacgctaagggacgcctggtttcaagcaattgattgcgccgtttcggcacaaaaccacaggagaaggttgaggcgctggccagaatactcagcgaatcaaagtttacaaaccacgagtgtgaagaagccgctagactagcgagctcgtccaattgcgtgtgtgatcagtgaatcatgaaagtctcaggcgactcaaatcagccttattattgtgataaagaaaaagagtatatcatgagtttgatcacgacttactcgatttgcccatgccagccaaacatacgcaaggaaagttaaagttagcaaggaaaatgaatgtctttcaaactcggaaatcctccggtccccataagatatattgacgaaaaccgtacaaagtaaacaccgatacaatacttatacattttataacggagaatctaattcgttctaaccctatttcatgaaaaagattatcttaccttctgcgtatgacctggcgcgatttggtcccgatcagacctttataagaattcgtgatgaccgagtcattgagattacgtcgacgaaatgaagatgttgtgaaatgaggtgagaaaatggccaattaccaagctttatacacaaacctagacaatcaaagttagatctttcgccgaacatttaggctccctatggagaaatcaagagaagcacccaagtccgtgagtgctgcctattcgatgattgacaacggctgagcttaaataccgggaacaacaaaagttaattgagaattaaactaaggcccgctttccatatgaaaaaacgttagtgactttgacttagttatcaacgggaaattaaccaagattatacatatttgaggacgggatcactaagattcacaccaaagagaatcaaaagttttgtttgttctgggtcacctcggtgtcggttaaaccactagccaccgccagaattggaattgaagggtgtataaacaaggaatttcaacgcgtttatttcgatggtagcgacctcatcaatcaagcttcaaacagcacaagttcaaggccgagtgaagaagtgcttacgccgtatatgccgtttttaaatctgatcattgctgagattggttatcttccaatgacgtcagtgggcgttaagctgttttttcagttaattggaaagagatacgaaaggaaatcaaccatatcaccctaatttccgcttttctaagtggggaaacgccctttcagaaagatgtagcgaacgccattttagatcgttggttcatcacgctaaagtatccgaatcactggtcgatcatatcgactgaaagatcatttaattgaagtaaagaaggatcattcctggacctgatttatcaggtttcaacgcacaaaataaagaaaggagcagtgagacactgtaaactttatcggtaaaaaacagcattttttaatcggcaaaaaacgacattttcacatcggcgttgacatatggtagtcaaagttcttttaataaaacatatggctgaagttagtgctgtaattgccgcgcattgtcgtaattgaagttggtaagccaaatggaatcccttattttaaaaaattgaatatgcgcaaaaaacatttgtagatggtgattttttagatattgtaaaggaatttgagagtggtgaagaatgaatgaaagtttaaaaggaaagcgattgtagccattcgaaggttgtttgctagtttaatgattacttttattcatgtcatgttgtttggaaatattgattcagtaataaatagtccgtttggatttcagaacatcagtaaaagtaatgcgctcggaatttttctaatcaaagcgtaaaacagtgccgaaaaatacgctattaccagtaagaaaagtttgcgtttggaaggtacggtttgaatagtctgaactttgaatcatcaatttaagattgcagaggcttataaaaaaagtcaaatatatgaacaatcggtcaagtgatgctattgtactaggtcacagctgcctaagtattaatatgcaaaggtatgaaacctactgatggcgcaaggtatgggaaaggttatttttaattacccatggggattgtaatgggtaattagtaaaaagtgcaaaaaaatttgagattaataactggaggctaaatcaaagtaggaatgggaactgattatcaaaagtagtgacgagcagatatactgtccgaatgactaccatgctgcttttattaaagtgaagcgaggtaataatcgtggaaaataatgtgatttcatatattaatagtattgatattaaaaaactcagaaatcggatgaaaacgttgaattattatatggtagaagttccaggagcaaaaattcaaacaaagcgaagtttccttgactttatgggcgaaaagttctccatgcctgactatcaagggtgggatgcttacgcggattggatgaaagatctaagttggatacctaatcgacgaatttgcgtgattattgatgattatagttcctttttaagaaaagattctaaagcgagaaaggactcgattgaactttttaaagatgatattttgccgttttgggagaaggatgttttgaagtttgtagtgggaggcaaaactagagtctttaaagtttatcttgttaactaagactacaaaataaataagcatgttgtatagttggcatagcaattgtctgatttaataaatataccgattaattagatgctaggcgaagacaaactagtgtatgctttcgccataattagggcaaaatatgatacataggccagcattattcagtaggttgttgtcagttataataactgatctgttttagaaaagtatcaatttaataagtaatatcaatcagtaagttagtgtaactagtgttcccggcgacgtgatttaaattgctcagatctagttaaatgatatttataattactttaaagtaaagacagaaaattgtaaatttgacaattacttatacgataatattcgaaatattgcttttttaatggaattacgtttgaagaggcagttccattaattcgtcaaaaaatgcaggatagtttactattagcgaaatataagtggaaaaattttacaatttgagccggttatcaagatatctgtcaaagaactaggtgaaagaattgtgaatccgggaaaattgttggagatttgaacctagtttaggtgaatgatcaacaacttggataaaagtcatcgccaataaagtgggcgatatcattacggcatatcttgtttcaaattatgggaggaaaaatgaatcaaaaaattctaactgtttatgagaattttcaaaatgtaagtttgagtattttttttgatgagctgatactttttataaatagatatcactatgaatttacgaagtatgtatctaaagattatttagaagcaatggaaaaatttgaagcaaagtattttattttgggacattctgataataactttgaaattggtatctcatattatagaaatctgatagagcaagggttggataaagaaaatatctgtagacaagtttcgttgctaatatgggatttaagtggttatatgatagacgaaatttgtccaatttgtcacgatagtaatttaagattagcatcatcaattggtagagagaagcttattaagttttgtgatgagtgtttgtctactgaaatagatggaaaatttgttcagactgatgaagaaatacttccagcaaatagagatcaagttaattcatatttaagggaacaagctctctaatttaaaactatcataaagataaccatgaagcagacgagaaattaacctactgaattgccaaagcaagtgcaaccttataaaaatgtggttgatgttgaagtatcaccatgaattgctgaaaaattcgggtagtttaatcatatggaagattgttaggacagcaataaaggaacgactgaagaattgaataaacgtcagccaggaaagttgaaaaaggaattcctagaagaatagtgcaaaggattataaacaaatggagattgcatagtgagcagttatagccaagcaaaaattttaatacatgaaaacaaagatttagtagatcattttggtggggcttcaagtgaattaatagcaatgggagaaacaaaactaggtgtacagtttccgtctgattataggaagttcttattggaatatggcgccttaacattcggtgcagctgaaatctatggtgtttttactgaggattttgaaaattcaggagttcccgatgcagtttgggcaactttggatgaacgtagggtggtaaagatgcccacaaacttagtgatgatttataatacagagatgggtgaaattctttgtttaaattatagagaattaaatacaaatcaagagcctaaaattacttcctattttccagtatttgctgaaagcgttcaaaaaaatgaagtcttatataatagttttggtgattttttgctagatatagtagaaggagaattagagtaaaaaacaaactgagataaaggtccggatatatgttaatctggatggtcagttatagccatgatggtggaaaatatgacacaggaactagtgttgttattggtcagtagccttgctggttagtctaatttactatggctgattaatttagattaagcatcatgcgaataggcaatatcaattaatcagataaaccaaccgatattcgacgaaaaccatttgccagatatcggttggtttttagaatattgatgaacctagcatattctaaatattaggacgattacaggtagtgatatagtaattaatgtagtgactaaattaggtgtagaggtgggcccaatgatgttgctatcaggaagaatactgaatgatcccgaacatgttataaatttgctaagttaacaaaggtgcgaatgttttggcaactgttaagaaagttatgaggaaggtcactgggtaaaaagatgttcaatcaactaaatatgacgatgaactgtgcggctaggaacttagttaaacgcaagtcatcgaagatttattattagaggccaaacaactttgaggtctaactaaacacacgacaaataaaggaacttattatgaatttaataacgttaaaagatttgagagcaaaaaggttagcctataattgggaaacaatttatgttggcatggaaatggcgtattttaccattcaagctatttcagattatgctgttgaaccaatggaaggcggaattaatgatgaatttatcaatcaactggcatggggagttgaagacgaggactcatcacgaatattatttgaaataaagtgtcattttaacttagtatctgaaaaaaacaatgatgagtataaactagagaatagaaaacttaggtttgtctatctgtccaagctcaatgatgaagtaactgatgacaagaaattattggatgaaattgaaaaattttatgacaaccaaggctatcctgaagatatgaatacttttattgaatatatgcctcaagattcatacacaaattgtaagattttaattctaaggttccatgagtttttaaatttagagggtgaacaattacgattgatttaaatgattaagcagtatgatcaattgatttgcctactgaagtatagggtcgaggttaattatttatcttgattatcctgaggaaagagaattgatggatgtattcgacgactggattgcatagaaaatcaaaaagaattaagaaagtgtgcatcacaaaattagcttcggtaactaattttgtgatgtgtttttaaattactctgaaatcaaggcatgtttttgataacgacacagttaatgataggcatctttccaaactaacctccaaatacgtttaatccccttaaaaatcaggtttaaatattttatcctaaccaccacgtctagctataatcaaactagactagtataatgaaaaattacttgaaacggctagtcagcttaactgactaattcggattagttttaagtgatcataacaatttgggggaagcttatgacaaaaattgcgtgtgtgattgtgacttttaatcgtaaagcgctacttgcggaggctattgagagtgtcttgacgcagccggaagcgccagaatatgtcttcgtcatcgataacgcatcgacggatgggacggaggcgtttattcagcaacaatttgactttgatgatcaacacttggtttacgttcgttgtcagcaaaatcttggtggttccgctggttttgcaactggaatccggctagcattgcagactgactgtgattggatctcgatttctgatgatgatgcgatttttcagaccggctactttgcggcgatgcggcgagcgattgtgactcagccgcaacaaggcgtattttcaggatcggtgttattaccaaatggacaccatgatgcgatgcatcgtgaaatgattaccaattcgcaaacactgacggttaagcccatagccgaagccgactatgcgcaggactttaagtatgatattttttcgtttgtgggtatcttaatgagtcgcggcattgttgaacgaattgggctacctgaacaggattactttattcggtttgatgactttgaatatgcgctccgggctcgcaagtatggtcagtttctaaatgtccacgacgcgttggtcctacacaaaacgacgtatactcgtactgctatagcgccgtggaaggaatattacgtgatgcgtaatcggctggcatcattattcaaacaccgtgggcaaactcgggttacctgctggtatgcccgtcgctttttagcgcgcaaattattcgccatcttgctttttcgggatagatggggccaagcggagccactgataaaagcgtatgttcaaggttaccgtgatggttggcatgaccggcttgggcgcaatcaagattatttaccataaaggacgttaggctaagacaaggagtggacaaacatgcaatatggggcgattgtggtaactttcaaccgcaaacaattactaatcgaatcaattacggcactactgaatcagacggtcccacccgcgaaaattattattattgataatcattcgacggatggtacaaaagctgaattacaaacagctgatattttggctaatccaagtgttgattaccggtatttgaccaaaaatatcggtggtgctgggggctttgctcgggggatgcagattgtggcggcggatccgaacttggattgggtttcaatgtccgatgatgatgcaatttttgaaccagactattttgaaaaactaattgcttatcagcaagatcatccaaatcgccaaatcctgacggggagtgtgtatattgaggatggccgtttgcaagcggatcagcggaaccggttcaccaactggagtacctttcaagcgcaggcggtccctgaacgtgaatatcacggtaattttgagtttgaccagtacactttctgcggcgttttcatgagtgtggccgtgatcaagcaagtgggggtggcagacgctggctactttatctggtgggatgactgtgagtacgcggtacggacggccaagctaagtcgaccggtcaacgtgagtgcggctaaattaattcacaagacggctttaccgtccctggacttcaagtctaaattcgtacccgattggcgactctattacgggcaacgcaatcgcttgattacgatcaagcggtggcgtgcaaactcattggtcagtctcggatggttgcttggattctacgcccgattggccattaaactctgtggaccgttttatcgtggctatcgcaaaatggttatcagagtttacttggaggcgttacgtgatgcgagtcgcgagcgtgagggcttgaatcccaacttcatgccgggacagaagttttagtgtgggcctgatcgtgagctgtctgatgacatgggaaccgtatacaggcgaaaccagtgattattgcaatttaaggtcagattactaaaccaggccgactcaattttggacatcagcttcatcattattaacaacgaattaaaagctagttgtgctgagaaaaaacttcttggcacaactagttttgtgttttggtgacattttagacggaaaagcaaaatttaatttttagatttattttgtaattcgaatggataattttactgtttttacagcaacgtttattggtcttttgaccagtgaccaccagaaagcattcagatgattgcttgtatttagtcgcaatggttgaaaccggtaatcataatattatttgttatttagatagtaaacttaatttagcaagccccaatatttgattaaaacccattatatccgtatgttgagcgattgtttatcacgtaatgtttgttataattcaccaagaacaagttaattttgggggaattcacatgaacgaacaatacgattatttggtagttggtgcgggactatttggtgccgtctttgctcatgaagcagccttacgcggtaaacgggtcaaagtgattgaaaagcgcgaccacattgctggtaatatctacactaaggaagtggcggggattcaagtccaccaatacggggctcatatcttccacacttcggatcgtgaaatttgggattacgttaatcaatttgcggaatttaaccgttatacgaatagcccagtcgctaattacaagggtcacatgtacaacctgccgttcaacatgaatacgttcagtgaactctggggcgttcggacaccggcagaagcagccgctaagattgcggaacaacgcgcggcggcgaatctcggtgatcaccaaccacgcaacttggaggaacaagcaattgcgttgattgggaccgatatttacgaaaagctgatcaagggttatacggaaaagcagtggggacaaaaggctacggatttaccagcgttcattattcggcggttaccggtacgctacacttacgataacaattactttaacgatacttatcaaggtattcccatcggtggttatacgcagattgttgagaagatgttagctcatcctgaaattaccgtggaaacgaacaccgacttctttgcgcataaggctgagtatcttgcccaatacccgaaagtcgtctttaccgggatgattgaccaattctttgaatatcagttaggggaattagcctaccgttcactacgttttgagactgaaaccgtgcccgtggataattatcaaggtaatgccgtagtcaattacactgatgctgagacgccgtatacccgtgttatcgaacacaaacactttgagttcggtaagggcgatgcggatcaaactgtaattacacgtgaatttccagcgaactggcagcggggtgacgagccgtattatccggtcaataatcaaaccaacaatacgctctacaaacagtatgcgaagctcgccgcggctgaaccccaagtcatctttggtggtcgactaggccagtatcgctactatgacatgcaccaagtgattcacgcggccttagtgacagtcgcgtcggaatttgcaacgaccaaataaaagaatgtgtgatgattgaagatgagaaaacggctagcaattgtgtgggggagcctagcattgctcgcactattattgggatatgcttgctacgccctgagtattcagcgcggtcaagacacggtcacgcggatttatcaaactgatcaaaatgggacgccgattatttcacccggaccaattaccttagtaggtaaggtcaatcaccgcaatttatttcaatctggcattaatggctatgtcttaacgactcgcgatccattgtcgactttgttgccgcgccgtaatcaaacagtgcatctaaagtatcgttctgcacagacgacggcggagctacgcaagacgctacgtcaagcacggtatttacaagccggtactcagaataccgccacgccggtctttcaaaatcgacagcagcgaggtgatgcgacaacgtacggtcgtatcagtaccagccaagacggccggatatggacgaaactacccattagttatccgcatgtgcaattgtcacggccgagtgtctggtacgcgaatggccgcttgacgttgatagatgggcaagaccgttactggacgactaattttaaagattggcaacatcaacggttgaactttaacggggctgattttaagcaaggtcgggttcaggccgtctttccaggtacgactcgttcagcggttgttatggttcgcggcattgatcgccaaagcagtcgcgccaaactctattatggacagctcacgaagactggacggatcaaagcttggcacgcgttacaactaggaaagctcccagcgcgccaagtcgctggaatgagcttgattgatcaacacttatacctgtttcgtcagcgcggtacgcagttggccatttatcgtgccaatcggttgacgcgtccggtcaggttggttggtcgcgttaagctaaatcatgcgcagtcacaacgagtgaccgcggtgaatttgataccgaccaccaagcatcgctaccggttaatatttgacttgacgacagctgaaaaagttcagaaacagccacgttatcggttacttgatcggcgatttaaagcagtggggcagcagcatctattggtcactgattatctctggagccaatttcaaattagtctacgtgggagtgagtgaggcacatgaaggtacagccaaaggaacgctttagtctagcgtggcggtggttgccgctcgaattgctgatcattatgctaagcgtcggccttggatgggcggacaatcgatggctacctaagccggtgtatcaagcatctgttgatattcagattgcgcaaacgccgcgttcagggctgtcaacagcccgtctaaaacgtcagcgacgccaggatatcaaagctatcacgcagttcaacgtgatgccacaccagagtgcagtgctgactcgagccagcacttatgcctatgcgcattatggcatttggcaaccgattcaggaactgagtgagtcggtccaagcggcaccagttgcgcggcgaccggtcttgcgagtgacagcaacgagtagttcacggcaagtggcccagcagaatgttcaggcgttcaatgtggcgattaaagctaatctgacgggcttaaaaaattatcgagtgaagacagttaaacgtaccgtaacgcgtgagacgaacgtgattcgcggggcgctttggaagttaatattagttgttgggggcggcttggcgttgctgagtccgtacctcgtgaaatatggtcagggttgggggcggcacgatgatgagacgtaggggagcaagtatgcagcagcaccgtaatgtgctctatctgattatcttcggaatctacttagcctcagtcacactacagacgacgacctttaacgagatgataccgcatcgagtgggcgttttgattgaattagcgactttggccgcattactgggcctcgtggtttgcttagataccttgacccccggccaaattattggagaagtcagtttacttgtactggtgactgtcgtgacactcacatcgggtgcgcattatttgatgccgacaatcatgttggtgattgcagcccgggaagtttcgtttcggcagatcattcaagtttatctgggcgtcgtggggacgattctcttgttagcgctagttgctgcggaagtcggactgattaaaaatattacgtttgcaactgccgatgggttacgtcagtcgtttggtgtcgtgtataccactgattttgcggcccatattttctatctgtgtgcggcgtatttgtatttattggcccgtcgttttcgattagtagcgctattacccgtgttgtttggcctggcaatgatttaccagtttacgaaaacgatgacggatgtgattgctttactcgttttgatcagcttgtacttggtctatatctatcgccgtcagcttcggtggcttcggccgatgattcggtatagctttttgatgttaccacttgctagtgggctaattattgggttgtcgaatatttttaattatcaagaccggttgctggtagcgctcaataataccttgtccacgcgactcgcgctagggaataacgcgttattagcatatggcgttaaattattcggccaagccccgattccaattaatggttggggcggcgatcggtttgaaacgtttaccaatggtgttggtgatgcaacgtatttcttcattgactcgtcattcttaaatatgttgatttcatacggattactattaacgctgattataattatcggtatgacctggtttttgtatcaacgtacgcggcaacacgattatttgttgccggtaatctttgtggccattgccatcagtagtatgtttgatcagcacttcttagaagtaacgaataacgtctttattctgatgttattcgctgatttaccaaattatcaaacggcagtcggccccgcatttgaccaacctgtcgttattcgaaggggggcgtcgtgccgatgaatcatcaacaggcttatcgggtccagcggttgatcctgatcatcgccctgatgttaattctattcggtgataccgggatgaacgcggtatttagttttagccaccaaccacaaagtatctggttctatccgcagctcgtcattgcattaataacggcagcgggccccaacttattgttgatggccctgggcgcctatcaattgcggcgcacggcattgaccgtgccacagttgattcgccgagtcttatggataataggcggaattaccttattctcactggccttctatcttgaagacttggtgacccaaggcagtttaaatagttttaacattgccggctttttaaccgcgttagcccaagcgcccgtgggcttttatgacattttgtatgagctgttgggcttctttgtcaccttgccgttgttaagggtgattgcacaccatgcgagtgttgcgattcagcaatacctattttgggcggagctcgtatttattggcatggtaccaatcttggcctatttcactggtttgacgacgatcagtgttaattcgccgctcgcgattacggccggttgcttttttgcattgatggggtattggttgagccaaacggaggtgttacaccggattacgcgagaacatctcttagtggcgtggctgctgacatgtgggtgctatgccgtgatggtgtcggtcacgatgtatcaagtgaatctggaaaagaattttgaccttatcagcagccagccatttgcccaaacctttcaggcaattccatgtttgacgctgtgggtgacgattgccacctggatgatgaaccggccacggtccaaagcagtacgccggcataactttgttcaaacgggttatggtgatatgctggtggccggtctactgattacatcatttatggtcattaatcggttgctgacaccaattattggtgcgtggtggtctggttggctctggagtatcgcggtgctgatcgttagcgttgaactagtatggttattacgacatgtccgctggttgcaacggttattaccagatttatttggtggctcccagttaataggaggctctgttaatgcgcaaaagaattgagtggatcgatattgcaaagggaatcgcaattttagcggtcgtgattggtcataccttgggcccctataacgggcaattcttcggtagtttgatcttcgcctttcacatgccgattttcttcatgttgagcggttatttgtatcgctcacgcccggcacgacaagaatgtcagcgtggcatcattaacctattactaccgtatctcgcaacggcagttgtgctcttagtcgtaagtgcgatagcccgattattaccgaatccgctccttaatgcgtattttccaagctggcgacaaggactaattgccacggcatacggggccggttcggcagtgttcaatccgtggcactggcaagttcaaccgattggggccgtgtggttcttgctcagtatgtttattgcgctgcaactgttcaatggtgtgatgctactaacggcccgacgtcatcagcgctggcgtcaggccattgtacggggcggggtgttcgctattttcgcaatcttaggtggttggctcggtcatgccgcttatttaccgtgggccgttaacgccgcgttgttagcacagctctttttatatgctggttacctcgttaaacaaacagccctgctaagtcggatatcatcagcttggtatttattattcacgttcatgtggttagtgagtgcttttcagggttattttgcgttgacagttccaacatcgcctaatctgttgattagcgtcatggggggcgttgctggcagtttgtgtatcattcgcgtcagtgactggcttagtcattatccgaatgcgcggccgattaagtggttaaaacgctacggtcagttatcgctagtggttctgtgttttcatttgatcgatctaaacgtgattggcattgaaggatggttgacgaatcatttgattacccatatgggaccactcgtgacgacgatcatcgcaatcagttaccggattggcttcgtgacggttgccatgctggcaattccgcatcttccgggaattcgagcttgttttttacctcggcagtatctatttcgccggctacaacgtcgttaaattactgtgtataatccggcaaataccgagataattaattgacctaacagtcacgtgcaaatacttgcattattaaatgatggaaaatttatcatgatttgaagcacaaatttcataccagagggggactggcaaatgaaagtacaaatttatgtagcggctcataagccgtatcaaatgccacaggatccaacttaccgacctatttttgttggtgctgcgatccatgggggtgcaccacaaaattatcaacctgataacgtcggtgacaacatttcggcaagcaacccgaactttaacgagctaacggcgatgtactggatctggaagaactgtcatgcggatgttaagggtttgaatcaatatcgacgctacttgtctgaggcacctaaacgcaaattagccggtattttatcaatgaccgaaattgaaagtttattgcagcaatatgatgtcatcgtaccaaaaaagcgccattattatattgaatcgaattattcacattacgttcacgcacatcatcgggaaccactggacatgatgcgaacggttattagtgaacgtcatgccgcctacttagatgattttgatcagttgatgcatcaaacgtcggcgcacatgtttaacatgatgattatggcgggtcctaagtttgacgactatgccaaatgggtctttgatattctgtttgctgtgtgtgaccggatcgatattgcggattacgatgtccaagaagctcgcgttttcgggtacttatctgagttcctattggacgtgtggatcaaccataaccaacttaagtacgtggaagtcccggtaatgtacatggaaaagcaacagttaccggcgaaagcgtataatctgttgaaacgtaagttctttccacaagctgccaagcggacccatttttaacgtttgacatttcaatttaatgcagacaaattgaagtgttgagtaggtgatcctggtgtaccatgaacatcaagtaacgtgtatcgataaccaccagtacgcgtttaatagtgaccaggtcatattaataggactgactttttaacgacagatagtttagttcacgatacttgagtggtgacaaacctacagcctttttgaatgtttttgagaacgtaggggtgtcataaaagtgcaataaagatgcgattttaccgacagatagctgacgttgtagtaacaaacgcttggcttctgataatttaatatgctgaatatacgcattaattgaaaatcctagttcttttttgaacagtttttgggtgtaatcattgttcaagtttaaagtatgcagaactccatgactgttagtaagttcttgtggatgggcactgatgtaataagccgttaaagccacttgttttgatagattctggtaagaaacatgaaagtcgaagttgtctaataaattgaaataagtagtaatgatatcattgcttaatggccaaaatgtcgatgatgtacaaggtgattttttaataaaattaaagaaatataatcgcaattttaggaagtcatttaggttgagattgtgggtataactagctgctgttaagctaccaattaagcccagtagaagttgattaagtatttctgcatcgatacaatttataggatgaacttccttgaatttattgatgcgactaattgcgtgatcgaaatcacgtattttaaaaaagtgtatcagatcatgttccaataatgaaaaatttaaaatgaattcttgctcggatgatgagatacgcaagggagtaaagcgtgcaatgttcataattagagaccttccatcataattattaaatttgatattttgcaatacaaatcattcatggacaacacaaaaattattaaatgtaatttattttgtagtagaaagatgttaccattatgattaattaaggcaacaaggtaactttagcatgcttttgtaaaaaatcgtgctatatattctgcgttatcaaataggtaatgctatacttatcgtgaatttaactgagaaactttaattataatgtcccattttacacctatcctttcgcatgattttttacaaaatcgtgcgaaaggatagatttttatgttaaaaaaggataattttggagagcataaaacacactataagctttataaatgtggaaaaaactgggctattatggggattacgttggtttcattgggggtaggtactgttactatgacacgggccgccgcagcagattccgaagtgacgaacgattcagcatctcaacatgtgacgagcatctctactgatgcgtctaaaaatcagcatacgtctagtaatgtgattcttacaaatgatgataaaagtgttagtgcatcaattaatcaagacgctagcgcgagtgttgtcaataaggcggtcagcgcaactagccaagaaaatagtagcgttcaaaatactagtcaggcaaccagtacaagcaaacaagaatccagtagtgcgaaaaatactagtcaggcaaccagtacaagcaatcaagaagctaacagtgccaagagtattaatcaagcgacccgtacaagcaatcaagaatccagtagtacgaaaaatactagtcagacaaccagtacaagcaatcaagaagctaacagtgccaagagtattaatcaagcgacccgtacaagcaatcaagaatccagtagtgcgaaaaatactagtcagacaaccagtacaagtagtcggaagattaatagcactaaaagccaagcccaatcattaacaactacgactacgggcaaagcggttcgtgctacctcgactagtgttaaaaagtactccaccaagacaaaagtgtcatatagcacattgttacagcagcttcgtacaagtaaagcgttgatctctgatgaagcggccttgactcatgtagacaaggacaatttcctaaagtattttagtttgaacggatctgcaacatatgatgccaagacgggaattgtaactattacgcccaatcaaaataatcaagttggtaatttttcattaaccagtaagattgatatgaataaaagctttacattaactggtcaggtaaatctggggtctaacccgaatggtgcggatggaattgggtttgcttttcacagtggcaatacaactgacgtgggaaatgctggtggtaatttaggtattggtggattgcaagacgctatcgggttcaagctagacacatggtttaatagctaccaagcaccatcatcagataaaaatgggagtgaaatctcatcaacaaattctaatggctttggttggaatggtgactcagccaacgcaccatatggcacctttgtcaagacgagtaaccaagaaatttcgactgcgaatggttctaaggtacagcgatggtgggctcaagatacaggagagtcgcaggcgttaagtaaagcgtatattgatggtaactttcatgattttgtagttaactatgatggtgctacaagaacgttaaccgttagttatacgcaagctagtggtaaagtattagcttggaagacgactgttgccagttcttatcaagcaatggccatggttgtcagtgcatcaactggtgcagctaaaaatttacaacaatttaagttgactagcttcgattttcaagaagcagcgactgtgaatgtaaaatatgttgatactactggacatcagctagctcaaggaacagctaattatccagatggagcgtatgtcaatggtcggtacaccactaaacaattaataattcccaattatagatttattaagatggatgatggctcagttaccggcacaaaaagtttagatgccaatggaaccttaatccaatcgggtgacaatggtactgttatctatgtatatgtgcctgaatatatggctattgtcaagacagttaacgaaactattaattatgttgatgaaaatggtcatgcgttgaccactagctacaccgccaatcccatccatatattgaccgtgacgaatccggtggatggaacgacgacaacctactattcaacaattacaacatcgatagaactagatgcgacaactggtagaccagtcgattctggatgggtattgggtaatagtcaagatttcgatgcagttacaaatccacaaatcaagggctatacagtaacaagtactgatgcgcctaattcagatttgcagcatgtgtcagcgcagacggttactggtgattctggtgaccttgaatttaccgtcgtgtacaccaagaatgtcccgatcgtggcaacggaaagtaaaacggtcaatgagactattcattatgtttatacggatggaactacagcccacgatgactatgtggcccagcccatcacgtttacacggactatatttacagatgctgtcacgggtgaaaagacatatgggggttggtcggcagcgcaacaatttgcggccgtggatagtccagcaattaagggctacacaccagatcagagcaaaattagtacgcagaccgttactggcgattccagtgaccttgaatttaccatcgtgtacaccaagaatgctccaaccgtgacaacggaaagtaaaacggtcaatgagactattcattatgtttatacggatggaactatagcccatgatgattatgtggcccagcccatcacgtttacacggactgtatctacagatgctgtcacgggtgaaaagacatatgggggttggtcggcagcgcaacaatttgcggccgtggatagtccagcaattaagggctacacaccagatcagagcaaaattagtacgcagaccgttactggtgattccagtgaccttgaatttacggtagtttataaggctgatagcacatcaacaaaaccggttaaaccagaacaaccaacgataccaacaacaccgacagaaccggttaaaccaggtcaaccaacaacaccgacagaaccggttaaaccaggtcaaccaacaacatcgacacaaccggttaaaccaggacagctaacgacaccagcaaaaccagatcaaccgatgacatctgataagtcggttcaaacaataaccattaagtttgtgggtcaacgattaccacaaactaatgaaacggatcaacaacatatgacgcttagtggtttattgttattagccatgagtggcctattaggtctccttggtatggctaagcgacagcacaaagagtagggcagaagtatatgctaaatcatcaacaaatcaaagcccagtttgaaagtttagaaacactacaatctattcagaagcaagtgcaccaaatgtcaatacaaggacttgtaacaaccgggatttccatgcgtgagtgggaagtattagtctatcttgagcaacatgaacaagctagtgctagtgagttagcaaaagtattcaaggtcactcgcacactaatttctaggaatacttggcatctcattcaagataatttgattcagccacaaattgatcaaagcgatcgacgaatagtttggttgtcattgactactactggtcaagaaactattgggaaagttgctcggcaaatacaggcaaatctacaagcttttgattgtaatcacgaactggctacattaatgaaacagctcagatacttaaagcaacagttaattatactaaacaactaaaaagcaaccctaaagtgccccataaattggatttactccaatttatggggcactttaatctcaaagacccaataacttatttaactttgttgggcctttgtaattgatgtatagagacgacatatgaagttaatgaagattgttgcgtaatttgatagcgttgcgtaatacaggcggttgtaatagtaatatcagtccaagatacaataagacacctacaccaatttgtaaacaaaggtttaagtaggaagctgtcatggtgacgtttaggcgaaatacaaatgtaaacattaatccaccagcaagtgtgtatttccaaattccagtaaatagagattgcgcatgcaagacatgtcgagtgatgaatagttggtagccagtgacacaaacttccgaaatcaaagtggcgcacatggcaccggccacgccccaaaaccaaataagtgggatgttgcaagcgatgttgacgagggccccgatagtgacggaaatcgtataggtcttagtctgcttagtcggtagcagaaactgctgaccaagcacgttgctcatcccaattaggatgatgacgggtgcctcaatcatcaacagtcggtcgactgccccaaatgcccgtccaaaaaataggggtgcgagcgtcgttgcgaccgctgccacgccgagagccattggaatcgcaatcgcgagcacaaagtcaaaggacatgtataagtattgtttgacgcgttcaagttgttgcttcatgaagaggttggcaatgtggggtaacatgactgttccagtcgctgtcacgagcgctaaaacgagcttgatcaacttgtcggagtaatcataaaatccggcggcggttagcgaatccatttgccataacatggtcttattcaaggcaaggtaaaccgtcgtggcgatttgtggcacgaataatgctaatgagggccgcagatgccgaaagagattcaattgacgccagttgggccgttcgacactatgtcgtaagtatggccacagtgtcagattgcccaaaacttgtgagcccgctaaaatcaaaatgtagattccggtatcttgccgagtcttcacgaatatgaaaatcgcaatcacagaagcaatcttgacgagcatgttacggagcacggttttcttgaaatcctcgagacccataaagtaccaagaaatatcaacagcacccgcaataatataaaatgattgatagaaaaaataaatttgcaattggtgctcaaaaaaaagaaaaactaaaaaggcgagataagcacaactgatggtcaataactgtaatatttcaatttcccaaaaagtttgtgagcgttgcccccgattatcgcgaataaaggcaatttcgcgattaccataaattgtaataccgaccgttccgaacaatagaaagtaagtaatgatcgaattggtcgttgcattgataccgacgccggtcggccctaagacccgtgagatatacgggacggttaggaggggcgttagtaaaattaagaggttataccccgctgtataaaagtaattccttatgattcgcatgagtggctccttgtggcagttaagcagtctaacgtcgaatttctcaacattcaattcattgtatcacagccaattagccggttgatagtggttttaactggctagggttggttattaacaaacttattattttataaattagaaagtatttttattgttaattaactgcggagtgacatagttatatcaacgataattaaattgggagactggcgtaatacttggagcaccccagtgagttgtgttcgtgtgcacttatgatcaaggactgaaaatttggccggtagggtcgtggaatcaatgatgattgcaggagaggggagatgattttgatggtatggcgagcgaatggtgcgtggtgtgttcaaatcaatgggttacaaaaacgcgcaaccaaattcccccttgagtttggttgcgcgttttgttttttatgtttaataagcgccattaggcttgaacataatgaccacggtcttgaacagaatgtagacatcaaatgcgacactccgtttagaaatgtaagttaagtctaacttaaccatttcatcaaaaccgacactgttacgaacggttgcttgccatagaccggtacaacctggcttgacggctaaccgttgtttgtcatagtcggaatattcttcgacttcccgtggcaatggcggccggggtccaactaagctcatcgagccttgaaggacgtttagcaattgtggtagttcatcaatgctatacttacggatgaatcgcccaatcttagttacgcggggatcatcctgcattttgaacatggcaccatcaatctcgttatctttaagtaatttttccaacaattcatcggcgttggaaaccatcgagcgaaatttatacatcttgaatgggacttcgccacgacctaaccgtgtctgcgagtagaagacggcgcctttaggatcttcaactttaatcgcaattgcaattagcaagaagagtggtgataagatgatgaggcctaagaggctagcgacaaagtcaaacacgcgtttaatgaactgataaccataacgacgatgctgacgcccggcgtcaatcgtaatcggtctgatttctcgttccttcaattccataagtaacaccctatgcttcctttaaatattttcccccgtaaatcacagccaggttaatctattactactgttcgggttaccacaaactgactatgtatgaaccatattgatacaacctaatgattatagtacaaaatagctatcaagtaaatatgcttgatacgattaactttgcagccttgctaatctcattatagcaaatattgtactggaataaaccaatatttaagctgtaattctttgagggttagatttgactaattgaactttggttaactataatttaccagcatttcacccagttgcaattattagcaacttaaaagcgcgcaactgttagtaaaagtggtgcgtcgtaaaattagttaatgaacagaaaaaatatcagctacgtattctaatgagttatgggtttaggcctaataattgtgaccgggataaaatatgaggggaaagtgaatcaatctatgaaaaaataattgaggtgattatagtactaaaaacggtatgatagtgatgactctgccaattggtgaataaatatttgctaagcattaactatgtgttaacctagcaatcgcgtaatttaagacatacggttagaataagttataagctgaatgaagcgtaaagagctcgttcttatcacggtcattaagtagaagatagtccaaattaatgaatctttttgtggctatggttacaatggctgctgatattggcccatcgttcgaaagtaagctggcaaattttaggttgctacggtggctttctcgcgtgatttctcacacattccctctaggttttcaccaccgttcaaggtacaattagattagagctcaaattcaagtgaaaaggatgtccgatatgaatgacgattggatcacggtttttcccgcggattataataattcgtaccacttaattttgaaacgggggacggcccattatgcgtactactactttaaggttgataagctagatcaacgggtcattttctatgatgacattgagcgtagcggtatttcaatcaagactcagatcacgcggacgtttatgcgggcactggttaaagcaattgattggcatccggtcggtaacagtattattatcgagatttaccctgtcgaccgtcaagagacgaaggcaatgcggctatcttgtgatatttagctctgaagtgattgccaagagtaagacgactttaaatgataaccaaagaatccccggtcaattactgaccggggattcttgtaattgcaggtaacgcgaggttaagcctttggtgcagtgacgattggtgtctcgatggtttcgacgtacttagcggcaagcggttcggcgactaagttttcgccatccttcacgaatagcttggtggcagcgaggtccgccattgccttgctaacaacgtctttactcaagttgtcgttggcgtagtgtaacttcaagtggtgaaccttgtttgtgctagtcttaaagcttaagtctaaagttttcatgggcgcttcctcctattattatgggtgtgttaagcgatgggttgtggatcgtagcggtaggcgttggccaagttagcggcagtgaactggtcgcccgtcaagacttcgacgatcttgccaaaagcggcaagttgttcgtcagttgcgtcttgggcgattgcgttaaaggtttgcttacgttgttcgtccaattccgtagttgtttgaacagtcagggttgcttttaaccaagttttagtcatgatgagttcctccttgaattttgtggtggtaggctggccagcttacattaatacagacggttgagcctgacgatttgtgcaaggtttgcccaaacttttttgactagcacccatttaatccgcaaactcggtgatggttcgaacggtaatactgatgagcttctcagcgaatagtggggtcagaatggtaatcaagctagtaaggtcgctgtcggtcagttcgcgacctgctaaccagtgttggtggaactggcgttggttagaattagttactgtgagcagtacatgtgtgttcatccaaatatacatcgtgagttcctttcagactgcgacagtcttgttagttaattggtggtttgttgctggtaaagcttgtgggccttgacgagcagactggcccgccagttgtagactgttcggcggctgacctggtggcgccgcatgatactgctaacggtctgttcctcgaaaaaaaattcggtgagataaatccgctcacctggccgacattgaacaaggagttctgttaagagggcggttaattgccaatgggtctcttgttcggtcatgggatcaatggtaatgggcagtgcgtgttccaagttgacttgcgactgggtgcgcaaagtttgtttacgtagatagtcgacagttcgccacttgatacggcgaaatgcaaatttacgaaaatctggtaaattagcgggcaattcgggcgcgtagttctggtaagcagacagccaagtcaggtgggccacggttacacaatcttcgaattgcgggtggtatttggtgacttgggcggcttttaaagcgccgtatagtaaacgttggtgctcgggtcgggcgagtaaatcgaaagccatttgattatcaaaacggtcagcgtgcatctaaataaccccatttatgagcgatttccttggccaaggttgataccagtgtagcgagcggtcgcaactgacgcaggtcgtgaaaatggactgaaaagtgacgatttattttcattattaatgttccaatgagatttggatagattacagaccaaccactttcctagattgtacgtaattgttatgatgtgattaatctaaaataaccgcggacagcgggggctcggctggtgaatgttagagagaaataccgactttgagggggatttaccatctatgaaccaaaatattgacgttccacatcacgttaacactttttggcagtgccacgctggtacttgggacacccgacagccacaacgattattagtcatcgcgcaacgctcagaacttgccacaatcgacgtgctggagacactttttctacttgacataaaacacctgacatgtgttgaaaatacgctaatctttgatcgtcaacggggattgatcaagacaaaactgacgacgcgccagatcatgatgaattacgctggccgtctggggttatctgggacacagttgatcaagcaactcgccggtgaactcggtttatcgaaacacaagttacctgtgattcacggtgatgcgatcctgatgccgttaagtacggccaaacggggaacaaccagctggtacaatcggcattatttgaatcatatcgaggctcaaggatttatgacggccttagtttatgatggtcaaattacgattcaagtggatatgagcgagcgcgtggccactcgccaacttgtgaaggctggtcaattacaagcggcgctccaggaacatcatcgtcggcgattagtgcccgatcaatcggtaccttcaatggcggacacggatcacgagatgatgcagtcgtatactgaccaagtcttaaagtactttggcatcttagcacttcctggagaaattagttgtttgacgcggcgatttttcggtaaactataggagtaaagattaaatgatgggagttggtgtcgttgactaagaaggtcacgaagattgtcgcgcaaaagcgagctggacgttataacatttatttagacgagcagtacgcttttccaatcagtgagtcggtgatgatcaagttccgcgtttttaagggcatggaagttgatgaacaactgcaagcagcgatgattgcggcggacgatgtctccaaggcgtatacgcgcgcgctggattatctctcacatcagttgcgtaccgaaaaagaagttcatgacaagttacgggatgaagaaattgacgagtcggttatcgacgcgacgatgcaacaattacgtgagttgcggttattgaacgaccaacagtatgcggatgcctttgtgcggacggccaaacggaccagtgacaaggggccacgggtgattcggcagaacttacgacaaaagggtgtgggagagcagctgattgatgacgcgctggccgggcagtttagtgctgaagagcagatcgataatgccagtgaacttgcgcgtaaactggcaaaacggtatcaccgccaagcttttaagaccatgcaacagaaagttcgccaaggtatgatgacgaagggctttgataatgacacgattacggccgcgattgcgagtttggcattagaacccgacgaagatgaacagtgggaagccctcgttgcacagggggcaaagttgtggcaacgcaatcgcaagtatgcgtttcgtgaacgcatgatgcgcacgaaacgcagcctgtttcaaaagggcttcatgatggacgatatcaatcgatttatcgacgaacaagttgctgatgaatgaaaaggttgaattacctgcccgcacgccataaaaatctggtataatgtttaatgaaattcgatgaaaatttaccctcattttagaaagttgggttaatatggcgcgcgaggctaagggacctaaggaaggcgacttcattacgatcaaaagctataagcacgacggaagtttacatcgaacttggcgcgatacaatggtactcaaaacaagcgagaacgtactaattggttgtaacgatcacacactagtcaccgaggatgatggtcgccggtgggtgacgcgggaacctgcaatcgtttattttcataagcattattggtttaatatcgtggcgatgattcgcgataacggcgtttcatactattgcaacttagcatcaccatacgtgttagataaagaggctttgaagtacatcgactatgatttggatgtcaaagtctttcccgatggtgagcggcggttgttggatgttgatgagtacgaagaacacggtgcccaatggcgttattcggctgatactgatcgcattttaaaagcaaatgtgaaagtcttagttgattggatcaaaaacaaaaaaggcccgttttcacaagactacattgatatctggtatagtcgctatcaagaattatcacgtcggcaatagctctgctgacggtctgtcagcggcgtaattaaagtacaaagggagtgactccgtgctggggtgctcccttttgtgttctggttgcgtctcgacattgaataataagagatgattaccagccgtcatggttgacacaagtcatgataattaggacaataaaaagcggcccacaagtcgcctctgtgggtcgggtgaaaataggaattacacttttaagcgccaaagttgactggccgcgaatagccaaccgcgtgccaccacggaacgtagactttttcatttttgacaccattgtcctgagcgtcaatcatctttccaccaccaacataaataccgacgtgtgatatcgaacctgtgccactaccaaagaagactaaatcgcctttttgggcgcgctgtttggaaattttgggatattgtcggtactgagcttgggccacacgtggtaaggttttctgcgcagcttgctggaagacatacttagtgtaaccggaacagtcgaacgtgttcggaccgaccgcaccatagacatagcgatggccaagttttgatttggccacgttatagaggttggtgaaagatctggtgctcttcttgagggagccggtcttgacccagccacgaacacgggtattagcactcgttataaaataataattagccgtggtattattagctaaacgaatttgccgttgttgggtgacaaaccaagtggtattaccatattgtcgaagcgttccccgactctggattttaagattatttgcggcaccactcatgttatagaagccgccctgagtattcttcgtcaggtaggcgcttttagtaagattagtggttttaatgacgcgattcgttgagctggcatcgacgtttggtgcttgccaaagctccaccgtgaggcctaaaatagcaacaatcagtgtgataagacgttgtttcatatgtatttcctccccgaaaatccccatgtccatctcattcaataacgctgaccccatcataagcgctcattataacaaagttgttgcaaatgagttgcggttcgattaagtaatgtctacagcttgagtggattaacaataattgattagatcttgaccgataggagtgacgaacttggcttttttgaagattgataacggtgaattacttaagaatattcggcaatttgccaagaaaaatggattgaccttagcggaagtagcgaccttagcaggcttaagtgcgagtgccatctatagttggaaaaagcacacgccgtcagtcggtacgcttaaggaagttgctcaagtgctcggtacgagttataccaaattggttggtaaggataaagaaccgacagctaaggcgaccaatgccgctgctgttgatcttaaaaaagtgattgaaaacaagaaaaaccagtttgaatacgacggccagccgattactaatgaacagatgaaaattatcagaaacgtcttgaagtcgatgtttaagaccccgcgactttaattttaagtaaaactcggttcttttaggtgcaactgggacctgcttagtgtaaaatattgctcagttacttgaataattgctagcagcgcttgacgggtttgaatgaatggtgcacaatggcaacaattatggaacggattgggagatgggcgtatgaaaaaagttactaccgcattagcaaaaaagaatatcaaccagttgttaacgattgttaatcaaggccacgataccattgaggtggaaaatcccagcacccaagattcagcggtaatggttagtatgaaagactggttgcagattgtcagtcaattagccaaaacgaatcatcatgacatggaattcagttaaataataacaaagaactaatcgtgccagtcaaggttcgcttagtccaataagctaaaggcaccaccaacatagtcatgtcggtggtgcctttttttgcaagtcgtagtacctataatagtgcggattgtgctaagattttctcaatttgaacgccgactgtgttcatggtcgcccattttgcctggttggcaaagaagaccatggcaattttgctgtcgttggagccgatatagaggctatataaactgttgtcggcaccaccaatgcgaattgtcccatcgtcacggtagtagattccgccagaataggtgggttgtaagttggcggccagttctcggaatccagccgaagtgagcagattatgaatgaaggtgtaaaagtcacccacactggcatagaggttgccacaaccaagctcgcttgacagtaagttagtcgaaattgaccggggagttgaggcccctttactgaaggtgtatgggagcggatgaacagcggtggctggtatttggttataaacgaacgtgtgctgcatgttgagtggttgcaaaatatcagcttcgaggttggcactaaacgattggcccgttaattggtcaacgatacctgctaagagggtgaagttggcgttggaatacgaccactggtgttggttagtagacgtcaaatgttgcaatgtgaagtcgatggcttgttgatcagtgctcaaggcctgatctgggacaggttcgcccatctgaatccccgaagtgtggtcgagtaattggcgaatcgtaatcgactgtgcatagggtacttgcgggtaaaagtgagctaaagttgtgttcattgtcagttttcctgcattgatcaaatgctgaataattgcaccagtcactgatttttctagtgaggctagtgggtacgactcgtcaacggtattggctaggtgctgattcaaatcagctgagcccaaagtcaaagttttgactcccgctggtccattgttagtcaggagtagggtgcccatgaaatgattagtggtcatgagctgattgatggcttgtaatgcttgctgggccgtgtatttcgtgacgggtgcggtattgactggcgtcgtaccgggggcgcccgttacagtcgacgtgctcgatgttgcggttaaagtcgctgcgcttgatgtcggggttacgactgtctctggtgtgaccgccgacgttgtggtgtgcctggcaggttgtgtggcactgttctgactaacaacagacgttccagttgcagtcggtttacttgatgtcacggcgaccgattgtgttgtagtcgctgatgtcacagttttgtggtcagtttgtgtggaagtggcctgactaacttgtgttgacgtgctgtttgcactggtcctaattggcacctgacttacagggcttatgctggtactaggttgacttgctggtcgcgtagcggttgcaatctggttagtgtggatctgctgatgcctaagcaccgtccccgctgtggttgccggttgagttgtggtggctgaggaagcagcattagccggagtagctaccgaactgactggagcttgatgggtcggtgccgtggcagcacttgaatgtaaccgaatcgtcacgtgtggttgggttatcgctggtccttgaacggtttgatgatcgttcaacttagctaatggtttgactggtgttcccatagaatgatttccctgaggtgttgaagtggatttctggttcggtggtgtaactggtgttggtgcattcacatgttggggatgtccggctgggctgttggggtgcgctagtgctgggttgttctcggcgtgtcgaaatttaacagtgttgttaggattctgggactgtcccgtagtagtcgtgcctgacttggacgttgttaaagtgttcccagtcttggcgtgaaggggcataactgttttggttggagtgattaaatgttgactttggtgcgaagtaggcagcgtgaatcttaatggcatcttgttgactgaaacccggatatgccgaccctgtggtcctaggatttgaatgtattgcccacgagttgtccggatgggcttgcccacacgtagatgaagttgattcatttaacgcgtacttaattgatgagtcatgatcagttgcagctgccggttggttaaaattggcagcgtcgtggtgtggatactcaattttgctgcccggttgacgggcgttttaaattgttgtcttgtcaaatgcttagtgagcggcattactgtgcgtgcggcgatccaaccattaaaacgattgccgatgatgtgaaagtaaaatccaccaaggccacgatgctgctgagtgattttgaaagccgtgtttatgggttggcgggtgaagtagccgcgccgtaattggtgttgattagttggcaattgcggatagattgtgactccgtggctggtacgtagacgaccgtcaactggtctagttgtggcggtggccggttgagcaagtgccagactactgaagctgatcaaggccagcatggtggttgcggatacccgttttttgaacgtcaaattaattcccccttttagctgctcattaatataaaacggtaatccgacaattgcacggtttttcgaatcggcgttaaacttcctaacatggtttggcaagatacggtgttttttaagttaacgttgttttgacagagtagataaataaaaaccggttaatacgttgtatacgtattaaccggttagcataatgatttttagttcgttgacatttgagtgctgattagtcggtctgactttcagcgtactgggtcttgatataatcagctgaaacttgtaattttttcaattcttcgtctgtgagatccaattgaacttgttcgacgatcccgtcacgaccaacgacggctggatatgaaaggtatacaccgtattcttcccggaaatttgaaacggggagttcggtgagggcgtcattcaagaccgtgttggctaagcgcaccgcggccgttgccacgccataactcgtatattttttgccatggaagacccggaagccaccgtcgcgtgattcggcgtctagtttggttaaatctaaaccgcggtcagcggctaatttggtaattggttgacctaacacgcgtaccgttgaccaagctgtaaattgggaattgccgtgttcacccaggttgtagccggccacggaccgtgaatccaggtgtagtgcactggcgaccgctcgtttcattcgtgcagagtccagtagtgttcctgtcccaatcacatgattctttggcaacccggtaaccgcttggtagatcgacgtgatgacgtccacgggattagtaatgacgactagaattccgttgaaaccactggctttgattttagcagcgacgtctttgacttgtgtgctggtaaagggtaattctaggaagcggtcattagttggtgaatcttgtaacttaatattcccgatagctgagataatgacatcggcatcaatgagactgctatagtcattgataatgatattcgtgtgataaggtaaattaggcattgcatcctgaaaatcaagcgcgtctgcttcaactttgctggtgttcgtatcgatgaggacaaggtcatcggcaaagccattggcgacgatgtagtgagcggcggttgaaccgacgtgtcccattccgataatggcaattttacgtgacataatgtagcgctcctttgaaagtttatcgttcattaattaaattaccattattctcattgattttaaatagattttgtgagaaatatcgaaatcgtattcggactaagtgaaatagggtataattaacgcattaatagttgcaccaagaaagggaggagcgcgagtgtttaagcgcctaaaagattcggccttgttattttggtcacttgaaattttgattgtggcgaccttgatctgggtctgcacgaacattggttttttgtttcagccaatcggcacgtttttaagtgtcgtgttcatgccaattttgatttcaggatttttattttatatgttgaatcccttggtcaagttgttgactaaggttcattacaagaagtttcggatttctcgaaccggagctgtggctatcgtatttgtgctattattcgggttactggtgtggggagcggtttccctattgccacggttagtcagtcaggtgacacaactgatttataacctaccaagtattgccactgagatgcaaaaagccgctactaagctgatcaataatagttcggtactgaaaagaattgacattagctcgtacaccaagcaattcaatggtgaaatcagtaagtattctcagaactttttgtcatcattatcaagtagtgttgttacggtgatttccacgattacgagtgtgacgattatggcaattacgattccagtcgtattgttctatatgttgaaggatagtgagaaattcattccagctatcagtcggttcttaccgaagaaacagcggcctgaagtcattggtttactacaaaagatgggcgacacgatttctagttatatcagtggtcaggttattgagtgtctcttcgtggggacgtttacggcgattggctacatgttgatctcgcaaccatacgggttattgcttggcgtgattgctggattgacgaacattattccgtacgtaggaccttacattgggatcgcgccatcactcatcgtggccttcaccaagtcaccgatgcaggtagtgtacgtgattatcgtagtcgtgattgttcaacaggttgatgggaacttaatctatcccaacattattgggcggacactcaaaatccacccgttaacgatcattattttattactagcagcgggaaatattgccggaattcttggcatgattttagcgattccgttctatgctgtggtccggaccgtggttatttacctctataatattgtcgagttacgaaatgaggagcacttgcgtaagcaaacgacggtctatcagccgcaacctgctaaggcgactaaagcagacttgacgacgaccactaaatcaaaaaagtagtctgtgctataattggtgaattaagcttgaacgtggcataaggagtgattttttgaagaaagtaattacgtatgggacattcgatttgttgcataaaggccatattcggttgcttaagcgtgcacgggccttgggcgatcatttgaccgtttgcgtctcgaccgacgaattcaatgctgagaagggtaagcatgcgtacacctcgtatgaggatcgtaagtatattttgcaagccattcgctatgtcgatgaagtgttacctgagaaaagctgggatcaaaaaatccgggatgtcgttgataacgatattgatattttcgtgatgggtgacgattggcgcggcaagtttgattttctaaaagactactgcgaggtggtctatttgccccgtactgaaggcatctcatcgacgcgtatcaagcacgatttagggatgcaatccaaggattaaccactaagctagatgatttatcagtcacaaaacaccgccgttacccgcaacttcaagctgcgtaacagcggtgttttaattaacagttattagtaagtcacgcctaaatgaccatggactggttcgatgcggattatagttagcattcagccagttcaaagggcttaatggaagatggcgttgagcgccaacacgcctccgagaccgcagacagcgatgatcgtttctaacatcgtccatgtaagcagcgtttgcttgacggtcaggtcgaagtattcccggaacatccagaaaccagcgtcgttcacgtgagaagcggcgacactcccagagccgatggcaattaccatcagggcggggtcgataccagcttgcgtcattaacggcgcaactaggccggctgccgtgagggccgctacggtagcggagccgagtgagacccgtaagatgacagcgactagccagccaagaatcagtggtgagatgctgctgccactgaacaactgggccacggccttaccaacacccccatcaattaagatctgtttgaaggcgccacccccaccgatgattagtaataacatggcaattgacttagtggcatcttcgatggtggccgtgatggccttattggtcttgtgttggtgaatccccattgaccagagggcgaataatagtgaaattaacatggcaattccgggtgccccaatcaaacgaatgatttggtcaagggttgacgggtttttaggtgtcacaccgtgatcaacgaccaattcgtagacggtggtaattgtcatcagaatcacggggaagagcgccgttaagacactgagtccaaacccgggtgcttcagatactttgaattgacgtttgttactgctaagtggcaggtgtggtttaccggtgaatgcgtcaggaaccatcttttgcgcccagcgtgaaaagagcgggcctgcgatataaacagttggaatcgcaataatgatcccgaatagtagcacatgacccacgttcgcatttagcgtcgtcgcaattgcagttggtgccgggtgcggtggtaagaacccgtgagtgacagataatgcggcgcccatgggaatccccagatagagaacgggaacttgtgcttcgatcgcaatggcaaagacgattggaatcaacaagacgatcccgacttcgaagaagagggcaatcccgatgataaatgaggcgactacgatggcaatttgtagccgtttgcgcccaaaaatatccagtagtgtcgtggaaatcgtgtaagcaccaccagcatcggccactaagcggccgagcatggcaccgaagccgaagactagtgctaactcacccagttgactgccaatcccgttctgaatactagtagcaatcttagttaatggcatccctagtccgattccgacgacgacggccgtaacaatcagtgcaatataggtattcagcttgaatttaataattaatagtaatagtagtaggatgccgagtgtaagaacaacaaatggcatagtggacactcctaacgatttagagtagcaatttcgtgatataacggtgccaattgcgccgttacgtggtcaaaaacgacttggtgttgatgatataactggtggttggcggcgttgggttgataagtctcggttgcaccaatcatggcgtgaatcgcggttaaatcatcaatatgccccagtgccttgagtccaatcacggccgctgctagacaggaactttcgaagcttgctggaatcgtaatgggttgtcccaatacgtcagtcaaaatttgccgccataaacttgaacgggcaaagccaccagtggcccgaatcgcatgaactggttcggcagctgccgtcaattgtaggacggtattcaggttcatcacgataccctctaagaccgcacgcgcaatatcggctttggtcgtggtcgtggtgacgcccagcagtgagccgcgggcatccgcattccagagaggcgcgcgttcaccacttaagtaggggtgaaataagagtccgtgggcaccgacgggaacggttgcggcaagcgctgtcaattggtcgtatggatcttgttgattcgcacgggcggtttggctttcagtagtgaagagctcatcgcggacccaccggaagacttgaccaccgttattgatcggcccaccaacaatccagtggtgcggcgcgacgtagtaacaaaatagtcgaccttcaggatccaagtatggttgtttcgtcatcacccgtacagcaccggaagtgccaatcgtaatggccgcaactcctggttcatcagcccccacccccaagtttgaaagggcaccgtcacttgcacccatgataattttcgttgtgggtgcgagtcccagggttgatgctgcgactggtgtcagtccatcgatcacggcgtcggtatcgaccaatggtggtagctgcgtgcgggtgatgtgtgcatagtcgagcgcgacaggttcccaatcgaagttataaagattgaataggccagtggcgttggccattgaataatccatttgaagttggcccgtcattttgtaaatcaagtattctttaattccgaccacgtgacaggtttgtgctagtaattccggtgaatgatgggcaagccagtgaagcttaaccaggggactcatcgggtgaatcggcgttcccgtaaggtgatataggcgatcgcccaggggttgacttttcaattcagcggcgtcttgtgcggcccggttatctgcccaagtgatgacccgggtcagcggctgtttctgactgtcaagtaggatcaaactgtgcattgcggatgaaaaggcgattccttcgatgtcttcgggatcaatgccagcacttacttgatggatggtcgcttggactgcctgccagatttcttgcgggtcctcttcggccgtggtcacggtatcatgatagagtgggtagccaacgttggcactcgcaattacgtgaccctggtggtcgtacaagacggatttggtacttgtcgttcctaaatcagttccaataaggtaagtcatggtgcttcgttcctcctattcgtgatcgacagcgtggccaccaaactcgttacgtagggcggcaacaactttaccagtgaatgtgtcatcggtttctgaacggtagcgcatcatcaaggccatcgcaatgaccggggtggcgacttgttggtctagggccgtgtctaaggtccagcgaccttcaccggatgaatgcataacacccttgatgtcatctagattaccatccttgctgaatgcatcttgagctaagcccattaaccagctgcgaatgactgagccgttattccacattttggcgacggccgcgttgtcgtaagtgaactgactatgctgtaaaacgtcaaagccttcacctattgctgccatcataccatactcaattccgttgtggaccatcttcaggtaatgaccactgccaacagggccggtgtacaaatacccatcgggagcggcaatcgctttaaatagtggttcgacgacttggaaagtggcggggtcgccaccaatcataaaattgccgtcgtggcgtgcaccagcttgaccgcccgacgtcccgacgtctaagaagttgatgtggtgacttgccagtaattcgccgtggcggatactatcttgatagtgcgaattaccgccatcgaggacgatgtcacctgcacttaaagtctgggctaactgttcgataacgctgttggttgccttaccagcgggtaccatgatccacacgatccgtggtgttggcaactggtcaagcaaattggtgagatccgtggccgtcgccaacccgtgagcactggcggtactaagattagtggggttaagatccattcccactggcgtgtgcccgttatcctgcatgttcaacgctaagttcattcccattttacctaagccaatcaatcctaatttcatgatgaaacccctcttttatatgaaaaatattaagtgctttttgtattcgcttacattgtaataaaactatttacataaatcaaccatatatttgtaaattattttcattagactgaaaataatggcaaccaagcccggttttacaggcctgattgccaagaaaaaatttgttaaattgctgaccaaacggctgcgccgatacttgggaagagggtcacgagttgttcacgttgcgccggtgtcaattgatattggatcgctggtagcaacgtgttaatggtattttcggcctgttcaccgagttcagctgcaccaatcaaccggtgctggtcatccgtcacgagtaagttatggccggtgacatcgcgcgttgtctgccggaaccagtcatcctttaaatcattgacggtaactttgatatcatgagtgtcactggttggaagtgtaccaacttgggccaatcgtggggacgtgaagacgaccgatggaatggccggatacttgatgggggcattggtgtcacccatgaataggtgggtcaggtattgcgactcaaagatagcagtgggtgttaattttggttgatccttggcgagaacgtcaccggatgcgtagatgccagcgacactcgtttgcaagtggtcatcgacggtgattcccgctgctgtgtagtccacaccgattttttcaagtcctaagtttgcggtgtttggctggcggcccgtcgcatctaagatccagtccgttgtaaccttgtcatccgcactgaggacttcgaagtggtcaccagtcgacttgatcgcagttggcacccattcacgttttaggactaaaccttgttccacgagaatggccaataatcgttcaacgaatggttggtggaattgacgaagcgcttgatcaccacgcatgagtagggtgacctgactgccggctgttagtgccatgttggcgaattcgagtccgatgtagccggcaccaatcacggtgatgtggtgtggcaaagtggttagattcaaaaagtcgttactgtcatgggcgagttcggttccgggaatgtccaaacgatgtggatgctgacctgttgcgatgacaattttatcggcggtgtacgtcttgtccgccacctgaatcgtatggtcgtcgacgaacgttccgcggccattgatgagggtcacgccggcactagtcattaagccagcaatcatatctggtaagccggcgatgacgtcgcgttcgtggtcgaagttggcttgccaatcaatcgtcggttcaccacgcagaccgtatccttggaagttagcaacttgattttttaatgctaccggctggtctaaggtgattttagcgttgcaaccccgattaggacaggtaccaccaatcaaatcagcttcaatgacggctacttttttgccacgagccgctaacggaatggccccgtcaaacgttccgtgaccgctacctagatatacaacgtcaaatttttctgacatattaaaatcctcctcgttcccaaatcacagttatttaaaaacaaatacattgtacacaacttaatttaacatgccaaataaaacgcggccttaatttaaaagtatggccctgaaatcgattgcaactggtctgtcatgactttgttaagtgaatttccaccgaatcggtgcaagatagtcggtggtactggattttttggtcaaatatcagtaaaatatgtaaggctatgtttttttacggtgggacggtaccaccgtgcacgttgaatatacaggttatgatgaaaggaatttttaatgaataagacagaattaaccgccgcggtcaatacccggcgtacctttgcgattatttctcacccggatgccgggaaaaccaccattacggaacaaatgttattgtttggtggcgttgttcgtcaggccggaacggttaaagcccgtaaaagtgggaactttgccaagtctgactggatggaaattgaaaagaagcggggaatctcagtaacgagttccgtgatgcaattcgattacgatggcaaacggatcaacatcttggacacgcccggacatgaggatttctcggaagacacttatcggactttgatggcggttgattccgctgtcatggtcattgactcggctaaggggatcgaaccacaaacgaagaagttattccaaatttgtaagatgcggggcattccgatctttacgttcatgaacaagttggaccgtgatggtcgcgaaccattggacttgttgaacgaagtcgaagaagtcctcggaatcgaaacttatccaatgaactggccaatgggtatgggtaagggcttaaagggcttatacgatcgttacaatcaccgtgtggaactttatcataatgaagctcatggcgaaacgttcttaccactagacgagaacggtgagcttgatcctagtaatgaattgaccaaggacagtatttatcgtgacacgttggatgaagtcgaattgatcaacgaagctggtaatgattttgacgaagctaaagtaatggcgggagacatgacgccagtattttttgggtccgccctcaccaatttcggggtcgaaacgttcttgaagacgtatctgcagtatgcgcctaaacccgctgctcataagactcgtgatgaccaagtcgttcagccaaccgacgatgaatttgccggttttgtgttcaagatccaagccaacatgaacccgaaccatcgtgatcggatcgcctttgtccgcatttgttctggtgaatttgaccgggggatggacgtggtcttgcagcggactggtaagaagatgcgcttaaacaactctacgcaattcatggccgatacccgtgaaacggtggaaactgccgttgctggcgatatcgtcggcctctacgacacaggtaacttccaaattggagatacgatttacgctggcaaaaatgcggttcaattcgaaaagttaccgcaatttacgccggagctcttcatgcgcgttacagccaagaacgtcatgaaacagaagtccttccataaaggtattgaacaactggttcaagaaggtgccgttcagttgtacacttcatattcaacgggtgactatattctcggtgcagtcggtcaacttcaatttgaagtcttcaaattccggatgcaaaatgaatataattcggaagttgtcatggaaccaatgggtagcaagactgcccgttggatcgatcccgaacaattggatgaaaagatgtctagttcgcggaatctattggtcaaggaccgttacggggcaccgctcttcttattcgaaaatgcctttgccgaacgctggtttgcggataagtatccggatgtcaagctgacctcgaagctctaggatttatattgtggtttacacttagctgaccaatctagttagattactgttcgtcagtcgatgtgcgtcctatttcgacctccggggctgggtgactattgctggaacgtaagccgacatcaatttgagttaacgcacaacccgcgttagctcaaatacgagtcttattctaagccggaagaaaatcacttccagctaagaataatttggctactgagcattgcctagccaacggattaatgcggttttggcattagtccgttggcgtagcaagcacaggcttcagtggcaccgagcacgtttcgggaacccgctcgaatggctgatgaacggccacttaacttggtgcaattgggcgctaactattttgatactggaactttgaataaaacatcagggtgcataaacgactttgtcgcacattcaattttgactacagcggcttaagatagtgagctattccaatatcattttcagtctgatagttgcttagcaaaattaccgtttatgaaaaacaacgaccaattcatcaaaaattgggcccctcaccgtctgctattcgaatactatcccgactggaaggcgtttctgccaatgctcagcggtgaaattccacttagcaagcgtctttggcttggttagtggaagaccagtcagtatttaagacgtggtcttcggcttaaatctgtgtccaccgcgttccagcaattggcagaaatgcctggaagtcggtgtaggacgcacctaccaaaaaagtttacgctaactcgaacttttcccagtgggcctaagctggctgctcttgatttaacggatagaaaaattacaacgtgtctcaagcaaaagcacgaacaaatatgcgaataattcataaaatgatggggctgccaagttgatttggcggtctcatcattttttgtgtggcgggaccggatagaagtgatatgagaggttcttctaacatgcttatcggtccatgtaaattcaccatgtaaaccaacgttgtagcactgctaaggtgagagaattacgatacaatcaatctgcaatttagattgtagggggcgatgagattgaaaataaggggacgctggatgctgggattgatgttaggaatggggttgtggggcccgatgacggtgcacgcggcgacgaacttggtacggtggccagcggtgcaaagcttagcgccccggaattgtgaacttgaatcgaaacaaacgcgcttatatcaattaaatcgtgcaacgatgcaattaacgccacgtgggacggcccggacgactagtcactggcaacgggttggtcaggtgatggtgacacaaaacaagcggttagtgacttattggcaggtgcgtcacgggactgctgggcgactgagttgggcgttggcggacaccgtacgggttgtcggaaccagggtcactgatattaagacgcccacgcggcaaccgatgcgcgtggtgacaacggatcaacaggaacacggggtgacgcgcgcggccaataagctgagttatttgcccttaaaaggggcgggacggtacaccactgagcatattttgtttcgtcctaccgccgcgtatctagcgactcaagggctacaaaatcagccagacacgttgcgccagagtagtggctatcgcgaccattatcatttcaaaacagcactgtatttaccgcaacagttagggagccgcttgttgaatgacccacagagtgcgacgttttcagctgacaatcggtacttgtacgtcatgtacgtcaatgatcaacagttgggtggcgccgaccagactggctgggtcgttcgctatgattggcaacgcctgatggctttaggggctgggcaatcagggaagatggcgatggtccgagtagcagcagctcaccaattcgacgggaagatgacggcttttgaccgtcgggtgctggccgccattgaagtggggccggagtttacggcgggacacgttcagtcactagctttaaatcctaagacgaacgagctgtggtttatttcatcgacggcacgtgatcagcttgcaagtgttgcgcgactaaatccgcaatccctgacgccggatcttaaaattgcctttactactggtagcgggcgtctaggtgatgaactgacttttgatcgcgctgggcaggcctattattggacgcatgcgagtcagctcagaaatggcaatgtcacgctttatcgtggcacaatcagttcgacgactggtgtacattttgaacaactcgcgcaggggttagctaataatccgggtttcttcgctcaatcgattggatataacgaggttactggtcggctctacctggtctccgatgagagtattacgtcacttccagcggctaaactgggacacttgacgactagtcaggtcggtgaggcgaactttgctggtgatcgcgagtttgaagggttagtcttcatgcaccacagccaggaaggtttcttgctgacgaatcggggcatcgagttgatgcgcataattgttgataagtagatattaaaatgcaccactcgctagattagattgaagctagcgagtggcgcattttagcatggttcgcgttaatcgaacaaaagtcttgtttaagcaaacggtggatctaatttcgttaaataacggcccggcaagtaaccttgatcttgcaggcgataccagacgaccccgttgtcgtcggccattcgctcaatcaaattgaccgtgtcaccatgagtgacggtagttaaatagcggccatatggttcgatgtatgtgtggacctgtttgccagggacaaaactgacgacgccggtttggcgaacaggccgtttattttggacgcggtagccggctggcaacttgagtaacagtgtgtcaccggtagttaattggaggtgcgtctccggaatccactgatcatcgccaatcgcataccaggtctcgtgagtgactaagcgaacgcgcatgtacgttttataagtgctaccgggctggagcttagttaaatagttggtcgtagttgccccaggatacggataaacggcggtcaacttgttgacttggacaaaaccagtactgaggtcagtttgttgccaattttgattgcggtagaaaaaaaggaccgtcttggaagtggtcgtgtattccccagtcacgtcgcctacggaacggaggagcttaaaaccggcgacggtcggcgcactgacttcgtaaggggttcctaatttcccccggtacatggtcggccggccaattagttcgcggcggtcaatgtcataggcgtacatccagactggttggccagcttggcgttcgtaagtcaacgtgatgctagcctgtggggtcgtaaaccagcgagtcaagccttcgatatggacgaggtggtagccggtgatgctgacggctggcaagtgaatctcttcgccaatggtgccagcaatcatatcagcagcctgcagttcattgccatcctgatctaggtggtgaacgagaactaatgcttctgtttggttaactgtaggtgctgcggcagtttgtgcggcaatggaacgtggtgcctcagtagcgcttgtggcggcttccgtgctgtttagtgcctgaagcattcctttaagtcggtcaagaaacgacacgtgaccactcctttcattaataaattaattatcactagtataacgcattcacaagggttctggcacgtcttaaataaattgtaaaattcccgctttgtcagtcgtgtatactaatatttaataacagggggcgttaacggatgaatctaaaacaattacaatattttttggccgtggcagaggaaggtcagatgacagcggccgccaaacgcttgcacgtggcgcagccaccactgagctatcagattaagcaattagaacttgagctaggcgtcaccctcttcaatcgcttgcctcagggtgtgactgttactgaagctggcaagctactggtggggtatgcccaacagctcacgcagttgtcggcgactgcggagaacaaggtccgggccctggcacacggcgtgacggggaccattaatctggggacagtttcatcctcggcaggggtcatgccgaatacggcattactaaagtggttagggcaacatcccgatgttcagcttgcgattacggaaggcaatacgtatgagttgttagacgatctgcataaacggttgctagacgtggcggtgttacgaacaccgttcaacgcgcaacatctagtctgtcgttactttcccgcagaacggatggcagcagtcattccgaagcgatattcacggtttgaaaagcggcgccagttacaactaagtgacctcgctacgttaccattgatcaagtaccgtcgttttaatgaattattccacgttgcctttctggaagcgtcggttacgccgacttacatcatgacttgtgatgatgcccgcacggcgatgcactgggctaatcaccaattgggagtggccctggtgccacggtcattggctgaaacctatgacggtggtgacgtgctgattcgatcattggcggatcatcgttttcagactcaactggccctagcaacgaccccggaagccttagcgaccccattagttgccggtttgatggcacaattccagcaagcgcagtcgctagactagtttaatcagtttgatatctaaaaatttaatcgcggttaagggtgaattgctgatttaatcgggttgttaccgattacactagctagaaattgaagtggtgttttcagacgcaaaataagcctaatgactgtcgtactggggatacgctaaccttcatttaataattagatatcaatcggtttaaatggtacactaacaattgaaatttaaagggtgaaggtgaaggaaatgatttattcgttagggctaatgctcggcgttggggtaattgccggaattttcggtgctattttaggtatcggtggtggcatgatcgtcacaccaatcctgacacttggtttgggattagatattaagtatgcgattggggccagtattatcgccgtgattgccacgagttcgggctctaccattgcatatttacgtgatgagatgttgaacttacgcgtcgcgatgtttcttgaaattgcgacgacggtcggggccgtcctcggggccgtgttgacgggggtgcttaatgcaacattcctgtacttcctatttggggcgctgttagttttcacgacgtataatatgattcgtaaattaatgagtaagaacggtgaattaccgtcagtcaaagatgacaagctggcgacacagttgaacttaaatggtacttattatgataaagcattgaataagcaagttgattatcaggttgaaaacgtgccgggtggtttttccatgatgtttggtgctggtttcgccagtggcttgttggggatcgggagtggcgcgttcaaagtgctagccatggatacgattatgcatatgccgcttaaaccgtcatcagcaacttctaacctgatgatgggggtgacggcggcagcgagtgcgatggtctacttctttaatgggtcaatcaaacccggaatcgcggccccattagctatcgggattatcgtcggtgccttaatcggctcacgaatcatgacgcggctcaagccacgcttgattcgcatgatctttgtgcccgtgatgctctatctgggaattcaaatgattgctaaaggattcggggtgaccatctaatggataagcaaaaaacaactaaagcgcaagagatgcacgccgttgaaatgatgattgggtatattctacgaattggcgtcattgtttctgcaatcgtgattattattgggatgcttctgatgttgattcagggcaatggtggttatgcaaatggtatggaaccccatacggtcgctgatattctagccggcattgtggcacttaaaccatatgccgtgattatgttaggtttatttctattgattttaacgccaactttgcgggttgcggtctctatctacgcctttgcagtggaaaaagatcacttatatgtttggattacgacgattgttctcatcatcttgattgttgcttcggttattgggtatctcggtaactaggctagacggagctgattaatcaggttgagtcgtgattaaaatgggcgcacatctaaaatggctaccagcttgtttcgaggttaatgtggaaagaatctaagttggtgtaaattcacgggctggtgtgttttatgccgatgtacgagtacttaactagccaatattgtttaataataagagaatgctgataaaaaatcagcattcttttttatttgtgcacttttagctgttttgactaacgtaaaaaagacctaatatcgtcatttttatcgttatttgaattatttattaagaaaaattgccgattgtgttcacttgataattgaacactgatgtgagaatataattgcttatatatcagtaatttcaggcatgtttatcagtatggataataatcgcaaaatgaaataattaagacgattatgacgaaataatgataaaaattagagtttaggattgattttaatttatttataatatacaattactttaacttttcgagggaaaagcacacacaaactattttaaagttaggggttgggttatatgaatttcaaaacagctgcaaaagtaaccgtcgttgccggcgcatccgtactattcttagctgcttgtggctcaagcaagagttcttcaagttctaagcaaacggccaattggaccgaatcagccgaattaccaacgatggacatttctaagtccaccgatgtggttagttctaacgcgttgaataacaccaatgaagggttataccgtctcggtaagaacgggaaggtcacacccggaattgcgaaatccactaaggttactaatggtgggaagacatatacgttcactttacggaagaacgcaaaatggagtaacggggataaagttactgccaaagactttgtttatggttggcaacggaccgttaatccaaagactgcgtcacaatacgcatacttatattcagggattaagaacgctgacgctatcgtcaatggcaagaagcccgtttctagtttagggatcaaggctgatggcgattacaagttgacggtcactttggataagccaattgcttactttgacaagctgatgggctttgtcaacttcttcccacaaaatgaaaaagtggttaagaagtacggttctaagtatgggacgagcagtaaggccatggtttataacggcccttacaagatgactggttggactgggacaaacttgtcatggaccttgaagaagaataacgattattgggataagaaagctgttaagatggacagcatcaagtaccaagtcgttaaggatccttcaactggcttgaacttatttaattccaataagctcgactttacgacactttccaacgaacaagttaagaattataagaatgataagaactacttagttcggaagacggcttcaactttctacgttgaatttaatcgtaaggatagcgataagactttagccaaagctttccagaacaagaagattcgtcaggccttgtcattagcaattaaccggaagtcctacgttaataatacgttaggtaacggttcgaccgtttctaaaggttacgtttctgaagacttagctaaaaacccgacaactggtaaggactttacgactgacgctgccgttccttctgcagttgactacaacttaacgaaagctaagaagttgtggaaagaagggatgaaagaaattggtgaaactaagctgaacatcaagcttctttctgacgatactgatggtggtaagaagtctactgaatttattcaaggtgcttgggagaaattacctggtctgaccgttactaaccagaacgtcccattcaagacccgtcttcaacggtcacaaaacgggaacttcgatacggttatctctgcctggaatgctgactttaccgacccaatttccttcttgtcactcttcacgtccgacaactcatacaacaatgggaagtatgacagtgccgcatacgacgatgctgtgaagaaggcggaaggtgccgatgccaataacaagactgcacgttgggctgacatggtcgctgctgaaaagcaattgatgaatgatcaaggggtcatcccaatctatcaacaagcctcagcaacgttgactcggagcaatctgaagggcatcatctacaacactgcgggctcaaactacaacttcaagtacatgtccgtaaaataatgatgtaaatccacagaaaaaagtgtgtgtgctttaactgaatgaatgtgaagcaaaggggtaaggattgacacattgttaatccttaccattttgttttataatgagggatgtcattattttttaagttgattttaatagaatgcgaggaattctcatgagaaagtatcttttaaagcggatattttacttgttcctgacattattcattgtggcgaccgccacgttcttcttaatgaagttaatgcccggaacaccgctgcaaaatgaagctaaattgacccctagcgaaaaggcgtcgatcttggcccaatacgggttggacaaacctgtttggttgcaatacttcatttacattggcgggatcttcaaggggagcttagggttatccttccagttctctgatcaagctgtcagttacctgattggtagccggatgggaccatcgatgcagttaggtggtcaagcgatggtcgtcggaatcgtctttgggattatcctaggggccgttggggccatcaagaaggatacttgggccgaccgtttagcaaccatcttatcgatcttagggatcgcagttccgagtttcgtgttagccatcctgttacaatactacctcggcttaaaggctggttggttccctgttgctggttgggaaggcttcgcttacacgatcttaccaacgttagctttggccgccagtccgctggccgaaacggctcggtttatccgaaccgacatggtggacgtgctgagttcggattatattgagctagctaaagccaaagggttgtcgaagtttggcatcgtgtatcaccatgcgttgcggaacagtttgattccaatggttacgctgattggaccattggccgccgccttgatgacgggttcaatggttgttgaaaatatcttctcagtacctgggattggggaacaattcgttaaatcaattctggttaacgactacccaaccatcatgggtgtgacgattttctattcagcactcctttgcttactattattgttgaccgatattgtctacggaattattgatccgcggattcgtttaaatggaaatggggactagttaatggcagaaaatccaagtagtatcgatattaagcccggcgacttcgagccgttagataaacaagcgggtcctgataatgaacggatcgcagcaccttccttaacgttcggccaagatgtatggcggcgattgaagtctaacaagaccgcttttatcagctttatcgtgttagtattcttattcttagtggcatttggtggacgggcagtctaccatgttgatcctaatgcacagtcgccacggtatgcgaacctccctccgaagattccgggtgttagtatccatggcttgaatggtcacttgactcaatctggtaaggacgttgatgcatatgcggcggccggtgcaaagtctgacgtgcattatcttctcgggactgattatctgggccgggacttactggcgcggattatgtatgggacccggatctcacttgaaattgcgttgattgctactttgattgacctgacgattggggtcggattcgggatactctccggttggaaaggtgggcgcgtcgatttattcatgcaacgtgtgattgaaatcctctcgtccatcccacaattggttatcatggtgttgatggccacggccttcacgaagactgggatggcctcaatcattgcggccatcgcgatcactggttggaccacgatggcccggctgactcgggcacagaccttgcaattgaagaaccaagactttattttggctgcgcggacactgggtgaatcacccgtcaagattgcttggaaacatttgttaccaaacctttcaagtgtcattattattcaaacgatgttcacgattccaagtgcgatcttcttcgaagcgttcttgagttatatcgggattgggatcagttcaccccaagcttcattggggacgttgatctctgatgggcagaagaacttccaattcttgccatatcagatgtggtacccagccatcgtgctgatcatcttgatgctcgcctttaacttgttaggtgacgggatgcgcgatgcgtttgatccaaagtcaaaacgttaggaggacggcagcactatggaaaaaccagaaaatgtgattgaggtccgcaacttggaaatcaatttccatacttatgcgggcgaagttaaagccatccgtgacgttagctttgatttacgtaagggtgaaaccttggcaattgttggtgaatcagggtctggtaagtcagtgacgacacgttcactgatgggcctgttagcacctaatgctgaaattaaacgtgggagcattatgttccacggtgaagatattattaaaaagtccgaaaaagacatgcaacacattcgtggtaaggatattgccatgatcttccaagatccaatgacatcattggacccaacaatgcggattgggatgcagattgcggaacctttgatgaaacataagggtttgaagaaaaaagaagcgatcgcccaagcgctagagatgttgaaattggttgggattactaatcctgaaggccgaatcaatgattatccataccaattctcaggcgggatgcggcaacggattgtgattgcgattgcattggtctgctatcctgaagtcctgattgctgatgaaccaacgactgccttggacgtgacgattcaagcccagattctggacttgatgaaggatttacaaaatcgaattgatacgtcgattatctttatcacccatgacttaggtgtcgtggccggaatggctgatcgggtcgcagtgatgtatgccggtaaaatcgtggaatacgggacagtcgatgagatcttcttcaatccacaacatccttatacctgggggttactcaattcgatgccaaccttggatactgaaagtggctcattatcagcgattccagggaccccaccagatttgttggaaccaccagttggtgacgcctttgcagcgcggagcgattacgcgatgaagattgatacggagaaggaacccccattctttaaggtttctgatacccattacgcggcgacctggttactacatccagatgcccccaaggtaacgccacctgctgaaatcgttcggcgtcagcaaaagtttgcggccatgcaaaaaccgcaagcaccaatttcaaatcccgtagcaaaggagtaagtagacatgcctgatgaacgtaaaaaaattctagaagttcgccatttaaagcagtattttaatgtcggcaaaaaagatgaagtccgggccgttgatgacgtctcctttgacatttatgaaggtgaaacatttgggttagttggtgaatctggttcaggaaagaccacgaccggacgttccatcattcacttatatgaaccaactgatggtgaaatcatttttgacggtaaggacgtttccaaattacacactaagaaggaacgccatgaatttcgccgggagatccaaatgattttccaggacccatacgcctcattgaatccacgaatgaaagtcaaggatatcgtggcggaagggattgatattcacggtttagccaaggatgatgcagaccgaaccaagcaagttgaagacttattggagacggttggtcttaacaaggaccactctagtcgttatccacatgaattttcaggtggtcaacgtcaacggatcgggattgcccgggcgttagcggtagagcctaaattcatcattgctgatgaaccaatttctgcgctggatgtttcgattcaagcccaagtggttaacttgatgaaggaattacaagttaagcagaacttgacttatttatttattgcgcatgatttgtcaatggttaagtatatcagtgaccggatcggcgttatgcattacggtaagattctggaaattgggcctgcggatgaagtgtataatcatccgttacacaagtacaccgagagtttgatctcggcggtgccggtacctgatccagagtttgaacgtaaccgtaagcaggttccttatgacgaaacgaccgaacatgacggtaagaagcggcgaatggtcgaaattgcaccagggcactttgtccgggcaactgaagacgaaatcccgatatacaccaagcgggctgttgacgcggggttaattacggaattttctgagtaacggctaataaaacagacggcgagtgcgaatactcgacgtctgttttattattcagtagaatatttaattaactgtttagataagtttattaattaataaccattataattaactcatgttaacttgacatataaatttaatatgtaaaaaatattgatggaatcaattgtcaaaaagccgattaaatcggggatagacggctatttttgaccagctaaactgtgaccggtagtcaaagttatttgtgtaaattttgtaattatgcaataataatattgttaataaagtttgttaacaaatataactattcgtcttaataattgattcgcaccatttttaaaaaaattgcgagtgaaaacgttgacttaatgaggtcgtcaggatacggttatcgagcggcaatgacgaatcgtatcaaaaatattgttaacaggaatcattcgcactattatttttttaaaaatcatgcgaagggacaatggcttgttttgaacggttaatgaaaaaagtacaaatttcgggaaggatgctgttagtatgcaacaaccaattaattatattatgaatatcatgcaccttgaacgggacttaaaacgacttacgtcgaactggtcgtccgccacagggcttagtttgaacgagttacggatcttagtttatgtcgaacaacatcctggtatccagattggtgatgtggcaaatgcgttgaatgtggcgaaagcctcgttggcacaaaatattggcaccttgataacccaaggatggttgaaaagtcaaccaattaaacaagaccggcgtttacgggtcttaacgcttacgaaggctggtcaggatcgaatgaaggatgttgatgcacaattgactaaatcacttgacacgacaccagcaacacagttagcggatcaattatcagctttgcaattataggcagatgtacacgttcacggatattaagtgaagtaatatccttaacgcgggataaaggggagactctttgtcccgcgcttttgttttagcacttaatagtggggagcattataggttaacaattactttgtttagtttactctaggttaagtaatttaaacttaataagattgattgaggtgtaatggagcgtatgcattataatgttgaaccgctaagaacggaccaagaaatcgatgattttttatgggctgtttcacaagcgcgttatggggagcgtaatcgcatgattgttttggttggaattaacacgggattacgaatgagtgatattttacgactgaaggttgggcaagtacgtggcaaagatcgtgttatgatcatggaacaaaaaacgggcaagaagcgctggttgtttttgaaaaacctcaaaacaaaattagcccactttacgcggtatcggggggcaaatgaaccgttattctgtagtggtcggggcggagctttaaccgttaatggtgtctatcgagtctttcagacggccggtgagtacctggagcgggatgatattggtacgcacacgttgcgcaagacatttggctatcattattatcaaaagactcgtgacattgccggattgatgatgattttcaatcattcgagcgagcaggtgacaaaacgctatattggcattgagcgtgataatttggaacgacaattatgggactttaaattaggcgtttaattatggcagagacgcgggctattcatagcgactcaatgaggatttgaggtaggcacaaaaaagagccagaagtgtaaacgattgtttacgcttctggctctaaatttaattatcttattcggacttcgtctcagccgccaaaacaatcttgccgtcttcaacttttgcaaccatgttcttaacgtcgccgtggtccaaatagaaatcggcgatgcgatcttcgatttgttcctggataacacgccggagtgggcgagcccccatctgagggttgtaacctagttcaacgagtttttcctcgacaggttctgtgacgtggacgtgtaagccttggttagctaacatgccgttgacatcttcgatcatcaaaccaacaattttcatcaagttttccttagataaagcgttgaattgaatgatgtcatcgaaccggtttaagaattctggcttgaagtagtccgtcaaccggctagtgatatcgtgcgtcttgccttcagcagcggcaccaaaaccgacattagcttcactgtcgccagtcccagcgttggaagtcatgatgatgatcgtatctttgaagctgacagtccgaccttgtgagtcggtcagccggccatcatcgaggatttgcaagaacatgtgcatgacatccggatgagccttttcaacttcgtctagtaagactaggctatatggatgacgacgaacctgttcagttaactgaccggcttcttcatagccgacatagccaggcggtgaaccgatcaacttagccactgaatgtggttccatgtattcactcatgtcaaaccgaatcatggcatcttgagaaccaaacagttccttagcaagttgtttagccaattcagttttaccaaccccggttgggccgacaaacatgaaggaaccaattggccggccagttccgttcagaccgattcgattacgccggatggcccgggcaactgcttcaaccgcttggtcttgaccaataaccgtactcttaaggtcgggtgctaaggtcttcatttgagcctgttccttagcctgcaagtcaccaactggaatacttgtcttttcttcgacaatttgttccatgtccttgactgttacagtggcagtatcgttattaggctggtctgaactttcatcgggcttagctttttctaacttagcaacttgatcgcgatagtaggcggctttttcgtagtcttccttcttcaaggcgtcctgtttctgcttttccgcctcgtcgatcttttcttgaatcgtctttggatcgaccgtcttcaacgtcaagttcttacgtgaaccagcttcatcgagtaaatcgatggccttatcaggtaagaaacgatcttgaatgtaacgatttgacaacttgacggctgccacaatggcatcttgattgtatttaacgtgatgatagtcttcgtacttcttctgaatgccttcgagaatcttgatagattcttccacgctcggttcgttgaccgtgaccggttggaaccggcgagcgagggcggcatccttttcgatgtcacggtattcgtttaatgtcgtggccccaactaattggaaatcaccacgggcaagggcgggtttcaggacgttcccagcatccataccaccttcagcattaccggcacccatgatttcatggatttcgtcaatgaagaggatgatattcggattgctttgaacttccttcattaattgttgcattcgttgttcaaattgacctcgaataccggtaccttgaacaagggaagccacgtccaaacgaataatttctttatctaacagtttttgtggaacttgaccagaaacgattttctgtgctagtccttccacgaccgccgttttaccaaccccagcttcaccaattaaaacggggttattcttggtccggcgattcaaaatctcgataatccgattaatttcggtatcgcgaccaatcactggatcgattttgccctgtttagcttgcgctgttaagttgaagccgtattggccaaggaggccaccgccgttgttattgccacgacgattgccgccattaggaccagctggctgggtcggtggggtctgttgttgccggtaagcgttattaggatcaacgccaccctgcattgcacggaaaatgtcgtcaagaccaccaaaaccgaatggatcttgtgccatatcagcacctccaactccgttatttggttgctgttcctgattctttagcagttgatagcaattttgacaaaggttgatttgtcgccgctgaccgttgacgctcgtatataaatggatcgtcgcttcgttcttatggcaattgtcacaaagcattatgctgtcacacacctttcgcatcagaaatataactaaatcgattaggatcatagttaaaggttcatcggctctttgacctttgttgacctttgactattagtatagcgaatttacggactgttgcaagtgaaaagcctcagggtcaaaactggacgtgcggccgggataattcgcaatggttgattgattcaattatttctgaatagtctggatagtcgcaactcatagcttgtcatgtaaccggattcgttgtatattaattatctggttaggataagtgatgatgtaactgtctgtctatattatagtacaaagcggtttttttgcatgtatcgagcctgaccagttttgatgtttgcagcgcatcgtttttcattggtgaccgtcaacagccagtgagcggcggagaactttgttcgtaaatatcagaataatgatgcagtaatgtgtcaacctaactttgaggaggcggtaattgtttggcaacggattatacccagttaatggaagcgttgcgtcatggcgaacgcgacagttttaccgtaacgccggatgaatttatggcttttcacgacgcctatatgaagtatgagtatcgtaaacgagtcattggtacggcggacttagatggccgcattgtttaccatttcgagaaggatggtaagacaaccaattaataggcctagcttgaatgaaagggcttgtattttaattggataattgctatcatcattattaagggctcttgagtatacgtgttggcggcaactcgaattgactcggaaccaattttaaatttatttatcttgaaggagatcgaatagttatggaaaagaaagaatttcacgttatcgcagacactggtatccacgcacgtcccgcaactttattggtacaatcagcaagtaagttcaactcagaaattacgttgcaataccaagacaagtccgttaacttaaagtccatcatgggtgttatgtcactcggtgttggtaaagacgctgacgttaccatttctgctgaaggtgccgacgaagccgacgctatcgcagctttaactgaaacgatgaagaaagaaggattatctgaataatggctgaaaaggtactaaaaggaattgcggccagtgatggtgttgcaattgctaaggcctatatgctagttgatccagatttatcattcgaaaagacaacagtttccgatacggatactgaagttgcacggttacatgacgctttcgatgcttccaaggctgaactaaaggtcattaaagacaaagcggttgaaaacttgggtgaagaagaagcagaagtttttgaagctcatatcaccattttgtctgacccagaaatgctcggacaaattgaaggtaagatcaaggatgataaagtcaatgctgaagaagctttgaaggaagttactgatactttcatttcaatgtttgaagcgatgacggataatgcatatatgcaagaacgagccggtgatattcgcgacgtaacgaagcgggtcttaagccacttgttaggggtaaccttaccaagtccagctttaattgactccgaagtaatcgtggttgcccacgatttaacacctagtgatacagctcaacttgatcgtaagtatgttaagggcttcattactgacattggtggtcggactagtcattcagccatcatgtcacggacgcttgaaattccagcggtcgttggatctgaatctgccacgactgatatcaaagaaggcgatacggtcgtcttggatggtatcaacggtgacgctttagtagccccaacggatgctgaagttgctgattaccaacaaaaggctaaagactttgttgcgcaaaaggctgaatgggctaagttgaagaacgaggccaccgtttctaaggacggcaagcactttgaattagcttctaacatcgggacacctgacgatatggatggggttttggatgctggctctgaagccattggattattccgttcagaattcttgtacatgaacagttcagaattacctgacgaagatacccaattcgaagcttacaagaaggttgtcgaagggatgaacggcaaacccgttattgttcggaccatggatatcggtggtgacaaggaattaccttacttgccattacctgatgaaatgaacccattcttgggttatcgggctattcggatttccctcgatcgtgatgacatcttccggacccagttacgtgcgttattacgtgcgtcacattacggtcaattacggattatgttcccaatgattgcaacgcttgacgaattccgtaaagccaaagctatctttgaggaagaaaaagccaagttggttgcagctggtacgcctgttgctgacgacatcaagcttggtatcatgattgaaatcccagcggcagctattttagctgaccagtttgctaaggaagtcgacttctttagtattgggactaacgacttgattcagtactcatttgctgctgatcgtggtaacgaacaagtgtcatacttgtatcaaccatacaacccatcgttgttgcgtttgatcaagcatgttattgacgctgctcacgcgaacggccgcttcacgggtatgtgtggtgaagttgctggggatcagattgcggtgccattattgatgggcttaggtttggatgaattctcaatgagttcaacttccgtgcttaagacacgttcattaatgaagaaacttgatactaaggaaatggctaaattagctgataaggcacttaacgagtgtgttactaacgaagaagtcaaagaattagttgaaaagaacgtcttcggtaaataaacaatcaaactaagagcaaatctgcggatttgctctttttttgtgggtaaatgcgggtcattaaccagttggtactagccccgggtttagcacgacgggggagtggactacccgcaccggtatgatgagagctggcacagtgcatgacgcgaattgactggacatttaggcattgtgacaattgtccatagttgcgaccgcgctagtcaatgatggacacagggcacattgctactcgctgttgacggtgaagagttggtgtagtggaaacgatgtaatggcggtgttgagtgatgcctagcgattacaattcatcatttcgaattcattttctataggtgtagctggtcagatagattttgtcatgaactcttaatttatattaagattatttgcaactcggatatttaaccaatataatgtttataatataggcattaagtcgaattcgtgatgatcatgaaataatgatctaagcgcggttaagcaacatcgattagcagcacggttaattgatggaaataaggggagaatctacgtgaatatcgggatatttacagacacatactatccacaagtgagtggggtcgcaacgtcaatcaaggtgttacgcaatcaactcgaacgggctggtcatcaagtctatatctttacgaccacggatccccatgttgataagaatatttatgaacgcaatatttttcggtttacgagtattccatttgtttcgttcacggatcggcgcatcgccgttcgcgggctttttaaggcttaccaggttgctaaggatcttggcctggatattgttcatacgcagacagaattctccatggggatgattggtaagtttgttgccaaacaattaaaagtcccatgtatccatacgtaccacacgatgtatgaggattatctacattatattgcgaatggtaagttgttaaagccataccacgttaaggaggccacacgggcgtattgttatcatctgaacgggattgtagcaccaagtgagcgggttgcaaatacactgacgggctacggcgttaaagcgccaattcgcattattccgactggaatcgacattaatcagtacgagcagcagtcgacggtggattatcggcaaagactcggctatcagtctgatacgccagtattactttccttgagtcgtttggcctacgagaaaaacattcacgaagtcattgcagccctaccggcgatcttagaacaggtgccgaatgcccaactcctgattgtaggtgatggtccggcacgtgaaacactggaaaatcaggttcaagacgccggcttaacggcgcacgtacaatttaccggtgaaattgataatgatgaagtttataactattaccagatggctgacctgttcgtttcggcttcgaactcagaatcacaggggctgacgtacattgaagcaatggctgcgggccttaaaacggtagtggctgctagtccgtacacggatcaattacttgatgatccgtcactggggacgacctttacaagtgagaccgatctgatcaaggatgttgtgcgttatttacaacatcccaatacttttaacgatcccaagccacggcagaagaagctttaccaaatttccgcagagtatttcggcaagcaagtgatcaactactatcaagacgtacagctggcgtattctgaatcagcggataaatcggcgaatattagtaattaacgtgtgtcaaatcgtcaatgagcaccgccaaaccggggatgcttattcgacgtatgacgcgtaaggggacgaattatgttagacattaccatgttttcaaaagctgactccgtcaagggtcagggagtcggcagcgcctatttagaattgatgcggttgttgcggacccattggcaggatgaatttaatattaaagtcaatcgatatgggcgctccgccgtttcacattaccatacggttaatccaatgttttacctgtctacgtttatgcctaatcgaggccgtaaaatcggttacgtgcatttcttaccagagacgctcgagggtagcttgaagttgccacgaccattccaaatgattttcaatcgttatttaatctcattttataagcggatggaccacattgtggtggtgaacccgactttcattccaaaattggaagcataccatatcaaaagagcagatgtaacgtatattccgaattttgtcagcaaacgtgaattttacgaaatgactaaggctaaacagttgcgcttgcgccaacaatacggctatgatcaaaataaattcatgattatcgggaccggtcagattcaggatcggaaaggtgttcctgattttattacgcttgcaaagcagaatccagatatccagtttgtatgggccggtgggttctcgtttggccgaattacggatggttatcaggagttgaagcaggtggtggataacccgccagctaatctgtcgtttccaggcatcgttcctcgtgagaaattggtggactattataatatggcggatcttttcttactgccttcttataacgagttatttccgatgtccgtgttggaagccttcagttgtgggacaccagtattgctccgggatttagatttgtaccgggcaatcattgatggctactatcaagcagccagtgatgttgatgatatgcaacgacagatcgaccagttacgccataatccagccgggttgcaattcttgcatgacaaggcggttttggctgctcaggattattcggaagagcgccttgccaaagtttggcatgatttttatttgcaacaggcaaaagaggggtagtcaatgacaagaaaaaatatctggtcattactcgtaatggttgcgttaggcgtcggtatttcgtggtactcactgcgcaatgtcaaactaagcaatctaatggacgatattctcactttgaattggtggtggttattagttgcgttagggtgtgtcggactatacttcggtctggaagccgtggtggtgcaaaagtttgtcaggcaccgttatcggaattatcgctttaagagtgccctgcgcgttcctttagccgagcaactattcaacggtatcacgccgttttcttcgggtggccaacctgcccaaatcttcgtgatggcacaatcagggattgatgctgggcgggcaagttcagttgcattgatgaagtttgttgtttttcaggccatggtggtattgaatttcttattcgccatgttaattggttttcattacttagctgaaaagttaagttacctgtcactatacgttttgttaggttttctgattcactttgcggtgattgttggtctgttgctggtgatgtactggtataactttacaaaacgagcggtgaagatcgtcttgatcccggtcagctggtttatgaaagctgagcgatttgccaagtttgaaaacaatattagtgaaaaaatcgattcgttctacgaagaaagcgttcgaatgaccaaggactggcggatgctggtcgaagcttgtatcgtcaccttcttacagctactgttttactacctgattccgtattttattatgcgggcaatgggaatcgatgatgttaatttgattatggtgactagtttgaacgtgttgatcttcttagtgacatcactattcccgattccaggtggggccggtggtgctgaatttggtttcacggcgttgtttgctaagttcattcccagccacagtaagctgattttagcgatgctgatctggcggatcttaacgtattatttaggactattcttagggatgatcgccatggcgatgcggcctgaaaaagcagaagaaattccgattgcggcacctagccggtcggattcacaagaacagtaattttaatgggccgacatcattgttcgacccatttttcgcggttacgaattaaaggaaggtactatgttaaagttaatcaaacaacggttggtatggggactagtgttgacagcgacagtcagcggggtgttgagctgcaatgtagcggcacacgcgaccagtagtaaggcggatgaggtcaaagccgcctacgtgatggatgccaagtctggtcaggtcgtttatgcgcagaatgccgatcagaaattaccaattgcgtccttgagtaagctcatgacgctgtatttagttgaacgggccatcgagcatggtcagatcaagtggacggatgcagtcccaattcgcaaaaatgtccgtaagatggcaaccagtgcaactttatccgtaatgccgatgcccgccaaggagacgtttacggttagggagttattcgcagctaccttggtagggtcttcgaatagtggtgccattgcgctgggggagtatgttgctggcagtaatgataagttcattaaattaatgaatcaacaagcatccaaatggcatttggatgcgagttttattagcgcttcgggacttgataatactgatttgaaaaattacgatttaaaaattaagggaaccagcgatcaggaccaaaatctggtgtcagcaagggctgtgacgaccattgcgcaacatttgattgatgcttaccccgatgttattcaagttgctaatcaacgttcagtcaaaattcataagtatacggtcccaacttcggtggagatcctgaagggcgccgagtactatgatccccgcgtgccagtcgatggactgaagaccggttatacgaatcaggccggtgcttgcttagtcgctacataccggcagaacggccaccggatgattgcaacaacacttggcggtgcgtggcagtttacggcgaacaacaacttgcggctgatgctcaaaacgaccgagcagtataaacaggttgtacctaagagcatcaattatcagattccggggacgcagaccaaagtgcgtctggtgacgaagtacaattcaaaactgtgggtgaatagtaagcagccaataacgcagaccaaaattgctttgtggccattacatcggacagcgccaaattatctggctgctaatacggccgttcttaaattgcgattgacggatccattgtcaggaacgacgaaggaagtcatttatcggacgcctgaagcgctgacgatgcttggaccacttcaatgggcaacggcgcccgcgaaacggaccaccacgggcacgtatgcgttcgcaaagtgatgctcgcttaatagatcgtgtgatgctgaagacaaataaaggtgcgccaactatcgtaatttacgagtagttggcgcacctttttgagttgaatccaattcagtcattgaaatgactaacagtgatgaactaggacagttagttggtggactgtcgttgcttagttgatacagttagcaggttcctgcatatatgcagtgaggcgatccatggcctggtggagcttttccatgctagcagcgtaacttagacgcacgtagccttccccctcggcaccaaaaccagtccctggaataatcgcgagctgattcttgcgtgctaagtctttacagaatgccatcgagtcttgttcaaagccagctggaattttcgcgaagatataaaaggctccggtaggacgtgcgattttgaaaccgagcttcgacatcgtttgataaacgaaatcacgccgagcttggtattcttgccgcattggttgcgcatcatcgattccgttggtgagggcttcaacaccggccttctgagcaatcgtggttgctgcagtgacgtagtattggtggacttttttaagttgggccgtcatttccttagaggcaaacaggaagccgattcgccagccagtcatagcatgagacttcgataagccattgatcaggatcacttcgtcaggaatgaatttagcaattgagacgtggtcgctaccgtaagtcagttcactgtaaatttcatcggatacgacccacaagttatggcgatggaaacagtcggcgagcgctttgatttcatcttcaacataggtgacaccagtggggttattcgggtagtttaacacgattcccttgaagttctcgtcaggatgagcagcaataaaatcgtcgaccatcttaggcgtaatgacaaaatcgttaacgcctgtatccatgaagaggggcttggcgtgtgcttcttgaatgatggggatgtacgctggaaagattggggacggaatgataatggcgtcgccaggattacagatcgtcgttaatgcagttgcgatagcttcagtcgctcccacggtcactaagacttggtcttcagcatcatagtggacgccgtactttgtctcttgaaagtgggcggccgcttggcgtagctccaacagacctgccatgccagtatagtgggagtagttgtcatcaatcgcctttttagcagccgctttaacgtgctcaggcgtgttgaaatcgggttcaccgagcgttaacttgaccatatcaggtatcgcactaacttcttcgtcaaactggcggatggttgaaacttgaatgtgactgatggtttcattgagatcgtctctaaatagtgtcatatatccgaactcctttaatttataagttgttctaattttagcacaacttctcaccgtcttagcaggaagttagggtataattataagtgtgaaaatttgtggtaaaaatgggctttctactaaaaaaacgtgttattagtcctattttttgctagaatgtaaacaaaacttgaaggagcgagattagtataatggataaatctgaactatcagcaattctcaaacgactagaagccatgcgcacaactgaagcaaccgaagtgcaatcacggcggttcgaaaaggaaggcgttcaacgtgggcaagtagcgtatgatcccgctacctcgacgtacacgttacaagaattcaatccagaccaaacgtttgaatttgataacattgacctcgtggcaattgaattatacgatttgctaacggataactagattcccccaaaatccagatagattttcgatagatccatattatgacgcgttgtaatgttgaagaatttttgaagaaatcttcaagatattgctaactagtacgcaaccgttataatatggatttgttaatagcaataacggaggaagaaattaccatgcctaaatttataaaaaacacggttgggaaggtcaacacaacgttgggcttttacctcctaaccgtggtcttattttggctaaagacatatatcgcttataagagcgaatttactttaggggttaagggacccgttcaggaatttatcttgttcttgaatccatttccgacagcgatcgtgctgctcggtattgccctatatttccgtggtcgcttaaagtattggattatgatgatcattgacgccctacagacgacgtggttatttgccaatatcttgtattaccgggaattctctgatttcatgtcggcgggggtaattaagagttccggtgctgctagtaataacctcggaaagagtttgggacagatcattcatggaaccgacttcctagtttatgcagatgtcgtgttgctgattctgttattagccttcaaggtcattcggatcgatccacggcctttcaaaattcggtatgctgcaacactgaccatgattggggtggcgttgtttgctgttgacctcggcatgtctgaacatgaccgttcagatttattgacgcggacttttgataacaactacatcgttaagtacttgggactcaacacatatgcagggtatagcttctatcagaccgaaaaggaaagtgcgacgcgcgcccaagcaagtagtagtgatatgaagagtgtgctagcctacctcaagaaaaaccaggctggcgagaacgtcaaatactttggtaaagcgaagggcaagaacgtcttcgtgattcatttggaaagtttccagcaatttttaattgattataaggtcgatggtaaggaagttaccccgaacctgaacaagttctatcatgataagagtactttgagttttgataatttctaccatcaagtggcgcaagggaagacctctgatgctgaaatgatgatggaaaactccttgtttggtttaccaaccgggtcagcgatgacgcagtatgggacgtcgaatacgttccaggcagcgccagcaatcctgtcacaaaagggctatacgactgcggctttccacggtgatgtggctagtttctggaatcgggataacgcgtataagtcgtgggggtataactacttcttctactcttcttactataaagagaagtcagactacaatattggttatggcttgaaggataaaatcttcttcaaagactctgttaagtatttggagcaattaccacaaccattctacgcaaagctgattacgttgacgaaccactatccatacgaattggataagaagaaccagtcgatcgataagacgacgaccggggattcaaccgttgatggctacgttcaaacggcccattatcttgatcaagcctttgccgaattcattagttacttgaagaaggccggcttatataagaatagtatgattgtgctttatggagatcattatgggatttcaaacaaccataaggctgccattgcacagttattgggtaaaaagtcggtaacgagtttcgacttggctcaattccagaaagtaccatttatgattcattctgaaggaatcaagggtggtattaaccacacgtatggtggtgaaattgatgcgttgccaacgatttttgacctgttagggatcaagaacaagggttacatccagttcggaacggacttactgtcgaaacagcataaccagacagtggctttccggaacggggattttgtctcaccgacatatacgaagatcagtgggacagtctatgattcgaagaccggtaagaagctaacggatatgacgacgaagcagaaggatactgtcaaacagatgcaaaatcatgtgacgacggaactctcactctctgatcgggtcatccagggtgacttactacggttctacacgcctaagggctttaagaaggtcaataagtcggactatagttataagctgactaagaccctcaaatcattgaaagagatccaagctgagaagaagacgagtgttctctcgaagcataagggcaaatcaacggagagtctgtataagacggatgcaccagaactgtctagctcaagtgacagtagtagtagttcaagcagtagttctgattaatcgaactcgtatcaactaagggataacgctgacggcgttatccctttttggttgcggaagtaagctgtcacttgttttgaccacagcgcggtacactattattaagccgattgttgcgcagtgtgaattgacactgatggtgaacgatgaagtattaccaattttggagtcccaagtaaatgcaaagttggaatggtaggcgcgtcgcggatgttgtgaaccgataaagtacggtgatgaggtggggaatgctgactgattggttgtcttgatttggtagattgtcagcgaaataatattcattatgctagcgttggtttactttgaaaaacagtcgttgaaaattaaagggagatttattgaacttttgcttgctatcttaataaaaaccccgtaaaatatagtctattgcgacattaatcggtgtttaaaacttttctgaaattaattcataaaaagggttgacccgggtcgttattcttggtattatatttcttgtcgttaagagcgatatgcaacattactcattattatgaatattcaaattgatgtgagcatttacattgaatagttattcaaaataatttataaaaagatgttgacagcttgttctgatgatgataaactttaatagttgcgttgaggtaatcaacgaacgatttagacctttgaaaactgaacaaagtttcgacgaatcaaatgtgtagggtctcttgattttgaatcaagagcaaaacatttgcgaagtcaatt

SEQ ID NO: 726 - DNA, 179812 bp, Unknown
  Metagenome-assembled genome
ctcgctcacaggtaacaactgatccccacgatactttgtttcagtccggtctcacgatcctagttgctccagcgcgtgttttaattgtgcgtgccgcactcgcctccaggtgagggatcgcttaatggcaattccctccgacaggcgtttgattgatattgttccgaaacacagagccgcgaataccacttacgatccgacggaatgacgtaccacggtgtcgctttagtatgcccggtcttgtgatagcatcatcaaatcaacgctgataatcatcccaatactgccgttcctgaatatcggcagctgagaattccagttgttacttgccattttcaatacggcgaataaaacgttgcttctgttccgcctttgcatgtttaagaagaacttgacacgataagtagccggttgttgtttggcacaagtaatcttcagtccgaagaatcgttaaagaaaacacgttcaaaaagcatcatccactttgttctttatcgttaattctcaccgacgtgctcattcacataatttccggatggactcgaactgaacagtacggtccttcataattcacgaccgattgaaagatcccaatcatgccgcgtttggggaaccgatcatgaattcgccataaataatccatgcgcaattttcttagtagtcgggttgcttgaactatgtgacttcacgccttggtggttgaccccattcatgatatggccgaatcatactgttcgtccttacccgccgcatccatcgcctgaaaaatgactaaaacaccaaacggtcttgtgcatataacttaccttgcagttcagtcagttgcttaatattctggcgatttgcgccttgatgaccttttcgtcttcaaattctggatcaaccgccgttgctaatttgttaatcctaattttgctttccagtatatcggtagtgcttttcaaaattcacgttctagcttcccctcaatttatcgataatcgactaatgtcgctagcggttgatgatctgctggcttgccagcaacggccgctttgccaattgaaacgagcaatagtgccgataccgctgggcgtcggttccaaaatagacgtgaatccgcagcatcaaacccggtcatcggattcgtatcaaagccatgatctttagccactaacataaattgcatcgcaatcaggccacatctagggcgccaatggtctcgtcaccagtatcattgttgcccctgactggcctgaaacgctggcgattggtgttgattttcacgatccagcacaaataagacgacggcactggccgtagttatctgacactgactggtattaccagtcgcggcacacaaccgttgtcacaaggctgcatcctcaatcaccaacgcccgaatcggttgttgattcaacgcggttggtgccaaaaatgcggtctgtaacatcgcggccatttcttcacgcccaattttagtttggccgtcatattgccgaaccgaatggcgcgcattcatgattgcttctaatggactattcgtcgtcatcagcttcaccttccttaattgtcagtataaaacagccttcaacatttcgccagtaagcgtggtcgtgaaatatttccgaacatttttctgttcaatgttaatttaattcgccgctagccgttgtcagcatcagctgaaacgtttacaattaaaacatagctttatagcgcttcagacctaatcagggaggatgttttacatggcaaaacgtaaaatgattttagacttagacaccgggattgacgacgcaatggccattgcctacgcagtcggtgcacccgacgttgatttaattgggattatcagttcttatgggaactgcctagtggatcaggcggcgattaacagtttacaaattctagaactactaggtgccactgacgtacccgtctttctaggtgaaccccactccagtacgacggaacactttgacgttatgccgatttcacagcagattcatggcatgaacggtatcggcgacgtgaaccttcctgaaccgaaacgcgccgtggaaaagcagtccggtgtcgacttcttaattgatgccgttcaccaatatggcgccgatctgaccctagtgccaaccggtcccttaaccaacttggccgaagcactcgaaaaagcaccagacattgccagcaccattggtaatgtgaccttaatgggtggtgcactgactgttccaggtaatgtcagtcactacgctgaagccaatattaatcaagatgccgaagcggccaacgccgtcttcaccagtacgatgcctcttacgatggtcggactcgacgtaacgttacggacattattaaccaagactgaaacacaacaatggcgggacttaaagacaactgcgggcgaaaaatttgctgacattgttgactattacattgcggcttacgatattacgagtcctgacttacacggttgtgccttacacgatccactggcagtcggcgtttcactcgatccaagttttgtcaccacgttagacctgaatatgtacgtccaggctagtggtgaagattatggccggacaattggtgaccctgcgcgactcaatgacccaactaacgtcacggttgcgttaacggtcgacaaggatcgttatttgaagacattcatgaattacctgacgacattatttaaagcccattagttatatttcatcatggcaaccggatcacagaagttcgcttccgtgatccggttgttattatttatttacaagtctgctaatttttcatttttccccggcaatttatgttaaattagcagtatcaccattcagaaagtaggtatcgccatggcacaaaaatattacgctgttcgtaagggacgccaacctggtatttaccgcacctggcccgaaactcaaaagcaagttagcggttatccacaagcacagtacaagagcttcacaagcgagaaagacgctcaggattttatggctggtaaggccagtccaacccgactagctcactcaaaatcaatatctaatcaaacgccggtcaacgcagccattactgtttatactgatggcggttcgcgaaataccggaaacgttgccggtcagcacgtgcaccaagatgataaggctgcctgggcttatcggattgaaatgcccgaccaactcgtcactgactctgccggcgaatggggtgccaccaataatcgcatggaaatcatggccttcttacgagctcttgaacaattgcaacagcttggccaaactaagactgggattctgttcgtacttgattcacagtatgtcctcaacgcagtcactaagggctggctggctggttggaaacgacgcggctggaaacgcagcaatggtccgttagttaacgctgagttatggcgtgaagtcgaccggttgcttccagcattcactgcacttaattaccgctggactaagggccacgctaccaatcagggcaatgtctttgtcgatcatttgttgaatcaaactatggatcaaatgcacgctggtcagccggcccaagcctcgactggtgctaaaattagtccacagccagctaaaactagtgtgccacagccgactatgtcgaacccaacaccaactaagtctaatcaatcggccactgtacgctcgacaccagctgaaaaaaagccagttgatcccgaacaagtcgcccgttcagtagcggcaatcaagaagatgctacgcgataactaatcaaaaactgtgaccccaacatactgattgctggaaccgaattccgcaagtcaactgtttggatcacagttttatttcattaaaatttatagccaaccaattttttttagtccattggcgatgccatcgtgatcacaatcggtcgtcgtaatgtctgctaatgctttaatctcagctttcgcgttacccatagcgaccccaataccggcgctctgaatcatctctcggtcattatcattatcaccaaaggccgcaacgttactcgaatcgacattaagtgccgctgccagttttgcaattccttgcgccttagatcccactttgggaatgatatcaaccccgcgttcatgaaaacgaacaaaggaaaactcatctggatgcggcaacaatcgattttggacatccgggtaaaacatcatggcctgatacacatcatggtgctgatagtaatcaggggcataatccaactcaggtgcccgaaacgtgttcaacacctggcgcgtcgtggtggacggatgtgtgtggatatgtagcccatccagtgattcgaccacaatatcaatattctgtttatccgccgccgcaaccaatttgccaacattgtctttagataaggtgtgttgatgaatttgttggcgaccagcaaacgctgctgaaccattgcacagtacataatcttgtaattgtaaggcattaataactggccgggccatcgctaaattgcgacccgtggcgatggctacatgaatcccatcatctctaagtgcttgaatactttcaatggtgctcggtaataattgcttattgcgagccaatagtgtgtcatcaatgtcaaaaactgctaatcttgctaccatattaattgctcctccaagttatcgcgggataaattctgatttaatcaattcatgggtacggctcttgccgattgccaatcgaaatgctgactgacccaatgattctagatgatggtcgatcgtcgaaaactttaatagtcgactcgtcagcaagttctcctgcccaatcactggaatgggggctaacccgtgatccataaaatattgataggcgcccgccccaatatcatcgccatttgcaaaaatcgcggccacgcgagacgcttgattggcaaaatacttaccagcgtggtaaccgtcttcataagtggcagcaccggtatagagtcgctcgtcatccaactgaccatatacttcgtggtaggctcgccgcgtaacccgtgtactagcactaatgacgttattacggctcaaaataacgcccatcgtcgcataaccttgttgcttcgcccaccgtaatgccgtaacatatgaagccatgcggtccgtataagctgcggccaatgcccggtcatcacctggatcttcacaacagacgatttgaccatacttgcggtaacgttccagtgtatccagtgaactactacgtgacgtaaaaatcagcgcatcataggctttacttcttaagtcttctaaataatggcgttcaatcgtcatatcataattagtcggtagcaacatgattttataacccgccgcaaagcctgcactgacgataccatcaactacccgtgcgaaatacgggtgattcgcatacggtagtaccacgccaattgtcttcgtccgcccccgacttaaatcacgagcgacccggttaggtacgtaatccagttcttgcataatagcctcaactttggcccgtttatcatccgcaacgtacttctgatggttaattacccgcgagactgtcgagacggaataacccgatagtcgcgcaatatcatgtatattcgtcatcacagaacttcctctctcaattgatgataccacgttgtttcatataattaccataatttatgaaaccggtaccaggtcaagctgattttactcagttttatgataatcgtcgcttttttccaatattaaccgtatgatactaactatggaggtcgatgacatgtcaatattaattgccttgcaacaacagtcagactttactagtactgaacagcggatcagtagctatattctggcacatctagatcaaatgccaactattctgatcaaagacctagccgctaagacgtacacatcccattcagcaatcattaggttggcccaaaaattgaactaccggggctttcgcgatttccaacggaaattgactgccgaaagcattgcccaggcacatcaagccgccactgtggatgccaattttccgttctcggcgacagattcggtcgccacaatcagccaaaagatggccgccttgaatattcgggccattcagacagcccagcagcaacttgatacgaaccaattagcccaagctgctgacttattgacgcgatcaaaacgaatctttatcttctcgcaaggtgactcacaactacgggcccgtagttttcaaaataaactcgtcaaaatcaatcgttttgctataatcgccgaagaatatgctgacgaatcctggaacgcagccaacttaacagctgatgattgtgctctgattatttcatatgctggtactactaaaatccatcagcaagttgccacctattttcacgctcatcaaattcccatgattgtcctaacaggtaatccacaatcaccactcatcagtcaagcgacccagcacttgctcaccgttcagagtgaatataattttgccaaaatcggtacttttgcatcccaagcggcgtttgaatacgtcttagacagtcttttcgcagtcatgtatgcacatgattttcatcaccatttacaagacctgcgacaaaaacagcacctaatccaggacggcccgctcaccacaaaataacacatctaacgactcaaaagcgcgtcctacagtttctaggacacgctttttacaatatcttctatttattgtgcagccacgttagcaacgacgcattagcccaattgcaatcccgcgctcgctaacgcttggtcaacaacttccatgaccgcttgggaatgatctaattgccgcttaacggttaccatatcgtgattagcaataagacgttcaaacgccacaaactcagcatacatccgatgctcagcttgattaagcgctaaatcagttgtcgttacatcatgtgcaatttcagtgatactttcgaccgtattagtaggaccgttgacaatgatcgaaccagtcgtcccctgaatcgtggaacgtaccggtgaagtcgaatccttggcaccgatacaaacgactttaacattcggataggtcaacactaagatgcctgatgtatcaatatttcgttcaacattagctaaatactgcacgtgcgttggtgcgcctaacaagccaaccacaaaatgaatattataaatattcaagtccatcagggcgcccccaccaagcttaggattaaaagctggtaagatcgttccggctttaaactgatcataacgtgatgaatactgcgaatagttgcattcgataattttcaagtcgcccaacttggtcaaatcacgtttgattgcctgatagttttccaaatactgattcgtaattgcttcgattaacactaagtcttggcgacctgccaattcgattagttccgttaactgggatgccactaacgtaaacggcttctcacaaatgacgttcttccccgcttgcaatgcccgcttcgcatagccataatgtaacgaattcggcaaagcgacgtacactgtatcaattgtcgtatcggctagcaaagctgcataatctgtgtagaccgttccaatacgatacgtggcttgcagctcgcgtgctcgcgccacactccgcggcgttgacagcaatcccaccaattcaatcgcgggaatgctcttcaccattggcaagaagtcctgaacaatcttgcctgttcctaaaattcctaatcgcatcataatcctcctcataatttatattaacgaattaataccggccaaatgcaaccagctaaggcccactgaaaaaagctcaagtttacgtaaacatgcttagccagcgtcggcttgcgccgaccgccaacaattggcaccaacctcctaggacgcgcaccggtagccgaacaacaatctaaagctgacacgtaccaatagctgggctagtgcaacacgcaagaagcgctaatgtcggcattgttgaataccagtttctaacattttcacttgcaacaacgtttcctcatctttgactaacttgggttgtccattgatgatgctgtcgtaaacgccggcgtaaacccgactgtagtcaccaacttccgaaacgactgcctcttcgtgatactgacccgcatcgtcgatataagttaacgtgccatagttttcaggttgatcaatgccaaagtcagcgtgattcggcatgtaaaaatgtttcagatcgtattcctgacgatccttagtcgcctttacgaacatgccctttttgccataaaccacgaagctcggccgtgatttaatgcggaaatagctagattttacagagactttcaaggcaccgtaatacagatcgatatcaaaataatcattcatccggtcacttcccaatagttgccgaacatcatagtgcacgtcatccggctccccgaagtatgcaatcacttggtctaaagtatggcaagcatgaccatataaataactcgtatctaatgaaaaatggtcaacattggttggaacctctggccggaaataatcaaagtgcatttcgacttccagcaagtcaccgaggacgccgctttcaatgaccttttgtgtcgtcaaatagtccgaatcaaagcgccgattctggtaacactgaataaacaaatgcttttgcttagccaattcaaaaagttcgcgggcttccgctgatgtttccgtaaatggtttttccaccaagacattcttaccatggttcaagacatccttagctaccgaatagtgcgtatgactaggtgttgaaacaactacgagctgaatatcagggtcctcataaatatctgctaacgtagtcgtgtaatgcacgtccgcaattggttgccaattctgacgtcctgaacgtgaatagatggtcttcaccttaatttgatctttgagtttcagtgcaaatggtaagtgatagcggttagcactcttaccgttgccgatataagcaattgttaacatcgcgatgtcctccagttaagttgataatttcattatactgacttagaacgtcacgccaagctaatgacataccttaggtcaaaacgttcaataattaacttctaatcggtctgtttttaaacattaggtccagccccaaattaatcattgcagataatacttttattcatatgattgcgttaaaattaaactactttacaaaatctaggaggaaatttggtttgcaaaccgttttcttagtcttattactcgtcgcggctgtcgtcgttgctaacgccgtctacgcacgtttcaatcaaattccagtcgcctttttacaaattggggctgggttaatcttgtctctgattccattgtatcgaaattttgaattggaacctgaaattttcctattcgtcattatttcgattttaatgtttaacgatggccaaaacaccaacattcgcaagctcagtcaccagtttggcacgaccctttcgctttcggtagtgttagccatcgtgaccatcctaattgttggtacggtcactcacttactgattcccgagttttcgctggcacttgcttttgcccttggcgctattattacgccaaccgatgccgtcgcggtctcatcgattacgactaaagttgcgattccaggtgaggtcatgacgacccttgaaaatgaatcactgttcaatgacgcttccggaatcgtggcctttaacttagcgattgctgcgatcgtcactggtaagttttcggtctggcacggagtcactaactttttatatgtttttgccggtggaatcttcgtcggcctaatcatcggttatatcattgttgctgtcaggatcatgctgattcgcatgcgggtcgatacaccttctgtgatcgtcccctacacattactgacaccgtttgtcgtctatttcttagctgaatcattaggcgtttccggtatcttggctgttgttgccaccggtctcattcatggtgtccagtccgatcaattacggttgaccacttcccggctacaaatcgtgatgacaacgacttggtcaatcgtggctagtattttgaacggtattgtctttgtgttattaggtgtgtcgttgccaagtgtcatcaaccacttacagcaacgtgatactagttcagtcgcggtattagtcggtctgggaatcttgctctacctaatcatgacgttcgcccgttttctctggacgcgcttcgacttagcccgtattcgcgcgtgggataatcatgaaaagacccgtaatgcattcgtgatgggtctgagcggcgttcacggcacgattacgctggcgatggccttttcattaccactaacactcaatggcagtgcttttccttatcgcaacgatattattttcgttgccgcagtggtcattctaactagtctgctggtgccaacacttttgttaccgttgacgttgccaaaacaagttgttaaggtcactgaagatgaattggcaaccgccaaagctgacatggtaactcacgctattgatctcatgcaagcacgccatggtaataatgctggcactagtaaagtgattgcgattctgtccggccaacgagtactagatggtcgtcctaagcgctcgcaactggcgagcttgttcgacgccactttcaaagttgaacaaaccactattgatgaaatggttgccaacaatgaaatcacgccccatgccgccgaaaagtacatgcgcgtcgctagtcagacgcgtctgcagaatcaacaaactttcttcgaacgcttgaaattatttttccagtttacactcagcaaatggtcgctcagcaaaaaagctcgtgcccgacgtaaaatgttccgacaataccggccccgtggtggtcagagtcgaactgagctcatgactcgtaatcggcaaatgtggcaacaaatgcgacagatcgaacaaaagccgtatgaggccgtgttagcttatttagccgacacgattactgctgacaatcagcaagctatcgggattgttcgccgcgcctatgatgaacgtcatcgccgcctatctggtgaacgggatttccaggaaactcaaaatgagcttctaattgaagcattccagttggaatataacttcattcagacccaattagccaataaaacattcagctcagaacttggtaaccaactctatgaacaaatttcaactgatcagttagtttacttgcaatcgatcaataccgactaaattcgtttagtaatgtcaataacgtgaccaactgtccacaccactatttgggcatcgggtccgttacactaacgttgtaccattggtcgaactgccaactgaacgtctcaacaagccccccaatcttgtgaccatggtaacctaatgacgcctgacaacttgtcggcgtcattttttatgatatttttgaaacaaaacacttgtcttagagtggctctaaggtgctaatctataaaagtattcatgaatgagaaagtgagcgatagataatggaaacaccgattttagcacgcattgatcagccggccgatctgaaacaattatccttgccggaattaacacaactcgcaagcaagttacgtcacgtcctactcaataaagttagtcaaactggtggtcacgttggccctaacttgggcgtagtcgaattaaccattgcctttcacaccatttttaattcaccagttgataaggttgtatgggatgtttcacaccaatcctacacacacaagattctaacgggccgaaagcaagcttggcttgacctcgctcattataatgatgtcagcggctacactgccccagaagaaagcccccacgactatttcaatattggtcatacttcaacctcgattgccttggcaactggcatggctgttgctcgtgaccttgagggcaaaacaggcaatgtcatggcagtgattggtgacggctcattatccggtggtttagcattggaaggtctaaacatcgcggccaccttaaagtctaacctcattattctggttaacgataatggcatggcaattgcagaagaccatggtggcatttaccaaaatctccgtgaactccgcgaaactaacggcacgagttcccataacttgttcaaagattttggcctcgattatcgctacgttgatgatggtaacgaccttgagaccatgctaacgacttttaaggaaattaaggatgttgaccacccaatcgtgttgcacgtccataccgaaaagggtcacggctatcaacccgcgatcactaataaagaagctttccactggcacgtgccgtttgacctagcgaccggtcagacgttgcatcccaacaccaaggaaacgtatacggatgtcattcatgccacgttagccgatgagttagcagccaagacgcctatcacggcaattacggcggctgttccaggaacttatgacctcaaacgctttgctcgccaatatccagaccggtactttgacgtcggcattgccgaacaagaatcgattacatttgctgccggacaggcccaacaaggcttacggccaatcgtcttccattctggtaccttcttgcaacgggcctatgatcaactatcccatgatcttggcatcaataaattgcccgttacgatcatggttgccggtggccgcattaacgcaggcgatccaactcatcaaggtatctttgacgttgccatgctcagtaatattcctaacttaacttacttagcgccaacgaccaaggaagaacttcaagccatgatgcactgggctctccatcaaaataacggtccggttgccatccgggtaccaagtaatgacgtccagtcagtacctctagcgcctgattttgacgcaactaagatgcacacattacacgctggtcagcaagttgctttactcggtgtaggcagtctcctgcctttagcaacagccgtgcaacaacaattagctgagcaacacattgacgcgacgctcattgatccccgggacatttctgaccccgatacgacgactttggccaacttaaaggccgaccatcagttagttgtcacggttgaggaagccagtctcagcggtggttttggtgaaaaagtcagtcgctactatggcaacagcgctatgcacgttctgaactttggtgctgccaaacgctttaatgaccgtgaaacaactaatgaactgcgacatgaatttaagctgacccctgaccaaattgtcacggcaattactgatcaactagcagaataatcatcaggccagcgactcaactttcgtttacccatcaaaagtctaaccagcatgttgtcgaactcaacacgctggctagactttttatatttaactgacaataacccaatctcagtttaacgattgggaaaacaggacggcggctactgtgccaatttggggcaaaaatcagcaattagcaaacagaacgccggctaataagtcgccattcgcaattatttatattaacgcccaatacctggcgccttggtcggccacaaaatattattaatattttattgttcagaaaagactttcagcaagctgctgtccttatagctccaaatctcattaatataattatttagtcaatccaacgctagttaaacaattgacagtcccatcagagttgtttacagtaaaaccaatctcaaacctaatattggaggcctttattatggcaagtcaccaagccttactgattattgattatacgaatgattttgtggctgacggcggggcactcacttgtgggcaacctggccaagcgctcgcaccaacgatcgtcaaactcgccaaccaaatggctacggcaagcgactgggtcttactgccaaccgatgtccataccccgcatgatccttaccatcccgaaagcaagttgtttccacctcataatgttcggggtacctggggtcgtgaactctatgggccactcaaagattggtacgctgatcatcaagccgccgataatgtttgggcattcgacaagacgcgttacagttcatttgcgggtactgatttggatttacgtctgcgagaacgccatgttgacaccctgcacttagtcggtgtttgtaccgacatttgtgtccttcacacggctgttgacgcctataatttgggttaccaactcgtcattcatcaggatgccgttgctagttttgacgccgctggtcacgaatgggcgttgcgtcacttcaaaaacagcttaggtgcaaccatcgtttaaaaaatgcgcaataaaaatcactcattcaatacgaatgagtgattttttaggattactaaattaattcaaggttggctcaacccatttttgcaacatcaaggtatttaacacaccttcaactaagataactgccaacatgacgagactaccgacccataaagaatcgatttgtccctggttgactagctgactggagagaaagctgaccatgctaatcaacaaattagctaagcggaaagctacgtaaatgaccaccaccgtgataatcacattgacgaaccgttgccgaaatcgtggtaaaaagcccttggtcgcattcgtaacaaaatggcaaagcgttatcgtgctccaaatcagaatcgtcacaagaaccaagactagcaacgttccgagtgcgaactgcacggcactacccgcatcaaactggctaaagaacagcgacgctgatgttaagcctcccatcagttcattccaaccaatccacagagttaagcagaataaaatcacttggaccaaccaaacataaacaatatcaaccaacgaaacgactaaattaatcgtatagcgtcgccaatcgctaattggcaataaccagaacgtccccgcccggaagaatttttcatttgaaactgccaataagataaacccaacgattaaaggtaacgccatccaagcacataaattatagaataatgtggcagctgtgaagtttcctttgatggcagtccacaaactagtgacaatcaccgccaaagcttcgataccaatcaataaactcatttgcttaaagcgtggccaactgagggccttaaatagtgaccaactacttgtcatccgtcacacctcccatatataagctctcataataatcttcaagttccatgccatgttcgtcgcgaatctcatctgcaccctgatgaacaacaattgtttggtccttaacgaccacgatttcatcaagaatcggcgcgatttcagtgacataatgatcactaatcaataatgtcgcttcggcaggcgtccacttgataatactgttaataatttttttgcggctcatactgtcgatcccactaaacggttcatctaataagtacaaagccactttgcgactcagggtcagcgcaatgattaatttctcgcgggtccccttagacaactcacccaatttttgttgttggttgagttccagaaagtcaaccagctcttgatagcgtttggcgtcaaaatcaggataaacaagttgataaaattgcgcgatttgttgtaatttcataccggcactaaaaccagtcaaatgatccgtgaaacttacctgctgcttacgggctacggcagttgtcgcgccattgatcacaatactgccctgacccttggcactacccgtaattagtcgcatcaaggtcgtttttcccgccccattttcacctaataaaccgacaatcttgctgggcgccagggttaattgaacattttgtaaaatcattcgttgattatgtttataacgtaaatccttaatcgtcaatgctgtcatgattgtgctcctctcgttgggcaatgtattgttgcagactcgccacgatttcggcgtcacttaaatttagtgcgtgcaattggtcgtacgctaatgctaattgctcgttcaccagtgtagtcctcaattgcataatatgcgcctgatcttccgttacgaaattccccttacctcgttgggacgtcagagtgccttccgtaatcatctcactgagtgcccgctgaactgtattaacattaaccgtcaagtccaacgcaagctgccggactgcgggcaactttgcccctggtggtaacgttccgtcaatcattttatgataaatatactgtttgatttgataataaatcggaaccttgtcatcaaatttcaatttaacggcctccttggtgtcctattttactattacaatataacacagctgataccaaaagtacaataatgacctactgttacttgtgatagcggttacatttgtaacttgaatctcaatttaggagcgctatacttaaattaggacgtggactaagttcgccacatcacaggagagggatggtagcatgttaaaaaacgaaaacgccattgcgctaattcgcgccatcgatgtcgcttatagtgaccccgaagtacgcgcaattcccgaattacaacaagccttagctaaggccgcacaagacttagactgtgttgcggaccaccatcaagtcgctagccgcctaaaccagttgctaactacttggggggctcgtcattcacaaggccccgccgtacttgaccagttatacctgatcacactcaaagatggcgtcgatgtaccttgccaggtcccataccgggcataattatcttaatatcacaaaagctcccagatcgaatcaatttgggagcttttgtgatattaagaggccgtttgtttgattcctgtttgtcagcaatgatcatccgattccgacctccggggctgggtgacaattgctggaacgtaagccgacgtcgatttgagcccgtgcacaacccgcccggtctcaaatacgagtcttattctaagccgaaagcaccccacttccgactaagaataatttggctactgagcattgtcacccagcgcctccagtcggtaagccgctcgaatggcagatgaacggccactgaactcggtacaatttgtcgttggctattttggcaaaggaacctccaacgaaaatttaaggttacagtaaccgctttgtctagacggtcaattattactatgttgattgagaaaattaccgtttatgaaaagcaacgacaaatccagcaaaagttgggtatatccctgtccgccattcgaatactctcccgactggaaggcgtttctgacaatgcccagtggtgaaatttcacttagcaagcgtcctgtgcttggttagtgaaaggctagtatttgagacgtggtttttcggctcaaatctgtgcccgccacgttccggcaattggcagaaatgcctggaagtcagcgtaggacgaactaactaagcaaggttacgctaactcgcacttcttccagtggtccatagctggctgcttttgtccttgaaagttagcatcctaatatcacgattcatgacaaatcagtgctaattcaagcaagctaacattactgcacgtattgttccaagaatgcggcgacgtgacgcttgtaacgttggtaattctgagtaatggccgtggtgtggccggctcccttcaccaaccataaagacttgggttggtgagcattgcggtacagcgtcttgcccatgctagtcgggacaaaatcatcccgggtgccgctgataatcatgataggcaagtggtttttacgaatctgagcgactgcatccgcctctttgaagctataaccagcacgtaatttagtaatgagactggttacgttgactaacggaaacgcgggtaaatgatagagttgccccgcttgataactaataatcgcatcagcactcgtaaacggactatcgacgacgtacgctttgatctgtggcaactgccgttcaccactggccatcgtcatcccggctgcacccatactgataccgctcatcacgatttgagttgtggccgttttatgtacgacggttttggcccactgcaagtcgtcgcggcgctccagccagccgtagccgaccgcttttccctggctcgcaccacttgctcgggaatcaggaaccagcacgttgtagccgagttcatgatacatccccgcccacgcacccatcaaacccttattcccagcaaatccgtgtgccaaaacaacagtcctcttagaatttttaactggaatataccaagcaaccaaccgtaaatgatccgatgactcaatagtccaagtttgcttacgcgcatgtaaataccaatacttttggtgataaaccgaactttttttcgatagctttgtactctgcgtaacaaatgacttatcaccacgggcaattgccacgtggtaaaaataactgccagcaccaatcacagctcccgctaccagaacaacgagtacccccagtgtgatccaccatttcttcattaaaattcactccttgatgagacaaaaatctgttttgagcgggaaaatttcgccactacttcataataaccgttataattaaagataactagaccagattgaggaggcttctttttatgcactattccaaaacgtgggatttggacagtatctttgctggtggcattgattccccagcactaactgcaaaaatgtccacgattaaacagcagttgaccacgacagcagacaccttagttcactggcgtgctgccgctgacacaccagacgccgactggtttacccaactcgtcaacagtctgcaagccattcaagccggtattgaccaagctaccgttttcgtggttgcttatcaatccgcacatgcggacgacaccaaagccgccccactactgaaccaaatttatcaacttgataatcagttaaacaatttattaacccgcttcaagaagcagctcgttaagttagatcaagccacctttgacacgctcgtgcaacaaccggcactacaagccatcgcctttaacttaaccgaaatgcgtcagcaaggcttagcgctcctagatgacgacactgaagccctaatcaatgacttagcactcgacggttttcagggttggagtgaccactacgacacgttagttagccaaattcaagtgccctataccgatgaaaacggaataacccagcaactatccgcgggtcaagctcaaaacatgttagcagccgccatgccgaacgcccaacgcgccgaattaatgcgcaactgggagcacgcttggcaaactcacgccgctccctttgctgatacgttgaaccacttggcgggcttccgacttgccaattatcgtgcgcatggtacgacgaacttcctacagaaaccactagaactcaaccgcatgagtcaagcgacactagacacaatgtaccaagttgtcgctgacagcaaggacattttactaagttacctgaagcgtaaggcccagttactcggtaaagatcaactagattggcaagatattgaagccccactaaccttgggacaacttcctaaccaaacttacgatcaagctgccgattttgtcattaacaactttcgccaatttagtccaaagatgggcgctttagcccaacacgcccttgaacatcgttgggtcgaagctgagaatcgccctaataagcggcctggtggctatatggaaaatctaccagagacccacgaatcccgaattttcatgacgtttacgggttcacctaatgacacagccaccctcgcccacgaattagggcacgcctttcatggcagcgtcattcaagatctgccactttggcgtcaagattacgcgatgaacgtggccgaaaccgcctcaacattcgccgaactgattgtcgctgacgccagtgtcaaagcggccgatgatgccaaaaccaaattaactttattggatgctaaaatgcaaaatccgttagccatgtttctggatattcgagctcgcttcctgtttgagacgcgcttctataccgcccgtcagcacgggatcgtcactcctgatactttgtcagacttgatgctaaccgcccaaaaagacgcctatggtaatgccttaaatacttaccacccgatgttttgggctagcaagttgcacttttacattgacgacgtcccgttttataactttccatacacatttggctaccttttcagtctcggtatctatgctcaagctaaaacacaatcggactttgaagaccgctacattgccctattgcgagacaccgccaacatgtcgaccgaagccctagctgccaaacacctcggtgttgatctgaccaaaccggccttctggcaagctggtgtggctttgatcaagcgggacatcgatgaattcatggcgttatccgcaccgttaatctaaggaatggaagtgagcacatgtttccagaacgtttaagagcactacgtcgggggcaaaaaatgaccctcgctcaactcgcggcggccctcaatcaaatgccgaccgcagacaagacgactcgtcaaaataccgcggctcaaatcggtaactgggagcgggacttacggaccccgtcctacctagaagttcgtaaattagccgaatttttcaacgtcacgaccgattacttgtcaggtaaatcagaccaagaagagtatgacctcggtcgcatctttttatcgggcaagccgttgacgtttaatcaagaacaattatccagtgaagaccgctatgaactgtttcagttgatggatggttacttacatggtcgccagcatcgagtttcaacggatgcgaccggccaagaagaattagacttacactttgatgactaggagttttttatgaatcccaagaagttaaaacaattaaaaaagcgggtcaaaaagcaagccggtgccccgtatattcaacagttaatgaagtaccgcgacttatttaaggatgatccccaaattctagtactgatcaataatgtcttggaaagtgaccgcttgctggcagccggcttagctccccaacaattgccagtcttagaagtccctgatgattttcaggaccatctctttgagcgcatcaatcagcaatatgccatgggtgatcctgctggtgatgcggcttggaatcaactatcagccgctctcccaaaagttgaccaacttctacgcaactttcgagactatatcgaagatcagtatgggatgtgggcctacatcagtgcgccatttctgaaagacctagctgacttcaccggcagcgcaccagttctggaagtcatggccggtaacggctatatttccaagggcctcaaacgtctccatcctggtcagccaatttataccacggattcaaaggattggacacacgaaactggcaatcagacaggacgccacccagtcacgacgattgaagcgttggatgccgtcagtgccttcaataagtacgccgcaactattaaatacgtcattatggcctggtcaccggacaaattgactattgattgggacttgttacaagctatgcggcaaagtccttacgatatcccattgatcgtcattggcgaaaaatacggcgccacgggttccaaacaattttgggaccacgctaattatcaggataacgaggccgttaccaagttaaatgctcatttccgaccattcgacctgattcacgaccacgtctatgtggtccgataattgaacacgcgttaaattaaagtcgtgctttcaggattaaattctgagagcacgacttttaatttttccgtcatagctgaatctcttttttgccaaattcattcgtgatttgcttaaatcttagcatcacattttcaattgttgcagttgttccagtcccgccaccaacgatgttcgtgaaattcccccggcagcgagactttggtcgtcaaattgattaagcgtcgcataaagccaaattccgagctgcaagaattcagcttccgtcattgcgaactgcaacgctaacaaccgctgagcggcttgagcataggcccttctgtcaattagttgtgccaattcgacttgatgtggcaacggctgatcttgatcttgcggaaacaccacctcagttgtgcctcccttatgacgactaagcgtgtaccctaaccccgttgcgaacgcatgtaactgccgcattaaccaatcactttcatcttgcattagcattaatccccctaattgtgtgccatccaataaatcgctaaaattgtcaaaatgactgataacgtacacatataccagtaaaattgtttttccggtactgttcgaccatgatttccctgataggcatccgccatactagtgataaacgtcgccaaaattgtatataagatcaataacgtaaacgcgtaggccgtccaagccgtccccatcggttggtgcattgcttgcaagccccagccaatcaaccatcccaccaataaaagacccgtaggcgctgcaattaaccgtcgcttcatcctcatcactccccctagaattagcttcattatccgcttttaaaactcccagaccaagcagaatgacgccctaaaattatatccgcataataccaagccttttctgcacgaaatattgttaaaaggttccggttaactcgattcctgttcgtcagccggtgcgcgtcctatgccgacctccggggctgggtgacaattgctggaacgcagctgacgtcgatttgagctaacgcccaacccgcgtcatctcaaatacgagtcttattctaagccggaagcaacccacttccgactaagaataatttggctactgagcattgtcacccagcccctccagtcgggaagccgctcgaatggctgatgaacagccacttaacttggtacaattagtcgctgactattttttattggaacttttagtgaaatatcagtgtgtattctctactttggcgaaatattcaactattactacggtaattcagaaatggtaagttatcacaatagcatcatcaacctgacagttaattgacaaattactgtttgtaaaaaacaatgacaagtccagcaaaagttgggtacgcacatgtccgccattcgaacactatcccgactggaaggcgtttcggtcaatgctcagcggtgaaatttcacttagcaagcgtcctttgcttggttagtggaagaccagtatttaagacgtgggttgcggcttaaatctgtgtccaccgcgttccagcaattgacggaaatgcctggaagtcggcgtaggacgcgtttaaccaagcatgtttacgctgattcgaactttttccagcgggcctagctggttacttttgatcttaaaccggaaccttttaacaatcattcctgacctatcctagaacaaaaaagcctgcaatcaattgattgcaggctcgttcacactgactattcgacgttgaactccttgaaataactggttagtggtttcaattcgttcgcgtcatatttttctttgaaggcactgacagaagcatccgatgtcttggctggatcaacattaaggatttcaactggtaacccccgtttgtccgtaatcttggcatcaattaggaccggacgaccagcctttaattcggtcatcgcagtttcgaaggctgcgtgcagttgatcaaaatgttcaacacggatacctttgacgcccattccttcagctatcttagcaaaatcagcatcaatcaagtcgataccataatatggttgcggcacatcttcttgttctgatttaataaagttcaacgtttggttagacgtgacaatattaaagattggcaagtgatacttaacttcggtcaacaagtcttgcatgaccattgagaaggccccgtcgccagcaatgttgaaggcttgccgatcaggataactcatcttcgccgcaatcgcaccgggaacaccggcacccatcgtggcaaatagtgctgaagtcaataatttttgcttgggattcatctttaggaaacggaaactattaatcgtattgtcgccaacatccattgagaaaactgcatcatcggcagcgacccggttgatttcttggtagacttgttcgtattcaagtggatcggtcgtccgttcactcagcttcttcaaatactgtttccagtcagccatatctgctttagccgcttggtagtatggcgacggtgacgctggttcacttaatgccaaggcccgtttgatgaagactttagcatcgccattaaccccgaaatccaaatgatggtgccgaccaaacttgccaggatccagttcaatttgcacatatttgaagtcgtgagtcgtgtacataatctgtgcgaacgaataatccgcgccaactgaaacgaccaaatcggtaatccccatcagttcatccgccgctttcgaggctgcccgataagcgcttcccatattaccatcaaagctatcaggaatgacgcccttggctaacccagtgataataatcggtacttgcagacgctccgctaacgccatcatgtcctcggttgcaccacgcgtcccttgaccaacgtggaagacggggtacttggcgttcttgatcatcgttaacaccgtcttaacttgttcatcatcaatagtaggaatgccggtcagtttagcagggacacttgctgaatcgtaattaagatcaggaatttcaacatatccaaaatcattaggaattgtcaccaccgcaaccccattttcacgataagccgtccgaatggccttatcgacgacgtatggtaagctttctggtgtcatgacggttcgattaaagaccgccacatcactaaaaatcggttcttcagcgaattcttggaaataatcatagttcatattagtatgagcaacttggcccaccaaggcaagtacgggcacgtgatcttccttagcatcatacaacccgttgagtaaattaacggcaccaggaccggccgacccaaaggcgaccccgattttacccgtcaactttgcatccgctgccgcagcgagggcccccacttgttcgtgacgtacctgcacatattggagccgttcttgctcaacatccaacgcgtgcatggttgagttaaacgatccaccagcatagccgtaaatctgtttaacatcccaagcttcaataacttttaacattgcaacagacgcttcaatcatctttgccatagtaaatgccttctttttaaaattattgtatacgttttcatttacggttatcagaatacatctaaattgttcaaaattcaattgtaaacaatcattattttataaatattttcttaactaaccaaattcgatgacctgacactggtccgaaatcgtgttagcctgccgttgttctggaaaatattgaacgcttatccatcggcttaatctaaccaatcagcaaggtgaaataatgatgaaagataaagcaattaatattctgactgccgaactgtcagcactccccgttttaataatgacgtactatgcgcttaccgcgaaaccgactggacagtggcagctgacctttagtctccctgtttattggctgatcagttccgacctgttggcctatccctggctcctcacccggattccctgcttgcgccacaacccccttaaaatgaattcactggctctaaaggcaagctcaagatacaactgccggctcaacgaacgggtcgcgcgctgggatgatgagatgaatctcgcgattttcttactggaacgcggctgtctaatgttactgtcagaaccactacttttaggcgatttaggctatcatagtgtccgacggttatggtattgatggcaataaaaagcacccatgctgttcagttttatgaacagtgtgggtgctgtgtgcattatttaagaatgttggtctccaagaaggcgacagcagcttcttgaatcttgtgaggtacatggtgaacgccaccttcagcgcgtttaaagacagttgccttcagggctggctcatctttaaaacggtgcttaaaatcacgaatatactgataaggtaccatttgatcggccgtaccgttgaaaaagaacattggtcgtcccgccagtgcttctgggtgttcagataagtcaaactttgccaattgttgataagtttgttcaattagttctgctgggagcttagcttgtaatgccgctggtaattgtgcaacttgatcggttgcaaaggccaccggttctggtgaaccaattaacgagacaccagcaactaccgtgggctgcgttgccataataccggcagcggtaatgccgcccatcgaagttcccatgacaccgattttattagcatcactaattccagcagccactaaggccgcgactaattgtggaaattccgcaactgaatgtccaacaatcgaccaaaaatgttcaggatgccgatcgagatcagtcccatcatttcgactgccatgtaaatacgctgtcgggagaatgactcgaaaacccgcgcgtactaactgataagccgtacccagttcagtcgctgtctgatttgtccaaccatgataatcgatgatcgttggtaacttagtttgtgcttgactagctgcaaacacgtgtaatacgggcaagtcaccaaatttggtcgtccgcaccaccacatcttcaaataaatttgttgtcatgtttatcaccgtttccaaaattaatagttaatagtgtagcagaagcccaaacgaaaaccaacccaaacgcgtccatcgtggttaaagcttaaccatcatggacgcactcgagttggctcgttttaacacggttagttatcagctaacgtcatgcctttcaaaactacttttcaagtgtatctaagaaatcttcaacttgcttttgggtcttacggaatttgtcaacatatcgaccaatttcttgaccatcttcaatcccaacgaaactaggaatccccatcacacccatgtcttgggcaatttcaatgttggcgtcacgatcaaccgtgatccagtcatattgatcgtacttcgcttcgatttggggcattactggtttaataaaagcgcaatccgggcaccagtccgccgtaaagaataacatgtgtttacccgtcttgatacgttcgcgaatttcttcgtcgcttaaagttgcagttgccatgaaaaatgcctccaatatctttataataattatagtttaccacatactaaaagtaagtaaagtcttttgctttattttgttgctcggatcagcgcttgcttgagatccgctgctaaatcagcactattttcgatcccaacggatagccgcaataagttagcggtgatcccctttgattgtcgttgctcttccgttaaatctgcgtgtgtctgaactgccggaactgttaacaggctctcgacaccgccaagactttccgcaaacgagattacgttcaatgctcgtaaaaaggtatcgacgtcggtacccgtagcgagataaaaactaatcattccaccacgtcctggatataagacgcgttcaacgtgttcatctgcctcaaggaccgtaacgagttcctgcgcattagcctcctgctgatgcaaacgtaatggcaaagtcttcaagctccgtaagagtagccaagcgtcgaacgggtcaaggaccgcaccagtcgtcaccagattaaattcaagcgcatcagcatccgcctgcgacttgactaccactgcaccggctaaaacatcattatgaccggctaaatacttagttgcggaatgaacgacgatgtctgcgcctagatccagtggcttttgaatcaacggtgtatagaaagtattatcaacgattaacttgaggtcatgggcgtgtgcggtagccgctgtggccgtaatatctatgaccttcatggttggattcgatggcgtttccaaccacagggcaacggtttgatcgtctgccagtgctgccaatgtcgcttgatcctgcccatcccagacagtaaaatccaaatgataatggtcgtgtaagaggtcaaagaagcggtacgaacccccatataagtcatcagacacaataattttgtcaccactattgaaaagcgtgaaaacgagctggattgccgccatgccagaagtcagcgcatacgcagcgatgccgtgttccatctctgccagcactcgttccaaaatacagcgggtcggttgggcctcgcgcgggtagtcaaatcctgtagattgtcctaaaccagcatgtcgatatgctgtcgacaagtagatgggcgccgaaattgccccggtcttctcatcatcactccgattaccagcttgtgctaaccgcgtttcaatgtgtaatttctcagcttgttttgtcataatctcaatcccatccaatctagttatggtcgggcagtctacagagacgccagtgtaaaaatgactacaaaaaaagccgccatcttcaagggacgccggtcgcgtgttaccacccaagttcaattacgggtcaccccgttaaactcatcaagtcattattgactcactggagtatcggccagtcccgccagtacagccttgcgaccgcaactgggcattccgagttcatcttcatcaggcgctaccttaccgctttacactccccacggctccctgtcaaaggtataacctgactactcttctcatcaacatgttatttaatgatattttcatcttactctcataataataggagcgcaagccccaatcttatttcagcacaataaaaaatggtgccagcattatcctgaccaccatttttacagaaacgcattcgacactgcctagctatcccaataatttcaagacaatcacaaaatatcctaaaatcaaaatactcaaccccagcgtcttcaagagggctaaccactggccccctgcagttcgacctttagggcccagacaaatcgcaacgccgccacaaatcacggccaaggttcctagctcacggccccagtttgcattcaataagtaaatgaacggtcccactaagccgctgacaatcgcgacgatccccagtattttcagaatcaagcggcccagtcgcttatcctgttcgtcataaatttcatgtttctcttttgccatcaaaccagccaccaatctttatgaactactttcagtatgccgtatttggtcacaatgagcaagaaggcggttacaatatcctggtcaaattactgaggcatcactaggctagcttgtcataccttaccttgggccttgccggcacttacccgtgataacagctgaatcaagctaccaaattgaccatgatgatactaaaaattaggtgttcaaaattgacacccgctgaacacccaattggcaataactatttttcaattataacctgctaaacgacgccattatggctgtgttgcaacaacttgccatacgttccccttagccaactgctgttgttccaattgaccttgggcgttaatccgaaaacgacccgctaagtgtgcgacatcggcgttggtattttcataaacttccacgtaaactaaaccaccgctttgatactgattaaacacaaagttttgcttattggcggttgtttgttgatagtccttagccacttgttgccaagcccaatcattaatctgactagctgttaactgctgtggattggtcgtctgctggccgctagttgatgatgaggtcgcggatgcagactgcccggtagttgtttgactagttgcagtggtatttgaatgtccctgcgagctagctgcagtagctgtcttactaccctgactagtcgttgcactagcttcggattgtgactcattagctgaagttgtggaaactgacgatgctttagttgacgacgatttagttgacgacgatttagcagctgtcgattgcttcgtcgactttgctgaagatgacgcgtcttttttagccttagtctttgacacaactgattgtgtttcactaacccgcgactgactagactgatggtcggcttctaagtaataaccgcctcccagcgcaatgatcccagcaatcacggctgaactaactaacatttttttcaagataatcaactccccaaagattaattgtctgatgctaactacagcatacgctatgttgtctcactttaccaacgtttacctgttctggatcgaaatttaactttaaattatatttggctcagttggtccatttttgggcacctaagattcattgtgccatccttttcttgactacgtatctcctcaacaacaaccgtggcatcagcagaaatgaattttgttaacttgaaagctgtttccacaaccttatttctttaaagttcattttgccatcatactgccccttataagtatatcgtaaatgacacccgactacggcccaaaacaggctaacaatgtaaccgtttcataatttgtcatcaaattgttacttatgtgaggcccccttcgcatgctatagtaatcaaccgatacaaaaaaactaggagtgtgtgaatagaatgccacgtaatttaaaagaagaagttgtctttaccgccattatggccggtttaatggtctttgtgatgaccgcctataacgttacccttgctcaaggtttcagcaatgggttagtaatggcaatccttagtggctacccactcggtttattcgttgccatcattttagacttattggtcgtgggaccaattgccaaacgattagctttcaaatatatcattaatgattacatgcgcaaacgggttgtcttgattgggattaccatctccgtcttgatggttcttggcatggtaacttgcatgtccctcttcgggattgcagtggaaggtgaattgtccggaagtcacgttttagcgacttacggtcacacttggatctttaacttgattgttgcattaccactccaactcatcatcgtcggcccaattgcccgcggtgtgcttggaaaaatgcaacgggcaactgctaacaccgagtcagcagctgcaatgaacgaagaggactaatctttcagtccattgacggacggtcgccgggataatcttatcctgatggccgtccgttttattttacgactatccagtcgaccaccgcttttgccgaatagtccaccctatgaaagtcttatgcgtgatctgtacgcaaaaaaaaacgcgtgtcagccatccgaaaatggttaacacgcgttcatcgcggcactggtaaaaccagcgggagtgacactccacaatgtcagtgacccagacactctgaaatacgtcagagaaacgtgccccgctatcaatattagtcactagccgctcgcgcggaaccgttattgctaacgatctgactctatcgactcatcgcatggactaccatatcatcttcattgataaaatgcaagtcgcaccgccacaaaattcgtggctcctactcaccacagttgggccgcagtacttaacttttcgcaaccaaaaaattgagtatcccgttcgatttaatgaacgacacactcaattccattggtattttgattttggcttggctccaatatcaattcttaccttaccatagtcatgtaaagatttagtaattaactcgtaaagattacgtttaagcttccgccgccgtgatctgatctaagcgatcagtctgagccgtcagccaatcggttaataacttttcagcgttggcttgatcagcgagcacgtcggcaacgcttcccagctcatcaattcgcaatcctgatggtaacgcatcggattctgcaatcatgtaaacgttgattggcagcgtatcctctgccgccgtaacctttccaatttcggtcagattagccagtggcaaattaataacactcgtctccaaccgaaagctgatagctggctcatgcttagccgtcagcgtcacttgggcaagctggtcggcattgagtgccgctaccagcttcgccagccaaggcttaaccttggtcgctagtttggcataggtaccagtcaagctatcctgcgtaaccttgtcagccgtaacatcatcaataaaagcttgtacgtttcgttgcataaaacattatccctcattcattattcaatttcgttaatttgcacgtcgccagcgagtcagtaacaccaacgtataaaagttgatccccaatccaatcacacccataacttctaacgccagtttaatttccatgccagccgtactctgatagcccgacattaaggcgctgacaagtcccaagctatatatcagtacaactaaccctaggacgtaaaaacccagcatacgattaatatacactgctagaacgcctagaaaatataagactagggcaatcagcaacccctgccacatttccgctaccgaaatattttttgcctgcaggtgaaaatggctagtcgacatcatccaattgacgataccgtaacaaaaaaaggacacaaacgcaaatgcaactaagcgagtcagtttcaacaaatcactcctattattgggcaattaagtcaataacggctgaccgttcaattcccgtgaagtactgatttaaatcaatatctgccagcgctttagcgatggcctcatggtcgtaccgcacacctttaagggcggcttcaatatcttgaacgttgccactaccaaagaaatcaccataaaatttaatgttattgatcaagccgtcatcaaccgagatccgcgcatcaatggttcccatatcaaagtgttgacgccgcttaaccgagaattccggtgatttaccgtaaacccaatcccaattagcataatagtcttcgtaaattttatcaatagctttttgttgttcaggtgtcacgtgatattccttatccgcaatctgatccaacgaatcaacatggaacaactcttttaacagggcatcctgaaattctggcaccgtgatattctgatattctggcgctaaataaggccgtaaattcgtgacccgactccgaacggacttaatacctttggaagcaatcttgtcggtcgggactgttagcgcctgtgggacaacgtttaaatcaacattcaacatcaaagtgccatgggagaacgtcttgccattccgtgaatacatggcgttaccggagaatttcttaccatcaacgagcaaatcattgcgaccactgaccgtcgctgtcgtcgcccccatatcgtgaagcgcatcaatgattggcttggtaaatgtcttaaagtcgccaaactcttgactgtcactatccaccacaaagctgaagcagaggttaccaagatcttgatacacagccccaccaccagagagacgccgcgttacggtaatgtgatgttcccggacatagtcggcattaatttcttcaagggtgttctggttccgaccaacaatgatgcacggttcttcatagtagaacaaaactaatggttcatcgaaatccacgttattcattaaatattgttcggttgccaagttacggccaatctcatgatctttcattgcgacataatacatgttttaaaatctccttcagctttaggttactttaatcatacagcaagatgaaaaaaggacccacaatgtgagcccattttttggaagaatcatacaaaaagtttggcgtggcattcttcacaccacaagatgactgattcactatccacatccgtgaacgtttgattggcggcaatccgttctccgtggacataaccgtgccatcaatagatggaggttgggccagtcagttatccgaaattagcggaaacgctgctatactgcactagctatcacttgacgggtttgttacaacaattgggtaacagtttgatactgacctgtgactcttccgataaatccaatatagcatacaatgtaagcgattgcaaaccgagtaaaaaaacaacctagtcagccgaagccaactaggttgccgaaacattaatagcggtcgtaatcgctattccatttcaatatccttagtataaagccatttggacgccggaacaactaatatgcctagccttcaagcttagcaacatagtgcgttgcaccggagcgactcagatatcggagccacgtgtaaccctcagcttgaaccgtcccattgtaataaaccgtttcacctgggttatattcaccgacaacgcttgcgcgcgtacttggcgccgtacgaatattagtcgtcgttacgaagcggaacgccccttgactgtttgttaccggcttagacgtcgtatttccggtagcggcattaccactaatcgctacgtaatgttgggcgcccgaataagacaaataccgtaaccaagtctggccgttagccgttaccttagcgttgtagtagactgtatcaccagcactataggtaccgacacttggggcatttccggccggtgtattcttaatcgccgttgtttgcgtaaagcgataactaccactttgaggcgttacttgcggtttatcaacattggtcgacgtactctcaccactaatttgcacataatgctgggcacctgagtaagacatgtaacgtaaccaagtctgaccatttgtcgtcaccttaccattgtaatagaccgtatcgccagcattataagacccaaccgttgtcgcactagttgcaggtgaactcttgattgctgtcgttttcgtgaaacgatacgacccactggttgcaaccacgtccggtttagccacagcaccaacctcatcaccactcatagccacgtaatgctgagcgcctgaataggataaataccgtaaccaagttgtcccacccgtggtaatcttgccattatagtaaaccgtctcaccagcattataagtgccgaccacttgagccgttttgcttgcggctgatcgaatgttggtctttgcggtaaacttatacgacccactagctggcgtaactgtcgcctggttattattatcattagttgttgtttgactaatcatcacataccgtgatacgccagaataggactgatagcgtaaccaagttgcattaccgaccgttaacttaccattgtaattgactgtttcaccagcgttgtaagtacccactacggcactcgtggcgtccggcgcattgtgaattgtcgttgtcttagtaaacttatgtgtaccactggttggggtgacgtcttgatcaggctgaacttggttattatcatttccgccacttgcctgaccactgagcgcttcttgatcccactcgtgtagcttgttatattcaatgatgctgatcagcgaactcgcgtacgttggcgcggttgcgtaaccgtcttgttgcaagagactggcaacgcgccgataatcggtaaccccaattaaattgctgtaacgcggattgacaaccaaaaaggcgccatgatcttcaacactagctgaccaattcgggtacttccgaaaagcgtcttgaatcgtaatgtattgtgagccattccattcctgggttgggaagtagattgattgcccttgataacttcccttgataccgaataagttatttccctcagttgctagttgtgactgtccccagccactttccagaatcgcctgtgcggccgtgactgatggcaagacttgatacttgttccaaccagagattgcccccgctttaatctgactcaggaagatttcctgactagtcattgcccgcgtggaccgtgccatcatcgctgatgactggaccgcatcagccgccacagccgtctcaatctttggtgagattttcgcggctaccgcctgctcagtcgcttgcttaggtgcggctgacgatgcggctgatttggctacttcactcgtcacagtcgcgctggattggtccgtagtgacatgactatcctgacttgcggccgcgctggctttagccgtctcattagtcgtactgtgactggcttggctcgtggctgcactagctttggccgttttatcaagttgatcaacagcactagttgtggagtccgccgtagcactagcagccgcgttatccttggcagcttcactggcgaaggactggctttgcagtcctgtactgtcagctttagcggcttggctggctgcccgcactgtgacacgacttgccgcactggtagtagacgtcgtcgtactggttgattcagcttgatcgtcagtcttggcaccgtcactggcaactgattggtcagtcgcaccagccgctgtcgtttccgtctgactgccagcacttaaggtcacttgttggcttgcagctgaagcagcgctgtttcccttagtcgcagctgccggtttttgattttcacttgccgtatcagctttactactcaacatcggcagcaaagcggtacttagcaataatgaagttactactttttttgtcattccaattttcaattttaaaatccccaaactttccgtgagttagctgttagcacaaccgatttaattcccctgtagcacctgctattacagaataatattagcatgtcgaagagggacattcaaacgagatcgcttcgaattattttattaatatcaattgattgacaccgttatcattttaactgattgatcagttaacaatttgttatcgttgaccgaattgacaatcgctgcaagacgttatgaccaggggcttttccaaaatcaccttgcttctcaattactgtatttaaattaaatgtgactgattgatcgattaacgaccttgaagaatattatttttcaatgactagtaccgactgaaaaaaattagtcatttttcagtccattaaaataattatccttacaaactcaagttatcaaataaatcaatcgattttaaatgcttacattgctgaaaattaatgctaaaatatagttattaactagccatatcaaacgggggtaaccattatgttacaacaatatcaaaatatcctggtaccagttgatggctccaaggctaccgacgaagttcttcggcggggcatcgaagtcgctaagcgtaacaagacccatctcgacattttaaacgtgttggaagtcaaccaatttagtgacacgtacggcggtgcggtcagtggtgatgtcatctacaagttgtcggaagacgttcaaaagcgcttggaagaactcaagcaacaaacaattgacgctggggtgaccgacgttgatgtccatgttcgttttggtaatcccaaaacggttatcgcgcgtgaatttcccgctgaccaccataatgaattaattatgattggttcaaccggcttatctgccgttgaacgtttgatggtcggttccgtaaccacctacgtcagtcgcaacgcaatttgtgacgttttgatcgttaagccgaccgctaaaaaagaagactaacaaaaaagtctggatacgttccagacttttttagtggtttccgtgcgttgccccgtcttccccgttataaaggagctttattcatgacctggacttatcaactcactatcccgtctagcttgaatcaacagtcgattcgggcttgccttcggacctggctgattcctaagcggattcagggccagttacgccaaacgcggcggattcagctgaacggtgcaccaacgtcgattgcacaactcgtcaatactggtgattgcctgacgctgacgtttatccccagtgactttcggactccgacctcaaactatattgcggctgccacggccccagccacgattttatatcaaaacagcgatctgttagtcgttgataaacccgctggcgtgaaatcgcatcctaatcaaccaggtgaaaccggatcaattttaaatgacctagcagccacactccaaccaactcagcaggtaccatacatggttcaccggctcgatcagatgacttctggtgcgatgctagtcgcattgaacccggtcgtcgtcccgattttagaccgcttaatcagtgacaagcaaattcgccggacttattatgcctgggtacgtggtcactttaccacgccaactgggcatttcaccgcgccaatcggtcacgatgctaccgacaaacgcaaacgctgggtcaacacggccgatgcccagccagcactcaccgactacgaagtatgtgcaacaaccgcccatcagagtttagttaaactgaccctgcatactggccgtacccatcagctacgggtccacttggccgccagtgaccacccgattatcggtgatccactttacgactcgcaagcggagtcggcgcctcggctgatgttacatgcccaattgttggatctacaacttccatttagcaccacacgggtgacggtaccggccccattgccaagtttatttaatagtccgcatttaatcgagcgctactgactaagcaagttcaacttcattcagatggctaccggcgcttgccatcaaactgttgtgaaagtatctatcttgaagggtccaaaaaggaagctcagtgagcttcctttttttgacacctgcatatttatcttagccaaaaagagcttaattatgcctctaaactgttaatttgagcgataataaatcttatcacttggaatgttttggggatcattttgcgttcctaacgctacgatacggtcccgactactatcaccattatttaggtcagcattatttccaccgggcataaataccacatcataaagtccgccagatgagcctgatattgaaaaactgccttgaagcatgctggcaccatttgaggtttgataagttaattgttgatgatacttcaatccatcaaccgtcttagaatttccttgctgatcatctaatgatggcacatccattttgagtttagtaatcgtccccggagtagcgtcttgcgtcaggccaaaatcgctaaatttcatccgctgattatgaatcttgatttgatttccttgtccattttgccaagtcccattcaaacttgaataatcaccagttttaatctggccgagcgccattgtcgacttgcggtttcccgtattggcggcggtcgtttgacgttcaaaaacttttacataagaattattacttgtgcgcgttatgattcgctcagtatccgtcttaatggtggcaggaacgttatcaccccagccactgattgcaactccctttggataaaaccagtacgtgacggcagctgcaccgatatcaccatcaatatgcagtgcgcctttttcctgtttgatggtagtagtaacagcctcttcatcaccattcgcatcttcaaatttcccacttgctaaggctatttcaccgtcactgattttcgtgtcttttacggttaatttagcgccagcctcgggagattgccaaacatcgcccttagtatcatgcttattgacactactagcaacttccttccagtcacctaacaaactcccataggagccctgactgatctcattaagattcatagtcgtagccccccgttgttgagacgttgtttttgtcgactgagaacttgcgttgactgacgtactcgttgccttagttgcatcatttgttttgtgcgccttatcagtaatcactttgggcttcactttgaccacactaacgccatgcttcttatccgcatgtgacgcttgcgaggcctgctgtgagctaccacaaccgctaataaataacagtaacagcagactgatacagacagtttcactttttttcaaaatctggtcccctttttttccgctctgaatccatggcatcgtctctttaaaaattaactaatccgtcacggcggtaatccgacggtactaacgcttacgaaaatagtgacgatagttgtgagaaaagcatattgccacctaaaacggctaatatcatgacataaacagatagtgcaaaacctaatgcgatttcagcaatgattaacgcataaaatttgtcaatatggggcttcacaacattatcaataatgatataaataaatgccagattcataatcccgatggttgggatcataaagaagaacaatccagtcatgccagaaaaattaccagttccagtgagaatcgtcaaaagcaacgtgagtagattaaagattagaatcaaattcgtaattgctgcaaattgattgataaaatcactaaattgcatcgaaccagtattaacaacgcggcgaaaggcataggcaatgctaacataaatcgcatatatcccaagaaccatgaaaaacaccagcatactcgtttttaggataaagctgccagcatgaatcgcagcttccgaactaccaccagtcaatgaactagtaaaatcattggcgacattttgtgccttacgtaagattaacgcaattgataaaaccagtaaaaaggcctcaagaccgatcgaagttagtccaaagtaccgattagtcggttcaatcggatgaccgggatgccggatcgtcatcttaaaccacgaaaagtagcttccagagaactttttgacatgttggacggtatctgtggtcaaaattttattgacggtatcatcactactacgttcaaccgtattctcggattcggcaactgactgcccttgatccggaatttcctggtttggggcaaccacagcaccacatttcgggcaaaacttcgccccggctttcagttgattgccacactgcgagcaaaaaagtgcctgcttattcatttaaacatcctccaaattaatcataaatttctcgttaatcatttgaatctaccgtttcaaacttaccggtactcgtgttgtagcgcgctagaatatcattaacatcatcatatcgataagtatctgctaaatcattagtaccactaacatagcatttaatttcatacacatccgtgtgtggttcactcgccgtataatcataatcactaatatccccaccggtagccgcggcaatttctgacacagctgtctgagctgaactagacaaatcatcataagcactgcccgtaccactctgcgattcactctcgctgttgattaaactcgagtctgattcatcactggcagtggtagctttggtgtcagtattcgccgttgacgttgtcgctgcctttttattcgcaactaacgaaattaattcatggacgttcgcgtgccccatcagattaaccttgtgcgtgattgtcgtgtcagaattacttagtttaaacatataggtccccggaaacagcggaccaaccttataagtggtatgcgcactttcagtggtcaccaattcgatgtcatttgcttccagtgtggcattttttagattggtcgtgattaacggctgcatcgtggtgacgcgtaatttgtaagttgggaatagtgtccacttagttccgatttgcttaacaacaaacgtgtgatcactagaataaccgttatgttgtaagtctgttttcagatcttgtgcgtactggggatgtttttggatataggtcattaagggctttacggactgttttgtgatttttaacccagtattatcgctaactaagtgtttcgacaatgtcgtgggcttattactagtcatcatttcgacttccgcggcaatctgctgatttttaccagtgtgatattgataaaacccaaatccacctcccacaataatgacgactgcgagcacgcttccactgattcgcaaccaccttgattgctgcgtcttagctggtttatgagcttgatattgccttgaatccccgagtttctgctccgttccactggcttgcgttcgttcagcactgtcaatatgagtcagatccgctccgcaattttcgcaaaaaacattatcagcctcattttcatgctgacaatttggacatattttcatttttggtacactcctccattaatttgacatccgatgaaataagctcctcccaacactctgatttctattctgctttgcaagctatactaattatttaatagcgttataacaaagctttaataacattatatacgactaaaagaagtatttaaagacctttatagtatgttgctattttatcattaaccgtaacctaataattgctttgtcacattcaacggatcacaaattcagcatgagttcgataactgaaagcaaagtaacgtgatttaattagcatcacgtatcaaaagctttaatgaccttataacggtacttataaggtacttacagctctgtttcaagcatagcgaaacctctaaaattagtgctaagacgcttaatggattaaggaggattcccatgttaaccgagataggcaaaatcattcggcaacgccgacagcaacacggcatcaccatcgagcaattggccgaacaatcgaatgtttcaatctcgctaatttctcgactcgaacgtggtaaggtcgataacattaaactacaaagtttgaccgcaatcgctgaaactctgaatttaaaaatagcggacttctttcgcgacgagcttctccaatcacctaatgttgttgcattactcgactacctgagtgatctgccagcccatcaacgtgaagaacttgccggtacgttactcaaactactccgactatccaaatcgtgagcatttgcgcaacgcactccggacagttagttcaccattgaaccccgtgattcatctacactaaaaaatgattcaccttcctctgacaagaaggcgaatcatttttaatttatcaagcttgttaacggtcggctaagcgcccttaaagccagcatacagttcttaatggtgcgttgtcactaataacccactcatcactgccaatatgatacccaccgccatggctttgaatggttcacgaacgatgggggtggcggtcaaagcctcgaccatcgccccacctaaatacgttacaacgagccccaatacggcgccccaaaagattgtgactagtaaactagccagccacgttgtcttcaatagcaagctcctccaatgcggtcaggcacggctgaccttttgattgagtgtatcaaagtcgtcacgcgtttgcaaattgattaatagaattcataacttttatataatagttctatccaaagaaaatccccaccatcaatgacaaaaaagctcagcaccgaccattcaggtcctaagtactgagcgattatcatgaccgctatgacaggctaatgtcccccactactcaaatccgcaagccaatttgattcgacgaccgtttgcggaacatattggcgattcaatagtgccagccactgccggacaatcttgctcaaggtaaagtcatgactgcgttgccgagcgcgcgcggcatattcagcgcgacagtcaaaatcagttaacagtggcattaagccagtaatcagagcattaacatcgcgggccggagtcaacacaccgtactggccaccctgcaagtactcggctgagccagtattccacattgagacgatcggtaaccccatcgtcatcgcttcccccataactaatggcatcccttcccaacgcgaagtcatcatgaagacactcgcctgttgataatgcgcccgtaactcagtatctttcagcgcaccccgataaataatgcggtcacgaacatcgagttcagccatcaaccgattgaacgtcgctaattggtcttcgggaccagtccctgcgactgcaatttgccaatcatcgggcaaggctcgcgcaactgtcaacaaataatcgagccccttatgttgcaggtcaatacgaccagtgtaggcaatgatatgttgcgccaagtcggcctgctgaccatgagcttgcatggtcggtggattatagaacttgaccgtatgggcgttaaaacgtgagtagccttcccaatcataatcggtcaatgtcacgaccgtatcagccgctaagagccctgcgaccagttcatcttgcatttggacgtaatactgattgaggtagatatcaacattattgtgcatccacgcaatgacattgacccgtggaaaacgctgtttgattgccggagcaaaactcgtcagtaaacctcccgggagaataacggcatcgtaagctcccgacccaatcgtcgtgagtaaatcatctatttgaggcgcataaacggtcaacggatcagcgccaaagtaattaagtaccgtcgcacttgcaggccggcgcgccgtgataagcggtgcgctcagttcatagaaagaccggggttgggccaaggagtaaaaagcaacctcggcttgcgaggtcaacgcattgccgaggaccgtcgccgctcgtttgacaccatccatcactaaattctcgactgttatcaaaattttcattagcatcgttgactggcgattaaacaaccagtcgctcctttccacataaactcggttcatggaaccggaatcgacgatgttaggctgagctgattgcgtcagacccgttcatccttaactaatcaccatcactagtatcagcttaggtagcgttattataacaggaataattaaaaaccaattaaaatatgctcacaattcacattatgctagtcattgcaagttgcttcttgattaaacgtcagttagctaggttctgattaagacgtcataggctacattccagcaccaatcagcacttgttgacataccactagtattgcttgatatacacgcaatctgaaataagtcgcccatgctgagttgacagtatccaatcgacacaattaatagcgcacaaaaatagcgttgctactggaggcacaagccagtagcaacgctattttcaaattaagattttaactgcttattttaaacccttccattgccaatcattaacttctggcaagtcagttccggcatcccggatataggcattgtgtttagcaagcatattatccatggattgaacgaaggccgcaccagtgttttccattgctggttgcgccgcaattgccgacttagctaagtcgaagcggtccatctggttcatgacccgtacgtcgaatggtgtggtaatatcaccattttcacggtaaccgtggacgtataagttatggttgtgacgatcaaagaagatgtcacgaactaagtcttcgtaaccgtggaaagcaaagaccactggtttgtccttagtaaagtaatggtcaaactcagcatctgacaagccccgcggatccttttcaggactacgtaacttcaagatgtcgaccacgttcacgaaacgaatcttcatctctgggaaactgtcgtgtagtaattggatggcagccaacgtttcaagcgttggttccgtcccagcagctgcaaagacaatgtctggttcgctaccttggtccgtacttgcccaatcaatgataccaagaccattgtcaactaattgcttagcttcttcaatgctgaaccattgttgacgtgggtgttttgacgtaaccacgtagttgatcttttcttggctccggaaaatgacgtcaccgacagctaataacgtgttggcatcggctggtaaatattcgcgaatgtattctggtttcttttcggccaaatgagttaatgcacctggatcttggtgggtataaccattatggtcttgttggaatacagttgaagccgcgataatgttaagtgatgggtactttttacgccaatcaagttcattggctttacgtaaccacttgaagtgttgcgtcaacattgagtccacaacgcgtaggaaggcttcataactggcaaataacccatgacgtccagttaagacgtaaccttctaaccaaccttcagcttggtgttcagataactgagcatctaagacccggccagctggtgcttcatattggtcactatctggatgaatgtcttccatccattgacgattagtggtttcgaagacaccatataagcggttagacatggtttcatcaggtccgaacaaccggaagttatcaggattcttcttgatgacatcccgcaaatagtctgaccaaacgatcatatcttgcttaacattcgcgccttctttggacgtatcgaccgcataatcacggaagtttggtaagttcaaggctttcggatcgaccccaccattggtgattgggttagcagccatccgactgtccccagtaggaataatttctttaatatcatccttcaaagagccatcttcattgaagagttcttttggttgatatgattcgagccaatcaactaaagcatccgcatgttccatgtcattttgatcaacaggaatcggaatttgatgagcacggaatgaaccttcgatcttatcaccgtcccatgacttcggaccagtccagcccttaggtgcgcggaagacgatcattggccatactggcaatgtcgcatcgtcattttcgcgagcatgcttctggattgccttgatcttttcaacggcttcatccatggccttagctaaggctgggtgaaccttttcaggatcgtcaccttcaacgaagattggttcccaattcatgctttcgaagtattccttaatcttagcatcagaagtccgaccaaaaatcgttgggttagaaatcttaaaaccatttaagttcaagattggtaaaacagccccgtcgttgattgggttaatgaacttcgttgattgccatgaagttgctaatggacccgtttcggattccccatcaccaacaacaaccgcggcgatctcgtcaggattgtcaagaattgccccaaccccgtgtgaaattgagtaaccaagttcgccaccttcatggattgaaccgggtgtttcaggtgccgcatgggaagcaaccccacctgggaatgagaattgcttaaagagcttttgcatcccttcaacatcctgcgtaatttctggataaatatcggtgtaagtaccgtcaaggtaagagtttgaaaccatcacttgaccaccatgacctggaccttcaacgtagaacatcttcaaaccgtacttgttgatgacccggttaagatgggcatagataaagttttgaccggcaatcgtcccccagtgaccaattggatgaaccttaacgtcactggccttcaatggccgttgtaatagtggattatcttttaaataaagttgaccaactgataagtagttggcagcacgccagtacttatcaactttttgcaaatatgctggtgatgagtaatctgttgtcatttcaaaaacactccttaatttgcttttcacttgaacgctaactgtttaaatgttttcgtttacaagttctattttaacaactcatttcaaaaaatcaacctttttgttaattggaacggtccaattttataaattaaaacaaaaaaacaaggctcatcccttgggacaccttgcttttagattaatatattttttaataatttgtacacagaatgattgaagcagcccatcaattagctttaatatgcccagaattaacaccggcgccctgattagttagtggcaaccagttcagtgcttttaatagatagcggtcccagaaatcccactcgtgcgctccagaaccgaccaaatattcatgcgaaacttttttggtcgttagaaaatgatcaaattcatcattcgctgactttaagccgtcctgatcgccaatcgccataaaaatcgcgggtaaaacgacgtgagctgccagtaaattagttacgagcacttgcaggtttaattccgaatgaccagcagctgctagatctgggccaaaaacgccatgctgatatgcgactgtttccgcaaaccactgaggctttgccggtaacttttccattccgggtcgcacattcagtccggctgataaactcacaatggccccaaaagtatcgtgaaattttagtccgttatacagcgccccgtaaccacccattgataatccgccaataaaagtttggtcacgctggtgtgatagtggaaacgtccggcgtgtaaaatcaatcaattcctgaccaataaattgactatacgtctccccagaccaaggatgatcagtatagaaactattctcgcccgctggcatcacgacagccaggttccgttcgtcggcccagcgctggattcgtgtgccactaatccagtcgacttcactacctaagataccgtgcaataagtacagggtggcaaacggaccctgaatcgggcgcggcacgccctgctcatctgggaccaatttatcagttggtaaacacaccatcaggggaacggtccggtgtaaactagccgccataaaattaatacgaatcagtgccatgacacctcagactcctaactattcgttgacacaaacgttgtatacttcatatattgataatgtaatcgcatattagacacttcaaagggtgtcccatcatctaaaaagaagatcccactcatcaggcccaccggttcattcggctgcaaatgtagcaactcttgatcagtcgtattggacgcatcggccgcaatcgataagaatgatttggtcactgcggcgtgcaaggtcttttgcacgtaattaaagatcgatccactgaccacttgtcggttcaactggggcacaagcttgattggaatatagccactttcaatcatgaaaggctggtcatccagtaatcgcagccgtttgatttcataaacaaactcgtcagcagttaaaaataagtcttgttgcaactcttgacttgcaggaatgacgcgaaagtctaataattgaatactgggcttagcaccctcagtatttaaactgtccgtaattcctaggttagttccttcatacttaaacgaagattgatttttaagatataatggattaatgaacgttcccgaaccccgcttcttgaaaatcaggcccttattggctagcacgttaagcgcgcgcttaatcgagctacgacttacctgatactgttcgctaagactacgttcatctggaagcttcttatcaacaaattcattcgccatgatccgtttattgagatcattgatgacttgttgataaactaggtcagccattgtaatccctcctttgaggttatttcatacctcaagtatagcagaattaatggcgtttgggtgaattgttccggtccatttataaaattggaccgtatttttaataaatgtgaggttaacaataatgtcaaaaaagaagaaaaaagatcaattaggtaaaacacttgttgaaaagattttggataaagcaaatatcagctatcaacaatatgaattcccaaccgaaacggaaggcgacgttcaacaattacaagtcgaccacctcggtgttgacgaacatcatatctacaagaccttagcgctgattggtaacaagaccggtcccgtcgtcggcgtcttgccgttagatgagcacctcagctataaaaaattggctaagctatccggcaacaaaaaagttggcatgattccattaaaggacttggaacggactaccggataccaacacggcgccaacacaccagttggtatttgggaaactaagaagtttcccatctacttagacgagaccgctaagcagcaaggtaagattctcgtatcttcgggtaaaatcgggcgttcaattgaaatcgacgctgatgatctacgcaagctcgtgcacggcacttttggtccaataacggagtagccccgtggataacttgatcaagaataacggcatcgtcttgctggtcatcattggtttacccggactatttgcttggtcactgacgattatcaaccgacaaaccaaagcgaatctggtcaaccactacggtattaacagtcaggtctactgtggctttctgggcatcatcatccacgagcttagccatctaatcctcgcactgatttttcgccacggcatccaatcggtccggctgctcaaacgccctcacctccatcctgaagatgagtcggcggatgatctggcactaggctatgttaaccatacttggaatcggcacagccggtatcaagtcattggtaacctgttcattggtgtcgcccccatcttcggatgcacagcggcactccttggactagactggctactcgctcctggcctatttcaagccatcttcaaattagctgatacacccgaacaaccacaatgggctgcaagttttcacgcgttaaccagtacgccaacgagttggtggcaactattaatgttgctctttctaaccctcgtcattgtgattggtggcttcgatctaagtcccgctgactatcagaatagtgcgatcgggttgtatagcaccatcggcatcattatcgtgctgactaccttactgacgttcatcggtatcaccggttggatccatacgttagttacttggggactaatggtcgccattatcttgggctactcactactcgtgtccctactagtcatgttggtaacccatcttctgaccaaccgtgcctgatttggattgccagctttaaaaccagaataagggctaaaaaggccatcacaagaattcacgatacattcttgtgatggcctttttcgttagccaatataaatggtaattgcatcatctgataacatgatctcagctcaaagaactagtgattcaactagacgtagggatgccattacgccttatcatccgccgtccactcagccttaaattggtcaacaaactcgtgcatcaccgctgtccggtgggctgccagtgctttggcagtatccgtattcatgagagctgctaacttgaacaacttttcatagaagtgattgatagccgtgccgggctggtgtcgatattgttcacgcgtcatatgttcacgtggcgcaattgccgggtcatagattttttcaccgacatgacctgaataatacaacgcccgggcgatcccgatagcgccaatcgcgtctaaccgatccgcatcctgaacgacttgcccttcaagacttaatttttgagggccgttgaaggatttgctgaatgacatgtgatcaataattgcaaaaatagccgtttgatcggcagccgtaacattttgcgcgttcaattgatcaatcaaatcttgatgcgccttcgctgggtcggccatcaatttatcgtcgatcacatcatgaagccaagctgccgctaaagtcagatttaaattcgccccttcggcttttgccagccggcgtgctagccggttgacccgctgcaaatgatcgcgaccatgcccactatgatcgtgagcaagcttttgcaaagcatacgtttgaattgccgttaattgtgtttcagttatcatacactcatcctatccctgggtctggtagtacgcccgtaacttcttgatcgttccccggctaaaggtcaagtgatcatgattgtccatactaatcacgcccttattaaaatcaaccgtaatcacatggtcaaggttgagggcataactttgaaactcattaaaaaaatgcatcgctgtcagttgttccttaatcgtatttaaattcttatgtacgacataggactgggtcgtcgtcacgattcgcgtggtccgcagcccatgttccttctcacagtagatgatatctttaagcttcagcgttaataataacgcaccacttcgaatcgttaaagtcggttcagcagattgctgtaacatacctaaccgtttttttacgacttgtaggactctttgtacttctggcacaaactttgccttatcgaacatatttgtttttgaaataaacccggttggtgttgtcatcgcactcaacgtatccgggatcatgtcatcacgcaccgtcacatagacaataaacccatcaggatcataatcacgaatcttagaggccaattgaatgccattgatttcgcgttgtaaaacgatatctaaaaaataaagatttggtccgccgccatcctttaccgccgctaacacatcggtcggctgccatactgagactaactcataattaaagtgcaatgcctccagctgtgccgtaatgatgtcgtttaaccagagacgctgttgttcttgatcgtcactgataaacaccttcatatcaatcactcttcccaatgtaaagcagattaacaaacaaaccactgttgatccactctatcccaatttaaattgcttacaatcattttatatgatactaaagccccgccattccagcaaccaaaaaaacacgtatggaccaaataactgacattacttggtccaccgcattcagcttatttttcaatttgttgtggcttggtctgtacttgattaagtcgcaataattcatccgtgcgcaatttattaacaatcagttgagccgctgcggttgttaaactgtgactgagatcctgatcagaaatcgtaattggatcatcgggatgatgaagttgattcgttaataccgtaataaaattgtcgtaagctcgcttgggatagccagtcgcagtcacttggtcgattccctgacgaattttatccagtggataactcggttttagtaagctaatgacaataatatccgccaattgcataatttgatatttcttcttgactggtgacaagatcactttatgtttgacataattattgatcattgcggcagtaactggatcagcacctaatggctgcaacgtttcattaattaataataggacctgatccatatataagtcaaagttcggtaactcgatccacttcggcagaatcacctttgccatgcgggcttgccaatctgcataagtctcattagctgccatgctgcgtcctcctctgataaataggttacattaattatacctagattaactagtcttgtaaactagatgacattgtaaatcacattaatttctgaatatggtatcatttatgggttaatgcaaatacaaatgaaaagtaggttatgtagtatgtatgaaatgaccaaaaagctccgtgtcggtgatgatgttaaagaattgattccacaagcagtgattgccggactttgggaccgtctcaaagcgatgcgcaaagagaaattattgattgatagcacgatggccatcatgttcagtgacgactacgaagacaataaaattttcttcatgacacttcaaaaatccggctcattcgccaatgaatatgaaatggcctatgatgggcccaaagacttcctcggccatgggacgattgttattatcaaagaccgtccccgtacgattcaaatgagcatctcggacgctaataaagctgaagacaccaatgacgatgcgactgatgagcaaaagtaggctcgcactttaaatcacatcatgattgctaataagctgctcaggtggtgaccgatgttcactgactaccccgcgctgaattggtacctggttatgctacagactttcagattcgtgctcactaggttgtcacgactgattgctagctctgtcaactagttgagacagcaccttgctaacagcacccctaagtgtgcaaaaaaatccgttgccatcaatgtgtatgtatcgaataaaagcaccgtcagaattcgctgacgatgcttttatttattgtatttctatcttaccttcgctatccgcaacggtttttggcaacgtcacggtcagcagtcctgcttgataatgcgcttgaatctcttcgcgcacgacattcgttagatgaaacttccgggtaaagtccgcgtccatccgttcgcgatggagtacgcgcccgtcatcgttacgatcgtcttgcgaccggtgcgcccgaatagttagccattcgtcagcatacttcaccgtaatagcgtccttatcaaaaccgggtaattctgccgttacggtgtaatcatcgtcatgttcaaccacgtccgttttcatcccaacgtgtgcgtttaagacgttctctgcttcccggtgagcccgcttcaataatttggtgggctttagtagatcatccagatgatgaccgaataattgctggcgcatgtcaataacctccgtatcaaatcaattattagtaagcctgttggtgaatggcttcagcaagtaaatctaaggcatggtcacgcgtgccaacttggtccatatcaaagatgatcgaatcaatgtcgccacccttgaaatcaaattgttcgaagtagatgtacgggtcttcgccttcaacttttaggaaagcggcttcaatcttttgatcaaaaccggccgcccaatccgcatcgtccatctgattgaaatctgcacgggtcacgtaaccacggtcacgaattaaatccatcgcttttttgacatcactatcttgataaaccaatttcttcgaatcctcatgaatcttagttttcgtttctactggcatcattaaagatctccctttacttggtatacccttagtttagcaccattcattggaaacgttaaccatctttctcgcaatcgcattatttgggcttaaagggttgccagtaggcccgctgactacgatagaccaattaattaaccgtcgcgggggctgacaaaacgggtgataagccttataatattagctacttcgcgttatacttaaagtaactaatattatgaaatgaggaatgtttctttggacagtggccagataattttaaatttagtcattattgtcattacgttcttcgtcgcggctttctttgtggcctgtgaatttgcactcgttcagacccgccctagcgctctcgaagaagaacaaaaaaaacgtgataaaccgtcaaaacggatcgcaacttctttgcacatggtccgcaaccttaacgagtatctttcaaccacccaagtgggggtctcgttagctggtatcattttaggttggattggtgaacaaacaactgaacactttgtgcttgatttcttatccctcttcaacctatccgtctcaaccgcggtattacgaggtattagtatcgtcattggggttttcctactgacctacttagaagtggtcttaaccgaaatcgtgcctaaaaatatcgcaatcgacatgccactcaaagtaatggcggtcattacgacaccattacggtggttccacgtgatgttctacccctttgtatggttgttgaatgtctcatcagctggcgtcgtcaaaatgttaggcattccagttgcgaatgaagataacgatgtttattcacaagccgaaattcttaacctatcacgaaatgccgtaactggcggtgagcttgaacgtaacgattacctttacatggagcgggcatttgagttcaatgacaagatcgctaaggatatcatgatcgaccgtactcagctagttgtgattgatatcaacgataccgtcaagcaagccattcgcgtttatttacagaaacgctttagccgcttacccgtcgtagctaacaatgataaggacaagattctgggttacgtttataactatgacttaattcgccaaggtgaagttgacgatgatattcgggtcaataagttattgcgtaatatcattacaattcctgaaactacaccgattcaagccattctccaaaagatgatcgacaaacaaacgccgatcgtcgtcgtggttgatgaatatggtgggaccagtgggatcgtcactgataaggatatttacgaagaacttttcggaaccgtcaatgacgaaatcgacaatgtttctaacgaatacatcgaaaagcaggccgatggcacttaccgcatcagtggtaagatgaccatctacgactttgaacgctacttcaagaccgacttacaagaatttgaagattccgatgttgtcactttgaccggttatattttggataattttcctaaaatccaagccggtgatacgattcaaatcggtaacttcaatttcaaagcgcttgattttgaaaatgcttatatcaattggtttgaggttagcgcccagacggatagcacacctgacgatcataatgacgatcaaacacaagactaaatatttacacgcactacttaaaatggcacttaaggaagttgatttcttaggggccatttttttgtatccggcgaacttcaactggtcaactttggtacttttatatgataagtcgtgtgaattgccactaacctgttgtacataaattggatgcggttgatttaagggaaagcctactaaaaattaagtttgtcttaagccggccgttatcacgacaaactgcgacgattcggagccgtagtcgtttgcaattaagtagtgcccagcgtaaactaaaactaatgtaaaacagaaatgaggaactgctgtgagtgaatcaacaatcaatatcatttatatctccattgaaggcaatacccgctcatttgtcaccggtatgcaggattacgccaagacccagcatgcagctgatgatagcaacccgttaattaccttaaaagaaatcaccgaacagtcagactttgccattgagactgaaccctacttcgcctttgtcccaacctaccttgacggtggtaacggcattgacaatggggttaaggaattgatgaccaacgtgttaggtgaatatcttaactacgatcaaaactcacggttctgtctcggagttgttggttctggtaaccgtaactttaacgatcagtactgtctaaccgctcggcgttatgctgaacaacttgacacggacatgattgcggattatgagcttcgcgggactgccgttgatactgaacgcgtctataacgtgatgaaagaccgtttggccgcctatttagacaatcaaaccttttaatcgaattaaccaaacaatcaaggtccaagttagttttcgctaacttggaccttgattgcgttcacagcacgaagttgaccaatcgcctcagtaacgacgatttcacgctattccgttgccttatccttatcaaatattgtggggccgatgactagtgattccgctaataaggtttcattgtacaatttaaaaacgtacttctgatacttgacctctcgttgtgaaatcatatccaaatattgccgttcttgttcgagtgcattcataaatgctcgcatctctaattctttttctgcaccagtaaattccggtcgccgaacaacgtcaacccaggcacgcgcaaaatcacgagtcctagtccgttgtttctgggtcatcaaatcaaaaatgacggattctttcacattcgacggcaaatacattttctgaactgtatcaatcgcgtggtgaaccatcgccacccgaatctgatcaatctcactagttgcctcatcatcagtcaacgccggctttagcaaccagcgaaaaataatcgtcggcacgaccatactcagaataatcaacgtactggcagccattagaaccaagttaaagtcaccacgtccgaccgcagtatcggttaacgtataggctaaggccagcgttaccgcaccttgcacgccacctaacgcaaaaatccatgcgggccgatttttgaaactcaaccgcaaccgaccatagctgtaacgcaccagcacattgctaatatacagaacaagcccaatcaacaaaaagttcaaggacccatgcccgaattgttcgttaacaagaattttgataaacatgaatccaagaaccacaaacaccatgctattaaagatttcagtaatcatgctcaccaagtcaaaagcaaaatgaacttgttgtgcattaattaaccggcttcgttgggcttccgcattatgcactaatcccgcaaccacaaccgtaatgattccagaaacgtgaatcgccttagcagcataatacaaaataaagggcgtaatcacgtacatcaacagcgacgcattcaacgaattatacgaagagcgtaacaatacttgccgaaacagaaccatgatccaggcactgacaaaaccaaagagtaccccacccacagctgaaataataaaatcaataatcgtttgcccatagttaatatagccattagcataccagagaaccgccatgttcaataagatgatgccagaagcatcattaaacaacgactccatttttaaaaaagttccctcagttgatggcatctccaaaccgttcgtcaccgattccattgccgtggcgtcggtcggcgtactgatagccgctagaataaaagctaacggcaagccgactaatcccagccctgccaagctaaatcccgcgacaattaaggcaagaatgactagtccaactgtcgtttggataatgtgctttaattccttaccaacggcattcagtcgagtggcttgtccttcaaaaaacaggagtggcgcaacaatcaggccaataaagatttcagaattgaagttttcaatatgattgctcaaaactggaataaaaaacaagccaataccgacgatcagactcaagtagttcacagatatttgcggcattacccgggaaataaaaatactaacaaccgcagccaacaccagaataaaactggaaaccatcaaattcacgtactcacctcattttattaattaattcatttattctatccgataatgctcaaattgtatcgtcaatcgtctccatcatcactttcaaagaatcaaaaaagctttcaaggcatttgaccttaaaagctttgttaatatcacggggcccacctgctccttaaccatttaataagtgttctcgccgggcgcgccacaagactaacgccaaactacctaacattaagatagtcaccgtaataaacaataacgagtaggagaactgagccaccatcatgccaccgaacaatggtcccacagctcgtcccaatgacaaagccatgttgtatcggccttgatattttccgcgctgatcatcagccgccatatcatcgacccaggcgggtgcaatcggtaagccaatgacctcaccgatcgttaaaaccaccatgataaaaataaaatcaacgtattgccgggcaaatactaatcccaagaatgataaggcaaatagcgtaatgcccaagccaatctgagtgccaatcttaaatcgttcgttgaataacgccacgatcggctgactcacaataattaatagcccgttaatcgtccaaacttcactataccggcggaacggaatccccaagttggtcatgtgcacggaaagaatactttcccataaggcataactcagataaatggtgaaaatcatcaaacaaatcatccagattaattgacagtgatttttaggcgtcacatcccgcttctgtggcgcagctttctctgtccgaacagtcggtgtgacgttaaaggtacttagcgtaatcgtcataagaccaaggtagcaaactgttgccaccatgaacaccacattgatacctagttccaacaagtaaccgaccaataatgtcccaataacgaccccaacgttgagtgctaaataaagcatgttaaaaacataccggttggatctagtcgttaccgttgcggcataggcattgacgactgtcatgctgataccatcaccaaagccgacaatgatcaagccaatcgcgtaaggccacaaactatgccagaaaatcaacgttgttaaaattgcggtcgaaataccaccaccaagtagcgctgtataatatggtcgccagtgatcaaacaagcgcccgccaataaagttaccagcaatcatagccaacgacatcaaaaaaagaataattcccgaaaacgtcaagctttgtttgagataattatgcatgtagaccgttgttaatggccacataaaagcggcacccgcattattcagcaaattggctagaaacagccaccgtaaccgaacttctttttgcatctcctcaccacatttctgatttaagtttattcattgagaaaacaataccctaaatagtatacgccgcctgaccgtttttacctaccaatcaggtcgcaaaaggtgctgagtagtctacgaaatcatttttacttaagccgcgcttagcatcaagtcttacactgcatgttgtttacaatcgcaacgctgtagtcgcagcctaggcccgtgctttgaccatttggtgcattctaaatgcggcccccactccgcggatccgtttcatccgttttagtattgttccgagaagcactgaccacgtgtatactaaagtcaaaaaggagcaattgacatgagacttttcaccattccagccgaacaaacggcatttagtaccaaagaggttgtcgtcatcaccggtatgaccaaggacgccctccgttattatgaacaacaacagttgattgggcccgtaccacgcaaccacaacaactaccgacagtattcacgtcaaaatttagagcgtctacaattcgttgccacttttcggcaattaggccttgatctaaaactactcagcggtgacggccacattccaaaccgggcccagcgaatccaagaactgagctcatatcgtgctactgtgaaaaagcaaatcgctcaattacaggcaactgatcagtttttagcacataagattgcttactttgaagcttctccaaatcattaaccaacttttttactttttacttgctatcgtgtggacaccatagtttatactaacggcacacttaatcaaagaaggttacgatattatgaaaacaattgctattaaccaatacggttccgcagatgaatttacgatggtcgacatgcccacgaccgaaccacaagctgatgaagttcaagttgcgattcacgcctttagtctcaatcccatggatattgctggccggatgggagccctatcctcaccctttactgacttatgggcctttccattggtcttaggttgggatttcgctggtgtcattaccaaaatgggcaaggccatcactggttttaacatcggtgacgctgtgtttggttccgccgcgcctgcccacgcagctaataacggcacttatggtgaatttattactgttaatactaaagaattagcccatctcccagcaggcttatcatttgatcaagctgctgctttgccaatcgctggactaaccgcttattacggcatgaagcacaatcttaagctgcaatccggacagaagattctggtgcagggtggagctggtggtgttggcctctttgcaattcaaattgctaaagcctttggcgcttacgtcgcgaccaccgctagtgctaatcaccgtgacttgttaactcgcctaggggccgatgaagtcattgattaccacgaaaccgatcctgccgccgtcttgcacgactatgatgccgtttttgacaccgttggtgatattgatactggtctcaaggtcctaaaagctgacggccagctcgcaaccattgccggccaaccgacggacgagcagcaacatgatcaacagaaaaaagttgcctttcagttcacccaaggctcatcacaagacctagccgacttagcccaattagttgtcagcggtcaagtgaagctaaccgttgcgacattaccgttctccgtagccaatgtcattaagggtcatcgatccatcgaaagtcgccatacgacgggtaaaatcgtcattcacgtgacggattaaccaatcctgctactcgataaatatcttccggcaccattcttagtagctagtcccactgtaaaaatgaacgttcagagttcgaaggacttctgaacgttcatttttattttagcggcccaattagccatggcacacttggtagcaaaccaaccaatttaatttaatgaatcactttaaacttcgcagcacacttaacaaccagttataattcacgatgccatgatgaatttggactaagttcaaactgtctcaaccaggtcgtactaatattaattcgacaatccataaaaattaatattgaaatgtccggtttttgaacctgattgtcgactaccacccctgatgattgttataatataattaaacactgccaaccggtgtaatctttcaacaattgaggtgacaacatggcgaataacaactttggcttggcgttaggcttcctagtgattctgttgctctggatctatcaacgcgtgcgaatgcctaagatgcgctcactcgctggctacatgtcgcgacgcgcgattgaaaatgaggaaacatggcggttcgcacaacgcttctattcaatgtttggcatcgaaatcttttccattttgttaatcggcgcgattattggtggtctgttcaagattccgctattgcaaagctttaattttcaagccatcgccttagcggttggtttgatcatgcaaaacgttgcaactgagcgtgaactgaaacaccagttcccaaaatctccgcaacattagtactttataattgaccatcaccacgtatggtttaatattaatacggtagtttaatctgaattaatgcttatgaacaagtacttggtttaaaatattcttagtaaagaagtgaaattgatgagtaacgaaaaaattgccttattcaccatctttggcggtactggtgacctcgcacagcgtaaactgtacccgtcactatttaagctctatcaaaagggctatctcaaggaccactttgccgttattgggacggctcggcgtccttggactgatgatcactatcatgaagttattagtgactccctagctgatctgaatgctgatcaggaaacggtgacgcaatttgcgagccatttttattatcaatcgcatgacgttactgatgctgaacattaccgaactttgaaaaaattatcagaaaagctggacgcccaatatggtttacaaggcaaccggatcttctacttagcaatggcaccaaacttcttcggtacgattgcccaacacttacgttccgaaaatattctgacagataacggttttaaccgcgtcattatcgaaaagccttttggtcatgattatgaaagtgccaaggaacttaacgaccaattaacggctacttttaacgaaaatcagatttatcgaattgaccactaccttggtaaagaaatgattcaaaatatcacggccattcgttttggcaataatatttgggaatcattatggaacaaccgttacatcgacaatgtccaaattacgttaagtgaaaaactgggtgtcgaagaacgggccgtttactatgataacagcggtgccttgcgggatatggtccaaaatcacattttgcaaattttgagtctgttaacaatggatcaaccagttgaattcactgaaaatgatatcgacgtggaaaaggtcaaggctttacggagcttacgaccacttaaaccagaagaagtcgcaaccaactttgtccgtggtcaatacggtgccggcgatgatgctaaagcttaccgcgacgaagataagatttcatcagattctaacaccgatactttcgtcgctggtaaagtcatgatcgataattatcggtggtccggagtgccgttttacatccggactgggaaacgcttagccgataagttcacgcgaatcgacgtggtgttcaaacggccagtcgtcaatatcttcaatcatgaagacgtccgagctaatgacgacgcagcaaccagtctcgatccaaacatcttgacaatcaacgttgaaccgactgaaggcttcgagctccgcatgaatgctaaagcaatcggccaaggcttcgcaaccaccccggtcaagttgaattattctcacgatgctgaagccacggctggtagcccagaagcttacgaacgtttgcttcacgatgccttaaatggcgacgcaaccaactttacccactggcaagaggttgccgattcgtggaaattcgttgacgtcattcaaaaatactgggatgaacatcaacccgaatttccaaactaccgccctggtacaatgggaccagatgcggccgatgaattattacgtcaagatggtcaccgctgggtctaccgcaactagccgtcctagcgtattcacttaaatggcttaattaaaagaaccagttaccaacacttgcctaacaacgtgttgataactggtcctttttatatcgctttaacaattggatgggttgctgcccatcggcaatacacgtttattttgctcttcgggattgcgcctgcggattagcttaactagcgtcgcaataatccctaacaccacccattccgcttataaacgcctaccctaccagttgttcacaaacttgaatcaaccgtttgacaccggtcgtcaactctgacagtgtcagcccggcaaaccctaacaagtaatagtccgccgtgggcatgtcgcgccaattggagttaagcggataaatccgaacctgttgccgttctagggcttctaataatttagcctgtgcaatgcctggaatctgaacaactaagtgtacccccgcgccggttgcaattggtcggatctgcttagtttgcgctaactggtgacaaagtacccgatacttttgtcgattagcagctcggtttcgactaaggtgccgataatacgccccatcttcaaaataattagccattgcttgttgtaacaggccggccaccatttcagcccgatattgataccgttgatgataagttgccaccagttgtggtggtaagaccaaatatcccatccgtaatgtcggatcaattccccgcgaaaatgtccccaaataagccacctgattagccgttgctagcgactgtagcgcgggtaatgggtgcgcactgtatcggtattcactatcataatcatcctcaatgatgagatgctgagtccccgcccattgtaacaacgctaatcgtttctcgattggcaagacgactcctaatggaaattgatggccaggggtcgtataaatgatctgaggattacgcgcacgaacttgtgtcaaatcgagcccatcttccgtcactctgatggggaccgccgtctgtccataactagccgccaattcggataaaccgcggtagcctggattctcaattccgaccgttccgcgtggcaagatactaagtagaatactgagacctgccttagccccactcgtgatgacaatctggtccgctgtgcaccgcacaccacgagtcgttttcaaaaatcgaaccaagttttcacgtaaagccggtaagccctgcgcatccggataaacggccgttggttgctgctcagtctgacgcaacgctagtcggacagcccgtttccaagcgttccaacttggcgataacaactgagtcacaccataccgaaaatcataagtgaacgccctgggtttagtgggctgtggcacagtctccagcgcctgtttagctgctggccagtgtgtccgatcgcgataaaagtagccactcccgggaacggtataaacatagccctctgctagcaactgatcgtaagcttgttcgacagtggtcttggaaactcccaaattttgtgccattttacgaattgaccataactggtggttggcttgagtagcatcatagtcatcacgcatctgctggtataactgaatatataacggtgtcgttgactgacgatttaatggcatcacacaactgtcctttcatttttatcaaaattgtctatttctaaccggacgattgttgtttattataaacggtaatcacgttgagaggaaggtcctaatgatgaatacaaatattcggatccaacaaattcaagtctctggcatccgacgcttcgatgaagcaatcagtcaaattcccgatattatcagattaacggtcggcgaacctgacttacccaccccaagtcacgtaaaaaaagcggcaattcaagctattcataatgattggacacactactcgccactaatgggatttgccgctttgcaagatgctgcgagtcactactttcaacagaaataccaactcacctatgcacctgagcaaatcattgcaacagtcggcgctagtgaagccgttgcaacgaccctgctcactttacttaatcctggcgataccgtcttattgccaacaccggcttacacgagctatcaacccgtcgttgacatcgcaaacgcaaaattagctcccattgacacaaccgcaacgggttataaattaacacccagtgcgttacaagctgcgctagatgatcaccgtcgcgaccacgtcaaggccttaattttaaactacccgaccaaccccaccggcgtcacgtacactgatgatgaattacgggctttgcaagccgtcattgctaccgctggaatctacgttattagcgatgagatttacagtgaactaacctatgaacagccccatactgcttttgccacactatatccaagcaaaacgatcacaatcaatggcctctccaaatcgcatgccatgactggttggcgactgggattcatcatggccccaagtaacttgattaccgagatgaagaagacccaccagtacctcgttacttcaacgagttcaatcacccaagcggctggtatcgaagcacttacccatggtctggatgatggctcagaaatgcgtgacgtctatcaaacacgccgcgattacgtcgtcaaacgtctgagtgaaattggattcaattatatttatccgacgggcgcattctatatctttgtccagctaccacaggatttccaaggcaccagctgggactttgcgacccgactcgcacacgaggcccaagttgctgtcgttcctggctcagcatttggtacgagtggcgagggttggttccggataagttatgcagccagtcaatcggcactacgcgaagggctaaatcgtttagccttatggcgcgcccaaactaccacacaggaggattagccacatgaatttagcatccgcacacctgattaccgccatggtcaccccatttgatgaccaacaacacattgatttccaccgcttagagcaactgatcgaacacttacttgcaactggcacggacggcttattagtcgggggcacgactggcgaaggccccacgttgagcatcgctgagaaacgagatttatacacgcagacagctaggatcgttgctgggcgagttccaatcatcgctaatacggggaccaatgacactgccgccacaattcatttcacccacattgtcagtcaaatcgagggcatcgacgccgccctcgtcgttgtcccgccttataacaaacccaaccaaaccgggatgatggcgcattttacagccattgccgaaaaatcagacttgcccattataatttataatattcccggtcgcgtaggcgttaagatgacggtcacgacgattctcacgttggcccacaaccccaacattattgggatcaaacaatgtggttccgatgaagaactggccgcaattgttgaaaaggcgcctaaagattttctcgtttacacgggcgaagatgctcagagcttgaccaccctcgtcttgggtggtcagggaacgatttcagtggcgagtcatttatttggaaatgaaatggcgacgatgcgccgcgccttgaaccacggcgatatcacccaagcagggcaaattcaacgacgtttaatgccgaagatggcagcactattcacacaaccctcaccggcacccgtcaaagcggcgctgaacgcccaacactggttagtcggaagcacgcgcctaccaattttaccgttaaccaccaatgaacaaagtcaactactcaacagcttaaaataatgcagaacggttggtagtacctggcaaaagcgcgtatactgaacctaaaataattaggaaagtggtgaccatgatgtgcggttgggcttttactggcggtatgccctttatgtggatgggtggcggcttgggcattatcagcttactgattctgttagccgttggtgcttactttttagggacacgttcacgccatcacgattaaagttctcattgggataatcaaaaaagactttcaaggcacggcttgaaagtcttttttgtttcatcatcagggatcagacaaccgggtcaacccctccccatttcaggtgacctgcagttttgcctgatagtatcagtccaaacgctgatttagacccaatgacttaatttcaagatcgtaacgtaagtaagtttaccagccttaacatttctattgagtttgtccccactaacttcattttcactcacaatccataagccgatttgaacaaactggccgccagtcccaatgccccgattccaatcacaattttaagtaatctggcaggtaagtggcgtacaattcgtggtcctaagctaccaccaatcagaaacccaatgcctaagggtaatacatagcgccactgaattggcgtttgcaagccataaacgacggctgaaacaatattggctaatcccaacgccagatttttctgagcattatagacgacgaatggtgcggcactcgtgaaagacaggatcgacaacatcaagacaccacccgcagcaccaaaataccccgtataagccccgactaaaaagatgcccaaccaagctaaagccgtcatccatttaggtgtcacaacaatttcaccgggctgtttaatatgaatatgacgaggaatcagtactaaaattcccgcaatcaaaataaaaaatgggacgaccttcgcaaaggtcgctgccgggataataaataacagaattgccccaacaatactcccaactaaagtcagtgggatgagcgtcttcaattcctgaccatgcccccgtagttcccggcgtgaggctggcacggctccaaagctagtaaagactaagcccacggtgttagtgacattagccgtaacgggcggcagtcccagcgccagtaggaccgggtacgaaaccagcgacgctaaccccgctgcagtgctaacgatacccgcaacaatcccaacaacgactaaaataacgattaactctccgaacgtaaacatgtgcaacgttcccttctctcttaatagccctacaatagccacaacgattaccatagtcaaataaccatgttataataacaaatcataatactaacaattaagcattaattaaataaggactttaagatgaatattaaagatttgcaatattatgtttcgttaactcagctgaaaaatttttcattagttgcagcccaatttcacgttagtcaaccgaccatttcggctgctattcggcgcttggagaccgaactgaaaacacaattactaattcgggctaatccccacttacccgtggcactcaccacgaccgggattcaagtccaacgacacgccaatcagatcctattagagcaccaactgatgtgccaagaagttgcccacaccacaaccgatcaacttgtcatcgggatgccgccaatcattgaaatcaactactttccccggattgcaagccaattaccacaagctttattcagccagattcaacctatcagtcaaggttcactcgcggcgctcaaaggattaaaaaacggacaattagacttagccgtacttgcttacctcaatgaattcacggatacgaccattcaactcacgacgtttgacacccagtcatttagtattgttgtaccaactgacgatccgctagcaaccaactcacaacttcagttcagatcgttgcgtcatcagcattttgtggcgctcaaagataactttgtccaccgccaggcgtttcgtcaactcagtcatcaaaatcatgttcggccaacgattgtctttgaatccaatgaaatcggcagtatcttaaacatggttcgtcagcatgtgggcattgccttattgagtaacgccgtccaattaccggcgggattacagcggctccccctaactgacgcgcaagcgcccacgttcaatgtcggcgttgcgtaccgccactcaatgacgtttagtccaacccaagccgacctgatccaacgactgaccgctgcttttcaatccgtcgattggcacgcatactaaccagcacctaaaaatccaccgtgtaagtttatcaatatgataagctcacacggtggattttataacgactgtacgtcaagttaggtcgccaaatgcaggtcattaaacagacaagttttagtaacctatcatggtcgctaacccgtctcaacctcagattaagcttgttgaacagccttcgagattggggtatcgccattgatcaacgcaatggttttaccgaccgttgcaggggtgtgtagcgtttgaactgtaaaagttgcgacatcatcacgcgtaatctcaccgccaacgtcagggttaacggttactttgccagtaccggcatcattgatcagcgtacctggttgtaaaatggtgtaatccaattgggttctgttttttaaccattcgtcagcataatactttgccacgtagtacggttgtaatgctcgtggccaacgactccgatccggtgtaaattcagcactaataattacgtagcgtttaacgccggcaattttggctgcgaccattgatttgacagccccatccaagtcaatcattaaagtcatatcataacccgtttgaccacctgatccggctgcaaaaacaatggcatccataccattaaaagccaacgctaaatcttcaggctgagccatcaaattgaattgtactggctgcgcaccagcatcctcgaaagcctcagcctgttctggttggcgaatacccgcgtacacttggtcaccttgggcaactaacttggaaacgattttcttaccaatctgcccatgggcaccaatcacaaagattttcatctgggtcactcctgtcctttagttaagtttcattataaagcttaccaggacaaaaaagtatcattctgttcctgatttgtccagtttacaaaattggcttataatatgagcatctaaacgagagtagtgataattcatgtcaaaatatattcgtcaagctactagtgctgacttaccagccatgatggctattatcgaacagggcaaacacgccttggctgccgatcagattccccaatggcaagatggttacccgttagctgctgatattcaggctgacattgatgctagaattgcctgggtactcattgtcgatgatcagattgctgggacggctgcactgctaacaacacctgaccccaattacgctattatttatgatggcagctgggcgcctactgagaaccaccgctatgcctcgattcaccgtattgctattgccaatggttaccacggacaacatctgactgacttttactttagcaatctcattaccatgagttaccaactcggctttcgtcaactccgaattgatacgcacttgttaaacaagcgaatgcaacacattattaccaaagctggcttcgaataccgtggtatcgtctacatgaatcatgacaacaacgatcaacggaatgcttatcagttactactatcctaatatttgtcagccacgcggcatttggctttaaacatcacgaacgctttaattaagaccaaactcaacaaaaagcacgccagattattctgacgtgctttttccaactttgtaagcaccacctgacagccaaacttaattaactggcacaaacacctgttgtggcagtgagtacaaatactgtttagtcacctttcctggatacatcgacgctagcgctgctgcatatagtttaacttgaccagcgtagcgcgtcttcaattcttcaggccgcttgacgtggtccgtcttataatcaaacaaggttaacccatcagccgtttctaaatagccgtcaataattccatgaatcaggacttttcccgtctcatgttcatcaacatcgaaaatctgacgtgctggaatcagtaacgagaatggcacttcgcggtgcaccttcgccggattatccaaaatttgactgcccagcgcactctggtaaaaagccacgatggtgtcaactgcaatcaatttcgcgacattggtcgttaagacccggttagccactaacccatcaatcgtactttgaaccgtcgtttcattgaccggtttggtcaaatcaagttgttctaaaactaagtgggtcgcactcccaacttccgcactggttggcgcctgcatagtttgtaaaaattgtggtaactccagtgaccctgtcacaaaccgggatgtcggtcgtgaacgccgctgactaacagtcgggttcgcattcatcagcggagtatccggatcttcaaagattcgtttcacttctgataccgattgatatgccgtcgtcgtcgtggaagcctggtgtggataatgaaaattcagtaacgtggtcagataatcacgcgttacttgatcaacatcgatggtgacttgctgttcaactagttcaagcgcatcaggttgagtacccgataccgcttcactttgctccgccaggacggtggtggcatctcccaattcaacggctagcttggtcggatcatccgtcaattcgtaattgggccattcatctccccaatatgccttcatggccggatgccgtatcacggccataccgacccaatctaattgattagtcgccgcaatccgtgcttgggcacttaagacgcgcccgtcgctagcaaaggcctgccgccatttttcggtcgcggtatcaatatccttgattgttccaaccaaatagagctgttgctgagctcgcgtcatcgcgacatatagtttccgcatctcttcagcgcgcatcttcttgctgactacctgcttagtcacaacttgtggcaaggtcgggtacttcacacgcgtttctgggtccaaataagtaatcccaatccccgcttctcggtccaatagcgcgcttgagcgcgtatcagtctgattgaactgcttatccatatccatcacaaaaatcacggggtattcaagccccttgctaccatgaatcgtcattacgttgaccgcttccgcatcagtctcggccacggcagctgccaagtcctgatccttttcctgcatccggcgaataaaacgaacgaactgaaataagcccttaaaactgccctgttcatacgtataagcacgttcatataaagcgtggagattagcctgacgctgtttaccagccggcatgccgccaacgtagtctaaaaagccagttcgttcatagatttgccaaatcagggttacgatttgattacgtcgtgccagatctcgaaattcagtcaattgtgtcaagaaggtctcgatcttagcataaacttgatcaccatattcagtcgccggaccagtcggataatgatgataaaagtcctggacggcttgaaaataatcactcgttttattctggatacgcaaataaactaattgattttcgtctaatccgacaattggcgagcgtagaaccgccactaacggaatatcttgatatggattatcgataatactgagtagtgccatcatgattcgaatctcagtggtttgaaaataattctgggcatcattgaccacaacgggaatgtgataccgtttgaaaacatcaataattgttaaattatgattacgtgttggtactagtaacgccacgtcgctgtatcgaaacggccggtattccccattagcacgttcatagattggcttatcttgggccttaagtgccaaaatcttttgggcgaccatcgtgatactcccaacggcaggatcatcaattgaaaaattggtttcatccgtggagacatcttctgtcgacttgtcagtttccgtctggtaaagtaatagattcgtcgtttgtggcatatcggccggataatccttgggcccatacttgaggtaagccgcttcatcataatcaatttgcccgaccggcgcgtccatcagctgactaaagattaggttagtcaaatgatcgacattcgccaccgaccggaagttttcagctaatacgattcgttccccgtgttcgggattcgtcccaaaatcgtgatacttgtgcaaaaacaataacggatcagctaatcggaactggtaaatcgactgtttgacgtctcccaccatgaacatatttcctggctggtcgcgcgccaacagctgcaaaatactttcttgcaaagagttaatatcttgatattcatcaaccataacttcttcaaattgggcccgtaactgcgccaaagctgcctgactactttcattgtcactcgttaagatttgcaacgttaggtgttccaaatccgaaaagtccaggacgtgtcgccgccgtttttcagctgcaaaagccgtcttaaactgcttggtcgcatccactagctcagtcacaattgactttgcccctaccataatatctaagacttgctgctcatcggccgcaaaataggtctcgctaagggtggtcatttgtttcttgacaccgtccacaaatgtgcccatagttttggcccgcgcagtcttctccggctcgtccttataagtttttttgagagctccaatcttgaaagtagcgacttgagtacgtaactcattccaacttgccgttgccaattgttcacggagcgtcgtcagcgttttttgtgctgtagcgagtacctcaagcgttttcgggactaagtcagcatccgtcgcaactttttgtgcctgtcgtaatttcatttgcatcccatcgacttcattaatgagcaatggtaataattgttgttgataaaaggcactggccgttaacgcttcctcatccacctgataaggttccggtaacttgctcagccagccttccggatccggggtcgactgggcaaaatcaaataaccgaaaaatcaatcgactgagaccatcatcacttcgatcattagaaaaattcgctgttaataagtcaaataacgtaccatcttcatcatataattgttcacgaacactgtcccaaacctgatcacgaatgagtaacccctcagtgttgtccgtcaataggcgaaaaacaggatccaaatcaataacgtagtaataacgctgaatcacgcggagacaaaaagcatccaacgtactaatgttggctaccccgagcaaatttaattgctgccgtaattgccgaatcgctggtgacgccgtggtttgcgccggattgtccgtcattaactgtgagattcgcttattgatttgcgattccagcttttgtttcatatgcttggcagctaagtttgtaaacgtcaccacgagtaactggtcaatattcgtgccggccaatatcttgcgcataatacgttcgatcaatacggtcgtctttccagaaccagccgaagctgaaactaacaagttatttccctgctgtgcgataacagcttgctggctaggtgtatagtttgtaccctcactcatggttttctccacctttctgtgtcttcagtaaatcaagaacctgtttggctgataatggcggtagatcccgataagcattttctgccaacattgcatcaaactgcataattgatagatacggcgaatattgtaaagcagtcgtcttatcgttcagccgaattggatttagttgaatttctccagcgaaaatcgcttcagcagctgcaataatcaattgactattatgctgtaataatcgttctaactggtcattcgtcaccagtgaagctgcacgccccccactatacgacccatcctttttacgtgcgaatgggtaaactttcgaggtcccgttaccttgttgtagttcgctatctaaatgttccaataactgcggatcatcgagcaaaattcccttatacttgttcttctttaggagtgctgcttcaaaaccgccctgaatatcttttggtttcagagttggattttgaatgtgcatgtaaagtgcgccagctaatttaaccgcagcttgatcagaaccgactaaagcttgctcgttatgcagcacagcgtccaaataagttaacatttgcattgcgagaccatagtaagcctcttgaaaatcaaatttatgttgggatgacttataatcgacgattcccaggtaactttgatctgccacttgaatttggtcgagacggtcaatcttcccccgcacgtgcacactatgcgttgcatcaatttgaaaatcgagcgcttttaatccgtgttccttgccaacgttaccaaataagacctcggtttgcttcggttcagcggctgacagtttactttgattgcgaatcgcaaatgcaatctgccggactgtgttgattaactgccgttgcaagtaagccatccggttagaactcgtcaaaattgtaaactgtggttgatctaagatttgacgggtcacagtctctaaatactgtcctaactgctgatcactggcttgggccaatgggatttgatcagaccgtaacgccttgatgagcccatctaagacagcgtggaaaaactccccagtactagcagctgataactcgaacacatcacgctcacgcagtttgagcccatatttcaagaaataagcgtactgattacgataaaattcttctagttttgaaattgacgtataaatttgatgcccatacaaagcctcaacgctggctggtgtcagcttgacaggttgattgcgatagcttaatccagccatcaattgacgtgctagctcaccgaattggggatcacgcgtcaattgttgccgtaaccacacccacaccggagcaggttgtaatggtgcgccaacacgattacggtcagtattcgtcgttaacacatcgcggtaaacctgaatcacatgactaatcgtccggcgcttagtcccaacaaatggccgcgcatcggcattagtcggatcaggcgtcccaagataagtatgttctcgcaaattgaactggcgttgaattcgccgcacatagttggaccaatttaaatctgtttcttgatcatcttttaacggggcgctgaaaaacaagtgtcgacgggcacttaaaaaggccaaataattcagacaactttcatcaccgagctgaacgacagctgaatcatttaaatagtggtcaccatctaacgaactgagcgttggttgcaaattttctttatccacatcactcaataagttgttcgtcataatccggtcaggcatcactaaatcggttgccccaaccatgaagacaactttatggtcctgactttgaaccattccgctctctgaaattaacacctggtccaacgtcgacggaatttgcgagtaactagcaccttcaaagcccgcttgtaatagtgccaaaaagtccgtaatttcaaatggctctgcacctaaaatcgtcacgtattcatctagcatcccacagaaagtttgccaggtctgctcaggctcggcagctgcccggacatcttggcgatccaaggcttgatcacgccaagctaatagctggtccgtaacgccctggcttgtcaaaaagttgaccagcaatgtcacggccgctttgccatccggtgcttgccgcatttttttaaaaaacggtggtaacgtttcagcaacaaagtgatgaatcaagttgatttgtcgcgaaatttcagcattttggtccgtctcgaccccggcatcaccctcggttaattgaaagtattgccaatcttccctttgtacccaccgctggccgtgataaccacttttaaggataaagttttcggtcagatctactgcttggcggtaggcttgccgatccatcggttgcccattgatatttggcatcaacagctcggttttcaacactcgcataacatcacgatattgatactgctgtgcgtcgatatcaaacaacgcgttaatcaactcaactaacggatggtcggccattgaacgctgtaaatcaacaaagtatggtatttctaattcatgaaaagtcggcgctaacatcgtttggtaggcatctaagtgccgtgtcatgatcaagaagtcccgataatgataatcgtcggcgggatcggcatgttttttcgcgaccattgcccgaatcatgcggccaacttgtgccaattcggtctgtcgactatcggtccggaataaatgcacattcgtattcggctcctcgtaaccggtagccgcttggggctgaccacgccaaaaatcatcgagagccactaagccgggagccacgcgcggcgtttcagcataaatatcttggctaaccggaatctgacgaatacgggcatactgataaagccgataataaagccgaccagattgataaaacagcgtgccattttctggcgcccggtcaacgactttgtgatcgagcatcaaactgattgtcacgtccgcgccctgttccagcatagtcgtgacgattccctgttcctgggccggtaattgggcaaagccagcgagttccacataaacgtgcgttccgtgcaagtcttgacgccgtaagtaagcattcaattgaacgagaatatcagcgggcttaagatacttatctgcagtcgccgccacgaagtctttgtaaacgatcgccagatcatgtagcttagcctgcaagtcacccgcctgagcattcgctgccaattgaaccacatcttctggttgcaaattagcggtctgtaactcattaatttcacgagctagttgagtcacaaaacccgtttgcgagatttcaccaccaaacaatcgcagctcatcggcatgtcgttgtagaatgcgatataatagcatgtcaatcccagcagcggagagtcgtggtacttgataagctgcttcgttcttcatcaagtaccaagcaagacgggtaaatgaaaagacctgaacctgagtctgggcatacaaatctggttgcccaaatgcctgtgccaagcggttcaacacgtcaacttcagtatcgaacttaatatggttcggtaccaaataaaaaaactgatcttgtggcttagccatcaaggttgccactaactgcgccaccatagtacggcgatggtccatcttggctggtcccaatacaaattgtaagctcaccactaattcctcctctgaactgaacaaacgttctcattaagttagtctcattatcgcatatttaaccggctaaaaaaacacctaacccgtaagttagatgtttattatcgcgtccattaaataccacgttattcagccaggcgacccgtgtgctgcacgtcttaattctcaacgttgacggccactgctgccagatgtgcgtcggatttataatggcttatcgtgcccggcatccagtaccgttttgtcatcctgatttgaaattttagaagctttaacgaacgtggtcacggcttaatgtggtcaactcgcacggtcgcttattcatccggctgcaagtctcgacctcaaaacaccttaccgatcacccggtgacactcgccaatcctcagagtgcttaaaagacgcgaattagcacaacccccacaatcatgacgagcaagcccatcaactggacccccgaaattgggttcttttttgaagcaaaccagccaaattggtcaatcattaaactaccggccatcagtccgactaaaacaatgacgaccgctaaaccagtgccaacaaccggaaccaagtaaacattacccaaaacatacagcgcgccaatcatgccaccaatccacacccaccaaggattaggcgtcttagttggcctaatcaatttgaattgaggtcgcaagactaacacgatgacgatcagccccagagtaccaactaaaaaagaaacaaatgccgcgtgcactgtggagccaagcacccgacctaggtgcccattgaccgcagtttgcatcgcactgagcattccggcaaccacacctagtgcacgccaaattccaaggccactttggtcagtgtcagtagctgtatctttttccgctgtttcagtgattcgattatgccgctgttcgagccacccctgagccgcaacggtgatgatgactcccgccaagactaaaattgcacccaaaaatcgggtcatcgtcaatgtactttggggtgagtcgaaccaaccaaaattatcaatcaatagcccggccaaaatttgaccaagcacgggcataataacggtttgaacactacccagcttcggaaacaacaagatattgccagttaagtagacgacccccaacagcccacccagccaaatccaaaccggttgactcgtaaataacgtcgtcgaaaatcctaaagtatggacatcaattagtgtcattatcgccaaaaacaacgtccccacagcaaaagatattagggaggcaccaaatggagatcccactgaattgcgcaatcgcgaattaatactcgtttgcattggtaacccaatcccgattgctaagccaactaaaattgctaacatcgaatattccctcatttctttatcttgtcttaacaatctgtcacaggttaatattagcacgagccggtaactaaaatagtcatgaaaatcgtctggataatccagcttaattttcatgactattttaaatatgccagccatttatggcgcgtaatcctaatcagtcactccccagtgttctgggtcctgacgccacgtatgcagcgaagctaattcctcgtcatcaatgtaatctgcttggcgagcaactttgattagttcaggatagttggacaaactgaacagcggtaatgacacagcggcaaaattttgcgttgccgcatccaaggcataactgaagattgccccaacagcctgaatatcgccacctgctgcttgaacggccttggccgcctgtaacacactgccacccgtcgaaatcagatcatccagcatgacaactttttgaccgggctttaacactccttcgatttggcgtccagcaccgtgatccttgggtttagcacgaacgtagatcaatggtagatttaacaattccgccacccaggctgcatggggaatgccagccgttgcgacccccgcaatcacttcggtcgccgggtattcacgcttgatgatggcggcgattccgtgcgcgatatgctgacggaccgccggataagaaatcgtcagccgattgtccgtataaattggacttttaatgccactggcccaggtgaacgggtcgtttggtcgtagtgtaacggctttaatcgtcaacaaatcagtggcgatagttgctgcaatttcactcatattagttactccattctgtcataatatctcggtaagcttgaactggttctgcagcctgcgtaattggccgcccgatgacgagaccgttgctcccagccttagcagcggcagccggtgtcatcacccgttgctggtcatctgactgcgccgacgctggccgaattcccggcgtaattccgagaaaatcagcaccgacggccgtatgaatcgcctgaacttcttgggcggaacaaatgacgccatcacagtcactcgcccgtgctagtttggcataatgcacgacactcgcccgaaccgttcccatgatttgctggtcctgattcaaaatagcttgattagtcgaagttaactgcgtaatcgctaataacttgggggcagtgactccagcggccattgcacccgcgaccaatcctcgtttggcggctgaaagcatcacgtgcccacccgcagcatgaaccgtcgtataggttacccctaaccgcccgatcacccgcattgcggattcgacggtattgggaatatcatgtagtttcaaatctaagaaaaccgcatggccgcgagcttgcacgtccgtcacaatactcggtcccgctgcataaaataactccatgccgattttgacagtgacatgtaaatcagccggaaattggtctaaaaaagctaaggcccgttcggcggtgggaaaatctaacgcaatgataattggtcgcttcatccttggacctcctgaatcaacgcttgcaagctggtgatcccgtactgatccattgccgccggtaatccagcaataatgtctgtacaagcagtcgggtgaccatacgttgcggccccaacttgaacagcatttgcaccagccaggtaaaattccaacacatcaaccggcgtgaacacgccaccaacgccaataatcggcaacttggtatgttgacgcacgtcatggatcatccgaacagcaagtggatgaatggcttttccagataaaccgcccgtaccatgcgctaagatcggttgacgtgtggctaaatcgatgcccatacccgttaacgtgttaatcatcgtcagtccagccgctccaccagcttcggcagcgagtgcaattgggacaatatcagtgacattcggggtcagcttcatgaaaactggtttatcgaccgcggcaacaatcgccttagtcaacgccgttaccgtcgctggatcagttccaaatgctaggccgccatggtcgacgtttggacatgaaatattgatttccaataatttgacgttaggtgccgacgccatttttcgtgcgactgccacgtattcatcaaagctcgcccccgcgacactcccaataatcggtaaatccggataatgagtcgctaaccacggtaatttatcggccagcacattgtcaattccgggatttttgagtccaattgcattgagccaccccgcggttgtttccgcggtcgttggtcgtgggttgcccgctttcggttcggcggtggtcgacttgatgaccaagccccccaacgcactcaggtctaactgttgagccatctgttgaccatatgccgccgtaccactagccggcataaccggatttttgaacgtgacaccggctaaatttactgttaatcgtcccatcgttttcctcctatgatcaagcttatcggcgggtgtcctgatttagagcgcctgcgttacaaatgactgtgattctcgtacttgcaaaattgccgcgaccgtatctaaggccgtaaacaatggaataccgtgcataattgacgtgtttcgaatcagggtaccatcattttcagcctgttcttcatccgaaaccgtattaatgacgacttgaatttcgccagcttccatgcgatgcagtaaatcatgctcgccactatcgatcttgtcgacggtcgtaacgggtaacccgtgtgtggtcagagcagtcgccgttccccgagtcgctagcaattggtagcccaacgcatggaaccgcttggctaacgccactgtttctggcttgtcttcatcccggacagtcaaaagtacgttaccatggctcggcacgtgtagcttagccgcttcaaaggctttgtaaagcgcctttgccatcgtgacatcgctgcccatgacttcacccgttgacttcatttctggtcccaacaaactatccacacgattcaactttgaaaatgaaaagaccggcgctttgacgtgtactaagggacccggtgtgaccaagccagtctgataaccttgttcagccaatgactggccaaggattgcccgagtcgcaacttgagccatcggaatgttcgtgaccttgcttaagaatggcaccgtccggctcgcgcgcggattgacttcaatcacataaacttggtcgtcgtggattacgaattgaatgttcatcatcccgacacagttgagcgcaatggctaatttttcagtataatccacaatttgtgcttggaccgccgccgaaagtgactgtggcggataaacggccatcgaatcgccagaatggacacccgcccgttcgatgtgttccataattcccggaatcaagactgtttgaccgtcacaaatggcatcaacttcacattccttcccgaccaaataactgtccactaaaacggggtggtcatgcgacaccttgaccgcgttatgcatgtaatagtctaagtcggtccgcttcttgacaatttccatcgcccggccaccaaggacataactgggccggacaaggacgggatagcccaacttatccgcaatagctagcgcggttgcttcatcacttgccgtatcaccagccggttgtggaatagctaaagctttgatgaccttatcaaattcgtcacggtcttccgcacggttgacatccgccacactcgtccctaatattttgataccatggtcagccaatggtttcgctaagttaatcgctgtttgaccaccaaattgcacaatcacgcccactggtttttcaagttcgatcacgtttaagacatcttcaatcgtcagtggctcgaagtacaatttgtctgatactgagaaatcggtcgagacggtttccggattactattcatgataatcgcttcatagccagctttttgaatggctttaacggagtgaacggtagcatagtcgaattccaccccttgcccaatgcgaatcggccctgaccctaacactaaaacggatggacgtttcgtgacaatactctcattttcaaactcataagtgccgtagtaataaggtgtctccgaagcaaactcaccggcacaagtatcgaccatcttataaacgggcgctagtttgtgcgctaagcggaagtcgcgaacctgatcgattgtttcgtgccaatagtcagctaccgtttgatcggcgaagccattgcgtttagcaacagttagtgtctctatgtcatccgtatgggtacgcaaagcttgttcgatttcaataatgtgtaatagtttatccaggaagaacacgttgatcttggtgagttcggctaattcatcaatcgggtaaccgcggcgaattgcttccgttaagtagaataaccgatcatcctgcgcatgaatgagcttatcgctgagtacatcatcatcaacactacgcaaagcgggttcttcaacgtggtgcaccccaatttctagtgatcggaccgcctttagtgtggcttcttcaatattgcgcccaatcgccatgacttcgccggtcgccttcatctgagtgcccaaacgacgatcagcatgggtgaacttatcaaacggccagcgaggaatcttgcaaactacatagtccaacgctggctcgaattcagcgtaagtggttcccgtcaccggattttcaatttcatccaaatgcaagccgactgcaatcttggcagccatcttagcaattgggtaaccagtcgctttggaggctaacgctgatgagcgactgacccgcggatttacttcaatgatatagtaattaaaactattcggatcgagggccaactgaacgttacagcccccctcaatcttcaacgcccgaataatcttcaaagcagcatcccgtaataattgcacttcgcgatctgctaacgtttgaacaggtgcatagacgattgaatcaccggtatgaatccccacggggtcaaaattttccatattgcagacgaccatcgcattatccgcagcatcacgcataacttcaaactcaatttctttgtacccggcaatactttgttcgatcagaacttgggtcactggtgataacgccaacccattttcggtaatgtcgtgtaactgttggggcgtctcggcgatgccaccgccagtcccccccatcgtaaaggctggtcgcacgatgaccggataaccagcttgctcagcgaaagccaacgcttcgtcaaccgtccgcgcaataccagaagctggcacgggttcgcccaattcttccatcagtgccttaaactgttcccggtcttccgcctgatcaattgcgctgagcttcgttcctaacagttcaatgtgcaactcatcgagaatacccgatttagataattccatcgccatattcaagccctgctggccgcctaaagttggcaaaatcgcatccggatgttctttgcggagaatctgtgaaacaaattcaagtgtaattggttccaagtagacctggtccgcaatttctttgtccgtcataatcgttgcggggttagaattgaccaagaccacttcataatcgagttcttttaatgccaggcaagcttgtgtcccagaataatcaaattctgcggcctgaccaataataattggtcctgaaccaattaccataattttatgaatatctgtccgtttaggcattgaattggcttcctttctgggttgcttgattagccgccatcaaatcaataaattcgtcaaaaatatgatcagcatcgtgaggacccggcgctgcgtccggatgatattgcacggaaaaggccgcgtagtcgcgatgccgcaagccttccacggtaccatcattaatctcctcatgggtgattaacaagtcagtctgcgctaatgaatcccgatccaccgcgtaaccatggttttgcgacgtaaaatcaatccgcccagttgcaatctcacgaacgggatggttaaacccacgatgtccgaacttcatcttgaacgtgtccgcaccgtttgctagcgcaaaaagttgatgtccgagacaaattccaaatagcggcacatgtttttccacttctctgatcatctctaaggctcccggaatatctttgggatcaccagggccgttcgtcaacatcacaccatccggattcaaagccatgatttcactcgccgtggtattgtacggcaacaccgtcaagttgcattgacgctttgctaattcgcgtaaaatcgaatgcttcaacccaaagtcgacgacgaccacgttggggcctgtcgctgggttgggataggcgttattcgttgagctctgggcaacaacggcccgatttaattccgtgactttgagccggtcaaccgtatctggtaagacgttatcgacgatggtggccttcatcgcgcccttcgttcggatatgtttagtaaccgcccgcgtatcaatatccataatgccaggaatcgcattctgttttagataatcgtccaacgactgagcattacgccaattactggctcgtcgggcaacttcgtgaacaacaacgcccttacaagttggcttgattgactcatggtcatcccgattaatgccgtaatttccaatcaaaggatacgtaaacatcaagatttcgccattataagactggtctgtgatcgactcttgataaccactcatgccggtattaaagactaattcaccaaccgtggccgttgtcgcaccaaaccccgtgccggggtaaatcgtaccatcttcaagtactaagtatcgtttcatgcttgcgtttcctttccatatgccaacttaccgtcaactagtgtcattaagacgttgccataaacgggccaaccgataaacggggaattgtgccccttcgataacatggtggccgcttcgatttcatattgatgatctaaatcaataatggttagatcagccggtgcccccactaccaaccggccggctgtatttaagccaaatagttcagccggacgcgtgctcatcagttcaattaaacgaccgagcgtcagtaaccgggtcttgaccagcgccgtatatagcgtggcaaaggcagtctcaatcccagtaatcccgaaggctgccgtcttcatgctgccctgtttttcggcatcagtatgcggcgcatggtccgtcgcaatcatgtcgatcgtgccatccaacaatcccgcaactaacgctgcgcgatccttggctgaacgcaacggtggattcatctttaacatcgggttatccatcgtaatatcttcatcacaaaggagtaaatgatggggcgatacttcacaagtcacgttgatgccagctgctttcgcattgcgaatcacgcgtaaactttccgccgttgagacgtgacaaacatggtagtgaaccccactcgcttccgccaacatgacatcacgagccacttgggccgcttctgaaacattattgataccaggcaatcctagccgatcagcaacgggccccgcgttcatcacgccatgatgataaagcgaatcatcctcaacgtgtgccgctaatggcaacccaactttagcagcaccttgcatggctgcaaacatggttccggccgtttgaacaccggaaccatcgttactgacggcaaaggcccccgcagctttgatgccggcaaagtcaacgagctgttcactagtccgcccagtcgtaatgctggcatattgtgcgacgtgaacatgtgcttcctgctgattacgcgccaccatcgtcgcgacccgctcaggtgtatcgggtaccggatccacattaggcattgctccgaccgttgtgaaaccgccatgcgccgcggctaacgttccggtcgcaatcgtttccttcgctgtttgaccaggatcgcgtaaatggacgtgtacgtcgacaaagcccggactaacaaagtgctgatcggcacaaatgacgtgatccgccggtccaaactgatcgtgcagttgatgcccgatcgccttaattcggccctcggcaatcaggatatccgttgtttgtaactgccctgcttgccacacttgagcattcttaattaatgttgtcatgcgttaaacctccacttgagttgctgaaattaatccttgatgagcgaggacgctcgccaccattgccatccgaatataaacaccattcgtcatctgctgaaaaattcgtgattgcggcgcttcaactaagtcactcgctagctcaacacctcgattaacgggggccggatgcatgataatcgcatgcttgggcattcgtgcggcgcgctcagctgttaaaccatactgttgatggtaggcagacgcatcgaaggtctgattgttcacttgcgataatcgttcgtgttggacacgtaataacatcatgacgtccatcgttgcgactaactggtccatcgtctgatattcgccgtatgcttcaaagtcacggccataccattctttggggccgccaaagtaaacctgggctcctagttgcgtcagtaacgccatattggaacgggccacacgtgaatgggccaagtcacccacaatagctatctttaaaccatcaaaatgaccaaattcttcataaatagttagcatatccaacaacgattgtgacggatgttgcccactaccatcaccagcattgatcaaactcatgtcaaacccggcgtcgagaagtggttgataataacgatcgcgttgatgccgaaccactgccaagttgacgccaatggcttcaatcgttttcaaagtatccagcaagctttcgcccttagtcacggaactagtctttgggtcaaacggaatcacctgtaatcctaatcgtcgttcggccatctcaaaacttgtatgtgtgcgggtgctattctcaaaaaataagttcatcgcaaacgttggctgtgacagttgtaccgttttcccattcttgaaagcttgggccaacttcaagtaggccatcacgtcctgattactaaattgttcaacactaactaggttttgactcgttttcatggctattgccgtctcctttgtatataaaaaaagtctagcttccgcaaaaatgtttgcaaagaggctagactccgattaagtggtcacgcatggccaaaccgtttcgttcctctctggaaacaattaaatggttttattcaattaaatcattcttctaatttttcaatactaattccatcatgtccgtcgtgttcttcaagggcgacactgacttgttcatccaaggccgttggaatatttttaccaataaaatcaggccggatcggtaattcacgatgtccacgatcgactaagaccgctaacgaaatctttgcgggacgtccatggtccatcaaggcatctagcgcagcccgaactgtccgacctgtaaataagacatcatcgaccaagataacgtgtttgccattgatatcaaccggaatatcagcaccatttagcttcgcttgaccggcaacatcaaccgcatgatgatcatcccgatataacgtgatatctaacgaaccaactggcacgtcaacgccttccaactgtttcaatcgttgcgctaaccgctgggccaaaaaaatcccacgagtcttgataccgataaataccaggttaccaacacccttattctgctcaataatctcataagtgatccgcgtcagcgcgcggcgcatggtcattgcatcaacgacttctcgtgccattagtttgtcagctccatttctgtaatttcaccttaatccacggggtaaaaaaagagtcaccccgttttcctgcgaaaagcgtgggagaccctacatgaccgttccccttgttagcctcacaggactaagttaaaggtgcttgtttaattggactaagtgtaacgaactccaccacaactgtcaaggactaatcaacttaagtcgcgttaattatctgacgactttggtcatttgccctttatgttgacaagcatcattcaggaacctgacgagttcaatagatttccaatcgtgacacgtgatcgtcttattccggcctctaagaataaatgatgagcggtcgcctaatattagtaccattggtcgttgaatccgttgatattagaacttcaattaaagctgggagaccatcaattcactttaatgactgtttcaatcttaacgtgctaatttagcaacaaatggtatatcaaaatatcattatatgcgaaatctaccctttatgagcaacaacaaactcagcaaaagttaagtccacccatcacttgaacaccacctcgactgaaaggcgttgctgacaatactcagcactggaagccggtgaagttcagacgggttgaaactgaagattatctcaacggcaacgttgaggggtgaactttcacttagctaactggaagtctcaacccgagcgaatcccgtttctgtatgtcggcatccaacgccctaaccaggtgaatttacactaaacaaaactttcttcagcagtcctgcgccggctactcctgcgcttaggataaacctttccaatacttaaattccttaacccataacactggttcgacgcttcatttgtttttaatctatttttcatttaattatagtcaaactgccaaattatcggtatactacttgttaaagataactaattttagggggacttaccatgcgtttacaaacactattacaaacaccatcaatgcaacatatgcgggtaattgcgggtgaacgcggtctcaaacgcgaaattagtaatatcggaatgatcgagtcacctgacattgctgactaccttgctaatggtcagtttttgattacgaacggctatcccttcgtcaatacaaccaccgacccactaactttgatcaaggcgatgcacaatgccaactgtgctggtctcggatttaaggatcatcgttacgttgaccatttaccaaaaaaagtgattgaattagcgaacgaactcgcttttccaatcattattacgcccggtgatgagttgatttctgaaaccatgcgcaaaatgcttagcatcatcttaaagtcacaaactaatgagctcagtcgcatcgtcaaggcaaaccaaacactagcggatttgttgctcaaagacccaaccaacaccacggtcttgaataaatgtagcgagctaattcatcatcctctcttcttaatggatagtcattttcgggtggtcagtgcttcccaagatttaccgatgacccgcaataccttgactgattttttacgcaatcaaaccgatatcgactatttcaacctcaatacccgcgtcattctcccttaccaaacaaatgacctgaccatcatgccactattttcggcttataaggaaaataaggcctttgtaggcgtcgtcgacttggacccggccaactcaactgatcagatgctgacgcaagtcgtcttaaacaccttgagtttcgtcaatggtcgggtggacatgttaaacgaatccgcattccgcaaccaaagtggtttctacttaaacgtaatggatggcggtatttcaaacgacctcgtgaataagactctgaaagcccgcaatattgatccgagtacgaagttccactgcgccaccattttagtcacgactaatcaccaggccctcttaagtaaccatctcttggaacaggttcagcaactgacactgtggtttattaaagaataccaagcatccgtcattgttttttcattaaagcagcaattggtcttattaatcaatgaccagcaaaatgcccagcactttctgaccgccctcgttcaatttattcagccaaagttggacagacaggcgcgtttgattgctggttacagttattcgactctaccactaaccgaactcgcaacaacctataatgaagcggcagaagccttggcactcagcaaaaacagtccccacgcagtcacgatctatcggcccaagtacgtcaaggaactaatttcactgattccacaaaatgaagcgcgatcgtttgtcgaacgggttttaggtggactcgtcagtggtgtcagtgcgaatgaacaacttaatctactcacgaccctgtatggctatttttattaccatcaaaacattgccgaagtggccggccacctagatattcaccgcaatacggtgatttaccgccttaaaaagatcgaaaaaatgctaacgttgaacttggacgatcctgaacagacccaaacactagaaatggcagtgctactttggcataatcaacaatcacaaaagtgaacgttttcattttcatcttccaaaaaaatatcgttttcacgaacattaatttattcggctacatttgtattcggttttcatctgtgctagaataagtctcattcaaataagtggtaattgcctatataatgtcatgatatggttgacgagtttctacccaaccccgtaaaggttggactataagcaaacgaggtcatcccgtttaccggggtgactttttttataggcaaatcagcttaatcgagagaggaagattgatttgaaggaagtatccgcagcacctaaaattaccaatgttaaggcggccattttagggtttcaacatctgttagctatgtattcgggtgatgtgctcgtgccattattgattggcgcggccttgcatttcagccaagaacaattaacttacctagtctcaatcgacattttcatgtgtgggatcgcaacgttcctacaattaaaacgtacaccactaacaggaatcgggcttcccgtcgtgcttggctgtgccgttcaagccgtcaatccgttgattcaaatcggtaaaacatatgggctggggaccatgtatggctcaatcattggtgctggtatttttatttttctgattgccggcttattttcaaagatcaagaacctctttccaccagtcgttacgggatcgctaatcacaattattggattcacgctgattccggtcgccttccaaaatcttggtggcggcgacaccagtgccaaggatttcggtaacttgcaagcacttggcattggttttctcaccatcgcaattattttattaattagcgtgtttgcacgtggcttcatgaaatccgtttcgattctgattggtattttagttgggactttgattgccggggcaatggggatggtttctttaaaacccgtcgctgaagctagctggttccatttaccgaccctcttttactttgggaccccgcactttgaatggtcatccattttgaccatgatccttgtctccttaacaacgatggttgaatcgaccggggtcttctttgcccttggcgacattaccggtcgtaaaattgaaggcgacgatttaaaacgtggttaccgggcagaaggaattgccgtcatcctcggtggcttgttcagtaccttcccctattcaacgttttctgaaaatgtcggcgtcgttcaattatctggtgtcaagacgcgaaagccaatttacttttccgctgcgttcttagttgtattgggcctactgcctaagattggtgcgctagcgacgattatccccgacccagtacttggtggcgccatggtcgtcatgttcgggatcgttggcattcaagggattcgaatgttagctcaagtcgatttccgcaataacaataatttactcgtggcagccgtttcgattggtcttggtttgggcgtcacggtgcaaaccaatatcttccaattcttacctggtgcacttcaaatcatgttgagcaacggggtggtcgttggtagtgtagccgcagttggccttaacttactcttcaacagccacgcagccgaaaacacgattgatgatgaatcagtcggtctcaatgaaacagaacaaccttaattatgacgcttaataacagcggttcacggtcctaatctggcagtgaaccgctgtttttttgttctgctacttaatagccgctctcattctattgattgctttatactgccattttttgctgaatgtcaagcgtcgtaccgatgaagactttttttaaagtaactttctttcgacttggcataaaacttgcccatgctgccgaagagtcatctaaacctggtccattccaaaaacaagccatcgtgaggcaataaactgattaatcccctgttaccctaaaaatcagtatgttatactagacaattgttgaattgttagttttttattaattttaggagtgggtcattattctagaacaattatttcatttgcgtgaaaaccgcacttcagtccgccgcgagttgattggtggtctgacgacctttttagccatgtcatatattttggccgtaaatcccgaactattgggaagtactggtatgagtaagaccgccgtcttcaccgcaacgattttagcggccatcgttggttgtctcttgatggggctagttgccaattttcccgtagcattagcaccggggatggggctgaatgccttctttacttatacagttgtccaggaatggcacattccttggcaaaccgctttggcgggagtctttgttgccggaattcttttcatcctactaacgctctccaagttacgcgataaactgatcaacttgattccaagtgcgctaaaatacgctgtatctgccggaattggcttgttcattgctttttcaggactacaaacctctgggattatcgttgcgaataagtccaacgcggtcgccctgggtaacttgcacagtcccaccgttttgttggcgattttcgggattatcgtcggcatcatgctagtcaccgctaatgtaactggtggtattttctggggcatgttcatcaccgccgcagtcggaatgatcttcgggattattcccctaccaactgggattatcagtggggttccgagcgttcaaccgatttttggtcaagccgtgacacaccttggtaatattaattcgtttcaaatgatcattgtcatcctgacgttcttcatcattggccttttcgatacgtcgggaaccttggttggggtggcaaccgaagccggcatggtggacaaagaatccggcgaagtcaaaggcgttggtaaagcgctctttagtggtgcactcgccacaactttaggagcagtctttggcacgtcaccgacaacggcttatgttgaatcgacttccggcgttgccgtgggggcccgtactgggttatcttccgtcttcgttgccctcttgtttgccatcgccgcctttttctctccaattttgacggtgattacgtccgcggtgaccgcttcagccctgattatcgttggtattttaatgttatcaaacgttcaatatattgattggaccaagtttgaaatcgccgtcccagcctttttcaccatgattatgatgctactaacttacagtatctcagaaggtttggccgttggctttatcttctacccaatcaccatgacggtcaaaggccgttggcgtgaagtaaacgccctcatgtggacgatgatggtcgtcttcattctctactttgcatttgtcgcttagaactgatggttcgctaagcaatgatggcagtctaaaacacccctgagtctttaactcaggggtgttttttagtaggcacggctgcatctaacgcctactagtgtttaagaacttgttgattatggtaatcttcagcgtagacttgggcaaagtcagcaagtttaacatcgcctaatcgaggttgatgtgctcgataatccgcgtaaaaatcgtggtcacgctggtaagcgaccgttttaacatattcccgtgcaaatgcgaccggggttccggcagtcactaaatgatcttgcatgacctcatcaggcacttgtgaaacgcgcaaatccggcattttaagagcctgtgacagtgcggaagcaacttccaaataagttttctcatcactcgcaacatatgtcaccgtttgccccggtgtcggttcggtcagcgccttaatcagtacagttgtaacgtcgaccggcgcaacccacacgttcttaacagccaaattggcatttgtgtagattcgatgactctttttaacggttggcacactgctcagtaaattatagtacattgccgttgggcggataaacgttaagtccacgtctggtaaagcggttgttaacgtttgttcgataatatgatacatgtaaagtgcaccgacttctggtcccaagtcggcccccacgctactcagattcaccactcgttttacgccggctgccttgatcgcggcggcatagatgtccgcttgtcgtttggcagcggtataaagatcatcactcgccgctataccagttaccatgaggtataccacgtcagcgcccatgaacgtcttggtcaaaaacgcttcgtcatcaagtcgaccaatggcaggggttgcgcgaaaaacctttatcaaactactgcgagttgcttgatgactgatgaccgtcacttcatgaccagcatgggtcagcttaggtaccaaggtctggttaatacgaccgattgaacccgttaaaacaattttcattttatgataaccctcttctatacttattaaattatccgtcaaagtcattatcgattataagcgaccactaaaaccccgtcaatcactggtggtttagttggctaaacagtgttgatgtgcggttgcgtgattcgttcataagacaggactgattaacgttaatcaaaaatcatttctatttatcaagagataatttttgttgaaactgtgcaaaattaggcctataatgtcaaaatgtttgacactgtcaactacgacggttagtcgtctttcctgttaccataagtttttcttacggagattatattagatgagtctagcacaattagaaataggattactgtggttgacaggctcaattgcggtcatcttcatcctgacgattggtacttattattggtactcccgcaaacgttccaacaattaccttgaaaatgatgattttaatctacgctactttattcaaaaacaagtcgattttcgtggccgcactaccggctatgaatgtctcctgcgtcaacaaaatactgatggttcgtggtcattaccaccacaacttgactcacttccacttcagcgggtgatcttcctgcttgaagatacctttaaggcgctacctgatgaagcgattacgttatcaatcaatttagaatacgaacaaatcatcagtcccgaattccgttattttgttcgctgggcaattgcgaacatcgaaccgatgcacttggcaattgagtacacacctcaataccaaccgcgtcgtatcaataaacgcctatttcggcgacgaattcgtgaagcccgcggttacggcatgcagtttggaatcgataacgtcggtgcaagtctagccaatcttaaaaacattcagtggcttttaaaagatatcgacacgctcaaatgctcaatgcgctcatttcgcaaggaagacccatccgtctggctggacctgaacctccaattctggaatcagctctctaaggaaaacaatattgatctaattctaatgggaatcgaaaatgaggccgatgaacaactcgccgagcaactgcaaatcagcattcgccaaggctacttattcggccatccaatcaatccccagcaatcaaccacaaaggagaaccacgatgcctaaaccaaccactgatgatgttaatcggcaacaactatactctgatgcgtactttgacactggccattggggactcaagattcgccaaacgatcgttggtatcgtgggttggatcgcagtgattgtgcccatcaccgtgacagtcctttccatttggtcaagttataatccacacattccgcgtttctggcactaccatgaaggtcttttcgaatttaagttcatcggtatcttactggccttttgctttgcactcgcatccctttttgcagtgaccatgaccattatacagaatcgtaagcgtgaacgtgtcgttgaacagtggccaacctttaatcccattaatcagaaaaaacggcagcaactgctcgctcagttcatggcggaccgtttcggcaatgccgaatttcgtgaacatacccgccactaccgggtcaagccagaacaaaatctcgatactaatcagattcagcaactttatcaacaaaataatttagacgatattaacgattaaccagggggcgccatgacaaatatttttattgaccacatattcgccgcaaccttatttaaatcggtaatcaacatcgcactcctgattttatgcctctaccccatcgttggctcttttttctggttcgccggcgcgctatcctaccgctttatcaagaccaataagcgtgatgatgactggcagtacattccggctgaacagcaaccaatgattaccatcatgatcccggcgcacaacgaagaagtcatgattgaagaaaccatcacatacttatttacccagctcaattatacgaactacgaggtcctagtcatgaacgatggttcgactgacaagacggccaccattattcaacggttgcagtccgtctatccacggctacgaaccgttgaaattgagaaaaacaagggcaaggcccacgccttcaatattggcatgtactttgcccagggtgagtatattctcagcaacgacgctgatacgattccagaaaaggacgccctgatgaagtatatgaatttcttcatccatgaccgcgatatgaatacatccgccgtcaccgccaatatggatgttcaaaatcgaacgtcgcttttaggtaaatctcaaaccgttgaattctctagtatcgtcagtgttatcaagcggagtcaaacttccatcaacgactctatgtacgcgtatagcggggcaaataccctctaccgcaaacaatttctaattgacgttggtggctttcgacaaaatcgcgcgacggaagatatcagtattgcctgggatcaccaaatggtgggcgccgtcccgcggtttgcccctaacatcgtcttccatatgaacgtccccaccacaatccgagacctttatcatcaacgcaaacgttgggcacagggtggcacggaagtgtggttaacgaacattaagaaattcattttccacccaatcgttcatcgctatcaactatcaatgttcgtcgattcgacgttgtcaatcatctggtcctttttcttcgtcatcacttccttgatgtttttgattctgatgggttacttcctgataaccggcaattttgaacgagtctaccacggcttgatgttgtcatttgtctttgttagttttgaactattggccgggttcatgcaactgttagcggcactcctgttggaccatcatggtgcgaaactaaagtactggttcttcgccccactctacatgttattttactggatgatcaatcctatcaccgtcgttgcaacgtttattcctgcactcaaaaccattctgggctttggctccggaacgtgggtcagcccgaagcgacagtcattgcagggtaaaaagtaaaacggtgtcgctattaacgctttcaataatcgataacgggtctactggtgcgagaacttgcaaccagcccaaccaaaaacgtgcacttacctgagtgataactgactcaggtaagtgcacgttttaatattaatcccttttgatcgttttcttagctatgcaaacggagctgcccaggccaccctgtgactagctacgctgagtaacaggtcccatgtgtcacgtgccactgaacacagagatcggcaggtaaatcacgaacggcctcacgacttacctgtgtgccaagttcagtaattgatcgcccttgctgactgccgaggccctggcgattcagctgaatcgtccgcgcaccaactcgatacaagtcactcatgatctggtggtaggctgcggccaagtcatgcaccatttccgtatctgattgatagactcgattaagtgcgcgcgcattatcggaccgtttgagttctgccaagcacagctcgggagcgggcaagatttgtttatccacagttccaccactgatttgattgcgcatgaattcaaaatgcgcaacggcaggatggttgaagccactgattttaccggtcaacgcgagcgccggtaccgaacctatcccggattgggtgatgccttgtagcccccagaaaaagttaaagtgccaccaatttagattatgcggcttatcaaccggtttccgaatatgatgcataaaagcagcgtcctccatccgtttaagtcccgccgcattaatattcagcgttgttgtgccccgatgcaaccctttttgagaccgcattgccatttgccaaccatgtacacggtgcctaaccatcatcatcaatgtgccaaattccatgcccgtttagcctccaaattaattgcattctgccaatataaaaatcgtcccctactgcttaaaaaggacgatttcaacgtttgggtcagcctttaactgccaacaccaaccattattcttttatgacgaatttaagtaatgtttccagcatagaatggtgctcaccgaatgtcaagcgctaatcgtgggacgctgtcatccccttaacgccaatatcagttcggtacactagatcaccgactctgagttggtcgatttgttgataaacagcccgctgtgctgcgaccaagctcggggcacttgcggtaaccatcatcacccggccacccgcactgaccaattgatccggggtacccgcaacgctagcataatccgcaccagcaaccgtcggaaccggtacaccggcttcagttggtcccggataaccgggagcagctagtacgacgccaagataagttgccgtcgtttgccactgcgcgtgtggttgccgatgttgcaataaatcgacgatgacttgataaaaatcactctgtagttgtggtaataagatctgcgtttcaggatcacccagtcgcaaattatattcaataacttgaacaccggtcgcagtcaggattcccccaacatagataaccccttcaaagcttaacccatcggctttgagacctgcaatcgtcggttcaataattgtcgcaatcgtttgatcgataaccgcgggcgtgatttgcggtactggtgaataggcccccataccacccgtgttcggtccccggtcatggtcctgtaaccgtttatgatcttgggcggtcggtaataacgcatagtgctcaccaccaaccaaaaccatttgggaaaactcaaagccagcaacgtagtcctcgatcaagaccgtcgaactagttttaaaggccgtcttaatcgctgccgcggcttgttcataactcgtcgcaaccgtcacccctttaccagctgccagcccatcgactttgataacttgcggcaccgcttgttcatgactataagctagtgccgaatccaattcatgaaattgccggtagtcggccgtcggaatgtgatggcgactcatgaaggccttcgcgaataccttagaactttccaactgtgccgcagcttggttggggccaaagatagccaggccggctgcttgaaagtaatcaacaatgcccgcggctagcggtacttcgggcccgacgaaggtcagggtaaccgtattggcccgtgcaaagttgaccaaccccgcaaagtccatttcgtcaatcgctagtgtccgaataccatcccggatcatgcctggattaccgggtgcacaatagacggtactgacttgcggacttgccatcattgccttggcaatggcatgttcgcgaccgccaccaccaactactaatacgtttgccatgcacgcacccatcctttcattaatgccggaagtgtcgaacaccagtggtgaccatcgcaataccataacggtcggccatggcaatcgaatccttatcacgaatactaccacctggttgcacgattgcacgaatgccgtgctgcgcagcatattcgacgcaatcatccattgggaagaacgcatccgaagctaggatagcattttcgtagccagcttgttgcatcgccttaccgatggcaatcttagttgaatcgattcgattcatctgaccagaaccgattcccaatgtccgatctgcggtggttacaacgaccgcattgctcttaacgtgcttcacaacttgttggccgaaagcaagtgcttttagctgcgcaggtgtcggttgggttgcggtgactacggtaaaatcagctggcgtttcgaaggccgcgtcgacctcctgacgtagtaagcccccaccgactgaaatcgtttcaaacttatcggccgtgtgcgtttgctcaaagtcaaccgtcatcaagcgcagattcttcttcttggccaaaatagcaaaggcatcgtcatcaaaactcggggcaataataatttccaagaagagtgcgtgcatcttctcagccgttgcgagatcgactgggcgatttaaggcaatgattcccccaaagattgaaatcgaatcggcttcataggctttatcccaagcagcctcaatcgtcgtacccaagccaaccccacacggattcatgtgcttcattgcaactacggccggctgctgatattcacagaccatccgcaaggcggcatccgcatccttgatgttattgtaagaaagctctttcccatgaatttgcttggcacccgtaatcgagaagtgcgctggtaaggcattttcgtaaaaggcagccttttgatggctgttctcaccataacgcagggcctgcttcttatcataagtaagggtcaacttttctggaaattcttcagtcgttaaatattgggcaatcaaggcatcataggccgcagtatgttgaaaaactttggccgctaaccgttgacggagtgccggtgtgaccgcgtccgtctgcaaatcagccagaatctgctcataatcagcaggatcaacaattggcagtaccgcggcaaagttcttagctgcggaacgcagcatcgacggaccaccaatatcgatttgttcaatagcttcagcttgtgtgacgtctggttgttgaatggttgctttgaatgggtacaggttaaccacgaccatgtcaatcggttgaataccagcttcttttaattgcgccatgtgcgctggcaggtcacgtcgtgctaatagtccggcgtgaaccttaggatggagcgttttgacccgaccgtcaagcatttcaggaaaaccggtcacttcttcgattccgatgactggaatatcagctgcttccagtgcctttttggtcccacctgttgaaatcaattcatagtcaagggcaacgaggcccttcgcaaaatcagttaatccctgtttatcagaaacacttaacaacgcacgttttgtcatcttaaattgctccttcattaatgagtgtctgtaatacatctggataaaattggtgttcacaatcatgaatccgggtcgccaggctggctagcgtatcgtctggtgcaaccggaacgacccgctgggcaataatttgcccggtatcgattccggcatcgatatagtgaatggtaacgcccgtctcagtcacaccagcgtcaaaagcatcctcgataccgtgacgacctggaaatttcggtaacaatgctgggtggatgttgataattttatgcgaatacgcattcaagagggtcggaccgataatacgcatgtacccggccaataagaccagtttaatttgtcgcgcttgcaaggccgtcaaaatgatggcttccgcggccgctttattcgcataatcatgaaaatcaacaatcaatatcggtatgttagctgcccgggctttatcaatgaccggcgccgtgggttgatcacagacgagtaacccaatcaccaccggtaactgccgttcaataatcgcttggtggagtgcaacaaagttggtgccgttccccgaagcaaataccgcaatcttattaggcatgttcagcctcctcgaaaacgacgggggccgtcccagtttggactgttccgacgcgataataggactgcgcgttggccgtcaaattagccgtcacagccgccacttggtcggggtgaacgaccaaaaccattcccaggcctaagttaaaggtcgaccgaagatccgtggcagtcagcccaccgagttcggccaataacgtcataattggcggcaccggccattgacccaattcaaggtgcgcactcaagcccgccggtaacgctctggcgacgttctcaatcaagccgcccccagtaatgtgggcgatactcgtcactaatttctgctgtaataatggttgaactgcatcaacgtaaatggtcgttggtcgtaaaagttccgtttgtaaatcatgaccaagttcgtcaaaaaccgtggtcaattggtagtcgtgttgtttgaataaaatatcacgaactagactaaacccattcgagtggaggccattagacggcaacccaatcaagacgtccccagcccgaacatttgctggtgataacaggtccgcgcggttcgcaattccgaccgcaaaaccagcgaggtcgtaatggtcctgaccatacatatcgggcatctccgcagtctcgccaccaatcaacgctgtatgggcctgctgacagcccgtgacgacgccagtcaaaatggctttgacccgcttctgatccgtatgtccaagacctaagtaatctaaaaagaactggggggtcgcgccttgtgccaaaatatcattcacacacattgcgaccaagtcaattccaatcgtggtatgttgatcagcagcgattgcgactaagagcttagtccccacaccatccgtccccgctactaacacgggatcgttggcagttgcatccgaactaagtggaaacgcccccccaaacgcgcctaattgctgattgccactcatttgtttgaccgtctttaagacgtcgtaaccagcgttgatatcaacgccagcccgcttatacgcatcgctcacttgatcaccccttcatgattggcttgtaattgcgcaatttccgcatcatactcggcttggtaatcatacagggccgttggataatccccattaaaataggccatgcatagtccaccatacggttcggtggtcgacaagccaactgcatcaacgacgccctgttcactgagaaaaccaagtgagtccgcaccaaacgtctgacacatctcccgaatcgtttgctgagccgcaatcaattcattagtcgattgaatatcgataccgtaaaaacatggatagcgtaatggtggcgatgcaattcgtaaatgaactgactttgcacccgcatctttcaataatttgacgatccgccgactggtggtaccacgtacaatcgaatcatcgattaagacgactcgtttaccagcgacaacacctttgaccgctgaaagcttcatccgaaccccctgttctcgcaatgcttgggtcggctgaataaaggtccgtgacgaatattgatttttaattaatcccatctcgtaaggcaggccactcgcttccgcatagccggtcgccgctgataaagatgaattgggtaccccgacaacaatgtcggcgtccacgggctgttcaacagcgagctgagcacccattcgtttacgtgcagaatggacgttgacgccgtgaatatcagaatctggacgtgcaaagtagataaactccattgaacaaatcgccaactgtgtatcagtcgtataatggtcgatcgtcaaaccatgatcatcgatcgttaacaattctcccggctgaacatcttgaacaaacgtcgcaccaatcgtatcaagcgcgcaagtttcactacaaacgacgtacccgcccgtgggtaactgaccgacgactaatggtcgtaacccgttaggatccaaagcggcaatcaaacaatcattcgttagtagtaagtaagcaaagcctccgtggacttgacgtaaagcatccttaacctgttccgttaacgttgctgcggggctgcgtcgaatcagatgcattaaaatctcactatcagaactagcatgaaaaatggcaccatgctgttccaaccgtcgccgcagtgtcaccgcgttcgtcaaattgccgttatgtgcgagtgcaaactgtgagtcgctaaaattaaaactcaagggttgaatgttttccaatccatgattaccagccgtggcataacgtacatggccgactgcagcttgacccgtcaaacgtgccaaccgccgtgggtcccgaaagacatcagccaacaaccctagtccgcgttccgtctgcagtttgccgtgatcattcgccgtgataccggctccttcttgcccccggtgttgtaacgcatggagcccaaagtacgttaattgggcggcgtccggcgagccccaaaccccaaagacgccacattcttcattcagacttcttacttcagtaggcatggtaaggccccttcccacaactgtttggcgaaactaaccttaatatcaaacgcctgatcagcagtttgaacgtgtagccgatccgttgcagttgttcgtcctaaataggtcacatatggttccattaaactttcaaacgcggcttgctgtgctggtgtcaccgagataacaaatcgtgactgcgtttccgcaaagaagttggcagcgggcaagtcactggccagttccaccccgatattttgtggaaaacatgattcggcaatcgtcgtaatcaagccaccttcagaaacgtcgtgggcactagcaactagtcctttttgaatcgcagttaacaatagacgctgattacgattttcagtcacaaggtcaaaatcaaacagctcgccactgattgttcccgtcaacatcttttgcagctcactaccattgaaattggcttctgtggtacctaacacgtagactgcatcgccagcgtgtttaaaatcgctagtcgtaatatctttctgatgcttaattaacccgaccatcccaatcattggggtgggatagatggcttccccgttcgattcattgttcaacgagacattgccagaaatcacgggcgtattgaataattggcaggcacgagcgatgcccatcgccgattcgtccaaatcgtaaaattgttcaggtttctctggattaccatagttcaagcaatcagtgatgcctaaaggttgcccaccggaagcgacaatgtttcgagcagcttccgcaacggcgatttctccaccgacacgggggtttaagtataagtatcgcccgttaacatcggtggtgaccgccaacgccttatccgtatgtcgaatccgtatgacccccgcatcggaacccggcttgacgaccgtattcgtttggacctgcgagtcatacgttccatataacgacgctttggaagcaatcgttggctgttggagcatcttcttcaatgtgccagttgcatcaactagtcgtggcataaattgatgatggctctgatggttcaagcgcgttggtcgtttcttttcgcgttcatagaccggcgctttggtcgcaagtgcatcgacgggaacatctgcaactaacttaccatgatggaataattgatactggtggccggctgtcactttaccaattgtgacagcatcaagaccgtacttttcaaagacttgataaatttctgcttcggcaccagctttgacacatagtaacatccgctcctgtgattcagagagcatcagttcaaacggcgtcatgccagtttcacgttgtggtaccaagtcaagattcagtgacaacccactgcctgctttggacgccatttcggctgaggaggaaactaggcccgccgcgcccatatcttgaatcccgattaaaacatcacgatgttcatgaataacctcgagacacgcctccatcaataatttttccataaagggatcaccaacttgaaccgcggaacgctgggtttcattggcgtcattaaattcagcagaggcaaaggacgcaccgttaatgccgtcacgccccgtttttgcgccgacataaataacggcgttgccaattcctgttgcttggcccttctgaatatcagcttgatccaagattccaacacacatggcgttcaccaacgggttcttctgataactcgcatcaaataccgtatcaccaccgattgtcggaattccaatacagttgccataaccgccaatgccggcgactacttgcgaaatcaagtatttcgtatgagcatcagtcggttccccaaagcgaagactgtccagcagcgcaatcggccgggcccccatcgaaaagatgtcccgaatgataccacccacacccgttgccgcaccctcataaggttcaactgcagacggatgattatgactttcagctttaaagaccacggcctgaccatcaccgatgtcgataataccggcgccttcaccaggcccttcaagtacctgttcaccctgcgtccaaaattttttcaagactggttttgaattcttgtaggagcaatgttcgctccacatgccggaaaacaacccggtttcagtctcgttaggtaagcgttgaaggaccttatccgttaataattgatactcagcatcggttaagccccaatcccgatagaccttagaatcgcgaacatctgtaggtgataatggttgctttttaagcatgggtgacctcctcttgactcgcaatgaccgattgaaaaattccgagaccgtccgtggaacctaagatcatctccacggcccgttccggatggggcatcatcccaagcacatttcccgcttcatttgtaatgccagcaatattagccgtgctgccatttggattctcgacgtattcgaagatgatttgatgattagcacgtaattgcgccaaggtggcctcatcacaataataattgccttcgccgtgggcaatcggtaaactaatttgatctgtcgatccgtatgcggtggtaaaaatcgtctcatgattggcaattcgtaatgggctgtcctgacaaataaacttcgctgagcgattggcctgcaatgcaccaggtaataatccggcttcggtcaagacttgaaagccattgcagattccgatgactggtttaccagcgttagcaaatgcaataacggccggcatgatgggcgcaaagcgggcaatcgcaccactccgtaaataatcaccgtacgaaaagccaccaggtaacaccaccgcgtcataacctgctaatgaggtcgctgtcgccggaatcaaatcagccgtaacgtgtaaaatatcgcgcaaggcattcaccatgtcatgatcacaattagaaccaggaaagactggtacggcaaatttcatcattacaaagcctccatctcagtaatttcgtaacgataagtttccatattaacgttggctaacaagcgatcacacatctcgtcgatttcagcggcaactggccgatcatccgcgtgaattttcacctcaaaatacttacctaattcaacggcatcgacattcgtatatccaagtcggtgtaaggcatcatgaatcgcctcacccttggggtctagaattgattgcttataagtcacatagattttaactaagtacatgttaggcctcctcaacggttgctagccgcgtcaatacttcctgataaacactagtcaagtcgcctagatccttgcggaagacatccttatcaagcgatgcaccggtctttaggtcgactaaccgacaactatctggtgagatttcatcagccagcaagactttaccggtggtcgtcaacccaaattcgattttaaaatcaacgagctgtacccccatcgccgcaaaaattgccgtcaaacgctggttaacctgtaaggcctgccgtttaatttccgccacgattgccggtgttgcaacatttagcgcgtggatttgtgaatcattgataaatggatcatccagctgatcactcttatagaaaaattccagtactggttctgcaaatttggttaagtgtggcacggcaaatttacgctcaaaactacccgaagccgcattccgaacaactgtctccaagggaatcatggtcacgcgacggacaagttgcacatagtctgaaggttgctcaataaaatggttggcaatgccgtgattggctaagtctttgaaaatcaaactcgcgatgcgattattcaatcggcctttctggtcaatgggaaccttccgcttaccatttagcgctgttgcttgatctaagtattcgacccatagaatttcaggatcattagtggcatacatcgctttcgctttacccgtgtaaagcaaagcttgtttctcaatcgctgccgtcattattattgttcccctttcaaatttgccaccgacgctaatgctgcgtcaatatcgtgatttaatacggtgacatgacccatcttgcgctggggcttaatggccgccttaccgtagtcgtgaaaatgccattctgggtgttcaaccaactgttgacgtgccactgttaagtcatcacctagcagattacgcatcactgccggactggtctgcgtaatggccggaatcggtaagccacagatacttcgaatatgggcctcaaactgcgagatgttgcaggcctcaatcgtatagtgaccagaattatgtgggcgtggtgccagttcattgactaataaagtatcatccggtaaaacaaagaattcgattcctagcacgccgcgtagttccagagattcagcaatcgaaaccgcaattttgcgggccgcactatgaacactgggctgaacattagctggggcaatcgttgtgtgtaagatatgatgttgatgctgattttcaactaacggaaaagtcgtaacaacaccagcagcactacgcgtcaccatcatggaaacttctgttcgaaatttctgccgcgcctctagaatgcacggctgtgtcaataagacactagcggcttttgtcaccactgctgtgtctagatccgtttgtccgtgaccatcgtagccacctgccgccgttttgagaattgccggcgtaccaacacggttgagggcgtaatttaatgactgtaaatccgtcaccggtgcgaaagatgtgactgggatgccatgatcatgaagaaattgcttctcattaagacgatctccagtaatatgcaggagtgcagtgccctgcggtaactttgcataggcttgcgcagcaatcaaagcattctcatcaacgttttcaaactcgtaggtcaagacatcactacggcgcgctagatcaagtaaagccgcctgatcatcataagccgcaacaatctgaaaatctgcgacctgggctgccggtgctttgggtgtcgggtcaaggacacctacccgatagcccatcgccttcgcgctaagcgtcatcatctgaccgagttgaccgccaccaacgattccgatcgttgcgggtggtaagagtgcttccttaaaattggcgttcactttgttcagcctcctgacgttgacgagcacgaaattctccaattgcatgttgtacttgtggttcccgtaaaccgataatttgggcggccattagcgcaccattcttagcccccgcatcaccaatcgccatcgtcgccacgggtacgccagctggcatctgtacgattgacaataacgaatcaactccgttcaacgtatgggtcttaatgggcaccccaattaccgggagtagtgtattggcagctagcatcccgggtaaatgggcagcgccccccgcacccgcaataataacttgaattccccgtgacgctgcttcttcaccataggattgtaatgtctggggcattcggtgggccgaaataacgtgacgctcataagagactcccagtgccgttaactgttctgccgctaattgcatggttggccaatcagaaattgaccccataatcaaaccaactttcgccatcatgatccctctttccctgttttcaccattagtttagcaatcaggcgggacgctgtcaacgaatttcttaactttatctattaattaacgttttaatgttcgtgttaattaaattgataattagattaatgctacctcaacatgtacgaattacctcactgtttgcaggttttcggtgtctgaaaaaggttatcaactgatttcaagcgactatcttgataatattattaatattgaaatttccgaacaatccgtcatcatctaagtttcaccataacaaacttactgctaccattatcaacaactatccgttgaaacgggccattaacttttgtcggtgcgcaccaacaattgacagcaatgactgggaatcggcgtaggacgagcaactaagcatgtttatgctaactcagactatttatagcggggctaaactgactgccgctgaacttaaaaacaatcaacaacttaatttgcgaacgctttcctaaaggatcggattgaagtgaccaaaataacgcaaaaaaagtctcaaggaagcgattcctcgagacttttttaaggtactaattattttgctgaagcgccggaaacactatcgacatcaggcgcttcaggcttggttggtgcttctggtgcggcttccgtatcggctgaagcgccggagacatcatccaccgctggggcagcatcaggcttcgtttccttcgccttcgatgaagctcctgaaacggcgtccgtcttagcatctggatcaggtgctaacatctggcccgtctgcttcaggtaatacttcacgattggtaagaggtcgagcacaaactcgttgatacctttgtactcacccttatcgtcatgcaaagcttgataatagtgcatcacatacttattagggataccaggtaccggtaacttgaagagatcagtctcaccggttcgtagcatgtgtaccgctcgcttaacaccaggtacggcccgctttggatgacagtcagctagtggattaccggcttgagcaggtgtccgtgaagctaacatcttgtcgccatccatttgatggttatagtataaaaattggttgttggcatcggcatacgtcaattccattggcatcgagttgaggaaccaatttaattggttgacggtcagcacaccccgatcgagcttaacgtagtcgtcaccctcagccgcatgggtcttagcagccgcttgttcgacccaatcagccgcatgcatgttgacgcccttgattgtcgtttcaacttcgcccttagcctcaaggtcttcattcttccaatcatcagcgtgtgcttccgcatccatcgcgttgaccatcttgacaaacttcagaaacttgcctaacgtttcttgtaagaacgagacagtccgagcatccttcagattgttttggtcatcgaaagcctgcttaacttcgccgagcaaaaattcattaccaggcatgaccacagcatcaacacccggtgactctaaaatctggcgtagattcaactgtgcccgcgacgaaccttgatcatagtaagaagcgccaacgatcaatacgggtttccctgacatcgggtgaattttaaacgacaaccattcgatcacgcttttaagtgcagcagtaattgtatgattatgttcaggtgtcgcaataatgaccccgtccgcctgcatgatctttcgtttcaaatattgaacggcttcaccttctgtttgatcatcactctgattaaacattggtacatcttgaatatccaaaatttcaatatcaaccatgtcactaaaatgattagcaataaactttaacagtaaccgattataagacttatcttcaattgaacccgcaattccaactaatttcatcgtcgtcgccctctctataatttttcccaatccatttcacgaacttcttcatacgtcgtcgcgttggcattctttaattttttcgtgatttcgacaaagacttggaaatccttgaacaacccatcgagcttcgtcgctttctgttggtccgttaaattcccctggtcatcaaaggcttgcaatgaatgaccaagcataaattctgaacttggcatgatccgcgcccgtaattctggtgaatccaaaacttgccgcagatgtgcttgagcccgtgatgtgccgagtgccccgtatgaggccccaataatcatgacgggtttgtccacgaagggctggatatggaatgataaccattcgagagcattcagtaatgccgcgggagccgaatgatcatactctggtgtactaataatcacaccatcagcttgttcgatcttatccgccattgcttgcgcctgtgccggaatttcatgattttcgggcttattgaagattggtagacccttgatttccattaattcaatctctgcttgatccgcatagtgggactgcatatattgcaacaacttacggttggtcgactcatctgaattggttccaaccatcgcgataaatttgtgcattgagaacaactccttctatgatcaaatagtcaaatattatataatttcttagtcaataactatattgtagtggatttcactaaagaaagcaaaacaattttaagcgctttcagttttgttatgcaaacaactgaactcactgatattaggcttatccgtgcaatcaagtaaattcagtatccgcgcaacgttaccgtaattatatctgcttaacaaattttttcacaaagctacgacgctacgatcaaatcaatcaaatccgccggggcaattcgaccaaagtaatgggttaagtccaacggtgctagcgccgtcataatcgcctgccgttcatatttcacaccagtcaaccgtgcaacgacgggagcaatcggttctgcaccgaagaaatcgccataaatcgtaactgcttcgatgcgccctgccaccacgtttaactgaaactcgacggtcccagcatcaaaatgccggcgctgcttaactgtaaacgctggtgactgaccgtaaatccaatcccagttggtaaaatattgttggttcagtgctgctacccctgccagtgccgtttcatctaactgatacgtcttagcttgactcaaatcagccacgcccaggatttcacgggccaacgtatcgcgaaattcctcaatcgtcaagtgctgataagccggcgccatgtacggtttcaagttcgtgactcgacttcggaccgacttgatacccttagagaccaacttatcggtcggcaccgtaagagctttcgcaatttgcgtctggtcgacatcatacatcagcgttccatgggagaacatccggccattctcaacgtgcatggcatttcctgagaacttcttgccatcaatcaataaatcattgcggccactcatcgtcgcaccagtggcccccatcgcgtgtaaagcctttagaactggtgctgtgaaccgcttaaagttaccaaaaccgtccccgtcgtccttagtaataaaactaaaactgacatttccaaggtcatcataaaccgctccaccaccagaagttcgccgcgtcaatgtaatgtggtgtgcgtcaacatagtcctggttaatctctgccttgacattttggtaacggccaacaatgatgcagggggcgttaatgtaaaagtatagaatcggttccgtcaaatcggcatgttccatcaagtaagtctcaatggcaagattcgtgcgaatatcatggctggagcttgcaagatagcgcatcgtcacacttcctattctaaataaatccgttgcaaatcattgatttcattgttagttaatttaagctcagtgtgtaaatagtggtttaaattacccgattgtcgtttaatttcggtcatagcggcgtccaaataagccgcatcaactgaccagagggcccgaatactttcgaccgttgcatctgatgcgccctgagcacgtgcttcggccatcgcaccattgatccggccaatcgaagcctgattagttaagagataatcctgcttgatcgtttcaaaatcgactccgagtgcggttaacaggtataccgcccccattccggtccgatcttttcccgcagtgcagtgaaatagtaacgtcgaatcgggttgatcatttgcaagtagattatcaaagaaccggcgatactcgtccttggcatgttgctcgtcggccaccatctgatagacctttagcatgtgcttgaatccactatctggatgcttctccaagttagccgtcatcttgtcagtaccgtcagaattccgcgtttcgtccacattgaacactggtgcgtacacgtacttagcattggcaggaattcgatctggcgcatctaagacttcttgtggtgaacgaaagtcaatatcgtagcggacgccataatcatccagcaaagcttggccggctgacgttaattgatcaagcccaccagtccgaatgaccttatgccacttgatttttcgaccgtctttagtcgagtaaccaccgagttcacggaaattaatgccacctggtacagttaatacacgttgatttgtcatttttgaaaccacctatctgttaacttttcattttctattctaacattatcggtcagtttaacggtgccccaatcaccgaatcagtcgctttatttccaagataattcgttagcaccatcgacaccaaccgacatcaacgcgtgctataatgtaagttacatagccagcgacggcccgtcaaatccagaacacgtttgctgacaaacagcatcacaaccttggaccgattagccataaatttccatactggcactaaataaaaaatattcactgaataatataacggaggatctttcgatgacatttgattatgcacaccaaactgattggcccatgactagtggtcaacatcagtcaccaatcgatattcaaacacaacacgttcagtcttcacagctatccgccatcaactggcgaggcttgtaccaagccaaaacgattacgggcgaagcgacgactttgaaggctagtggaattggtgccgcttatttgaacgaccgcgactttgcctttcaacagattcactttcatacgccggcagaacacttaatcgatgggcaagccgcaccaatcgaatggcatctcgttcatcaaagtgctaccggccagctcgccgtcgtcgccgtttttggacggattggcaagcctaattctagtttacaaggcttacttgaccagttcacagcccaaacgagccatgaactgacaacaccggtcaacttaactgagctcctcccagataccgggacggtctatcactacttgggctcattgacgacgccgccactaagtgaaaccgttgaatggtatgtctgtgccgatactgtcatgattggtgaacaacaattagctgcttatcagcaattatttgccgctaataaccgcaagattcaaccgttaaacgatcggccaatcattgccgaacgtttctaaataattttaatggggtgagctgatgcctaagaaagtaatctggggcttgattgcaagtggcctatttcttttattgatcgtcggtctcggactgacaacacaaatccatcaagataaagtcagtcacgtgattactgcgcaaaaacggccattgatcatgattggaggtagtagcagcacgcggactgactttgatgacatcatccgttcacttaatgagcaacagcaccatccgctcatcaccctgactgttaaggcgaaccaaaaattggcgtttaaagaaaaacgcgtcgagaacaccaaccttaacgatgccctcatcgtgatctttttcgaagatagcacggactcaacagagaacattatgacccaaacgaacggcttagccaaagctattcgttatttgcaacgtcaccaacatctcaccacggccaacgcactcggttattcaaatggtggcctgatctggagtcgctatctagcaggtttgagctcgtccaaaccattagcagtccacgatttgatgttgattggcaccccattcttgggtactgatgctgcacatcctgataagacgctctatacatcacttcttgatcacaagaaccaattcaagaaattgcatgcggtcatcaacattgccggtgacactggcgagggtaacgacgatatcgtaccgctcagcagtgtgaacgctggtggcaacttatttatgaacaatgttacccgctacaccgccatgactgttaaccaaaaatcaattagtcacggtgacctgcttcacgaagcatatgttgcccggctcattcgtcaaaatctgatcaatcaataatatttttagctttagctgataaaaaactgagccacccttcatgatgatgaagggatggctcagtttttttatgattgattgtccgctatgactactggcgatcaaactatccaacaatttagtgtcacgagtagcccacacacgggttgcatagggctcaaaggggcgccacgtcgattatgaattggcagtcgctacaaatcgagctagctcatcggtcgacataccggcactgacacccaccagtaacttaatccgggctttttgtccattcaatccctgacaaaaaatcacacccatttgtttcaattgaacaccgccaccttcataagcatagacatcctgagcgataccgttgaagcaccgggaaaccagtacaaccggaatctgcatgtctaataatttttgcacagctggtaacgtcgccggtggcaaattccccgctcccaatgcttcaatgactacgccatgagtcgtgggttgtgcaatggcgtcaaatagttctggtcccatcccggcatatgctttgatcagaaaaacattatccgtgaccgtttgaatcgggcaaaccgttgaccgtagtaatgattcaaaaaagacaatgcctttattagcgactaacccaatcgggccaaaagtcggtgttctaaaagtggccacgttggtcgtatgcgtcttagtgacgtagcgggccgagtggatttcatcattcataaccactaaaacacctttttcggccgcatccggtgtactagccgtttgaatcgccgtttcgagattatgcagaccatccgacccaatctcattggcggaccgcattgcgccggtaatcacaacggggagctcattcggtaaagtaagatctagaaaatacgccgtttcttctagcgtatccgtaccgtgagtcacaaccaccccatcgaccccttcgtgtgcggccttatcgatccgttgctttaactgcaacatccgtgccggggtgatgtgcggcgacggcacgttaaagacgtcctcagtctctaactcaatatccgtgccaaatgaactctgataattgtctaaaggattttcatctccgggggtcacattgccggattcatcggccgacatcgcaatggtgccaccagtgtgtaataccaaaatcttcttcaagaatactcctcctcatcttttcacgtgcctacgcacatctaacagtaaaattattttaggcttgccatcgcctaattgcaatccaccctcactggttcttcatgacaacttccttagattctcatacaagtgatatcaactaaaaaaactagcaaccattcaaacaatttacaaaacctagcaaccagatcagtacgttttattagcctacatagtgctagtcactcggttagttcacttatcaactagttcgttaatcggttcgtcggttagttaccccttcaggacgaagtcactaacctcagtgcaccttattactcaatttcagtctcggggctaaccgattggccactcgctagacgttgataaatcagcgtttgacgtcccaatgactatcaagcgagaaaataatgattgacactcgcgttagttgcctttatagttagttacataagtaattaaccaaataacaaaccaactaacttaagagaggtatttaaaatgacaaccacaccaatcatgaccgtcagcgacctgcacaaaacgtatggtaaggcgggcagcaaacaatacgaagcgttaaaaggcattaatttcaatgtgcaaccaggggaatttatcggaatcatgggcgcatctggttcagggaaaaccaccttgctcaatatgctggccacactggaccaaccaactagcggtgaagtaacgattcatcaacaaccgattacacatctgaaaggcaatcaacttgctgatttccgggccaaagagattgggtttatcttccaagatttcaacttattagaaactatgactgcttacgagaatatcgccctaccattgtcgctgcaaaatacgccagtcaaaaagatcaagccagctgtcgaaaaagtcgcacaccaattgggaattgaagaattcctatcaaactatcctaatgaattatctggtggtcaaaagcaacgtgtggcagccgcacgagccttaatcaatgaccccgctattctatttggtgatgaaccaactggtgcccttgattctaagtcagcgcgtgaattactcgacctgttcaccaaaatcaaccaagaacgggctgtctctatcttgctggtgacccatgacccattttcagctagcttctgtcaacgaatcttattcatcaaagatggccggattgggcaagaacttaaacgtggggatttaagccgcagtgatttttatcaacaagtcctcgacaacctagggacgtttgaacagtaagccgaaacagtaaaaggagtcctttaaactatgttaactaaacttgccatgaccggcttcaaacaccgttggcgcgactacctcgttctcttttcaggactgatcatgtctagcgcaatcttctatatgtttgaagcactggccactaaccaagatttcttaaaacaaaatacgagtattagtatggtcggcctcatcttccaatttggttccgtactactcacaatcatcacattagtctacattggctatgctaactcattcttattaagtatgcgtaagcgagactacgggctcttcatgctcgttggtgcacgcaaaagtaagattggtcaattaatttggctggaaacactacttgtcggtatcactgcaaccattgtcggcattcttgtgggaacagccttaactgtcggtgtaagccagattctgattaacagtctaggcctgacgcttcaccattttgcagcctggtacacgccagctgccattgcgacactgttactctacgttggattgttcttaattgccggtttattcaacctgctatccctgaccaagacaccagccttgaaattactacacagtaatgatcaacctaaccggccacaactaaaaccagcccgtcaactcatcgaaattgtcgtcggtgtcatttcaattgcaattggttactggtcaatggctaacctgaaaattttgcaactgatgggaattggaattgcgctcgtcacaattgttcttggaacttatctgctgtttaacgctatttttgtctggttaatggtcgcactcaaacgattctcatttgcccaacgtggtttgaatggcttcaccttatcacagctaagctttagaattcgtaattacactaagatgctgtcaattgtcgcaatgctattcgcactagctctcggcgcaattacagttggaatgggctttcacagtcaaattccatcaatggctaatattaataacgcttatgatatgggactggtcaacgctagtaccgctgaaaaagcacaaattgcagcgatgaagcccaagacaacggcgacctatcatttcaaagcaaccaagaaagtcgtttatttccaagctgctgaattcaatcggcaaccattcacgactattcatactcgcaataagaatcaactgacttttaataccgttcataataatgcggctaaattacaaaaatcagaagataattatcaactgatgcagcttcagagtggtgtcatggcaaccgcaacacccgtatttttatcaaaaacggcgtacgcgaaacttgcccagcctgaacagcgactaactgtgtttactaccaacaacgttatcgaacatcgcgttgcattgaacaaactggccaaacatcactttcacactaccagccctgaacaatttggaggtcgctatgcgatgtatctaatggttaacggcatgtactccgggctggaatttatgggtatgttcctcggtatcgcctttcttgcaatgctagctagttgcctgatgttcaagattctgtctggtgccgatgccgatcaacaccgttacaaaatgctcgataaagttggaaccactagacgccagctcaacggtgccattaacaaagaaattgctgtgctctttattcttcctggaatcgttggtattgtacacgtcttgtttgggttacaaatgttcaaaatcataatggttacctcaccatataccggaatttggttaccattcttgatttttgccggtctctacctactttactatctcattacgatcaccatctatcggcgaatcgttttacaataacctttcggaggagggaaaaatcatggtatactttggattagtcgctttattaatcgttattacaccattacaccgttacgtgctcgcaagtcgtcgtcaattctggttaggggcgctcatgccgcttctgtggctgagcgttaacttcggtttagccacccagattatctttgaacatcaagacattctactggccgtactgggcaccctcctcctactctctagttggattgctgcccggatcgatcgtaccaaacgacaactgcaccagccgcaacaaaaggccacaacgaaatagggcaatcactgcaatgaggtgaataaaatgcagttcaactttaatagcacggaaccaatctacttgcaggttgccgaccaaattgaagaagctatctttacggaaaccttcgctgaaggtgaacaaattccttcgacaaccgagatttctaaagaatttcatattaatcctgcgaccgtgcttaagggcatgaatattctagttgatgcccaattgattgaaaaacggcgtggggtcgggatgtttgtcatcgccggtgcacaacaacgaatcgttgaaaagcgccgggatcagttctacaccgactacgttaaaaaactagtcgctgaagcacaaaagctccacattacgcaagatgaattagctaaattaattgaacgggggttttccgaatcatgagtattcaagttcaggctgtccagcaggcctttcgcggtcaaaccgtcctggataatcttaacctaacgatcaaaccaaacacgatttacggtttgctaggccgcaatggtgctggtaaaagtaccttgctgaacattatcagcaatcgtatctttgctgacagcggaacggtcaccatggacaacgaatccatgtgtgataacgaccgcacgttaggaaaggtttacttgatgagtgaagttaacctctattctgagcgttcccgggtcaaacaactgtttaaaaccaccgcactactctatggtgattttaatgacacttatgctaaaaaactagcacaaacctttggcctcgatttaaacgcgcgatttggcaaattatcgacgggttaccgaacaatttttaaactgattattgcgttatgtgtaccggctgaatacatctttttagatgaaccagtcctcggtctggatgctaatcaccgcgaaattttctatcaagaactgattgaaacctatagtgaccatccccgcacattcgtgatttagactcatctcattgaagaaattacgaacttgattgaacatgtctttgtgctggaccatcatcatattattgttgatggtgatgtcaccgacatcctagggcaatcttacgcggtaactggtccacaaactgatgtcagcacttatacggatggtttaaatattatcggcaaggatcatcttggcggaattacggcccactacgtttacgggccattagataacgaccgaccaattcctgatacggtcacggtcgagcatctggacctacaaaaactatttgttaacctgactaataccaaggaggaggccgccgctcatgtcaattaaggttcgcaacaccacccgttatttattaacggaacaattgaaaatgacggggtggtcggtactcgctttattcgtcgtattcggaatactaccgctactatttgcagttattacgggtaatattcggcagtattctccacttggtaattttgctagcctaagcctcgggccactcttcttcatgcttatctttattgtggggtcactcacttacgacaactttaagctcttaatccaaaatgggatttcccgacaaacctactttcaagctcgagtattcgcattactcatgcttagtggtttgcttgtcatcatcaatgccatttattactacggtattcatgctccgtatttacactggagcaccaacaccgcgttgatgagaacgggctattcgctgtatagccatgcgctgggaagtcaggtctggctaaacattttagctagcttatgctttaactggattttctacattggtgttggccttaccggcatcgcttgtgggaccttactcgcgttatttggtaaatgggccaaaacgattttaatcattggcacccccatcattggcatgcttattatttggataatggtcatcattatgactcgcaatcaatcgaattataattacacgggacttgaaaacttcttgaaatttattattggttatcccagccacggtgaagcgacaactggttactttaacccaaccatgccattcatcacaatgctggtaggttgcggtatcatcggtggtctcgcttatctgttcaaccgtaagttaagaatcagaaattaagctgataatctaaaaaatgaagcaggtcgtgaagttattgacttcacgacctgcttcattttttaatggttaatacaaacgtcacaccattcgagaagtggttttcccactaacgctacttttcaacctgcgtattttgcaaatccgtcttaaccacgattacatcagtcaacgcattacgctgcacatacgttgtaaccgagccttccagcacgcgttcaacggcatttaacccggttgcccccatcatgatcaagtcattatgatgatccttgacgaagtcctgtgaaataattggtttcggacttcccattcgaatgtggaaggcaatgtccgtaaagccatcctttttgacttgatcaaccgtttcttttaaataagcttcagaatcctgaaccaattgatacgtaatatcaccatccgccaaaccagctaaattatacccaaactgaccgggatcaatgactgctaacacgtcgatatgtgcctcattacgtttagcgactgcaactgctttatcaagcgcaatctcagcttgttgtgagccatcgaggggaactaaaatattcgaatattcttgtaccattgacgtcacgccctttccatctgttaattctattttaccatttatcagcgttggttgcgttatcatttatataaactaactaccagttatgcacagcagctcgccggctagcagtgtcgggtttacataatatttacaacaacgacatctgatatttacagttaccccttacaattggagttaatccacttgggggtgaatagtatgctttctttaggtattcgaccaggcctaatcgccagccatacaattgtaatcaacgatgccctttcatatcaaatccggttaagcaaattgcgtctcggacccgatgtctatcggctagacatccgtgcaaccactacactgggccgcttgaccgtgtcccacgcacattaccataactttgccacggcccagcaagcctttaatcatcagcgccaccaacttgaatcgcactaaaaatatccaacacgcagccatttaattatgataggatggtacctagtaataatcagctaaagtgagggtattcatctgtgggacaacttatcaaacaactctggcaacgctatcaaagcgtcctttcctatttaatctttgggggcttaaccaccctaattaatattattgtttttggaattttcaaccaattctggccctactggatagccaatacgattgcctggctcatctcagtgctattcgcctatatcacgaataaaatttgggtatttgactcacaaacacctactttccgtgctgttttaattgaaatgacatcattcttcggattccgcctactcagttactttattgaccaggggattatgattgtcggtatttcggttctgcacggaaacgaccttatcgtcaaattaattgatcaaattattgtggtattactcaattggttcttcagtaaactatttattttcaaggaccgtggtcattaaagcgaaccaacttaaacatcaaaacaagcgtcgtaggaatgtccgaaaattcctgcgacgcttattttattcataataattaccgccccatctttttttctgatacttaacttagctactattttagcaaccatattttcacccaaactggcgttgcaccgtatgtaacgtcgctaactttgtgaccacatcatcaatattgaccccatcccaattataaaaaatatattggcgaccacagcgcatcttaatcaccaaatgacgtgctgatgaagcataaccattgcgaacttcggcctgatccgtcgtcaatgcatagtattgaatgtcatccgtatttaaagctaactctccaattcgtatcatgacttgttgactgacctcagtcggcggtcgaactgacaaacaagtcccatcatggtgctgataccgtaactctaccgcaactaaaccggccgcggttagctgcggtctaaaataaaactccgcgccaatatgcaacgcacttgacggccaaactgcggttagccgaaatttaaaatgccggccatgaaaatcagtcaggatgccttggtcgtaatctggttgcattaccgtaatatgcccaatcatgacgattcactcccttcacttagttattgataatgtatcacgcttcacaagcatagttgtgtttaaaacccataatcagtcgtttttaccattttttattaaaatagtaattaaattatccttactcatactaatatttgagttaaccaactttattgatcggaggtcccgttttgatgacatttacaaatcaagaaactgactatcttatgaacctactaaccaaccagttaatggccctactaagccgcgtcacgcgctggcagacgcacagtctgagtcaacaccaatataaccaacaagtacacgaaacgctccaacccgaactgaacatgctcacgcaaatcactgctaaactccagggacaagcccgtgacaaaactcagctaggggccattcaaactggtttgaagaaacttcaagttgccaccacctatcagctaactgccgaccaacttgcacacgctaatgaacgccggctgaatcgccgataccgcgattaacttttacaacatcagcatatttaccaggagattcaaaactatttcgcaatccttaacagaaaattcaaatttcaatcacgagttagctactttttctcggtacaatggttttatcaactcatacaaccacttgactgaaggagggcttccatgttcttaattgtttactgtacgttcgctattgcagtttttttctggatattcggttacgttaaaaccgccgtcatcattggtatactggcactgagcttgattgcttactccttcattcgccgagagattactcgacgacgtttgctcaagcgacgcacggttaccaataaaagtcgttaaaaaaattccaacacgccggtgtcggaattttttggttatttttgcatttgtgataaacaagtgacgatccgctgagccgcctcacgcacattttgcggattagtcgctaagttcaagcgaacaaacccctgatcatcaggactaaaccactcaccaaagtcaactgcgagctgacattgatcttgaataaacgctttcgttgcagctggctgaacgtacgcacgtaaatctagccacgtcaaatacgtcccctgcaaatcggctaaaaccaacttaggcgcgtgggcggcaaaggtggtgcataaataatgataattatcacggacgattgccaaaatctggtctaaccaggccgcgcccgattcataagccgtttggccggcaacctggcctaagacgctgatctcagtctggctgaagcgcccgatttgtgcatcatagcgttgtcgtaattttggattaggaattactagatgtgagttcaaaagcgccgccagattaaacgtcttagacggtgcattgacgacaatcacccggttactaaaccgcccattggctaccgttaacgccgatttgaacggatggttggtccgatcaatttctaaatcctggtgaatttcatctgaaataacaagcacatgatactgttcacataatgctaacagccgtgtctcttcatcttcagaccagatccgccccacaggattatgtggcgaacattgaatgaacaaccgcacctcgttcgccttaatttgctgttccacatcttcaaagtcaatcgtatagtgaccacgatcattgcgtaactcagatgtgaccagctgacgatgattatcccgcaccgcgttgaaaaatggatagtacacgggcgtcagaatcaaaacgccatcacctggttgcgttaaaatattaacgagcgcgtacaacgaattgaccacgccactaccaaatcgaatccaatcgcgtttcaatgtcagaccatggcgtgcctgttcccaatcgataaaggcttgataataacgatcaggcgtaatggaataaccataaatgccatgcgccactcgttcttgtagtgcttgcgtaacttgttctggcactttgaattccatgtcagcgacccacattgccaacaaatcaggattgccataccgagcttgtagtgcgtcccacttcaatgaatccgtatgctggcgcgttgttgcgtacttcttaataaatgctgcttgttccatcttaaaggccttctttctcaacaaaaaaacttcgtccttaacttactaaggacgaagtttatactccgcggtaccacctattattacagtcttgctgtcgctcacgcaacgtactcgttacgttcaacccaattatcggtggtcaatccgggctaatagcatcaaccattagccaactccgagttcatcttcacaataagctgatggtcaaattacaccactactttgactcgctaggcatcaacttattgttactcttctcatcaacatttaatcttcacgttgcttctaagttacaacgtgaagattaaaaagtcaacaacgtctttaaaattgcgcttgctctaaaacctggtagccatcgattcgttggtcagcggtaggaaacgccccggtctgtaagaaacgcttggcctgcatgacccgcggcgaactattcgaccaatttaattgatcaagtggcactcgagcggcccccgccgacattgattcggtgtaatgcggtcgtttgagcaacaaatggccccccaccggttccagtaaataataaatattaattaacgttgctggcaattctaatgttgttaaggctggaatcgtaagctggacggtcccaagttgctttgaaataacagtttgtagtcctgtttgaagttgtgcaatctgactaacggcctcactcaacgtggcccgtgtcgtcactggtgcggttactaaatcataacggttcttgaacggcccggttaaggatttattaaggaccatggccgtcgaatcaccaatgataccacaaacaaatagtggactaattgctggttcgttaatcatcaatcttttccttctctcagtcatacgattaaatagataaattaattagcctataaaaatataacagttacattttaccttagaattatgataaggttcctaaaaaaagcatgcgaatatgaatatttaacaacttttaataattctatgaaaaaaaccgaatcttggctactaaaacgcacaaggttcgattactttttttgttatttagttagattgcacatcggtcgtattaataaatgactgggctggcacacgaattaaccaccgcgtcatggcttgatgccccacatggacacctaagccattccagaatgacggctgataagtggctgtcagcttcactgcgtaggctttttcgtgctgccggtcttctttaaccagctgcttttgtgaccacggaataccagcatccgccactttaacttgtgaaagattagtcaccacggtcgccttgttacttgaaacagtatatttcgcaccattaacccagtaattataaatatgcacgggtttttgggtcgtgcctcgatccaccgcgacatagtaggaaccattagttccaactcgcaaaaccagtggttcaacttgatacgttaccttaacgtccttagcatctgacaggtcgacctggtgattgaaagtcacgtatcccatgccaactagtaatccgagactaacgattaattcaacggtggttatgataagatttccccactcaaacgtatgcttacgttccacgatcatcttgatgcgtcgtacgcgaatatgatgaaatacccacacgactaacgccaaaacaatgatccacgcaatgatcccaatccaattccatgcagaagtcattgattgccaaccctttctcaattacattattatgttctaattgtaaataatccaaccttaaataacaagtaatccagcaaattcaacacaatcattcagaagcagattgtgaaaataatcactgaaacggtgccaatgtaatcgaattcatggtaaaataaagttattaacttgtagaaagaaggagtacacatgatcgcgtcactaatttattgggtcgtcgttgttggcttgattgtttggggtgtttggatggccatcctttccgcatattgggccagccaaaaacaaaacggcaacattttctttattgcaattatgaatacattaggtgccttggccggcctctcagtatggtgggtcttcaacaatcaagactggcagtactactggttatccagcaccgttaagacaaccaacctcttaggcatcgtcctaatctgctacgttgtcttgattgtcatcgaattcatccaaggccggggcatcaagcctgagacagctaaataatgattattttaaacgccaagcaagttgctaggcgttttttattgtcaaatgcggcaacaatcttgctcttcagtgtttgttacggtgataacatttgatttgtcatgctgcatgcttcatcatgattaataaaaaaaacgattctcaaagacattgagaatcgttttttgataagcgactgtcctaatggcggctatcggtcttgaagatttcaactgggaaacacacagaacgctccaccagtcgacttgtgacactacttcacaactaagccacggttaattcaaagcctcccggtgccatctcatttgcggtaatacccgctgttaagattggcgatacgccacttactgttgagactgcctgtgcacctaaattaaagcggccttgaatcgtctgttcaacatccgtccgcgttaagattaagcagtgaccatcaatcgcccatgtcaattggctagttgctaaaaagtcggcctgttgccggcgaaacttgatcaaacgcgtgacaaattgtcgaacttgttgttcttgctcgtctggttgccagttcatgcaccgacgattgtcagggtcggcaccaccggccatggccacttccgttccataataaatacacgggctccccggcaatagcatcagtagcgtgagtgcagatttaaatttagttaactgaccatgcaacgtggtcagtagccgtggcgtatcatgcgtatccaacgcgttgaacatcgcctgttgattaggttgacgatacatcattaattccagattggttttaccaacgtaatcttcaaggttgagttgaccattaaacaacgccagaattggttgtgtcagtggataattcataaccgcgttaaactggccgttaccgactaacgattgactactatgccaagactcacctaataggtacacatcaggtttgattgcccgcaaggcaccacataacgctcgccagaaaccatggtcgacctcatcagcaacatcaaaacgccaagcgtcaatcccgaattgttcgatccaatatttggtcacatcaatcaagtaagcttgtaccgcggggttctgggtgttaactttcggcatcgctgctcccgtcgcaaaggtttcataattaagccgcttcgtcttcggatcacgtcccaccggccagccatgaatatgaaaccaatcagcaaaccgtgactgctcgccatttttaatcacatcttgccactgtggtgactgctcgccaaaatgattaaagacggcgtctaacatcacgcgcataccgcgcgcatgggcgccatcgactagcgcctgaaaatcggctttcgtaccaaagtggggatcgatttcaaaatgatcgatcgtatcatacttatgattagatggtgacgtgaaaatgggacacaagtacaggccattgacccccagtgcagccaaatcatctaaatgcgctgtaattccgggcaaatccccaccataaaatgaatcacggtgaacacgcccagcaccccacggttgaacattagccgggtcattttgccgcacaccatttgcaaaccgttcaggaaagatctggtaccagaccgtctccttaacccatgccggtggcagctccgcatcactgacgtgcatatatggcatgtgaaaatagttgcccactgtttgccagttagtggcaacgtcgtcaaagaagccaccctcaccatagccaaccgtcgcaccggtcgtatccgtgatcagaaaggcatagaccacccggttagtcggtacggtcagcgtcgtctgccagtactggttgccctgcgtcgctaatccgggctgcattatccgccgctctagcgctgttgttccttcttgccataagtaagaatcggcaaataaaatctccacttgggcaacatcgtcacgcgcagtttgtagtcgtacctgtagttgatgtgcggctaagacggctatatcttcactttcagggcggtgcctaattccagctagttgcattgtaagatctccttttatgtaaacgattacattattaactagaccatttacgtcaattatcctcatgattttggtgaaaacgtccccgttcgcctcgattttagtgtatcatttagtcaaaatcagttgaaaggacgttatccatgaaaacactttatcgcagtacccgcgaaactgcaagtcacaccatgacgtcatcacaagccgtacttcaaggcctgacgccggatggtggtctctttgtgcccgtaacgctaccgaccgctaattttgacttcgaccagctcgccacgatgagctaccaagaagttgcttacgaggtccttaaactcttcttcacggattataccgctgatgaattacacgcctgcattgacgcggcttatggtgatcagtttgatgactcccaaattgcgccggtcaccaagcatggtcagcagtattaccttgaactttttcatggaccgaccattgcattcaaagacttggcccttcaaatcctaccgcatttgatgacaacggcagttaaaaagaaccatttacaagccgaagtcgttattttagcggccacctcgggcgatactggtaaagctgccatggccgggtttgccaatgttgatcagactcgcatcatcgtcttctatccaaaagatggtgtcagcgcaatccaaaaacagcagatgttgacccaaaccggagccaatactagtgttgttgcgatcaatggtaacttcgatgaggcccaaacaacggttaaaaaactgttaaacgaccaccaactacacgcggaattagccgcccaccagttccaattttcaagcgctaattccatcaatattggtcgtttattcccacaagtggcctattatgtctacacctacgctcaacttatcaagcaggggcaaatcaagaacggtgatgagattaactttagtgttccaactgggaactttggggatattttagctggctactatgccaaacaactgggcacgcccattcataaactgatctgtgcttccaatcgcaataacgttctcaccgatttctttaataccgggacttatgataaaaaccgtgaattcttcttgacgagttcaccgtccatggacatcttagtctcaagtaacttggaacggctcctcttctacttgacaggatcagacgccacggcgactgctaaactaatgactgatttgcaaacgaccggccgttatacgattacaccggcaatgcgtgccaacttagctgatttttgggccggcttcgtgactgaaagccaagatcaagctgaaattcatcacctgaaccatgcccatcactacacaatcgatccacatacggccgtggcctcggcggttgccaaacagtatcaagccgcaaccagagatcagcggcccatggtggttgtttcaaccgctagtccgtataaattcccacaggccgtcctaacggcaattactggtgagcttagtgcggtagatggcctagccgcagttgatcagttacatgagttgattcaaacgcccattccagcaacggtcacagccctccgtactgcgcccgtgcgccataagcgggttgcggatgttgatgatatgggaacgaccattaaaacaattttaaatcttaactagaaagtgtgaccaagatgattacgaccattgcgttagacctagataatacgttactaacttctgagaagacgatttctccgcgaactgaagcagttctcaaacagctgcattcggccggcaaacggatcgtactgtgtactgggcgaccaattaaggcgattcaaccatacttacaacaacttgaactcaaccaaccaactgactacgcgattacctttaatggtgggctcgttcagcaaaacacgactggtgacgtccttgctcgtactagtgtgaccaaacaagatttacaacccttatttgagcaagcccagcgcgatcatttctacttagacgtgattgatttgaagcaagtctactccattacggatctaggcaagtcaccgtacgaagaattcttgcaaggcttaatgccatttaagaatgttcgttttgccgacctgcctgctgatgatctattcggtaaagtcgttagtgctggtcaagatgctaaaacagtccaggccaaattaccaagtcaaattaccgatttcttccacgtggtcccatcccggcggactttgttggaattcttaccaccgcatactgataaggccagtggtttgaaacaactcctcggtcactttaatgaagactatgacaacttgatggcctttggggacgaagaaaacgacctaggaatgctaaccgccgccaaagttggcgtagcgatggcgaatgcgattcctgcggtcaaggctgcaaccacccatgccaccctgagtaatgacgcggacggggtcgccgttttcctagaaaattacttcaactgatccccaactgaagcctgtaacgggcttcttttttagcacaaccactcaaaatcaaactaacgaggtgtcccatgcaagatccccgcattatcccagcagaattaacgactggcgcttttttcgatattttagcagatgaggaccacagcttaagttatattcaggttagtgaagaagacgtgagtcaccagcacatcgagcaccccatgctggatcacgtgcacttcgaaaatgtccggtttacggccagtcaatttgaacggcttgacttgaccgatgccatctttatcaattgtgacttttctaattgccagtttgaaaaagccagctggctacgcgttcaattcaaagattgtaagctcgtcggtgtcgacttgaacgaggctgccctcaataacgtcgcctttgaccactgtcagctcgacttagccatgctgtgcgacatgcggttcaaaaccgtgacctttgatcactgtcggctgaatggggccagctttatgaacaatcgactaacgaccgtcaagtttaacgaaaccagccttgaccaagtcgctttcaacgataccgccctcaaaaatattgacctaagcacctgtcaattcgagcgtctcgaacttgatactgccgcagcacgcggtatgatcgtcaatattgatcaggctgcttatttggctgctgctttaaacggcatcaaagttaaaccctgataccggtggaacagtcaccgtatgagtgaccaactcacaatgccaaggacgattaagctgctggctggtaaatcttctaataacactgcacgtatctgtcagaatacttttcacgcgctgaacacaaaaataccacctccgtcaggtaacaacctgcgaaggtggtattttgtcgttcatcatgacaattcgaattgcgccccggtgtaaccagtgcggtcggccgccgtgattggtcgaataacttggcaagggttgccagccgcaatcacgttagctggaatatcgtgggttaccacgctcccaccaccaataatcgtgttagcaccaatggtcactcctggtaatacggtgacgttagcggctagccaacaaccatcaccaattgtgattggtcgggcgatgcagccgcccctaattcgttcggttgcatcaaacaagtggttgctcgtgtaaaggccgacttttggccccaacaagacctgactgccgatcgtaattggcgccccatctaacattacacaatcatagttggcataaaagttatcacctagatgaatgttccgtccaaattcaacgcgaaaattaggatttacaaatggcttgcgaccagctgaaccaaccaattgtcgcaataaagtttctttagtctctggatcagcagtcgcattgaccgcgttcgttgtcaacgtcgcttggtcacgcaacgccgttagttctgcatccgtatctcgatacggctgaccagtcgccatatacgcaaacttctcatctaaattcattccgcaccccacttctatcgaataaaattcaagtaccatgttattgcgcagattccttgtgctgaacgaatctggccattctttaataggtcaatcactttactgagcgggacaagttgcgtattcacgtattcgtccgcgtcaaaatgtcgttcgccatgttcttgcggatcaatgtgagtcaaaatcaagctgaccgtttcgtccgtgaaaccttccgacgagctaatttgcgtcataatttgtggttcatgggcaatgtagcccgtctcctcttgtaattcacgggccgcggccgttaacggatcttcccccgcattaatgaggccagcaggtaaactaatcgtctcggcattgcgaccgacccggtactctgaacctagcacgacttgatcatccgcagtgatggctaaaatcgtgacggcgttcccatgctgaatcaaatcgcgttttacttctaatccatcaggtgtttgaatcgtttgtttgaccaaatcaaaaatcggcccatgatacaccggtgtcgttgataggaccttaccaggccggccaactttctcaaataaatctgccatacacattcactactccttaatctatctcaaatccggtacaccatccggcagcatcttacgaatgccacccgcggggtctggcacgtcaccttgatatcgcggtatcagatggagatgacaatgcattacggtttggcccgcagccggatcaacgttaatgccaatattatagccatccggatgattgtgcgcatctaggtacgcttttgcttgggtcagtaaggcgagcatcgcattcctggtcgccgtgggcacatcaaaatacgtggcataatgtgctttcggaataatcaacaaatgccccggactcaccggctttttatcgaagaaggccgctgctaggtcattctccaaaatatacggcaacggctgacaaaaaatacaagccataccaaagtccccttcctattttgctaaccaaccaccatcaattggaaccaccgtcccatgaatataatcagcgtgctgactcgctaagaatagcgtcagatctgcaacttcctgcggttgggcccaccgttttgcgggcgtctcactggcaacccatttcgccatcttaccatcgccagcaaaatcagcggcattcatcggggtatcgatagcccccggcgcaatgcagttggcgcgaattccctgagccgcatagtccaagtcaagttgtttcgtataaccaatgatggcgtgtttggctgcggtatacgctgcgccgcctccgccacccaccagtccagcgatcgatgccatattcacgaaaacgccgtgttgtgcggctaacattgcaggtagcaccgcattagtcacgataaactggcttgtcagatccgtcgccaaaatatcttgccacgttttcagatccgttgctaaagttggttgataaccgtctaacttaccggccgtattgcacacgacggttggcttgccgagtacgttaactcctgatttaatcgccgcgacgagcgcattagtgtcggtcacatcagcaatttcatagcgcagggctgacgtcgttactagcgctgatggctgtggttgccgatcaatggcaatcacgtcagccccctgggctaggaaactctggacctgggctaagccaatcccggaggcagctccagtaaccaagacagtctgtccacgatattcatcaaattgcattagtcaaccaactgccagtccgtcgctaaaatatcacaatctgttggtgaccacatactataggcttcatcggccgttttgattaaaaagtacgggttcagcgggtcgccgttgaaagtggttgccgtctgtaattcgacgaacaattcggtcccttcccaaccagtccgaacagcgcgcttaccagcttttaattcaggtaaaatagcttcaaatgtcatcacgatacctccaattattaatacccaaatcgtatcataatcccgcgtggagtgacaggcaaaaattggtaccaacaaattgtctattttactggtacggaccaattatttgtgcgataatgtaagcgaatacagaaactaattattatttggaggaattttaaatgagtaaactcggtgtttccgtttatcccgaacgatcaacctttgaaaaggatgcggcgtacctcgatttagccgcaaaatatggctatcaacgggtattcacttcactgcttgaaatcaaaggggaccaagccgcagtggttgccaactttaaaaaagtgatcacttacgcgaaccaattaggcttgcaagtaatggtcgacgtcaatcctgacctcttcaaacaacttggcgtgtcctatgacgacttgtcattcttccacgacctcggtgcctggggtgtccgcctcgacctaggattcactggtcaagaagaagcccggatgacgcacaacgaattcggcattaagattgaagtcaacatgtccaaagggactcactatgttgacacgattatggattattcacctgaaaaagataacttactaggctcacataacttctacccacaacaatacactggtcttggttatgattattttgttcagacttctgaacaataccgtcagtatggcatcaacaccgccgcgtttgtttcatcaaatgatgcgacttatgggccttggcccatgcaagacgggttatgtacccttgaagatcatcgggggttaccgattgcggcacaagttcaacatttgaaaatgacggggctgatcgacgacgttttaattggtaacgcctacgcgagtgaagccgaactaaaagcggctgctgaagtgttctttagtccttacccactgctacacgtcgaaaccgttgctgatctatcggcagttgaagaaaaagtactctttgcgcaaccacagacttatcgcggtgatttttcagattacgtcattcgttcttctcagacccgggtcatctacaaagacgaagcctttcctgctcatcacctagatgccattcataccggtgatgtcttgatcgataacgatgagtttgggcaatacaaaggtgaattgcagattgcacgccaaaatcttgaaaatactggccgaatcaatgtggttggtcatattactaagagtgacttaccttgccttaacttgctacaaccatgggccgactttaaatttgtcgctgccaaatagtactcaacgaatggaggggtcgcagtaatgacaactgattaccgtttaactagcgatgctgaccgcgaagctttctaccaactttaccaatacgcgttcaataatcacgatacccccgcgcggcggcgatttttcatggatcgctaccaacatggctggatctacggccgtcacgatcatggtcaactggttagtgggctatacagtctgccactagcagtcaactttcatggcgtcacctaccggatgaatggtattggcgatgtgatgagtgcgcctgaatatgccggtcagggtggcgcgggacagctgttaacgacggcgctgacagaaatggcagccaaccacgtgacgctgtcctaccttgcccccttcgcgtacggttactatcgtcgttttggctatgaacacgtcttcgaccacgcgcaccaagtcatggccgctccagacctaccacgtgtcaaaccgacggactggtctggtacgatcacccgctatggcaatgacgggctggcccaaatcaacgatttttatgcacgacaaccgcaaaatcagcgtggtggtctgattcgaccagcctggtggcaacattacctgactctcaaacatcattggtcggtcgcaatttaccgcaatgcggctgccaatatcgagggctatttgatctatgaacggcaggccactaactttgcgattcaagaatgggtgactagcacgccgaccgctttcgaacgattggctaactttatcactaagcatggcaccacctttgaaacgtttagttatgatagcccaagtgcgaccaacggcttggacctactagccgacccataccgtttaaaagtgactgtccagccgtacatgatggcccgcattgttgatttatatgactttatcaagcgctatccgtttctcacggacatccaaccaattcgcctagcagtcagtgacgctaccctccctgctaatcaaggaatctggtcattgacgcggcacaacgggcaagtaacgctcaatcgggttagcgaccaattaactggaccggctgacattcagttaacgattcagcaattaaccactgcttgctttggcacccagagcttagcccgggcgtaccaacacggattaatcaccggtgatgtgaatgcgatcaaccgacttgacactagtctagtgaaagaacgaccagcacttattgactacttttaagtgcttgatttagataagcagcatgactgactcaaagtgggccgccagaatgattattctggcggcccacttttttaaagattcgtatttcccgttcaaacagtttttgtcacatatccagtatttttaacaataagattacagctaattcttgggacgtttcttttacggcaaatagtcattctcatcttagtctattcaaaaaagatgtttgaagatccgactagatctccaaacatctttttactgacattatcctggttaatcaccagcatcgtgcgtaaataaaactaacgaatatcaattgattaccaatgtaatattaaccatgtcttgacattaattttcatacaaataacccgcatcccgtaaagctgccttgatggctgttaattgttccggggtctgataagcaaccgtatggctatggacgccatctgttaattctgataataaatggccttgtaatttcttgagccggcccataaacagattaacatcaccaactgagcgaatctctaattcaccccggagccggccatacaatgggtgttcgacttcaacatccttgattatgccccctgcgtgaatgatcaaggccatttcctgcatcgcttcgtttggaaaatgacggcaaactaggacagcagttggctgatccgctttttctaattcatacccttgaagagtagcaacaatggccgttccgtgagccctcaataatgaaatatccccaacaatggtctgacgactaacgttaaactgcttcgctagcgttgttgcacttacggggacctgcgtttgcgataattttgatcgaatttgttcacgccgttctgatcctgtcatgactcacccttcttactctttcaatagaatcattctaccagaaaaccagtagaatagctttcatcaaatactaaattatgataaactaagttcatttaccataggtgtcaagacacctaaatcttaataacgggattgattagcaatgcgcaatttatctttattaaccgacttatacgaactctcaatggcaaatggatttcatcacgacttacctcagaccaacgccaccttcgaccttttttatcgccgggttcctgacaatggtagctttgtcattgcggccggcctccagcaagttgtcgaagctttacaagattttcattttaccaacagtgacctcgactacttccgtcaacttaacctatgggatgaatccttcttagccatgctggcaaattttaagttaacttgccaaattaaggcactaccagaaggaaccccggtctttcctcgtgaaccactattgacaatcactggaccacttgagcaagcgcaattacttgaaacactcgtcttaaatatcgtcaatcaccaatcactgattgccactaaagctcgtcgactgagttatgctgcggcaggacgtccaattatggaattcggtgcgcgccgtgcgcaaggcccggacagcgcgctttacggcacccgggcagccattattggtggcgccaatagtacttcaaacgttctcgctgcgaagctgtttgatattcccgttgctggtaccatggcccacagttggattgaggccttcccggatgaactaacggcgtttcgcaagtgggccgaacaatatcctgacaatagtgcgctactagtcgatacttatgacgtgcttaactctgggattcctaacgcggtgacggtctttaaggagctacgagcagctgggcatgaacccgtcggtattcgaatcgattcgggggacgtcacgactttatcacaagctgcccggacacaattggacgcggctggctttcccaacgccaaaatcactatttctaacgcattggatgaacacatcattacctcgctgttgcacgaaggcgcaccgatcgataattttggtatcggtgaaaagctcatcactagcgcgtccgcaccggttctaagtggcgtctacaagcttgcggcaactgagagcaatggtcagagcacccccaagatcaaggtcagtgccagtcgcgaaaaactaacgattcctggtgataagcaagtctatcgtctgtacgaaccaggaactcagcgggcctttgctgatttgattgcactagctaccgagacgatcgtcgatgcgaccagcctaaccgtcgtcaacagtgacccactcagtgtcgaccgtcaacagcgactcacccattttgaagtccggcccttactcgcgccggtagatttgtccaacaccacgtcaattccggttacaaccattcaggcaacgacccaggctaaacttgccgagctcccacgaacaacccagcggctcgtcaacccagatctttacccggtctacatgacgaccacactcagccagttacaaactagtttgttgaataaaatgacgatactagcagattaacaaacgaacacgcgtagcaacgaccaaagccacttctgtacttagcgttcaaatgaccgctaagtacagaagtggctttagtttatatcaagtaacagttagctcactgaccagtaatttgatcatgttcacccggggtcaatattttggtcatcaccgtaatcaaatacgcttgttcgcgctcaatttcagttcccggcaattccagcattaaccgcgctaggtaaccgaatagctgcgataacaaactttgcagtatcaaatcattcggccaatccacaatcaaatgatctgcttttagttgatttatgacacttcccatctgcttgaccatcttaggcgcaatctggctaagaatctgttcgcgtcgttcggtgtcaaaagctgccatttcaaaaatgacctttaactctttcacgttagctttagcaaatgcaactcggtccgtaaaaattgctgtgacgaatgcctgtagactgggataacgctgccgtaattcatcctctgaaaaatcactcgctaaaattggcacaatgtgcgcggcaattggtgctaagatggcatcccgtaaggcagccttagtcttataccgccgatagaccgtcccctccgcaacgccggcccgttgtgcaatatcactagtactggtctggtcaaaacccttttcagcaaacaaatcgagacttgcctggaggatggcccgttgcttaggtgtaatcgtttcattctgacttagatcctgttgaaaataatcccgtatccgtggtcgttccatatcctcacaccttccgataacgtttcattccaacaatattcaacattgttagtacgaccataaaccctactaatattaacaaattgacaccaatatcgccaagcccagcaccctttgtcacaacagccgtcaacgcattagcaccatagtataacggcatgatgtgggcaattgcttgcaaccaactggccatgccatcgactggaaccaacccagcaaaaaagatttgtggtacaacaatcagtggaataaactgaatcatttgaaattctgagttagcaaaggtggaaataaagatacccaaggtcaaagccactaacgctaataataagttagtcagaaagaccagccaaatactaccaactaagtgaatcttgaagaccgtaattgcaaaaacaacggtcaggacagtctgaatgatggcaaagcccccataaccaattagatagcccataataatttcactccgtcgaattggagttgcaagtagccggcttagggttccagtagtgcgctcattcaaaagtgaaacgccagaaatcaagaacacaaagaagaagacaaagaaaccgagaaagattggcaaaaagttttcaaagaacgttgaatcactactaccataaatataatgactgctagtggtataggtcgtcgtttgtgattgactatttgttggcgccgcagcactcgctgtagcctgcctcaattgcttttgaattttagccgcagcagcagtattcccacttgcctgtgcttgggccaaggcagtctttagcttgctaaccgttgcctgtttttgcgccgcggtcaacttttgtagtgccacctgttgcgtttgcaacacctttttttgtgctttagtagccgtgaccaacgtttgaatttttaatttgaccagtccgctttgcaaagaagctttgatcaatgacgtattggtcggattactattagaatacgtgatcgttaagttgccatctttttgcgtcaaatatccatccaaatcatgctgcttaatcatcgcttttgcctggttactactgtaatggtgaatatcgacatgcttcgtattaatggctttgaccacctgatgatcaacattgtgaacacctaaagtcgccacttgagtcgtgttattttgaaacaaaaaatacatcaacgccataattaagagtggtgccaaaaacatcagcgccaaggtacgcttatcacgtaacatttgcttaaaaactcgtctaacgattgccatcgttcgcatcttgcatccgccccgctttcaaaaagacctgttcgatcgtatctactgcatactgttgtttcagtgccgcgggtgtcccctcagcaagcgcaatcccgtgccgaatcaacatgagataatcacaccgttctgcttcgtccatgacatgcgttgtcacgagcatcgacttaccggtatccttgagcttatttagttcggtccaaatttgttgccgtaattctggatcaatcccaacggtcggttcatctaaaatcaataattggggatcctgaatcagggcgattgccaacgacaagcgccgtttcatcccacccgaatagccactgacccgcttgtctaattgggacgtcaagtcaactaatccggctgcataatcaatcatctgtgctaactttatttttggaacactcattaattgcccaaaaaaggtcaggttttcacgggccgttagtgtctcatacaaggcgtcactttgggccatataccctacttgtgccattaccgccctattgggcatcaccgtatccataactttaacagtgccactatccacagcttccatccctaaaatactcttgatcaaggtggtcttcccagctcccgatggcccaatcaagccataaatcattccagccggcagtgtcaaatcaatctgattgagcacttgctgatgaccaaagtgcttgctgacctgcttggcgatgacataatccgttgccattttaataaccctctttctcgaagtgagtgcatactcactcacttaatggctttagtataatcagtacatctcggtttgtcaacagcaaaaatgagttgtcactcacttactttatttccagcccatttgtcaccgcactgcaaacaaaaatgcgccaccccgttgttgggatgtcgcattttaattaaatatcagcactgatataagcgttagcaatgttttaacgattgttaatcttggtcagcaatttttgtcctagctcataatccaactgacgctccgattccggcatcatgtcgccgccagttgcccagacaatgtgggtgacgtctttgccagcaagcgtgggaaattgggccatgatgggggcgatcgcggtaaagccggctgcagcggatggttcgaccattacatcttcagtatcgacgagcttcgtcaaataacgatataaatcatcatcttcaaatgttgctgttccgagtaatagcgtttgcatcaccttgcctgccaaccgtgatggccggctaacggctaacccatcagcggcagtcaggccatctaaaccaatgtcttgaacagcaattttttcattcagcttggtcatcatccctaaggtcacggacggcacgtgggtcggttcacaaaagacggggtaaatattggctcccataatcatcttgaggccaaaagcgacgccactaggactgccaccgaccccggccggtaaataaacgacgaccgggtgcgcagcatccatcttgatgccttgtacttttaattgatgttgtaaccgtaccccagcaacagcgtacccgaggaataagtcacgtgaaccttcatcatcaacaaagtgcgtatggtcatccttggccgcggcggcacgggccaccggaatcacacttgaaaagtcggtatttagttcctcaacggtgacgccatttgcccgcagtttgtccttcttccactgacgagcatcgtgagacatataaacggtcgtcttaaatccaaacgttgcggccatgatgcccacactgagtgccaagtttcccgtcgatgcaacgatgacgccgtattgtgcaaataactcgtgatacttagccgttgccaagacactgtaatcatccatatacgttaaatccgtatgggccatggctacctgttcagcaaacttgagcacttcgtaaatcccaccacgtgacttgatcgaacccgaaatcggcaactgactatcagcttttaaataaagctgccccgccaatgactggtggttgagagcctcccatgctggtttcatctgctcaagtggtaacaatggtgactcaataatcccattcatagctgccgtttctggaaaagcaacggccaaaaatggtgcgaaacgttcccaacgtgcgaccgcgtcaaaaatatcggcccgcgttaacggcaggtccgcccgcttcccataatctgggttctgccaaacaattggtcgttttgccatcaattccttaatctgtgggtgttcttcaatcattaccgttgtatccatactttcaggtccttttcatttaattgcatcatattacgtatcgtgagttaaaattatcagttttcgatggccgtctgcatgcgttcagcctattccgaccttccgagactaggtaacatactgaaacgtcaccacgatcagcacaaatgccgataagtcgatataacacgcactgagccaacaagcctcccccaacccgaccctttcaaccgaacctaagttagtggcttttctctgaatctaacgatttttaatcacaactcatgttagataatatgacatcaccttcgtccatcatttaaccatatttgatacttagaaacaatctttaggcactgattaacaataattgttgattagccaatcaaacaagctaataaggcaatcgaaaaacgacgttcaaagttcactcactttgaacgtcgtcttcaattagtggttattaattgactaataatcgtcgttcgaactgcataatcattcagtagtcttctagcacaacgagtttcctacttcaaatcggccccattcgtccgaatcactttttgataccagtagaacgaatccttcttcgagcgctctagtgtcccgttaccttcatcgtccttgtcgacgtagataaaaccgtaacgtttcgacatctgaccagttccagctgagaccaaatcgatacacccccacggcgtatagccaatcaagtcgaccccatcttcggtaacggccttgatcatttcactgatatgagcgcgtaaatagtcaatccggtaaggatcatgaatactaccatcggcttcgactttgtcgcgggcacccaacccattctcaacaatcatcattggcttgtgatagcggtcttgtaaccaattcaaagaataccgcaaaccttctggatcgattggccagtcccattcgctcgtcttcaaatatggattatcaacggcttcggtcccgacaaagtggtaacttgggttatcatcctgagcggcgaccgtgttggaattatagtaactaaagccaatataatcaacggtgccttccttcaagacttggcggtcttcggccgtgatatcagggcggaaaccagtctgtttgaagtaagcttccatattatttggataatagccccatgactgtacgtctgcaaaccaataacgccgctgcatagccttttcagcttgcatgatatcttgtggcttagcagttgcaggataaatcggtgtcatgttgatcatattgccaatctggaagtcgggattaatggcatggccaatcttaacggctagcgcactggcaacgacttcataatgagcagcttgatacatcaacgcttcagcgtcaggatcatcgggcttcaacactaaaccagaatccgtcgccatcaggaattggttcgtataagtcgtctgattattaatttcattgaaggtcatccagtacttaaccttgttcttatagcgcttgaagaccgtttcagcatagtgcacaaaaaagtcaataactttccgcgaacgccagccaccatattccttaactaagtggtacggcatttcaaagtgggccagcgtgatcactggttcgataccatattgccggcaagtatcgaacatatcatcatagaacttcaaacccgcttcattgggttcttcttcatcaccatttggaaaaatccgcgtccaggcgatcgatgtccgaaaacacttgaagcccatctcagcaaatagcttgatatcttccttatagtgaccataaaagtcgatgccttcatggttcgggtaattcttacccgcaatcacaccatccgtgatttcacgaggaacaccgttggcaccggcagtcatgacatcagccacactgacccctttgccaccagcttgccagccgccttctagttgatgggctgcgaccgccccaccccataagaaatcagatcgtaaaccactcgttgttgccatgcattatcatcctttcactataaatctttaccatcactcgcaataacttgttggaaccagttaaaggagtctttcttagaacggtcaaaactgccttgaccattatcatcggcgtcaacataaatgaatccataccgtttcgccatttcaccagtacttgctgagaccaaatcaatacagccccacggtgtatagccaatcagatcaacaccatctaatacgaccgcttgttccatcgccaagatgtgatcacggaagtaactgatccggtagtcgtcatgtacactcccgtcggcttccttcttatcgtaagcaccaaagccattttcaacaatgaattgtggtaagtgccaccgatcttgcatccagttcatcgcatagcgcaacccagttggatcaatttgccagccccaatcagacttctcaacgtaggggttctcaacaaagtcatcgggttccttgaaatcgtaatcactgtcaccgtcacgaccctttgtaacaaatgacatgtaataactgaaaccaacgtaatccaccgtaccagcctttaaagttgccaagtcagcagcggtaatatccatatcgaagcccttgcgttcaaagtacttcggtaaccactttggatattcaccgagacagtggacatccccgaaccaataccgtttttgcatggcccgttctgccatcatcacatccgctggtttagctgttaacggatagattggacacatcgcgaccatacagccgatttgaaaatcaggattgattgcgtggcccgcttgcacagctagggcactcgctactaattcataatgagctgcttgatacatcgcctgttcccaattgtcatccttgctaagttgtaggccggaattttgtaacaatgggtgcggatcactccaagctgtttggttattgatttcgttgaaggtcatccaatacttgaccttatcctgatagcgcttgaagacagtcttcgcaaaatgaacaaagaagtcgatcatcttacggttgctgaaaccaccataaaccttcactaagtggtatggaatttcaaagtgtgacagggtcacaacgggttggatgccatgcgataataaatcatcgaataagtcatcgtaaaacttcaaaccagcttcgttaggctcgctctcgtcaccattcgggaaaatccgggtccacgcgattgacgtccggaaacacttaaagcccatttcttcaaataatcgatcatcttctggatagcgatgataaaaatcattgccccagtgattaggatagatttcaccatctttgacgccatcagtgactttacggggaaccccgttacgtccggctgtcattacatcggcaatgctaacgcccttgccatcaacatcccaagcgccttctaattgatgggccgcgaccgcgccaccccacagaaaatctttgggcattttgtatccttttgtcatgaactaattccctccattaatgctgctcaggctatccctgagttacagtctttgttaccttaactaacgaaaagcgtgtaaccgccacgtcaccgttgttaagctgtctgccattataagcgaccacggcatgaatgaaaaaacaagcccagaccaacaccagcaggtatttgcctaggctcaaattaattaactacttcgcctcatcggcaactaaacgccgataaacgtctacaacttcaccagctaagtcgcggaaggtgatggcattcatgatgtgatcttgtgaatgtactaataacaatgacacgtgggtatgttccccttgcgcttccgccgttaacattgaggtttgtgaattgtgtgcttcggttagaaagttatctgcttcctttaacttggcatcagcggtttcaaagtcgccttccttagcagctttaattgcttcgaaagcggaactctttgcattaccaccattaacgatcaaacccataatggtttcgagacttgcttcaacttcttttgtttgttcttctgccatttaccctcatccttttagcatttattcgtgtgcatcacaatcaaaatgccaccggccgcgattgatctaccgtgggctggtagcacttacaatttaatgattagtttgcttttgcaattgatgcttcggcttcctttaaaactttttcgccgttcatcatgccgtagtcttgcatgttgataacttcaactggaatatcaacgcgcttttggaaatcacttaacatataacgaacttgtggtccaagcattaaaatgtcaggattcttttcagctaacttcgcatcagcatcactggcagcggttgcaaaaatatctgcatcaatgccttctgcttccgcagccttttgcatctttgagactaataatgacgttgacatcccagcggcacataccaacataattgttctttcagccataataaacacgctcctagattgttttaaatttatatgttacagcggttgctttaataaaccgctttcattacaattagaattataagtcatgggtacaaatttgacaagccttattaatcagatatctgcaatttatttgatttgtacccacaaattattaaataacaacttaatattcgaaagaagtgaacaccatgtatcgtgacattgcaaccaaactcgttgccgccattcaagacggcatttttaccgtcaaactccccacggaagcccaattaatggaacgttaccaagctagccgcaacaccattcgcaaagcgattgacttggtgtaccagcaggggctcctgcgtcgggttcaaggcagtggctattatattactaatattcagcttcaacataaaacggtagtgaatctgtcagcacgctcactcttcaatagtcatgtccacccacggactttaacttcgaagattctgacttttgatacgatccacggcgatagtgccctgagccgcaaactcaacattcccgtcgacgaagaactgtatcgtatcattcgcctccgctactggcacgaccaactgtattgtttggaaaaggcctactacttacgctctgtcgtcccctatctatcgaccgaagctgtcaatacgtcaatttgggacttcatcaacgaagcttacggcatcgggattgctaacagtgatgattatctttcactcaccaatcttaacaaggaagaggccgaactaatgaatttggcacagggcgcaactcacttggccttggattcttgtaactattataagaataatggcttactagatttttctcacaccatctttgtttatcccgacctcgcattgtattttcatacgacaaatcttgcaaataattaatttatggctaaaaaaagacgattcactataatttcatcacaatttatgggtatactagtaacagtatccaaatttacgatggaggaattagcgtgtcagcaccccttttttcagtggttgtaccagcttacaaccagcacaaatttatagatagctgcttgactagtctacaacgccaaaccttgacagactttgaagtcttcgtggttgatgattgttcgactgatgacactggtgaacagattgccgcgttaatcaaaggcgacgaccggttccacgtgatcactcacgcccataaccggggcgtctccgcagctcgtaactccggtatggctgctgctaagggtaagtacctttgctttgtcgatggcgacgattgggtcgaaccagactttctggcaaccttcctagccgcctaccggtcagcacccgatacccagctcgttgtatgcggtcactacggttacttagccgttccgagtcctgccaaaacatacaaccaaaaagacttgattgccaacatcaactttggcacggttggcggtttttcgtggaataaagcattcattcgcagtattattaccacgcaccacctcaagttcaacgaagatattgattttcttgaagaccagttgtttgcctttcgttacgctaactacgtacagtcctccgaatacgtaccggaccggacttaccattaccgttggcgttttcgaagcaaccttgctcacattggaattccattcttcaccgctcgtcgtaagatgatgaagattctcaagcaggaaaacaagcaagttttgaacgaagattggaataatcagtagcaacgttacgttgccatcgcccctaaaggtcggtagctgaaatagctatcaccctttaggggattttttgatacctagcataatcggctacgatgaccagaagatgcgcaattattcgaggctagtagccatccactcgcagtctcaaatgcgctttcgccgccgattaaaccgaccgtggcgcgaaacaagctagctgctcaagctctttttgatatcagcgacaaaataaagtggcaattaacaattaaagacttgttgaatgacgagtaacgctttacaattggactatattaattaatttgatgggagggttagcgatggctacgattcacttatacttagtccgtcatggacaaaccaagctcaacgcggccggccgtttacaaggcatctatgattcggaactcacacataccggtgtgcgctccgctcaacggttagcccgcatgctagcagatgttcatttcgacgctgcttacgtcagtgacttgggccgagcacaacaaacgagtcgcattatcaccgcactccatcctgaaataaaaaagccgacgattgacgtcggcttacgcgaatttaacttcggtgggcttgaaggtaccagaaacatgtggatcgtcaagcaagtccaaaaacaattgggcattggaacgtttgttaagttgatgttgagtcgtgaacgcttcgccaccctactatgggtctttaactccctcgaccagactcgtggcgccgagactttggtcggtgtcacggatcgaatcagtagcgcgctacgacgaatctgtttgtatgaatctcaggatagtcagcatgacaagaatattcttatcgtttctcacgggctggttctcagtgcattcctataccaaatcagcccccgtgagcttcccacccgactcctgaaaaatacaagtgttagtcgcgtggactaccaaaatcggcaattcaagttgatcgacattaatatcacccctaagaagcgggcctagttgtctcgatgctaacaggttgcgtggtacaactcggaaattgcaagcgcgcctgaataccaaaaaaggctttgattttgcgttgtaattcttgaccagttgcatgcactgaagcttcacttgcatctggatcgccaactacaattaaaatgcgactgcttttactatccaaattaggcctgattggggtggtagcatccgctgaaagactggccccttgtgccgttaaatgaagctgaacctgctcagtgccaagcgtattcatatcccacgcattgatctgcactggatggcgcgcgtgaatcacttgaagcaagtctgccaaagcattctgcggctgagcaacggcaagcccttgtgcagctaattgtttttcaattgctggattcaactcacggttatcaagattgctcatcgacaaaattgctagtggaatttccgtggtagtcgtcggtaagatttcaattttcaacagttatcacttcctaaaaacacttcaatactaagtgtgccaaatttgacgtaaaagtcaattaccaccacttaagtcatagcgaaattttaataataccacaaaagcgattcccacacacgtgagaatcgcttttttaatggccttattgtcctcgtcgatacaccgatacgcttgtaagctgaccttacttagtcgttgataatgggtgggccgcaaagtatttttctaagaatagtgccaaaccatcattataattcatatcagttacatagttcgcaactttcttaacttgtggcaaggcgttgcccattgccaccgataagtcagcttctgccatcatcccaacgtcattcaaaccatccccaaagacaaacgtgtgggcggcatcgacatgttgctcacgttgaatttgtttgaccgccgtccccttatccgtattcagaggaatcatctcaatattattcgggttcgatgatgaaagtcgcaacaatttactattagtgagcttttcgcgggcagaatccagccgtgacatgtcttcacgactgagaatgacgccgttcgtaatctggtcctcaatcgtggctaattgcgtaaagctcttcacttcttcatagccaatcgagacttcatccgcatcaaagttagccgcattacgagcaacgaaccgtgggatttgttccgtatagtaggccatgtctggcgtgaacaacatcattggtaagttatcacgacgtgcaatcagataggcaagctcaaccgcagcacccccgagtttggttagctcacggccctgggcaccatcgaacaccgccccgttagacgtcaccaaacgaacgtcagcgtttactttgtctcgaacaatcttcgccagttcgtacatgcgccccgtagcgatgtaaaataacacgtcctgcttctgaaaccgttcaatcgtcgctcgagttcgctccgagacatattggtgatccgttaataatgttccgtcaatgtccataaagactaaatattttggcatagttgaactcctcctacgtatttacctatatgttgtgctagctaactgatcatctgtgacattcagcttgactgcttttgctgggtttgccaatcagtcggtaccatcctgccatcgtcagtaaatacgcaaattggcgtatccgcactgatgagtaagccggttggccggacttgaataggcttaaattaaaaagatgacgcaccgccgccttttttagcaatcataattagcacaaggcttatttacactcccaattgtacgctattccctcctataatggaaatcgctttcaaaaccgaactagccaccgcattttcaccacgtaaggctaaacaatcttaagtttagaagctatttagagcattatttgccctcatcagctttatataccaaagaattcaatctcactacttgacattcaccagtctagccgctaaattagagaacaattaataaatgatgataaaaagcattgaacagttcagtagttgccggtcgttagccttagcgagtctgagatggtgtgagcagacctaatccggtatcacgaatatcgactgtgagttgtatgggtgaaatcaagtaacccgtactggttaacacccactaacgtgtagtacatctttcatgatgtgcttaaggtcagtaatgtaaattgctgatgaataccggtggtaacccgcgctcgcgtccggcagacgacttcgtctgtcggacgtttttattttcatttattaataaatcattttaaaggatggtcatacatatgcattttacagtactcggcgcaggcgccatgggattacgttacggtgtgttattacaagaagcaggcaatcaagttgattttgtggatacttggcaagcaaatgttgatcaaattcatcgtcaaggtggcgtctacgtgtcgcgcgatcaccagaatcgacacttagttcccgtcaaagtctcaactcccgaagattatcacgatgatcccgacgtgtgggtcgtatttactaaacagatgcaacttgctgattttttgactcggacggcccacgcttttaatggtcgccagtacgtgctcacttgcatgaatgggatgggtcacgttgaaaaattattacactacttcaaacccgaaaaattattagctgggaccgcactagtcgctacggtcttaaacggccctggtgatgtcgacttcattggagctcgcggcgccggcaccatgaatctcgccaattatacggaacaccctgacgaaatgacccaccgaatcgtgacagaattagataaatgccaattccaccctaatttaacaacgaacttccgcggcaccttgctggctaaagtcgtcttcaactcagtggtcaacaccctctgtaccctctttgaaattacgatgggcgaattcgcggcctatccaggggctgatgagctgagtcgtcaattgatcgatgaagcctatgatgtctgtgagcgtgatggtgtcaccatgttgaatacccgcgcggaagagctcgcctctgtcaactacgtcagcaaagtggctaatcccctccactacccatcgatgtatcaagatatgtctcataatcggccaactgaagtcgactatatcaatggctacctcgtcaagctcggccaaaagtaccattaccaagcaaaaacgcacgcgtttctgacccatctggttcacttagccgaaaccacccgccaaaccagtgccacaactgaacacactactgaacaaaatgctcagaacgcgaccgaacaggctagtcaacaagcaagtgcgtaaccgattccccttttctcagcaaaatcatgtacaatggaggttaagttgattttactgaggaggcggtttgctgtgcaagtcagtcgggaattcaaaggtatctttcttgctagtatcagtgcgaccttctgggggatttccggagccgtcgcacaaacactttttgatacgaccgatattaattctatttggttaacgggaattcgcatgctgggtgccggaatcgcactattactggtcagtttgctgacccatgttgatttgtggtcgatttggcgtcaaccccgcgatctcctacagatcgtggcctacacactattgggtctaatgccggttcagttcacctactttttagcagttgaagctagtaacgcggcgaccggaacaattctacaattcatgggacccgtgttcattgctctgtggatgctagtcgctcatcggcaattgccgacccgtgcagaaggccttgcaattatttgtgcactactgggctcattcttgctcgtgactcacggcaaccctcagaccctagtcatctccgtctgggcgttgatctggggactcttatcgggggtctcgtccgctacgaataccttgctaccaaccaaactacttactaagtacgacccaatgaccgtcaacacctggtcaatgttgttagggggtatcttgtttaacatcgttcagccagtctggtcaatccatattccactgactatgcttaatatcagcaagttgacctttgttgtgctgtttggaacattgttagctttcctattcttcttgcaaagtttgcaatatatccggccaaccgttgtcagtctactagacgcttttgaacctttatccgcaaccatcattgcggtggttctactcggtgtcagcttcggttggctcgacattctgggcagtgtcctgattattagtaccgtctttattttggctattgggcagggtcccaatgatcgcacggcagagaatttcaagcaaccataaacgatgactcataattatgaaaccagtaaaagccggttgtgactaagtcctagtcacaaccggcttttacattgccgctaccgttacatatattcaattaataaccacgattcagatccacttggttacgtaccagcgtgccatctttgacaaactgcgcaaagttcgccgcaaagattggaaaaacggtcgcccgaaagtgggcaatttgacctgaaatatgtggcgtaatcagcacgtcatctcgttgccacaacgggtggtccgtcggtaatggctctggttcagtaacgtccaacgctgccatactgagttgatgatgatccagggcggtcattaacgctgtagtatcaaccgccggaccacgcccaatattaatcaacatcggttgctgtttggtctgctgaaataattcagtactaaacaaatgatgcgttgttggcgttaatggcaaagcgttgacaataaagttagccgttgctaacgcgtcagccgtcgcggtaaatgccactgtttcatgaaaatgatcagcggggtgaccggtcgtattgaccccaatcacgtgcatgcctaacgcactagccttagccgctaacgattgcccaatttggcccgtgccatatatcaacaactgttgcccggtcaaggtagatgtcgtcattggcaaggcccattgccgtgccccgcgctgattcagccaggccgcatggtacccccggactacgcttaacatcgcggctaagaccgattcactaatcgcatcggcgtgaataccactcgtgttcgcaaccaccaccccggccgcttgcaatgcctttaatggcaaataatcgacgccagctgaaatgacctgtacaaactttaactgattggttggccgcgctaggatcgtctttaataacggatgattaccatacatgacttcaatttggtcgtaatcggccgccgtgaccgccgccgcatccttgaacgtccagtccggataagtggtttgtaactgttgcagctgttcaggtttggttgcttgagccatcaataccattggcataacttattaccccatttctaatttcttgatcaatacttttatcataccactatcattcacttgaaccgtaatgatccacaaccggatattagctaagattggccagtaagttaggctgacccttttttagcccacagtttggtttaaatcacaatgtttgacgctactgctgacaaacggctcacaaaataccaacaaaaaagcgatgttcgaaagtcgcactcccgagcatcgccaatcggtaactaacctaattgggtttaatcgttgaccaattatttaacaaccgcaaagccaccggtccagccgatttgttcactggctgctaatgtcatttgcataaaccccatcgcttcaagctcacgggcccgctttaacttacctgcatccttcacttctaacggactgtcagccaaggcgcgggtgaagcgttgcttggcgctatcgtcattaccagcaactaacacggttgttggttccttaccattgacctgcccactctgaagcgtcgccgcaaaagtcgtattgaaagccttgagcacctgactatctggtagttgctgctgtaattcttgggcagccgaactatcagctggaacaaccaagtcatcccacgtgtcaaaattcaaggggttcgtgatatcaacgacgattttgcccttcaactgagtcgcgtactgtttagccagcgcagctaaagcgggataaggtaccgccatgatcacgatttcaccgagcgttgtggcttggtccttggaaccataataagtgacctcgtgcccagcgatttcaaaattatgaccaattgcttgccccatgttgcccttaccaaaaattgtgatttccatatcaaaacacgcctctctcactttataattaattttatatttacattctaacattgatgtcccgtttacatcacttttgtgtctgccagttaccgcaaaccggtcgtcattcgccccagataatggacactccttgaatggtaacaattagtggaactaatggctaaccagctcggatattcacctgcctgcacgcttcccaggttattgacacgagtcgatcagtcactaacgaccaaaaaccgaccaacttaattatgaattaattaagctggccggtttttaaattttcagacgatcatcaagtttactggtcttgtttacccagaaaaattaattattgcccgttgccgtactataaccatctgtagaagaagcagtgccaccggtcgttgttgaagacgtatctccataattcgtcgttgagctactatcggtgtttgcactataactgtagctaggcgtacttgagctcgacgttgccgagctcgtgtccgtatcgttgctataactatgcgttgaagccgaactactgttgtcactactttcactataagtcgaatatgatgaactcgacgatgattctggttcactatagctatacgtgctcgaacttgaggctgaagacgatgcgttattcgctttcgccaacttcttgcgatccgtaatcaacttctggtaatcattggccgctaactgcgactttttgcgataagctttcaggtttgcaagtactttatcgactgtcgttgacggggtcgaagccttgagcttatttttcttgttatataatttttggaaatcagcatcatagctgaccactttcttaaccgtttttcccgttgtcgtaaacaacttatcatacttcttagcaaagtacggcttactagtcgttaagccagcagttgtcaaccgttgctgacccttagtaatggtgtccatggtcacgtcggtcttaagtaaccccttagcgttgcgtaaatcttggtaactagtccggaccgtcaacatcttagcagccgtatcatgctgtttctgcaaacgggtcttttcacttgaatccttcatattatcaatattattttgcaacttggtcaaagtcgagcttgaggcactcgcccgcaagtcccgttgggctgatgatgtataaacttggtccacgatcttttccgcattggttcgtgccgcagcttgagtggcttgcccatggttccacatgaagaaagctccaccagcagcaacaaccagaatcgcaacaccagccaacatcaacttccagttatagcgccgagctggcttcttaagatgtggattcttttcatccgtttctaactcagaaaagtcacggtcgtcatccggctgatcatcatgtggtacccgctgttcttcgtgccgagcgacccgtgacatggttggcttattgggctgcttgccaccgttgggctgctgatcaccatacaactcttcacgtgataatggtaactcaggctgcgtgtcatcatccgcttgttccgtccccttgaccgcaatccgcggttgctgtttacgagcaaccggtggaatatgatcagctgggatgcgcctttcgaccttcggctgtttagcagcagtcgcttgcggatccttagcggttgtggccgtggcctgagatacagcagcctttgatgtcgctgacttgggggctgtggacttcggggccgtggattgtgctaccgcagatgcggcggccgcggcactcgatgtcgaagcactagactgttgactgtgcgtcttggcctgactggcagcttcctgactagcacgccggtccatccgcgtcattggaacttccgacgttgccgccgactgatgaaccttggtacttgctgttgttttagccacacgcttctgatcagacactgcggtgctggttgcttgtgacgcttccttagcggcccgcgctggtgccgattgagccgcactagctgtcgtcgaagctgcgtgcttggaacgctggtcacttactgcctgtgatgagaccgcgctggccgtctttggcgccgcctgacttgctgttgaggccggtttagttgcggcggactttttagttatttgcgcggattccgcctttgccgacgactgagaaccagccgagcctttttgcttaaccgcactagtcgccccatgcttgacgggtgccgccgattgttttacagcctggcgatcgtctccggaatggcgcgcttttttagccaccttttctggttcaattactgcgtcaacaggttgcttttcggcactgttattcgccgtcgagcggggaatattgaccgttgattttgcttcggcttcgtccgcctttgatgcggccgagtctttcagatcataggccaaggggatctgttcattatcttgttcagtactatcatcgtcgggaattggctcagtaatcgaattccagagccgtctacccaatccttcttttttattttttctagacaaaaccaacgctcctcgccaatttataatttacattagattcctggttaagcgccgaccaaaaatttttatcaatttcggtaaaataaccattaatagttaaattatagcatggaattggctactgagaaaccactggtcaagcggatttgtgaataactgcccaataccttaaattaaggttaaaactctgctataatcggcttatcaagatatttgaaagcgaggagttcatatggctactgcgaaagttatttttgctaccattaccggtaacaacgaagacgttgccgatattattactgaaaaattcgaaaaacttggggtcgatgttgccaaagaagaaatctcgcaagccgacgcaactgaattcaacgatgttgatatttgtgttgtcgtcccttacacctacgatgagggcgccctccctgaagagggactcgacttctacgaggacttacaggatttggatttaaccggtaagatttacggctgtgccggctctggcgatactttctatgatgatgattattgccgtgccgtcaccgatttcagtaacgcgttaaagaaggctggagctactcagggtgccaaggacgtgttcgttaaccttgcaccagaagctgatgatgtaaaagccctggatgcatttactgaacaactcgttgctaaagttcagtaacctgactagtttgattgagtgaataacaaagaaacgcttcaagaattcatgactaattcttgaagcgtttcttttattaactgttatcgacacatcatcctgacgctgataccgaaaatcacaatcaccgtaatcacttttattcagtccttacgatttcgagcacgttgtttaatggcgtttcacacgccgaaatccgagccaactaccgaacatggtcaaccccaatagcactgttcccatcacatttgcacgacttggcgcttcaccagtttgcggtaaagccgatgtgccgagtttggccgttgcgggctgaacagctaccgaagctgattcagtcggccgtgattcttgatgatgaccggcaacgatagtttgcgcgtgttgtgaactaactgtgttggacgtctggctccgatgcggcctgaagtgactactgatttagccccattagccgtcgtttgcatgccagaattacgatccgcaccctttccatgattcgtgccaaccgcgggtgttgcgtcatcaataactgcatttgcatcaacgtcagccgcatcaccctccatctggtcagcatcatccgtaggtatttctgcttgatcatcaccatcgatacttccagtcgagccgccgttcacatcgtcattggtattggtagcgcctggctgttcagtattcgtatcgccatcgctcgccgcaacgaccgtgactgttgccacgcgagtgaaaacttgaccactcgcatccgtatactgataagtcacctggtaaacaccggcttgattagtatcgaccgtgccagttacgactaggtcagcaagcgacaattcaccgccattaacatccgtagccaagactaaattatcgcttggttgccacgactcaccgacagtaatagttgaatcatgaatctgtaaatcgctttgggattccgcctgttcgtcggcctcctcgataaccaccgttaccgtcatcgttgccgtcaccaactgaccagtcttgtcagtaaattgatacgtcaaccgatagtccccggctgtagtccaatctggcgttccaacgacctcaatggccgaccagtctaacgtttgaccatcactatcagtggcattctgaaaattgctttggggctgccaagtactggttccctgcccatccgtatgcaccgttgcgtggttttgatataagttcaaactggcttggttttccttaacagttacagtaatcgtctgcgtctgactaccatacgtgtaagtaatctggtaatcacccggaaccatggtgttcacttcacctgttatcgtcacatcgttaaagtcgatggcgtgaccgtctttatccgtcgccccgtcaaaaccgtcctgcgcatgccaagtgccaccagcgtgtaactctgtatcatggacagtcaaacttgtctggtcagctttcacgatcaccaaagcagtgaccgtcttacctgcatacttgaaagtgacctggtaagtacccggctgacttgtatttactcggtcacccgatagtttcacagcctggggattagccacatagagggcctgaacatcgactttttgaccaaattggtcggttaaactctcgatactgtccgtccagttccaatcatcgccaacttccagggtaatgtcgttggcatcgataactgcttggtttgcttcccagatgtaggttccaatcggcgtattttttcctgaatacagattcatcagttcagcactagttaaccgttgctggggattggctacatttatccagtaaccggtatattggtcattagcttcaatgtccattagcccaaccgactcgattttggctggcgtcaaatcagtatccggaccaagtgtaattttttgtagacgctcacatcccgcaaacatgtcgagattttgttcaacgcgatgcaaattaaaaccagatagatccacctcagttaaattggaacatcctgaaaatagcaaatgaatccaagtaacctgatctgttttgaactgagacccgaatttaacactggttaagttgtgcatgtccataaaccaagcagccatattgtcaaggctatcagtcttccatttggataagtctagctccgacaaccccgttttgataaacaaaccgcctgcttcttttaggctttcaaagttcaaattctcgataccaataatacgagttaacttttcattgggaccaaacatgtagtccgcttcacttactcgacgagtgtcccaccctgaaatattgattgtcgttagttggctagtccctggagaattgaaaaacaggcaagacatatcagtcacatttcccacctgccagctgctcaaatctagctccttaacatgcgtattttctgaaaagaaatatcttaaatccgtcgcagaactaacatcaattttttcaagcccttcatagtgttcaacattcgtcaaattttcaaagaagcccccactatcacctataatgcgaattggctttgaaatcacaactttaactatttgtaacacccacgattttgattgccacggactatccccatagcaatcgtaaatatcgccaccgtccaacactaacacaccagaatccgcgtcaaaatgccatttaatgccatcggcgttgtaaccagcaccccagatgccggccatcgagtcatcgtcttccatatcatcgttgcgataaccatccgtgagatgtgggcgttctggatttcgaatcacgccagccaaatcaccgcttccccgctcattgatggtttctgttttatgctgcgacgacaagacttttgcagtactatccgtgtcaatatcttgcgactgctcgtcggcactaactggctgttcagaatcatcagttgtcgattggttcggatgcgtatcaagtgttgcagtatgttcgtctgacggaacgggggtctcactgtcaacttgatccgtgaccggtacactgacctgatcagaattcgcatgctcatcatcagattgattgacaatctcatcagtatactgttcttcagcggcctgcactttaattggttgagcttcagttaccagttcactcattgcggattcatccatggcgtccgttactggggattgctgctcagcgttaccttcagacaaagttgccactgccggttcagtcaatgcttctacgtgtgttgattcatctgctcgtcccgtcaccacattcatgttcaacgtaacgagcgtgattccagcgaacaaccacaccttaccactcttgtacatcttgtaccgtttcttcacttgttccattaatttctcactcctttattaattaaccttgccgacgtttaatgccgacgatgctggctaaaccagtcaccattaacatcatgagtcccagcaacccgaagcgattaacttgttcgctagtttgcggtagctcaccagctactgacgctggatggctgactggggccatagtcacttccggtttagctgtatcagccttagcataacgtttagcatcaattccgtcctcattgcgttcagccgtattcagtttcaagttatcacgaaacaccgtggtcacttgcttctctaaaccaccgttaaattctggtcgcactatcgtgtctgcttgctccctttgactgctggaaccagcgtttgcgcccgttaaaccactgttaggatcactagtatcagggtgttcagtagttcccggttgttctgattgttcaggaacttccggcagttctggttgatcaggtgtccctggcgctgacggttcccctggtgtttcgggggtttcaggggtttcaggctgttcgggtgttcctggttcttccggtaactccggttcagctggttctcccggtaacggcgtttcaccattgccagcaccttcgactaccgtaatggtggctgtttgagtccactgcaggccattggcgttcgtgtattgatacgtgatttcataagtaccgggttgcgtcgtgtcaacgtcaccaatcacaactaagtccgctagtgttaatggccgtcccgtcgcatcactggcacttacgaagttgtctgccgcctgccagtggtcgccaactgtcaccgttgtatcttgaacaaccagttctgtcaggtcttcaacgtcagcctcttgttcagtcaccgtgacggtcgttgtcgccgtgactaactgtccggtcaagtcagtgaactgataaacgacctcatatgtccccggccgtgttaagtctggttctccaagcaccgtcacgttctgccattccactgaacggccatctgcatccgttgcactcgcaaaattatcccgtgggcgccagacagcgcttcccgttgcgggatcaatttcaaccgcaacttcttgcgcatgcaaatttagttgactttgattagccacaaccgtgacaaccacgtttgtttgccgacccgcataagttagtatcacgtgatacgaccctggccggctggtgtcaacaggctcaccgctaactgtcaccgcttgggggtctgtactgaacaagactcctggatcaactaactggccattttgatcaactagttgcgcaatattttgtgtccagtcccatttttgattcaagaagagcgtgctgtctttaccggtaatcgtggccgcagagacggtttcccagacaaacgtcgccgtgtcagcgtggtttcccgaatattgcgccaggagttcagcactcgtaaacgtttgcgagctatcagctacgttgacccatttgccggtatatttgctattcttaggcacttccggtaaatcaactaagggttgcgtgccgtgttgactaaaatcaagtcccggaccaagtgtcaacgtttgcaaacttgtcaaaccagctagcatttgccagttttgttcaacactctgcatattgaaatgggacaagtcgagcacctttagtttggcatcatcattaaacaaactattgatttgagtgactttagcgacggtaaactgcgtaccgaattcgatacgctccaaatcggacatctgcgcaaaggcaccatcgatttcaaccaggctggctgaatcaaagctcgtcagattcaagtgacggacgcctgtgcgcgcaaacatgttagccatcgtcgtcacactgcgcgtatcccagtcagtcaaaccgtcaatagttcgaagttggccgttgaactggaacatattttgcatgttggcgacattatgagtatcccagccactgagattaaggtatttaagttcagtacccatgaagttccccataaacatgttcaccattgtggtcacattgccgacttgccaagcactcaagtccagtcgctctagcgaggtattttctttgaacagagactgcatgttggtcacagcactggtatcaatcttttctaacccttcgtaacgcgtcacgctgtcaagattcgcaaacagactattcatgttagtaccggcaacaattttgtcagcaatcacgatacacttgatcatcggcgcccaagacttgcgacgccaaggattatccccataactgttatttaacgttcccccgttcagcgttagcgtgcctgtactggcatcaaagtgccaatcaacgccaaagttaccagacatttcatcctcatccgccctagtcacagcacgagtatcaacgtgctgtgactccaccttaaggtcatctaccagctgatgctgctcaacatgttgcaagtcagcggcgggtttacgttctgacgcgtcagcagtatcgagtaataactgttcactcgcttcaggctgttgttcactaacagtcgattctgcggcattactgaacagatcgtcagtccgtgatgcttcataactgttcgtcgcgggcgctaccgtgtttagtccgttcactgctgccatcgaatcagcggctacctcactattgggcgcgccagatgtcccgttcaacgcagccgttgatgcagcggattgcggctcgtcattagtagctggctgtgcatcgattaccgtctgattagtaatcgaagcgttctcatcattagccacgacaacgttatccgttttagaaaccgaacttgccagtgtttgattgctgctaccttgattttgaattgacacaccgttagtcgctacgacactcgtttcgctagtcgatgcagatgttggttcatccgcatgtgcggttaacagttgagtattcaacaataatagtgaagcgctcgcaagcaaccacatcttgccacttttatacattttataacatttcacttctgattcacggtaattgatagtaattccccatttcttcaaaaacaacctaactgacctaacgattaatctcattaaataaagtgttcttactatatttgattatcgtgtttaactagtacatcatttacggtttttaaatataccatggtaccctcataatgctcaactgattatcacaattctaattaacctgttatcattatgattaatccgcttgtttatcacaaaaatataattatcaactccctatttctgcaatcgttttcatcgtggtgattcattaattctggtcgttttagtattcgaccaccactattcgttcaccatactgacagttgcatcatgcaccggtcagctgtcaccatggcgactgaccagtgtcttccagtaatccccggccatcaaaaaagccttgagcaatattactgctcaagacctggtttacccattctaatagcgtatttccctaatttgaatcgaaagactccccccgcgtaatcatgagctagtagatacgataattgtcactcggccccgagtcatttggatcgtcgtttcacaacgatttgtcgaatcgcattataaactagctcaacgatgacaaacagcaccgtgatacccacaatatcaattaaatacgaactaagtcgatagcccaccttgccgatccacaaatcatacggcccttgaatcagtaagaaatagatgactaacgtttcaaaaatcgtccgggtatgccgccaaaacgatcgccattgcattgatttcacgccccttcaagtggtgccaacatttgtaacgcctgtttgacctgactcactgctaattgactttgatcaccgacccggccgacgtgtccaaaggcaactgccgaccccgtcaactgactacagacactgttataacgaccaaacttgcccgtcgccgttgccacgattggcacaactaattgctgccgtgcttgctcagttgccgccattaatgccaacaccgtctgtgcatcatgtccagccactgtcacccgcacgacatcagcaccagttgctgctaattcgtgataagtcgccaataaatcgtcagttgttgctgtcgtgacggtctggctcgcaattaaccgaatttcgttggcacgcatctgtttggtcaacgtcataaaatctggctgattgaccatggctaagtcaatatccacgccagccacgcttcgattattcactaatgtttgataagtttgataatattcggtcacttcagctggatcgtttgccagcccaaacatggcaattaatggaatcgtccccaaaacttgttgcaattgggccgctgtattgactaactccgcacggttatccaattcctgataaggatctaaccgccaaacaacaatttgtgccaccgaagttaaaatctgccccgctttacgcaagaggtcctcccgtgtggcccccgctaaaacaacaccaatcttaggcatccctgtcgctaacgttaactccccaactgtaacttctttcaagaccattcctgctttcattttcattcgaacaatgcgcgtccgttgccgttaaattttatctactcttaacaatagcaaattttcgctgttttgacactcaaaattcatttttcgacttaaaatttaaagcgcttttaatattaacttgttaatactggcatcgctttcagtttggccttacaattaagcatactttagctcacaaaggagttcaacatggcaaacgaaaaacaacttcgatggtccaacattgctttaattgcattcgtggcggtctggggcctaggtaacgttgtcaataattttgcgttacaagggctttcagtcgtcacttcttggattttgatcatgattatttattttattccctacaccttgattgtgggtcaactgggttcgacctttaaggatgctgaggggggcgtctcatcttggattcgagcaacgagtaccaagcgcctagcttactatgctgcctggacttattggatcgtgcacattccgtacttagcacaaaaaccccaagggattctaattgcattcagctggctgttccgcggtaatgggaacttcgtcaacacgacacctgcgttagtcgttcaagccatttgtttagtgctattcttattcttcctctggattgcttcattgggactaacgacactgaaacgcatcgggagcgttgctggtacggggatgttcatcatgtcgattttattcatcatcttggccgtatcagcaccgtttatgaccaaggcgactgttcagacaccgaacatgttttcactcaagtcctacttacctaagtttgactttacctactttacgaccgtttcaatgttagtcttcgcggtcgggggatctgaaaagatttcgccgtacgttaataaaaccaaaaatccgggacgtgagtttccgttaggcatgttagtgctcgcaggtatggtcgcaatctgtgccctgctgggttcatttgccatggggattctgtttaactccaagcacattcccgctgatttgatggccaacggtgcttactacgcgtttcaacgactaggtgccttctaccacgtgggcaatctgttcttgatcctctacgcaattgccaatgtgcttgcccaaatctccgccttagcgttctcaatcgatgcgccattgaagattttgcttggtgatgccgaccctgaatttattcccaaaaaattaagtaaaatgaacaagaaggatgtgcccgtcaacggttacatcttaactggggttttggtcagcattctcattatcattcctgcattagggattggaaacatgaatgaactctttaattggttattgaacttaaattcggtcgtaatgccgatgcgctacctgtgggtctttctagcttacatgctactcaacaagcacttaaaggaattcaagagtgattacaagttcctgaaaaacccagtcgctggccgtttggtcggtgcttggtgcttcctgtttacagcatttgcttgcatcctcggaatggttccaaagacttcctacgctagcaatcctagcagttggctcttccaactgactttaaatattctaacgccaattatctttgttgccttagggatgattttgccgatgattgctcgtcgtcatcgcactaaaaccgcttagtgcgtcaccgatctttacgcccgcatcgtcgctctacgcctgcggactcactgacttttttgtaacgttgatcgataatctattcgccaccgctgacagcgcaaaaaactgtcagcggtggttttggtattaccaaccgttgctagtaggcatgcgtgttcacgtaacatttcagtcactaatttgcggctcacaatcttacactttttacacgtttagcggtatgattcttagtgaatatagtcaatccaaatttaccaagcagtcgctcttcaaggaggttcttattatggctaccgtcgacgctctcgacatgtttttgaccgattatgccaatatctctcgttacctgaatactcgcttaaattcactactggccacgcaacatcttacctttgacgcttttttaatcatgcatgaaataggtcaaagcccccagccactattattaatggagatcgcgcatcagcaccatgtctcacgcagcgcaatctcacgccaaatcggagtcctcctcaaaaatcgatacattgagcaacaggctaatgccactgatcgccgccaaaaaggactttccttaacggctaccggccgtcacctagatcagcaactaatggccaccatgcacaaaacggttcaccagtggacgactcaattgggcccgcaacgggtgaagaccctgctaggcatcttcactgactttaacgagcaaattatcaataatgaggttcccgccagcgattaataaccagccatcctcagcttcatcattcggcattagtcgtaacgtgccccattttaataagctgatttttattcgtcgccatttcaagttacggcttttaaaggccttaatcaaaaaacggcgccatggatgctagtgattctagcgtccatggcgtcgttaattttcagttacaatcaaagcagcttacactacggtacgttcgtccgcgacttggccggctctgccgctagtcatctgcatgcacgtcaaaggcatgcaacaactgttctgaaacccctggcgcatctgggtcgtggtgacctttaccggtatctaaagctcgtaattgggccatctcagtcgaagttaattcaaagtcgaagatatcccgattactcttgatccgtgcactgtgcactgatttaggaaagacgatcacgccttcttgatgttcaaatctaagaatgatttgaccagcatccttatgatacttaatagccaattgttgaatgattggttctttgaataatgcttgattgccctgacccaagggcgcccaagcttctaatttaacatcttgtgccgcgagtaattggcgcaagggttgttgctgaaagtacgggttaaattcaacctgattgactgcagggatcgtttcaaattgtggcacaaatttttgccacaacgttggtgtcatattggaaacaccgatcgactttaatttcccggccttttgggctgcttccattgcttgccatgcacccggaacatcgccataaggttgatgaattaagtacaagtcaatatagtctagtcgcaacttagttaacgaacgatcgatggcgcgactggctgcgtcaaagccgtagtcttggagccaaagtttactcgtcacccagatttggtcccgtggaatcccactatccttaatagcttgaccaacttcgtcttcgttaaaataggccacggctgtgtcaatgtgtcgataaccaatcgccaatgcttctttgactgcttgataagtggaaccgtcgtctggaatctggaaagtgccaaacccaattgctggaatcgcgcggccatcatttagcgtaatagttggtgtttttgtcattaataatcactccttaacttattcatgtaattgtcgtaaactagcgccaaaaatctgttcaattgtcacaggatcacgatgatcaaagaactgactgacgccctgatcaagttcggccattgctgacatttctgcagctgttaattcaaaatcaaaaacagcgatattctcagccatacgttcaggatgcactgattttggaatcaccgtaatcccgcgttgcaacagccaacgtaagatgacttgtccggtcgtcttaccatgggcctgtgcgatagtttgaatacttggattactgaaaatcgcatgcttaccttctgcaaacggtgcccaagcttcaacccgtacgtgttcatcttgattaaagcggacctcgtctgcttgctggtaccatggattgacctcgatttgattgacagctggttgcacggacatggtcagttccaagttctttagctgatccgcataaaaattggaaacaccaattgcgcgaatcttaccagcatggtaagcctcttctaaagcacgccaagcacccatcacatcgccataaggttggtgcaaaagatacaagtccaagtagtctacgcctaaacgttgtaatgacgcatcaataccttgctttgcacgttcataggtgaattctgagacccacagcttggaagtgacaaagagttcatcacgtctaagaccactcttttgaattgcccgccccactgcggtttcattttggtatgccgttgccgtatcaattaaacggtaaccagcctttaaggccgcggtcaccgctgcttcacattcattcaggtcagggacttggaacacgccgaatcccaattggggcataaccacaccattgtttaatttcgttgttggaaccatcacgcatcaacctttcactatttgattacaataacaagcatacccgcaaacctaatacttgaaaattactacttattcatactagtatacatatagtgcatactagtaacggaggttcctgatgattgaaaattatttattagaagagctgatcacattcgcccacgagcacacgctggctaagaccgcggccgcattaaacgtgacgcaaccaactatcactcgcggcatgcagaaattggaaacaatgctcgctgttcgcttatttgatcgtcaacccaatcgaattacactgacgcccactggccagttagccgctcaggaagctgaacaattattgacacaacaacggacttttgtaaccaaaatacaaaactacgagcaaagcttagtcacacgtaccgtcgaaaccaccctacctggtccacttgccttactcacccatctcaaaacggtattacctaattcgctgcgagtaaggcaaccactgattgccgacgaccaaatcactgagcatctcattaaccgccaggcaagtttcattttctctaatcaggaaattctgacggccggcattgaatctcgcttcatcggtactgaaaatctcgtggtccatttacagcgattcatgtaccgtgcgaaccaacctagcatcacgttcgccgaacttaagggaattagcttcgtggttctaagcgcaatcggtatttggaaagatattattcagcaggccatcccagatgctaaattcttataccaaccccaacgcacggcctttacagaaatcactaaatactctgattttccgtacttcagtactaactttaccgcattggcgcctcaccagctggatagccaagccgatgatgacaatcgagtcgctatcccgattagcgatactcgtgctcacatgccaatctatgtcaattatcttgttagcaatcgacaatcattaatgcccctattcaagcaatttgaagccgcgtggccagccaatctcaagcatacttccacgtcctagcagctaacataattaagccgttcggtctaaaactgcaaaatgaagtgttacgctcaatcacagggggtatatactggttgaagctcgccctcccagttcttgatagcaaaagaggtccacacgctcgcttagctaatctaatgcgagcgtgtggacctcttttcatattaagtttggttcgttcaagtcttaatcttaaacatggaccctaatgtgatgattagttgcagaaaaaacagttaaacaagcattccacgccaatcatcttctaacagcaagccgtttagcagatttgaactgccgacctcttccttaccatggaagtgctctacctgctgagctaaaacggcgttaattgaccctatccagtataccaaaagcatgtttaaattcaaactgtactggttgacattcaacgtaaaaaaaaggaaccgaattaacgattccttaggttgcatggcaacgtcctaccctcgcagggagcgatcccccaactactctcggcgctaagaagcttaacttctgtgttcgacatgggaacaggtgtatccttctcgccatcgtcaccacaccattgagaaacttgtgctctaaaaactagctaatatcaaatatttcatatgcaccggaacaccaattgctggttaagttctcgaccgattagtattagtccgcttcatgcgtcaccgcactggcccactcctaacctatatacctgatcatctttcaggggtcttacttacataaaggaatgggaaatatcatctcgaggtgtgtttcccacttaggatgctttcagagtttatcacatccagacggtaggtacccagcgatgcgggcctggcggcacaactggtacaccagaggtatgtccatcccggtctctcgtactaaggaacagtactctcaacttcctaacgcccgcgacggatagggacgaactgtctcacgacgttctgaacccactcggtaccgttttaatgggcgaacagccaaacccattggggacgaataagccccggatgcgatgagcgaacatcgaggtgccaaaactcaccgtcgatgtggactattggggaagatcagcctgttatacccagggtagcttttatccgttgagcgatggcccttccatacgggaccacggatcactaaagcccgactttcgtccctgctcgacctcctgtctgctcgcagttcaagctcccttgtgccttacactctgcgaatgatttccaaccaatttgagggaaaaccttgggcgcctccgtactttttaggagggcgaccgccccagtcaaactgcccacctgacactggtctcccacaacccacacgatagtggccacccacgacgacccaccccgcacgattagtggtgagggttaggttagatgggttatacagcgagggtagtatcccaccaacgctccaccgaaatagcgttccggtttctatggctcctacctatccgtacaagctgtttacaaaacactcaatatcaagctacagtaaagctccatggggtctttccgtactgcggggtagtccgcatcttcacggacaataataatttcaccgggtctctcgtttgagacacgtgccagagagttacgccttcgtgcggtcggaacttacccgacaaggaattttagctaccttaggaccgttatagttacggccgccgtttagggtggctttcaatctgctgcttcgacgaagctaaaccatcctttaaccttccagcaccgggcaggcgtcgcccctctacgtaatcttacgatttttgcagagacctgatgtgtttgataaacagtcggcctgggcctacactgcggcttgatctgcgatcagcaaccccttctcccgaagtacggggtattttgccgagttcattaacgagagtctacctcgcctcaccttggatttctctcctcgacacctgtgtcggtttgcggtaacgggtagttaagtagtactcacctagaagcttttcatcggcagtggtgaacaagttctcagacgcttcgctactaaatttcgccccatcacagtgtccttaaaaggaaaagcatcctggactccttcacaagactactgctggacattctaatccaacagaatgcacatcttagcctcctgcgtcccctccattgctcaacagcattaactagtacagagaatatcaaaccggttatccatagtctacgcctctcggcctgacttaggtcacgaatcacctgggaggagagccttccccaggaaaaccttatcattcgggggataggattctcacatatcttttcgctactcataccggcattctcactttaagacgatcccaagtcctccgatttgcttcaccgcctgtgaacgctatcctatcacggcgacctaatggtcgcattccatgtgtcggtagtagcttagccccggtacattttcggcgcagatcactcggactagtgcgtattacgccactctttaaatggtggctgctttgagccaacacatcctagttgtctagcacc

SEQ ID NO: 727 - DNA, 46545 bp, Unknown
  Metagenome-assembled genome
tccattattgtttcggctaataagaaaaaccagtcaaccagaaaggttatttgatgactgcactcatagatatgtttcagaataaagttaacgagtatttgcagtcatgacgttaagcgtgagtggttaaccgttattttaattacgggtactttaagaagtcgccggaacacttgattgtactaataaaattagtcgttttcagtgatacttagggtaagacccttatgaggcaatttggacaaagtgacgtctgtttttacatgttttcgcgatagtctcattcttcattggatgcaccccaactcgattgatgtaatcgatgtcccccctgaattcctttgcctacagaaagggtccatagggtttacacggttaaaaaaaatgtcgaagatattcatagccttgtttatattgaacaagatagtgtacaattttatgacaaggtggtgttggtggattaaagtcaatatttgagacagattttaaggcgacataccgtgttaaaaaaatagggccctttctgtaggaaaagggaatgtcaaggggggacatagattacatcaatcgaggtgcgggcatcctaatgacagaacagaatgagacgaggaagatcggcgaaacaacaggtaaaaaagacgggtccacgtggtgtccaaatggcctcataaagggtctaccctacggtaatcactgaaacgattaattttattagtaacaatcaagtgttccgcgagcgttcttaaattacccgtaattaaataacgttaaccaatcacgctttgaacgtcatgactgcaataatcgttaacctttattctgaaaccttctatgagtgaagtcatcattataaccaccttctggttgactgcgttttattattagccgcgaaacattaatgggtctagaatttttggtgtttttggaaagtattttccattccaaaaaagtaactaggccctttttgataacaaaaaaaaggcactaagccgccttagtgctatgctttaagcgacggcgaaagacgaaaaactcaagataagcggggtgttagggtaggaatagatgttctctcaactagaaattacactaaattactgggacacagacacaaacagtcaggtttcggttactcgggaagggcatttcatggtcgggacgcgggtcgcacaaagtattggtcatccaggcagagttactacacactcaggccgcttgtcccagctgtcatacaatacagttgcaccctaacagacacaagctcactcatgtcaacattgcaggaacccatgaccgcctaattctagagtaaacaaagcaacgctggcgttgtagtaaatgccatgagcacttgtacggccacccactccagttggtatcaaaccaaccacgccataggtcagcggactagcggactcagagctgagctagcagtaactcatcccggctcagactatcgccagtctaccggtatttagacaaactcagttcgcgattttgacggctaatatcatcccacagcgagccgccccgggtacgattaatctcggctttgatgaattccgttccacgcacggatccatgtcgtttatttgcattgacgccccgacactcacaaatagttaagagtacttagcgacccccgccttaagaggaccaatcaaacagttcttcttagtcagttacaagcaaccgcagaacgggccgcggttcaagggcgtcatcaatgacatgaacgcctcctataaggcattcgtaacatcgaactatttcctaacgccgaactcattattggatcggttccacatgtattcaattaatgggcggacgaggataaacattcgcactcaatgtttaaagccaaactcgaaagcattgcgggaattataaagtactgaaatcactatggcgcctatcacaggcacaaaaccggacgcacaaaagagccgctacactaggaggcctgaatgagcactcgaccgaaccagacacgtattgatattggaaccgattacgtttccggcgcctgcaaaacagcttatgaaacctaatcgattccacgatgctttgagggggcgtccacgtgatgaatcacgaatcacgtctatcactaataccagccagccccctaacaagcacgcccctatggatcacggccatgcattaccctacgaaagaatcttaatggagttaaattgaaacgccgccaaatcgtctctactctaaaggccgatagagggcatcaaaccgtaagatccaggcgctcaaattgctggttatggcttctccaatcaggccaatatgttcacacgcgttaccagctgccaggaaggaagtatcaaatacccaccctaacacacacccccccaacctcatccaccccccacacccatcccaccactccatccagaaccaaccagtagccaaccaacaccgcgcccactaacaataacctcacccccaaagaaccaccccaatctccacacctaagggatgttacaagctggattaaaaggagataaggcaaatcaaaaaaaaaacaaaccgtcacgatgtcggctcttatttgttatgccttccaagtacgatattcagacaacacaccagattaaacgccgcaactaataaaacaacaaaaaagatctcccacacgaggagatctccaaaggatagaaactatccttcaacaccatttgacaaacttccgttatttcatcaggtcatcaaacatttgattaaccgtctcttgatcacgattgttcgtaaatgctttaactggttgtaagtcacttaaatcattggcaatttccttcgtcgcataaatcatcactggggtacgcttcgcaaactgggtttggactaacgccacattaccaactaccggggtgcccttcgtcttttcggtaatccgccacttatacaactttttcgtattcaaaacatgttttgcccgctcatcatgatcatgcacaatatgataggccattaacacattatcagccatgttgattcctcctattttggccatcggtcattccttaatatctttagtatacgcgctgaaccctcagactagcaattatttgaaccaagccaccaatcgatcaaaccaagttttgtgatgaccagtttgggccatcttaactactttagtaaccgttggcttaggtgctggagtcgttggtttggcaggggttgctggcttatcggtatgatacttaaccgtactggtcttatctttaccgttagaggcttggttattccaagtataggtctgaccttgcttgttcaactcactagcaactttgtcagttgggagactcgcaacaaagcgtgttttagtttgcttaccagcatactcagcgattttatcagcttttggcgtcacggttagctgaccgttctcaaatttgactgtgaaatcagcggtcacatctttagtgtaagtcaatgtcgctagtttttccttagtcattgttttagcatcaatcttgctagtctttgatgttgactgatcatcagtcttagctgacgaactagcactcattgcggttgaggactggtcatcggccttagatgatgaattggtatcggttgttgtggtatcagctagatagactttcaccgctttcaaatcaactttcgcatctttcggcagttgatcagtatcggtcatatactgagtttcacctaaattgttatactgattgaaaatgttgaaaggcacggttttggcgttgataatattggcattggctacgttatcggctaacttgccgtccttggtttcgaccttcttagtgatcaaatcagggtctttttcagcattataatcaacgttattggacgtttgatcgcccttagcgactttattatgccaaacgtagtcgccatctttcttcgttagttgactatcagctttttccttaggtagactcgccgcaaaccgcactttcgtttgttgatttttaaactcagcttccttaccagctttcggcgtcacggttaacttaccgtccttataagcaatcgtaacatcgctggtcatgtctttcgtatagctcagccccgtgagcttatcagccgtcatgctaaagacgtcggccttcccatcgctcatcatcaccttgatcttactggtatcaactttcgcagctttcggcaattgatcggtatctgttaaatcgtcagtatgtgagttgttatcgtactgattgaaaatatcaaagtaaacgtccttacccgtcaagatattaacgttgtcactcgttgttgcaagcttgccttgggcatcttccacgcgcttagccaccaacgatggtgagagcttctcaactgggttacttggtgtgtttgaatctgtcgttacatcattgattttggtggtgaaattgttcttgaccgtcacattgtcggcattgacggttgtgactaacttaacttctggtaccgcataggccttgctcttgtcggcgttcatcgtctttaacaagtccgctttagcggtataagtgaccgtttgaccgtcaaccttcacgtcccaattcttagtattagctttgacggtttccgcctggttgactgtgagttctttttgaaccttatcagttagcacataactcttaatgtcatcagttcgattagctggcaaatcagaattggttagcggataagtcaaggtatcgcccttttccacagtcttaccattaatggaagctgtgtccttcccctgattatcaccggcagtgacatctttatgattacttggggtgaccatcaaatcagttaattggtaactagccgtttctgctttaggcttggttggggcgaccggtttaggctttagcttgatagcaaaatcaatattgccaaccgcaaaataatcatcagattgataaggagctgaccaatggtcaatcgcttgcccccacgtataactaaaaccacttatattgtctaatcgccgccaaacctgggtcccggtttctgaatcgtcatatgctgtatcatcatgagccttatagctatcatcgctaaccttggtcaccttatcaccataaatcgtctttacagcctggccatcaaatttaacatattgactggcatctaagtcgcccataccaattagggcttcctttaaagtgactggtttgcccgaagcatgatcataaaaattaaccttataatgcccatacaaattaggggttgctaaattagcgcccatcgcgtatttgcttaaataagcatatgcgggagtcttttggttatccaatttatcaactgtaaatttaacatcaactggcttgcctgttgaaacatcaacgaatggtgattgatatgtgaatgttgacccaactttcaagacgacccacgtgccatttttattatcaacactgctagtggtactgccacccttatacgtttctaggaaagtcttgaattgcgcggctgtcatcttactaacgttgccataatccagcgtcattttattagtcgagttagagacatacgtcacattagcgggattattaccaatcaagtcttgtaatgtctgtttagaccactgcgtactgttggtatattctggatctttcatataagcttcccacgcggccaaatccttttgatattgagcctctgcggtattgtacttatccattgcggccttttgggtcgccgtcactttggctaatgcggtcgcttgggtgttgtaatccgtcgcaatatctttttgcgcttgcgtcgcttggccactcgttgcgaccgtatttttagtggccttttgcgtcacgttaacgccggccgcttgggcttgtgtgaccgcggtttggagggctttatcatcaaccttaactttcaacccgttagtttgactaccgctcccagtactatcagcgcgcgctgtcataccacgctggttaccaactgcgactaatggggctatcgtcaaggttaaagctgacaaaactaacatcttcttaccataaagctttacttctgcggttattttgggattcatcgtccaccactcctcttttttaattgaactattctgcgctcgtgctggttaagttgccttgcaccacctcccgcattgaccccgtcgcattacaagtaaacaacgtgaccatggcttgtttaggttgttgatataacacgctagtgctgactggactaccgttaatataggtctggttaggggtaactgcttttttaccagtcaacagccggttaacccggtagtgataaaccttggtagcactaatcaagttcaccgtcgcacccattttaatttggggcacatttgagaatagcacccccggcatcgtcatattatgaccagctaacacgtaattgccttgtcccatctgctgatgggcaaagtaagttgtcgcccccaggctcaacgtatattggtttgtcccttgataaatcggtaatgctagcccaattgagggcactttcacgtaggcaatttcccggttagctaagcctgtctgttgagctttacgctgggttttcaatagttgttgataatcctgattagtgacgccggcgttgttatttgccgtgtagcgctgcgataacgtctggctctgactagttttagctactcgcccggtttgaccactcactccactcaccgtttgcttcaactgcccttgtaattgccgattacttttacgtcccagtcgcttttgcgtctgcacatactcagtcgtcatttcatgagcttggtactgcgcccagccccatatcccgccgccaatcaagacaattagactgacgatgccaattaaagccgaccacagctgatgttgcttaatccatttcatcactcacacctacttttcactcgtttttttagccgctgactttgcggtggcttgggctttagttaattgcgccttcattgcctgcgtttgggactgcgcatctttagtggcttgttgtgccgccgagacttgcccctttaaagccgtattatgttgactcaattgataatattgccggttcaatgacgccgtattcgattgggcttgccgcaattgttgttgattggttgttaaggcttgagccacttgttgatgatcgtgataggcccacaagccaccgccacttagtaccgccaagcccaccgcggttcctaggcccaaacccactttctgtagcgtcttaggctgtggctcgcgctcgaccgacttagctggagttggttgttgtttagttgccaattgcgcggctaatagctgctctaactgactactcgccgccggcggttgaacctgcccggattgttgcttcaactgcgtcaattccgtggtttgcgtttgtaatagtttttgcaggtcttccttttcttgcgtcacgttttgcttctcagctacgacccggtctaacttgtgttctagttgttggacatcaactaagttgaatttggcgcgatcagcactggcttgggtttcaaccgcatttagatgcactttcgtcacttctaaggcgtattcgtccaactttttggccagattctgataaaccgtcccggcaatattttggttattggccaccaatttccccacacggcggttataatccgctcgcgtttgctggtctaattcatgctttaagctggccaattgttgctttaaagctgtctgccgagctttcagttcactagcatagcgctcgttagcttcctgcacggccttggtatctaagtcttgcttagtcgcttgcacttgttgctcatactcagcttggcgttgcgtcacggcccgttcggcgtccgcttgaatttgttgcacgtcaacgtcacacttagacttcaaattggccaataccttagcctcggtttgggctttactttgggccactttagcttggattgtttcccgcaaatcggcctgtggatcatgttgggcctgatagtctcgtaactgtttagcaatcgcttgccgctgttgttcgctataactcactaaatcatgcgttgcgtcggcattgagccgttgctcgagtgtgcgcaagtaagtattgctatggcgcttcttttgttcaacttgataagcgacgtattgttgatcggcctcgggcactgccgccaaattttgcaccttaaactggggcacttttatttgaccaatctgcgacggcttaggtatcaccggcattttttccggtttagccgttgaactaccctccgcttgactggttggttcattagacccagctttacgctcacctgtactatcacccgaactggtcggctgactcgttgtgtccctcgctgacgccgctactttcgtagtctgatttttagtcgtggctcccgtctgactagcgggtgccttttctgtggcactacttgccgccggtgcttctgacgccggcctagttgctggttgaaccacctcatctaaccccgcataccggacgtgaaagtcatcagcctcagcttgggcttcacttggtactaaggccacaacttgttgatcgggattggcggcttgataagccgccataaactcactggcccaagtccgcttatcatcataatcaatgtccgcaaactctggtgcattgaagatactgttgaccacggccccggtaaaatcacgatagtcacgatctaaagtaaattgccccacccgcacatagggctcatatttaaacccccgaccagctgcttgccgttgtaacacggtaatcgtttcaaaactcatggggtccccttggtcaatcacgtgttcccgtaggcgttgaaacaactgacaagccacgttcaacgtcatcaatggtagttgctggataattcctgaccgggccacgcgttcttgttggcccaattcttcaatcaactcagttacaacggcatcgtgccgtaatttttgactatcccccttactaaattccagtacaaatggctcttgtaacttcgcgcgttttttaaataatgacatgttgttaactcctttcaaacttgcgggttatgtattaacggggtagtaacgtcttcgttacccccgctactgccccgtttagaaaatcctcacatctaactgccgaaggaaccttgcgaatacgtcttcgctaaggttgcaatcgctgaaatggcaaacaaaccaatcactgaaataatgatccaaattaggtgactcttgatcttgtcacgtagccgatcaccaccccaggccatcagggcaaaacaccccgcaccaatcgcgatagcgccggcaaacccgacaatttgaaaagcattcgtcacctttttcataatactttgcgtgttgctaaccgcatctaagctcggtaatacttttaaatacccggtcactgcggccaatttgaaactagctaaccatgttgacatcggtcttcctcctttccataaccccgagtttacgtgctccgtcaggtcacggcgtaaccctgccctttaacgggcttcaataatgacctttaaatcaccaaagcgatctttttgcccttgaaatacccccggccaccggccgacaactcggactaaatagtgatatttagttacttgggtcgcatcttgttgtaatagcacccgcgctagcgccgctttaattttggcattcaacatatacgcaattggccgggccccattggtcacatcaaaaccaacggtcgctaggtattgggccacctcgggactaaaatcgacttttaattgccgctgcgctaacgtcgctttaaattcttttaaatacttggttgcaatcgccagaccaatcttttcatcgagcatattgaagataatcttgtgttcgatacggttcacaaattctggtcgaaattcattcttcaacgctttttctaccacagctttaaactgcaattgccgttgttcgccttgtcgtaagtggttgaattgttgttgatcgttaaccactttagcggccaagttcgtcgtcataataatgatcgtgttcttaaatgaaaccggttgatcatcactatcatgtaagatgccatcttggagcacttgtaaaaataagtcttggacatcatgactgcccttctcaatttcatctaacaacacgatggcaaagggttggtgcttaaccgcttcggttaaggttcccccagcgtcagcggtccctaataagcggtgcaccgcgtcttggtcgttatattccgacatatcaaaccggattaaagcgtcgggcgacccaaacatggcctgagcgagttgtttagccgtttccgtcttacccgtccctggcatacccaaaaacagaaacgaactaatgggcttagtcggatcttggaaccccgcaaaatacaacgttagggcatctaagaccccttgaatggcttgcggttggcccttaatattctgattgagccgacgttgcacatcattgagctgggcttgtcgattcttcataatctgatgtaaaggaatgtgcttgcgctgttcaatgaccttcgccactgtcactggcgtcacggctttcagggcatgggccttcgcatacgcacaactttcatctaataaatcaaacgccttgtccggtaaataacgatcaggtaaataccgcacggcataatccaccgccgtcttcgttgcggtcgcgtcaatggttaagtcatggtaagcttcgtaactagcctttaaaccgcctaggatctgataactagctaacacactcggttcagctaattgaatcacatcaaaccgtcgggctaacgccccgtctttttccaaataacggtgatattctttcgtcgtggtcgcaccaattaacgtgatttcgcctcgagccaaggctggctttaaaacgttactaacatctagggcattgtcaccatcactgccagtgccaacaatcgtatgaatttcatcaacaaacaccatcgcccgactagcttgtaattccgtgagtaaagctttaaagagacccatgaagttctgatcactttgctttaactgggccagttccaacacataaatgggctgagcttgtagctcggggggcacttgttgcgtcacaatccgcttagctaagccttcaattaaattggttttaccgactcccggtggcgcaatcaccagcggattccgtttatttttgcgacaaagcgtctccaccaactgttcaatttcctgatcgcgaccaatggtttgatactgatcaggattagcttcgaccactttagtcaagtcttgggtatactccgtcaacaagctcatgactataaccctggtagtgaatctgattctggcgtgtcatcaacctcttcacgggttaatttgtcaccatcggcgccaaagattgtcggctgattaacagtttgttgattagtaggttgttgttcaaaatcagtggccgtaaatggttcggggtgcccatgacttggtaacgctgatggtacatttaacttaggagtcgcttgatcaactttagtggcgctagccaggtgatctgccaccgcagttccaaccttttccgggtcaaagtcttgggtttcgtcaactgactgtaagtgttctcctggcttatctttatcgatttgatcagtgctggtagccggttcggttctctggtctggtgccattttaggctgattattaactaattcatttgtccctgctggtatcttttcccgtgcctcaccagttagcgtcaacacctgtttttcttgcaaagcttgtaaaacctgatcaaccagcgcttgatcaaccggttttttaaaaatcagttcaaccggagtctctaaaggaattaattgcccattcaggcaaagatcttggcctgctccccaggtaatccccgttagtttaatcgttgtgattgacatgcttataacccccgttctttcagttgtgataaccattgctcaacttgtttagtgctcgtaaaacctttggcttcaattactaaccgtccagtttccttttgtaacgcgtcttcttgggctctaaacgctgcttgagcctttagcagacgagcttgttctgctttaatatcaacgatacgtgaacgtcgactactcatgataaacactcccttaatttgttgaataattgaaattgatcaaaagtttgcatatcaaaggtcaatttggtatacggtccagccttagccggttgtaattgtgcattccaatccttggcccctgaccattccaccaagttttgacacgtttggtggggcgtgattagccgcatgtgttggaatttttcaatcaaggcgcgccctgccacatcattgtccggtgccaaatgtaaataggccggtaacgccggttgggtgagcaggtaatcgttaatggtctgcatcttggcactggccccactcaaactcagtaactgactgccacttaactcccgggcgtacatttgccagtacgacagtaaatcgattggtgattcgaagacgtacaagtgtctaaacggccctctaaaccgaacattaaatccgtaatgtggcttggaaccggctttaatctgctttaacgagccatgtttggggtaacgttgtcgattgatcaccgtgccttgcacatcttggcccaccaatatgccggctgcatcaaaccagttaaaaatcacattatggtagccatcactgcctaataggccttgccgcgcggcaaaggtaattaagcgtgaatccagatgccgatactgcgtcagataagccatgccagccgcatctaacggcgctaccggtcctaccgctgacttcgtggtatagtcagctttcactgcgactttctgctggggattagtcttggtaaacgctttgagtctaaagtgcatttcgcgatcgctaataccgtaataggccttaatgaattgactcaaattaccagccaacccttggctgttccaaataaagtaatttttgcgggtatcaataattaatgaatcgtgttcctgtgagcgtaaataccggccttcatgtttaaagggcaacccagcatagctaacgtaatccgcaagttctaacgccataaaaaaaggcctcctttaccagtaaggatacttactactgataaaagaggttgaaacctgttaattaatgatttgttaatcctgcttatgttctagatactcgcaatcttcatcagcttcaacgcctacaaattccggttctaatatttcaggcatcccatagcatcttaggtaaaaaggtgctgcataggctaaactatgcttttctgcgtaatcataccgttcttgcaaatctttgttgcgaactgcaatagccttttttcgagtccactttttaccatcatcaatcattggtaatcccatacgtttctcacgttttttagcctcgcgataagaccaaactaactgtcgccattcactatctcttttgagccgtttaacttctaatgaatgaccgtcattgtccctcaaaacttgagtttctatatctttggctatttccttccaaacacgtcttttgagataaggcaataccgaaaaacgcagaaaccgttctactagcaacaacatggtcatatacaaaaagaaaattaacgcataggttaatgtttgaaagaataatctttctggctgtctttcgtaagcaactaggactgaggcaccaccgattaatagcgcgaagattattatgccgtataaatatagaaccactaagatttgtcgcaaaagcgctgtatcaccaataatcctcactatcttcttcttactattcaatatgattcctcctctaccttcaacttggcactaattgttttcctcatatggaacaagtttaatagatactttgataaattgactttcactaaaattacgggcaacttgtttagcaaatctgtaggccagatctgtccgagtttcaaaatcaaaatgtattgctttggctaagtttgttgtaatagacacttcatctttagtgaaatcatcagcaaaaaaactccaaccaggccaatcaatgccttgatttgttaaataccaaccaggcataacttgtaataccgtcgtttttttactgctaagtatatttttttcatactcttctgctgtcattttttcatctcctaattatttctgcgttaatatttgtaacggcttccaagtatcctgtaacattcattaacctcctgtacttattattttgagatttcaaatccaaaaagcccctttaatcaacactgtaacttgtgctaaccaaagaggcttactactacttgtacttatcaaaatcaaattttagtttgccagcttctaacttcaacttggcactaaatgtttttcccgttttcttactcttaaaacctttgagttgggctgtttcaccagtcttgatcaattgcttgatggcacttattggcaattttttgccactccattgtttgggcaacgtaaacttacagccatttttgtaatttgaacacccataaaacttgccacgatctgaaatctcacccgttttacatattggacaaaccccaacagcggcctgcgcttgctgtttttgttctacctgttgttgggccaccaattgcgtctgtaagtccgcattctgggcaaactgctcgggaacttctttaagcaatttttggattaacaacttaatctggcctaaaaagttttcgggcgtgcgctttttcttaccaatttcttttaaagctagttcccatttagccgtcatcgacggactcgttaacaatggttctaatgccaccgcttggcacagtgtcacaccagtgccactaacatgtaactcatttttattcgtaactaaatagtgccgacgcttcagcgtttctaacacattggcacgcgtagcttcggtgccaattccctcgacagcttttaacaccgccgcttcgtctgcgtccaaagtcttgccggccgttttcatggctgtaattaaggtcccttcggtaaacggcttcggtggggtggtctgtttcgtcggggtggttaagacagcttgtaccgtttgaccaggcgtgaccacgggtagtgtgtctttcccctgctcaactgattctgtcttgaataggcgtcgccaaccaggattgattgggactttgcccactgatttaaacagtgcctgtccgacctgcgttataatggtcgtttctgtatactcataaggccccgcaaacatggctaacgtggtttttaacaccaagtcatagacctggcgttgtaagacgggtaatttagccaattgagttgaattaggcaccactttcgtcataataatcgcggggtgttccgtcactttctgatcattgacatagcgcttttgcggcgtggtctgtggtaaagccattttttcaggcaataactcttggtactgatccaggttcgccgccaaatagtcaaactcttgctgcgtaaggtactcactatcagtgcgcggataagttaaccactttgcttcatataaggcctgcaccgccgctagggtttcactcgcactcgcatgaaaccgttggttaaccgcactttgtagactagatagtgaaaacagccgtggactaggggcctttttgacgatgttttggacatcttttattaaagctgtctgcgggccccgctgaacgcttttagcctgcatgaatatcgttaatcctttttcgtctttaaagcgctgataggggtctaattttgcctcgaatttttgctgattggctaaaatttcagcatttagctccaagtagggctccggtttaaagtttttgatcagttgatctctttgatagaccatatagagcgttggcgtttggacgcggccaatggcgtacacccccgacaacccatgttgccgtaataacaaggtgtacagcggactagcattcatgccaacgagccaatcactgatctgtctggtctgggcttcttggtaattcggataaaattgccacccatctttcaaatcacgaaagcctgtgataatggcttctttttccaaactgtttatccacaaccgttgcatcattttgtgttcgacatcaatttgagcttgtttcatgatcgaccaagcgatattttcaccttcacgaccattatcaccagccacgattatcgtatcggcccgatttaatagcgtcttgaccacctgaaactgcttttgcttgtccgcaataacttcgaattgataggtgcttggaaatattggtaagttggctaaagcccaatctcgatacttcgcatcatatttttctggcgggacgagttcgaccaaatgccccagcgcgtgtgtcaccagcgtatcattgggtaacactggatcactaacctcatagtaacccgactttttctgactcttttggaaggccgccacatatgcccgggcctggctgggtttttctgctaaaattaccgttgtcataatttgcactcctaacattaatttagtcccagcttaccagcttggcggccgtagcattaaactcaccctccagaaatatttgttatgagtaacgatgcttgcattacggcttgcactgtactaaagtaacagtcgtattaatattacttctccaaggtaatcctttttgaacaaagattagtcctatgtactatatagtctactccgaccactcataacccccattatgagtggctttttgttcttagaactaccttttagccactgaaatatttattgcgagtaaccggttgtatattgattgctaaatttaccaatatacgttattttaagagtgccaaagcttctcctgttttggcattgcggtatataacctaatcaattttcatcacatagttccctcggaccgttcgcaatcctcattacgagcggttttttaatttttgtggtagaataaatcatagaaaaaggaagtcctgcttgcacaagacttccagtgtagagccgtttaagacggtgacaaattttagactagatagccgctagctctgccaagctaaggcggttattttttttgctgacttttaatcagctcaacaattaatgcaattaaggctacgataaaggtaccgaaagccagcattaattgcaaagcgtccgaaacggacacttgggctactcctttcctggaatttgggttggcttattaggtttacaccataagcaccacctccaatactggaaatagccaccgccttaacttctctactagcatagtataacataatgcacgctgtaactaccgatactacggtattcacagcgtgcattttagctaatttatccattgtctaattgcttgttcataatgtctatctggctttactcgtggtctacgggacggctaaaatttaaataacaccctagtctaacccagccctaagcaaccatcgctatcgcttccaagtgctcactcaaaaatcacgatgagtgttgttatacagacatttgtagtgacttttgtttttctaatcgattatttcttttgcaatttccaataatgattcatctctaaaatttgtcccatatttttggatcgccgcaataagatcattttctgttatcggtattgttttcctaaatatctcaacatcaacatgttcctgatttttaccgaaaaccaaaaaatcaatactttcttgcatgccatcattaataatttcctgatggtgattgtaaaaaataaaactaagattaatgaatttaccgggcttgttcctaatttgaacatagttatcagttagcggtgaagcttccaaaacaacctgctcacaattagtatgaatggcttgagataagccactctctcgtttaataaactggccaaacaaagggattgctggtgaactttcccccaatatccacggtaaattatttaaagttgcttgccggtaaagccagccttcatcaagcatgtagttttcgagcatttttctcgctaggttccgactaatgcccaaatcagttttctgtctcattattttaatgataatatcaaattctgacctcatcgtggctagcattttattggctaacggactgcccgctggtcgcttgccattagattttttccaattagggttggaaaaggggcaatcttgataatcaatctctgaatacgttgctaaattagcaatactgcccttattatggcgaccgtatggttttctaccagcctcactagtgttcttttgtaggccaacaatttgaattggattatcacatttcgggcagacggcgtaatttgagattcggttgcgttctttttgcacgtatggcgtctttttcaatgtctgctcttcaaaattttttctcgttatctgatacgccggggcaacccccactttcaatttgaattgatccatttcaacgcctcatttcagctcattgcattgcgtatgtctatccaccactgatccgataatggcggaacataaccttccttttcagcgatccataaacagtttatcactaccgacaatggtaacgaaaactcatgctgaccagcttgcatcttaaataataaggcttcacaacaatcttcaccgccagcatggtcttcaacctgccatttaccagctttaattttcggtcgtgcttgatttattttttcttcattcattttataccctcattttatcatttattttagttattgcccgcgttttacagccacttccaaccccaccctggaactagatcaaactcaagccattatataaactatgcaccactaaattaaggcgcaagtcgtgttgccgctggtataagcaagctaagatcaaaccggctccaaaatacagtaaccaacttagactgagccgcatttcatgaacgctcgcaaaagccccggcactaacaatggcttgccagcgttgatggttccccaaaaaccagtgacaaaataagcctcggaacaacaattcctccatcagcggcgcaataatgaccaattgaccgatcaaccagacttgacgccacccgcgcaaactaaacaaccaggcggtcaaagcttgttgattagcggtagtagcctgcccaccacggtgcatactggtcatcataataaggctaagccccaacagactaactaaagcccagccaccattaattagaaccggtcgccaatgatcaatggggcgccaccaggcctgacgactaccataacccaggcctaacgctaaaaccattaacaccagtgtgccagtgccactaccaagtaagaaaatggtggcgcccgcggacttagcttgcagccccgttaagcacaccccggtggcccattgttcaattaggattaatcccaaccagccccctactttgaccactaactgcatctcaccgcccccgttcttgttgggcttgttcaatcgcttgttgctggttaaacaacgcatttttggcctttaaatcttgataatgggtctgttcggctcgccgcaattgctgtttaacctgttgcccttcttgctttaagatttggtgactggcctgttgctgtttgcgttgaaattgctttaaatgtcgcggcttccagtggttggtcttcgcctcaatcgggccccagccagcttttttagtggattgttgatcccgcttgattttggcgctgagccgttcaattttttgataccgctgttgcactacggccggcggtaaagcttccttatagctagccagtgtggctttcaaccgcaataattcctgtttttgtttagtgatggcttgaagctgcgcgcgcatctggcttggcttggttaatttaacacctagttcctcacttaacgcttgttggagttctggtcggagctttgaccagttcaccccactaacgacgctacccccattaagtcgatgttccgcagccaatcgttgttgcatctgggccacccgctcggaagttaattgcgtgatgggcacatttacgacgtccgtgaaatacgctgttaaatcttgtaactgttgccgttctgtgggactttgttcccatggagcttgtagcttcaatttagcgagcgttaatcgttgctgataccggccccttaaaaaggtacaggcctcacgttcggccgcattgagtggcgtcgattcctgtctcagtctcgttaacactcgctgtgcttgttgcaccttggcctgactggctcgagcattttgctgacgcaaggccatgcgccgttgccgcagtttcttagtcttggccggggttgactgtaaccgattcgcttgccgtaaagcatcaatccgttgacggttagcttcaatatcggccgcagtaaagttttttgctaaaccggcaatcgtcagttcttgctcattgtctggtagctcgcgacaagcctcaaataacgcattggtgagtcgctctcttagttcggcttctttatgtgccagcgtccgcccagccgtccgttgaccaaaggcggctgcattgtactgatctagggcctgcaccgtttgctgaaaggcttggaactcgggattgtcttgtaaatattgattgaccagggcactcgcaatttgcttaggctttgccatatcgcgggcattacttcgataccgccaccgctttttatcagccggcagactggcaaaaagggcctgtagctgttgttcaccaacggcctgactcagttgttggcgcagactagctcgttgaacacccagccgcttttctaaatttaatttttgctcccgttcgcggggccgatcaagcgcaatcaacgcttgaaagacctgactcttgattttgcgaatggaaggttgagtgaattttcgccgcgcttctttcgcaacgcgtttaccgtctcgataaccgattctatcgggtcgtggacttaactccgagatacccaagtgtacatgaatatgattcgtattaaattgaatatcaccccaccaaaatcctttttcggctaacccattagctttcaagagtgggcccatactgtgacgcaccgccgctttgatcttctgctgatcacaggcttcagtcttagggtcatacaagtgattgtcaatcaaatattgcgttgaaaatgagataaccccggcccataaaacgcctttattcgcctgggcggtgtctaatttttgccgtaattgatccgtctcggccaccgttaagtgatcggttcgttggtcaaaggtgggcgttaattgttgctgcttgggcttggcaacctcgtcaccttgatctaactcagtcgccgtattgcgcgccgtataatcaataaatttttgataaggcaagcgcgttgccaccccgtctaccggctcaactggttcctcatcagggcgctgactagttggcgctaattcagctaaattgtctcgttccagttgatctaatcgctgttgtactaaattaacatcattgcttaaatctgttgcgttatcacgttctgtgtatttcgtatacccactgtagctcattttattggccaccgtcgcggcggtaaaatattgcaacctaaagacgactgctggttgctggtgctcaattggtttcgacataatgctgtgcataccagtccttccattgtctaaattcagttcgattaatctttaaataattggcattcacttttaataacgcacaaatttctttctcagtaaactcaaagtaagccagtcgcgcggcctgttttaaaatgggtacgcgctcgcttgcgaggacttgatcattagcggcaaattcggtaaacggcactggtcgaatcttaactaagatctgatacagctcacgttcccgagcaattcgcggccagtcttccgcaccaacttgttgtcgatacgtggcatcgtcaacgacaaacttttcttcatcattatcataggcgccaatttccacagcccacttatggtcagccgtatcaaagctcgataattgcgctaacacatttagaaactcgtcggacaaatgccaattttttttgctagcggtcttgaattgattaactaacatgtccgtccctcccacttttagtgttgccgtaattgattggcttgaatatcagtttcaatcaacttttgcacttgttgcatcgccatattgttatccgaaccgggcgtataaattgacccaccctccgtcacaactccggccgtacgattataaatcgacaataacagatacttgatttcggcttcattttgccgatttaaccgcaactgcttatcaattttctggttcattggtgactcctgaacgcgtttcaatagttcagcttcgcgcccataaaatgatttttgccctaaattcgtgtaaagaaacagttgaataaattcgctgatgatgaagttatacattttattttccgtgcgcacgagccgggccaaatcaggattactttcaaagtaagctttaagttcggcaacccgtttttgattataagtatccaaccgtaaattgattttgcggccccgttgcttgttactatcggcaacctggtcattgtaatctagtggattttcgttagccatttcaataatctcccttcaccatggcggtcaataaattcttaatctcggttaattcattggtattcaaattagtaacttcaacaacccgattcatcagggccgtttgttcaattaaatggttcgtaatattcccattaatcaggaaatctaagttgtcctgcgccaccacttcattaataatggtgcgcataaaatcagaaaggttatcataacccgctaacttacccaatcgttttaatttatctttatcaacttgatcaacattgcgaatatagagattcgttttaccagtgttcattggaacaacctcctaaaaaatgatatcgaataaaacttaattgtcacggctagtaaaaagaaactagcagaaaattagcgcttaacaagccaactgcattaaagaagtaaagagcataagggaatctgttgactcgccattaaaaatggccagccaacccgccagtggcggggattccaggtgcggactgcgtttgctcgttttttgacgttttggccaccaaatagccaccacttgaccgccttttgaccaccagataaccaccgtttgaccacttttaaaaacttagtttttgtgcgttatttgggtacttttagtgactttagcgagtttaaaagtgccattttttatcgcggcttgtttctttttaagtaaagcttgttccgctgctaacgtcctaatgcgctgtttagcactcttgatattttgttgattttgttcaatatctccggttaaagtttcaatatcattgtccgtttgggtctgttgactagcgacttcatacttacgattcgttcgcttcgtttggatcttatcgtggtccgcactaatggccgtcttggccagtttgattttgttttgttgccgcttaatgctggtgtttcgcgctgaaatttcatcattaatggtctggctggcaaaggcttttggcgataaagccgaaacctgggcccgtctaattttcgcctgattagtcacaataaagtccgcttgtggcgctgacgagctcgtttgatctgtcttaggcgtggcattaatcaaccggaaccgaatcgcttcaaagttctgatttaaatgatcaaccatcacgacatacttgttttcggtgactggaatcacgaccatttttagtttttgtggcaccactgtcgctaactcaaaatgtaaatattgcgacagaatttccgtggtggggtccgttgacgcctgcacttcaaacgtcgcaatcaggcgttgttgggtcgggctatactggcgttgtactagcttgacaccttgtgcgctgttgtcaccactgaagctctggtaaatgttcaacggcgtatcatcattcttagccgtttggcgatttaacaggccataattaataattaacccactggttaaaaccaggtaaagtccgataataaaaaaccggcgtagccggctatgttcttttaaataccgccacccggtagttagttttttcatcattcaatctcctttgcagggttaatttgcagtcaataaatgtttaattttggttaagttcgttccttgataccgagtgacttgtccgtgatcgtagcggattaaagtgggcgtttgggtgaccttaaattgcgttaagtaccgtcggttttcagccttttgggtattaatattgacaatctgtagcgtctgaccgaaatagtttttgaactcacttcgtaacacttgcggcgctatttggcgacaatcccgacaccccggttggtaaaataacaacaccgccggggtctttttcgctaaccgttgccgcacaacttgcgtgacagtcggcgtttgactgggccgaattaaacgctcgggttgccaataaaaccagctcactataccgaccatcacgaggactaaactaactgataaacctttcaacaaccagtgcttgttagtcatacttgcccctccattagttgttccaatttaaattgggcgactaatttttttaacggtttaacgggccattcaatacggccaacaacggtcggccgccgactagttaacgcatcagtagtcactggcacttgcttaacaatcccaatttgaatcgcatcattactgggacacccaattaatacaacatcattgggcttcaatttaattgactggtttaacgcactatcatattgcaccaccagtggttctgatagccgatctagtttaataagttgaaccgttaaagcaactttcattcctcaattgcccccaatctaacaatccgtaacgggtgagttaagacgcgtaagctttggcgttgaccacccaaataatggccacggttgttttccgtatcaaccaaactaggaaagttggccaacaaccattgttgggctaatcctcgcgtggcaaatacttttccttgaactaaatccccggcagttgtatctaaaataccgtactgactcatcttataaagtcccccgtttcactaattggcaatgcttagctaaggtccaatcattgtggccttttgcattatgcacaatatttacagtcgtgccattttccaaatgttgttcgattagctggcccacttgtggcgcttctgacactttagtgttcccattcgtagcccgcggtttgtatgtcacccaatcccctaaatggatcgttttagccatcattgttcttcactccaaggattttgttcaagtccggcttctaaccgttgcacgttatgcgccatcttatcttttaaccgtaataaggctagaatggcattgtcataggcatcaatcttggtaaagtcactgcgctcgaccacttcacttaaccgatcagccgcgtcaatggcggcctgaaccagttgattaaattgccgatttaactcgttgttggccattaacaacgtttgttggtgcttcaattgttcgattttctcagtcatctgttcatatttttcactggtttccgcgtattgatcgcgttcttccctaagggcttcaatctcgcgatcaccttcggcattaacttcttccagcagctgatttttagtcgctaaaagcttagtctgcttctttagatcttcgtaatcatcaggcactatcggtactggaatttccacttcacgaatcccttcagccttaacccgttgtaatcgagcttcatacttatcttttaaagctgcttgttctgcggcgtgttggtcgtctttagcttttaactgcttttttagttcacgcaattcacgaacagtcatttcatcaggggtcttttcctcacctgactccaagcgatgcaacttttggcgttcttcttcgggcaatgtggcaatttgatatagggcttccactcccaaatgttgcgacatcgcaacatttgattctcctaatccatcaactattttcactgctctatttgcaaaagtcttgtcaacacctactgatttcaaccatttctcatactcaccatgcgctaagtcattttctttaacccacttcaatcggcgaccaatttcaaaaattgactggcctgcaattgactgataactcttaatctccgtcgtaatttgggttaaatccgttgataaagcttggtcactaggtgtctccaccacttgttgggtaatatcttttcgctccatttactggccctccttatttttaaagctcatgtgaaggcaacaaaaaagggaacaactggtttcccagttgttccctcatgtatctactatttcctcagtcagcgccagaataacataactaacaaaaaaatttagtctttaaaccttgcaaccgcaacgctataccgtgacgatgtccaatagtctaaagaaaatcgacccaaaaggcctaccttctgctcattttatgctaaaattagcaccgttgctgctgaaacttagtagtaacataagagagcaagtaggaaacatagacaagttatgcttcttacgtcgaatcatgctaaagcccggactggtaatccaggaccagtgattcccaagctctcttttttgatgcccacacatcaacaaaaattcaaaataggttcttaaattccagctgtaggttgtacacatcgcaaacaagaacatatgttcttgtttgcgactttaatttatcacttctttaataagacgtcaatactaatactcatttatcaataccagcaatcttgataccagattcattttcagaatcaaaggttactatcccttgatttttggtaatccgctgtcctaacagtgttttaactttattagtcgtaacagcaatctgttctgaaacaatataccctatgaatttatgatcactaattaaatcagactgaatcggcttaattaggtcataacgtacagttccaccattaaattgtttactagtaaatgttatgctctcctttaaaattttctttttatttttagtcttttggtagattgttttatttctttctagtccttaatccgtcttgctgattaaactatcaatggccgtaacctgctgcttagcaccgtcataggtgacttcataaacacttgtcccggcgttccaagttttagcattagcgtatttgctcttatacttcgcaacaactaagacctttaactgggcgccactaactgcttggcggtaaacccgtaattgcgttagttttgaggtgacttggctcccatcaccatataattggcgcttgccaccaaaatactgttggtttagcttgggcgctaaccagtgcttaactttcgcttgccgctgttggtaagtgtcttgattatagttatataaaccattgaacaccgtcgtaatatttgcgaccatggttgcgttactagtttgaatcgtctgattatcggcactattatttttgagctgctcttgggccttaaccgccgcctgttcagcttggttggccgccacgacggtgccttttaagtgggcctgcgtctttaataaggcagccttttggcgcttaatctgactaatttcagtggtcttagcttgcacctgtcggtactcatgaccaccccaaattaatgcgccagccgcaactaagccgaaaaatacgatgataactgttttgcgttccatatcctaactcctttacttcgctttgatcgcccgggcaaacgtggtctcgcccgataagagactactaaacgccgtcccaaactgcgcaatattaatgcttttaccagtacccccagattcgataatacgggtctgattgccatgccagtcttccgttagaatggccgtatggccgttattaccactaccttcaccctggttcacaatcacaatatcgtccgctttcgcttcatttttatcaatggctttcaaataatggtgcggcccagtggcatcgctcgccatcgtgccagtaaaccagcccatattagcgggcactttataaccggctttatttagcacgagccacacaaatcctgaacagtcggtaccaccggatttattaggattctttaagtctttccccaagtctgaactcgggtgtgtctggacataatagaaataccctaaccaacccttggctgttttgagaatatcaccatcattctcactagtcgcgtcacaactactcccagttgtgtcatcactagcggtcgctaacccatcactcgtgcccggatcagtatcacctaatttggccagccaatgatccgctaatggataccgccctggttgccctgacggtcccttctccaagaaccactgctcgggattattgcgcataccctcatattccatcaaccaatcatacgcggcttggtgcgcgctggtttccttaaaaatatgtttcgcaccttgatagctatgcgccatctcgtagaccataaaattcaattgggcatctaaggagttccattttttattatttttagccgcaaagctcatgaggttatcgtagcgattactcatccactgggcgaggcccgtagccccagaaccgcccgtattcttaacgctcggatttaattgtgactcaaactgccaaacacccaaaatgccggctgcggcttgtggggtcgctttaacatctttgttcgtccgtaagaactgataaatcgtcttagcattcttattcatatcagcgctggtcaccacattactgctagtctcagtggtcaccgcacaatcattgtcatcatcactactggcaataaatgtaatgagtagtaacagacagctgatcaagaggagtggcacgcctaaacctagactggccataataactttcttttgcatttatccgagccaccacctcataatgataatcaccacgaccaatgagaaaattaactcaatcggcaggattaatttgtcctgaatttgcagcgggttttgggtttgacttaaccgtttcagttccgcaatccgttcttgccgggcctgttgccgtaacgccttgcgttgcgcccgagttggcttgtctgacttgggttgccttttcatatttagcccaccccgccatcataacgatctagcatggctggtgaagcctgcaccgtaaagacatagttgccattgccttcaatgtgcataaaacattcatgctcacctaactgggccaccgtggccagttcttccggtgtgattgctttaccaaaagcttgttgtaaccggggtaaattatcagcggtcaaccgaaagaaaatgggataagtaaataacccaaacatctttttcatcgccgtatcatacttttgataccgctcactcggtacgatacttttgctatcacccaacatttccttgatcgttggcatcactagattcaacccacagaagttcttgcgcatttcttccatcaggttcgttaaccaggccacgccttccgcaaactcgggcttggcgtaattctgaaattcatcaatgttcaaccagtagtaaggcacatcttctaacgccactgcgtggttgttatacaaggtgcgatattttttcccattattgatgatgtcagccgataataaactcaaagctgaatagacttgcgcgttaaaggtcgctgaaccattatttttcaaacctgaacaatcaaagaccaccgctttaatcttagaaaaatctggaattgtggtaataccattgaaaatgtcaccgtctttcgtcatcatattttcaaacgtattaacgatgcgattaatcgacgtaatctcaacgtccggccgcctcgtaatttgatagttgtcttgtacttgccgtaaatagaccacaaactcccctaaagtcgggtattgatcatggggtaacccaatcgcgtacaacttatcccggttttccgatgggttggccacccacatcttttgcatgatataaaactcagtcgttaagttctgtaaccgaatccggtcatcgttggtcaagtccaggttttgtaagcaagccatactactgatcttttcgatatggtgattaaacgagccaatttcatcaatcgcttggccgtctttcgtcgtggccgttggaaaaatctcaaacgggttaatccgattctcactcccgtctagtgagatcacgaatcctccttgggagcgacattgcttggcatactcgttggcaacatcaaaagtccgggtaaagcccccgcgggcaaaggcgatgtcattcaacattttagctaacacggatttaccagaaccagggcgtcccgcttccatgaaaaacgacgttaagcggttttgcccgacataaaagggatcaagcatgattttgccctgggtcttcgaacaacccaagtacaccccgtggggatcatcaagttcgatatgattgaacggaaagccatggccgatgacacttgcggctactggtgtgccttgccggtgattatccaataagctttgcttctcggcgggcacatataagcttctaaactccgcttcttgttcgccatagaacacccgcaccccaaagtcatcaggcatatcttcggtaatcttagtcaaccgctgacgcaattgggcttcattatcggcatagacaaagacgcgaatacttaaccgtttcatcttttcagcgtgtaataaatcccgtaacagcgcggcttgtttctgattggcctcatcggcttccatacgtgcaatcggctttgcatttaaatcgcgagcctgtgagttagtttccgccactgagttttgtaaagctttgcgaatctttcgttgatcctcagtacctaaactaatcgacgtcaccgtaaaatcatatttcataaatttgcgtaaccaaaaataggctaagcgttcctttggaaacttaaaaacgtgcaagcacgccacacaactgccgccaaagacgaggtgactatctaaagtcgtatcaacatttccctgcggctgggtatgcgctaacagtgccaaatcatagcccgcggcttgtaattgtttaactctacgtctagttaacatggcctccaggcctcctttatattttcttgtcgttcatattattgagactgtataaaaacttaatttttcgatccaagcctaacggttcaaaccgcaaataatggccttgtcgttgaaacaacgtcgccactcgttcggtcaactccgctggggtgtccccaaaaatcaaggctaagtattcttggcttttcaaggttttctcaaccgccgtcgcaatttgtaagctttcattgatataccgtaaccgcgtcgttaacatttgccgttgttgatcgtcatgacaattgactagggcttgttcaacttttaaataatcatggttcaaactcagctgttgttgcgcggtggtcgctggaaattgggtcgcaataaagctccaatcaggatcataacgttgtaaaaattcggtaaactcttgtgtcggttgacttaacatattatctggcagtgccgttagtcctaccccgggaatccggcaaatttcggcgtagccccaatcatgcgccaaaactaaatagtggtggtcatcattggtaaagcctttgtaaccaagcagttgttccacactgcgccattttttaaattgtttactcggtttcgcttgggcttgttcaacttggcgagcctgtcctagcggggtaaccggtttaaccgcgctgttgcttgttttgtgcatcttgctttaaccctccaatcgttaataaagcactgagtgaatcaaactcgtaatatgaatagctgtggtagtagtgaccacccattagcagatcattaatcactaactggtaatttttcttacctgggttgtgatacggtatgatgactaaccaaaccgcaaaaaccagattaattccttgaaacagccaattaatcccagctcgactgtctggaaacactaagttagcgataatcatcgccaccccacaccaaacgagcactaagacaatatcggcgacgtaaaacaagaagaccttcatacgggccttcacgtccggcgtcaccccgacattgggcatattattctgattcatcaacctgtctcctttctttgaatagccttagcttacctagtgctttgatcatgggtgcactactaccttgacgacccaaataagcgcacaaaaaagcgcgcccccggtaagggacgcgctaaccaagaccgtgatggtactcaccatcactagcctagttgaatacaggttgatttgtttgcgaggtaggttacctaccaccattaatagctggtaagccattaacaattgttataatacgtccttcctctaataattgcaaccctagtaaatcgagtcatcaatcttaatttcgggtaagttaaccatactttgcttatccccaccctgttcacgggcaacagtcgttaacactgtaccagccttggttaaggtcttacccgctgaacgcttgggcccactggccattaccggttgcctacctgatgctgactttacctcgtgcgagctttgcggctgtgtagtggtacggtcaactggagcggcatcattcaccgacctgggttgatgatcaaccggccattcaggttgatcatcaacgggacgctcaaagacctctcgctcatcctcctcatagtccgaaatgacaccttccggaataacgcctttgtttgcttgatcaccatgtgctggtcgtgacattggctcgctagcaccatcttcacgggttaagccttctggacgatccgctgaattaacctctgccccaactgtcggtgcaccctgatcaaattgttgatcatcattgctaggaacagtcccctctacagttgggtttggtatggttccctcaagactagcctcagtctctttagcagttgccgtaccagccttatcggttggggcttcctcagttttcggatcaggtaaggtcccgttaacattggtgtcggttgctttagctggcccttgattagttcctttgtcagtagtgacaccagctgtcggatctggcaaagttccctccggactagcctcagtttctttagcagttgccgtaccagcctcatcggttggggcttcctcagttgtcggatcaggtaagttaccattagcattggcgccgattgctttcgctggtttttgattaatgtttttgtcagtcgtgacaccagctgtcggatctggcaatttctcatctgaatccttatctggttcctgatcaggctttacagttgggtcagacatcggtgtcactgtcttatcagcaccatcacctgttgcggtcttggtgctatcagggtcagcttgagaagacggatcggcctttacggatttaccagcctcggcactcgtctccgtttcttcgttggttggttgctgattgctttttggttgatcaccctgatcggcgcgatccattgttggctgaccagtggttggattcgtctgttgctggtctttagcttgtgtcgctttagttggatcaggcagagcggaagcctcaccagtcaaaccatcaaccattttctgataagaccctttcatgccttcccgggccatgctaattcccttaactccagccttaagtcctttaccagccgcagttagacccagtccgagacccatcagagcacctaatgcggtgccatttttggactgaggtacccccgtccaacgttcaatcagactaactccggacataaacgccacaaaacaagacagatacataagtactaagaaaaaaccaatcggcaacgccgaatttggatattgttttagaaaagccacgcccggattatcggctgaccccagataatctaaggcaattagaaacagccgtaagccaatcatttcagcgaatatcccgataaacgagccttggattgcttgcatgacttcttttaaccgttgattggtacgtaaatcttgaaaccccatcagcggcgctgaggcattgagcatcaaaatttcaaaccaagatttgccaactcgaaaagcaattaacccaaacatacaagcaagcaataagagttgtaaatcggcgataacgaaatggccagtataacgtggataaaccgactcaaaagccttggttaactgactttgcttacttggcaaggtggcgtcctcaaccgtatattgattcgtttccgcccccatttttacccgatgcttaaagacattatcaacacccttaggaatcgcattcgttttcaaattatccgacgcaataacttctgaaaggtccaaataaccaatgttgtccgcattaatcccgttatatttggccattttaccatctaatttcgccggattaacgtcaaacccttttttggctagggctactgaatcgacaatattattctgaaccggttggaccgcaatgctggttacaccactgccattattaccaacaatatcttgggcaccggccgtcacgaattgactaaacaagttagtcccaaacggcaacattactaagattgcaatcaccaccaccaagttcgtaatcacttcatgtagtttcgtcttagcccgaaaaatattctcaaccagcaagtaacctaacccaacagttaaaagcgcaaatcctaataatacgatggtcttataaagggtccccatctcaccaacattaaaattagcaaaaaagccaaacagttttaaaatcgccatgaacacactctctaaagcctgagccgtgtgatacaggcctaataagatccactcattgaccgtcccaataatcttctgaaccgctaaaatatccgtgtgcaagacagcatgccatgatagataaaacttaacaactccatcaccctgctctcctaaagaactgccgccccaattaagaatcttatctcctaattggttattattaagcaatgcttcgggcacttgataaccggacgctagtaccactaaccactgaaaaaacgttgtcataaccaaacccctctcactttcgatttacagttagcttaactactgctcatcaaaagcgagcaacactactcaccagccttaactagtattggccgaatattcccggcttaaaacccgcctaggcggagtagcttaaatcgcgatcatgcgtctcacgtgaggagctagttctaaacggtttggaggcgacgggacgactaataactaaacaacaccctagtctagcccagctaacgcccagcatacctatccagtccccaaccaagaaaaccttgtacagaactatagatacgtaatggcattttagaacactaaattttaacccgtatctagcaagctcaattgggcattgcggtaatgatcttggcgatcatcaagactcaattgttgtagtgccactagttcttctgaaggttctaataaccgagccaccgttagccaatagtttaatcgctgttggcgttgtaacctcatcgcatgttgtaacaaactactacgagtcgcaaacttcgttgcttgccgaccactgcctttttcacgataaactaagccttgatcaattagatctttcagggccttggttagactacctaagcaaatagttaattcttgggaaatgtgccgtaaagacgttttggtaaaccagttattgtcctgagaaatggttttgttaaaataggccaacaaatcagcttgccattcatgaacgtgactgttaacgcgttctgaacgcggcttcgcatacttgtaccaggtcgtttgcgaacgctgcaaataaacccgcctgtcagcatcgggaacccaagtttctagtagggcattcacatattcgcggctagctgcatggaactgacctgaataagcatcgcgaatgactttttgaacatgctgtgtcaccagcgggtgggtaagattgctgttaaattcgtccaaaatatcaaagcattgggcttgtgacacgtttgaggaataacaagctaaggccagcgtcaagattgtattatgccgaccatagcccacgttttgatcaatgtccgtttggttaattaaggcttgaaaccacggttggtcaatctggcggctagtccgccgagccttaaaagaccattgagtagtttgggacttaatttggtgctggtcattcgcaaaattaatactccaagtcattaaagcttggaagtcaaccgtcattttaggctcaaagtattcaatattgtccggccgcggaaccctgaaaacaccaaagctgttgcaagtcacatcaaccgccggcaacttttgcgcgtagtattgctttaatgacttagcaatcgctttagccgcacgtactgccggcaattttccattagcatgacgacggacgaacactggctcatcaaagacataatagatatgatagcccttggtagtcgccaaaattaaggttgggagaaactgtacgtctaacatcgccgtgtcccaaacctcggcaaacttcgcgtgcctttcctcagcattgtggtaatcaacatcaaccactaacgtgttgatctgacttaaattttgttccttagcgccttttacataatgcttagccgcatctgtataggtgaggtagttaaaaacattgggcgtccaatgcgtgctggtcgcatagttatcatagactgcttctttggaggtataaatcgtcccccaactttttgccatttgggctttactgcgatacatggcaatcgcaccttgcttatttttttgttccggaaccgatttttctaacttcaagacgttactatgccgggctttagtttcccgtaacccttgatgcaaaatcaaatcaatcgcttgttgtgctgttttcatcgctgacatactgctcaccccccctactaaaaaagaacgccgtagcgttcttagtcattatttttatgtattaaaattaaacgttcatacactagatttttaagcaatcgctccagttaacgtggctacttggtatttaaaccccaacttggctcttagggcggtcaaattcatcaaactgcattcttgccaaacgtaactggcacgagtacaattaactcattcgttgatagttctatgagttcccgtggcttagaccccacggggatttttttgtttatttaatttttaattgggattagcttaacaggtttcaacaaacatggagcacttctccctttagacttaatcaaacaaaaagcagattaagccgcccactggggtaacttaatctgctttaactaaacctatgtatgcgtttaactcgacttttcgactggcataatcctaataggtttagtataatattcctatcaggcaactagagttgactacttttagtagttcatatcctagctagccatctataaagacgagcgttaaaggcgatcaagtatcctggtacttggtttgctgatcagagagttactggaaataactccttgatcgacgctcttttttgttaacctaaatataacatagttacaaattaaagcaaccttaatacaaaagaaatatcactgtttttgtaacaagttacttgtaacatgttacaagtaacttgttacaaaaatatgtttacaaaatcgcctttttgtattatatttaggttattgaaagaggtggcttcatgactaaagtaataacaatcggtaatttcaagggtggggttggaaaaactacaactagttgtcttttttcctatttattagctgaaactaaaagaaaagtattattagtagattttgatcctcaaggtaacgctagtgaaattatgaagaaaacatacccaaagatcattagcaaacccaaaaatgaatttatgaatggactaaaattatttgacctgtctcagtctgtgacaaaatttactgactactttgatatgttagtcagtgattggtcactatccgcattcccagatatgctagaagagtatagaaaagatgagcgtaaataccttcttgataaacttctaagtaatataaagaatgattatgactttgttttaatcgatataccaccaactttatcaaactttgtcaataacgctgttttagcttcggattacattataggtgtactgcaaacacaggaacaagcatattctagtacattaaaatttattagctatcttcaagacttgaccgagtacgaatcacacttcgatttacttggcataattcaatatcttgtgaagatagacggtcgcgttgatcaagaaattatcaaagacgcttcagaatcacttggcccagcattgttccatgaaaatatctatcaaagagaacgcgttaaaagatttggtagaagtggtattaaaaataatgacctttgggacaagcgagtactgcacatgtacaaagtagttttagatgaagcattgacacgaatggagaaataaaaatgcctgaaaagaaaagtcttctcaatcagattcatgcaaaagaaaggctggaaagtaaaacaagcccatttgctaaagaagaaaaaacaaaacctcttagagtcaaagagagcaagtatgaactcataaatgaagttgcgtataaacagaaaaaaactaaagtagatgtattggacactattctagaagctgggataagtgctttagggcttagtaacaagtaacaagttacttgttacttgttacttgttacttgttacttgttacttgttacttgttacttgttacttgttacttgttacttgttacttgttacttgttacttgttacttgttacttgttaaaaaaagtcactttaaaaagtggcttttttttacacccataattaatattcacagtactaaagtagtatggtactttagtatctttggcgtttaatctcaatgtgtttccctaaaactccaactcaatcatggactcttccataccgtcaaggacctcattttctttgataaatttaactcacttctctgctggagtaaatcgattagctttcacttgagtatgcagttttccatacaagttctcgacgacctgcccatacattttatgtatttattatatcgctttcgtgaacatatgttccccattgtggtaaaataaacgtaaattattgagaaggtgagcttatgttttttgatcaagaaccgcatggcgtgttctttttaattgataacaagtccttttatagcagctgtgaagccgttgcccgtggtcttaatcctttaaaagtcccactagtcgttcttagtgaagctgaaaacaccaatggtgggctcatcttagccacttcacccgaggctaagcagttatttcatcttaaagccaatgtctcacgcaaacgtgacttgcccaatgaccctagactctgggtcgtgccgccgcgcatgaatctctatattcaacgcaatttgcaaattaattatatttttcatcaatttgcgagtgaaaaagaggtttggccctattcaattgatgaaagtattttggatatgacccattcatggcggctttttggcaattctatccgtgaagtggcgcggttaattcaaaaaacgatccgccaacagctcggtttatacaccactgtgggtattggcgacaatccggtgcaagccaaactagccctagataactacgctaaacacaatcatgaattgattggtgaaatccattatgaaactgtgccggataagatttggtcaattaacgaattaacggacgtttggggcattggcccccgtatggcgaaacgtttgaaccgccttcaaattcacaatatgtatgagttagctcatactaacccttatttactccaacagaacctcggggtgattgggagccaattgtttgccacggcctggggcgttgaccggacccggttaactgaaccaatcaaaactaaggaagctagtcttggtaactcacaagttctcccgcgtgactacttgacacaaaatgagattgaaacggtcattaaagagattggtgaacaagttgcggcgcggcttcgtcaccaccataaactagcagggtgtttatcactaagcattggtttttcttatgctgcggctgaaaccgatggccgcagtggctttcaccaggctttgaaaattgaaccgactaatgataaccaagctttaacgcaacaattattgtggttatttcataagaactgggacggccaagctgtccgtaatattggcgtttatagtagtaagcttagtcctgacaccgggcagcaacttaatttattcgaatccccgcttaaccaaattcagcatagtaagctaaaccaagttattgatgaaattcaccgacgctttggcttcaccaaactcgtctatgccaccagtctattgcccggtggtaccgctattgaacgggctgctttggtcggggggcataatggaggaaatagttatgaataaagatttagatgttatcacgagccgcttggccttgttgtttaaaccgactagtcggacccgttattggctagtaattgccaatgacccatacgatcaaacttacaacgtgttcttcaatagtcagcgagctaatgaacgattaaggtcaatgcctttacacaaactcgctaattataatctcaatgacttagaaaacttactaaaggcgttgcggcaacagactaaattaacgattgaatttattggctttactggtcaggtttggccgcaaagtcaaaaaattattcaaaagaggcggcaggggcttgaatgaaaaggagtttgacctcggcattgttaagcgcttctttgagcacgattaccatgatcgtggcctaatgaaatggcaaggcttttacttatctgatcatactgccgctttaaaccaacagaagatccaagataaacaacaatatccacccaagccacaacagtctttaagtatcgttggtcaaatcttgtcaacagcttacacccagaaccaaccagtcaacttacaattaaacaccgttgatcataataatcaacactttgcgaccatcacaactccaatactgggctataatgcgactactattgtgcttgccaaccaccaatttatcaatattaatgatattcagcacatcgaattagtgcgctcaactaactggactggcaatcaataaagaccaccaaggcgctaatgacgaaccttggtggtctttttataaatgttgacgcataacaactaatgattgccgtttatcagactggtcactaatgaagcaaaaacaaacatatataggacaaagataactatggcgacaatgaattgtactaatcccgctcggttccaagtcgcttggacagccttgaatgtctcgacatcttgataatcacctttttgccaggcccattcattccccttaaaaccaaccacaaaaacccaaacgatattaaaaattggaattaacgttaataacggcaaataggttttattgccaatgccccaaaaaatactgtacataaatgcgccccaattccaccctttgaccgcttgtggcacttctttaccattttatttcatcattacgttcccccttaatattagcttaccaaacctaagctggcttgtatactaacctagtatacattatcgtgatattgtattacgttgagcagctttaactgggcctagattcaagccccgacgtcttgcttcatgattagccaaccgcaagctattattcaccttagcaatttgttcaggatttaccgtcttttgtagccgatttaggccattaacttgttgttttaaaccgtcgtttgtgagatgctcattcacaaaccgctgcgtcttatcagtaagtttcgttgctaacttcggtccaactacgttttcaatcgttatttcattttcgttcaaagatctggtcaatagatctttcaggtcgtctttctcaacataatcttctgcgccaccttcgtaaaaggtatcaccctctttcgtccgataggctgaatattcatgtcccacttcatcatagtcgtagaattgagcaaactcagccttagacgcaatctctttaacgaaaggggcctgactaggcttaattttttctatcactgttggtgtctcaatcaacccttcgttcatttcctgtaaactactaactggctgatatttttcttccgtcttatcctttttttgctggacaatctgttcactcgcagccaagcccatttcgggttgccactccttaaattcaggaacaaccgcttgttttaactcttcattctgtggccgccccatacgctgctcacgccgcaagtcctgcatcagctcatcactaatttcaatcgttttattactaacttgtttaatctcactgagtgcttgatgaatcaccgtttgatctttagcccaagttgccacataccctaatgagtaatcacccgtatcaataccgatattttgcatggccacataagccacggcctccgcctgtgcttcctgatagccgcgcggtcgatctttaaaggctgatgttagtccatgtaattgactatgggcatattcatgatacaacgtctttagtcgcataccttgatccaactcctgactatcaatcacaatttcattggtttggggggcaaagtaaccccgagcttgattttcagtcattggtcgctccgttacagttaaattcgtcgtttcgttaaggtaggtcttaaaggcttgataaagtggcgtcacattcgcgtgttctcctagctctggtttgataaaatcttgcgtttgcggtatctgcttaccggtagtgtgccgcacatcaaagaccggtaaataccgataacccacgatggcctggtcacgtttagttcctaactgcctttgttgttctggtgtcaaccgtttggtaatgggcgccgcaatccgaatggctttagcgcctttagtcacctgacggctaaaatctttttgccattgtttaaaacccgccacttgggttgcctggggatcttgggcataaatcaaattaatattgcgtaagctatagtggtggaacttggccatcgtttttaaataggccttaaagttcgtgctagtggttagtgcttggagttttatttcagcctgatgaacgagctgttgcttccaagcctgaatttcaactcgacttttgtttgccatttacaacgcctcctgatctggaaattccgtttgcccatcaagccggactaagtcatcgccgataccatataacggcacaaaagtccccgttgtgcttttgatccaagcaacttgtcgatattgcccttgactaccaacttcgtctaaatatttcagatcggctttcgtcgccaatactggtaactcactaccggcaactgccgttttatcaatcatcattttagtcagctccttatcgttgatagcactagcctaacaactccggtgaagcagcgatgacttctaccaacaccaaaaaggatcactaacctaccggtcagtgatcttactgattaatgattacggctagctcacccttttacgaatacatttttcgtatagctttaaatgggccaatacatagctagcgactgcatcaactgccaaatccctaatttcaacatatgctgatgactgatagtcaacacaagccattaactgtttttgcaaggcgccccaatccttctcttgcgtcaattgctgtctaagttcttcgctagctgtcgtcgctggctcagttatcacttgtgctgaacgagttggggcttcattagccaactgaatcatttgatttagctcactgtcattttcatcactagcatagtcatattgcagggattttagcataagtcgtttatgtggtgtattaacattaatatcataaattgttgccttgttatctaaagtttgatttaaaaactgccaacttgccggcattctagtcttgccggtatcgaatatcggattagcccgaatgatacgtcccctttggtccgtccttgcagtcgaacgaactacaaccatttctccagttcttagtcgtaataattcttccatcgatataactggcaccgcatctaaattactattgaggccattcaattcagccacattaccttgtaactggtgccccataacattgacagtcgtgtggcccacttcatcactaatctcctgagccgtttccttatccttggaaaggatatacaaggtattcccacaattgctaataattgtctcagcttcttctttcgtataattgattctgagttgggctttgttttgtaaaacccaatcgaataacaactctgatcctaaaccaattgaaaattttgttggtagatcttgaattttaggtaaattcccaccctcatcgattataaaatgaactcttgtataacactttttttcattatctaaggccatttgatacatctggttaaaactttggtcaatagcgaaagacacgagttggttataagaaggattgtgtggcggtgttcctagaaagagagccactggttgttcagaatagtcgaatgtaatttgttgttcctcatcgtttagtattactgattgaaggggttctaaggttacctttccagcttctttgaaccctttatctaaaggtgaacgtttgtgggtcttgatagtaccttgataacagtagtgatactttctgagctcagggtcagttagatcatgattgaaatctattttgattcgatatttgcgaggcaattttgctttgattggaaaatcgagaaatcccagcctatcaatcatttgagagcgttgttcaatctcgttacccttatcgtcataaaatataacataaaccgtttgcagtgacaattgctgaccaaatcccactctaagcctacgtggaaaggccatagtacgaaagtctaatgaattcatggaagtcagctgagcaatatcacgttgttgataaatcttaatgccctccatcattgaagcgtaaatattgccggccgtttcgtcacctgcaaaatttgattgctgaaaagcttctaatgccatctcttgcaactgtgttttattttttatttgagccatctttttgaagtaatacgataacctggtcgttaacaaaccagcatcgtcctgaatctcttgcccacctaattccgtcagctcccgataaatattattcatcgtgacgcggttccacgagttatggcgaacagccatatccaactgactaagaattagagcatttaacaagtttactgaagaattattccaaaatttactattcccaccatcatcattactctgatagatagctgaagagatgcggttagcttctcgttgggcttcatcataataccctcttctagcgtaatctaccacaacttgcagtgggttataagacatcgatttggccatattttgcaaatttagtacatatacccgatagccgcgtctttctagcattctcttcgacttagtgaataattccagcttgggatcattaacttccattgaggcttgcttctctgcccgagaaagaatatcaattaagggttccacttccgttacgcctttccccgatcgcgtgatcccataaatcaagctgttaaccgtcgtttgatcaatcccatatgtgccagacggcaatagggtgaatctttcagctaatcttttctttgtcttttggaaaagaggactatagcttgcactttgaatcagtgaaccaactggtcgattgtaatgaaccaacggtattccaccatatccagggaagctcttatttctatcgggtattagctcatattctttcttcaattgatcaggagaactaaaggtttcagcgcccttttcaaagccgttatagctttgataagaccgaataatctgataccagcttaaacttaacgcgataacgcctaacaaaagtccccaaattaaccaaggattattcaactgattaccaggccaggctttcgtccaatccaacactcgcgaccaagttaagcctaagtgcgtggggtcttgaaaggcttgaccatgttgaatcaatcccttgaaccacaatttcagactttgtaacagcaaataaatcaaccacgtcgcataactaaagaacgcgagggttatcgctgaaactaatcctaagaatccaaccactgccttgatattacgcgcccaccatggcgcattattttgtcgtcgccgatttaaaccgtgaccaatacttttgatgcccataactctaccgcctttcactgcgtttcagttggtggccattgattttagggtgcgtttagtagcccgctaaccgcaccctaaaaccaacggtaacgtttcaacacccccttagcatacttgctgcgcctgccaaccgcgcaaagtgcccataaaaaaagtgtccttccaaagaagcacaccacttaataactattctggatcaattgtttaaactcagcctcaccaatgattttaatttcatgggtcaaggcccaagttaatttatgcgtcgttgggggttcaaacaatcctttgtcaattaccccaaccaccaataacgtcacagccgatgaacagtagttcagcacgcgaccgccagcagtaagcactaattgttgcgcctcacttcgtgtataacctgttaaggtacccgtaaataaaacaatttcattactgaaagccaaaagttgcagccctgttcgcttcatttcaacctccttaccagaattatacttgctctgtttaaaaaaacactttagccttaaattgtcaacgccgatgtgaaaatgtcgttttttgccgattaaaaaatgctgttttttaccgataaagtttacagtgtctcactgctcctttctttattttgtgcgttgaaacctgataaatcaggt
